United States Patent 10,240,205 (METHODS FOR ASSESSING RISK OF DEVELOPING A VIRAL DISEASE USING A GENETIC TEST) - sequence listing, part 15

SEQ ID NO: 1568 - DNA, 48473 bp, Homo sapiens
gtgctctgagtttttggtttctgtttcaccttgtgtctgagctggtctgaaggctggttgttcagactgagcttcctgcctgcctgtaccccgccaacagcttcagaagaaggtgactggtggctgcctgaggaataccagtgggcaagagaattagcatttctggagcatctgctgtctgtgagattaagcactatgtatattgctttattcactccccacagcaaccttaccaagcagttcttttccacgtgaaaagatggaggctgggtggagcaaaaggaggtatttagagtcctcagcaagtgagaggcagagctgggatttgaatccagatctgcctgatactgaagtctaggctggttccacctctccggactgctttccagggagtagaagacagatattttaccttagctggctgcttctagaagtctgaccctgctggctcaaaacgactttagttccttgcccagaggctgcgggctgcgggtcaagacatcagtagaaggagggcccagccagagaggctgacatgggcttctactcaccgtcatctctccttccttccaggagcagcccctgggtgcgtccactttctgggcacgtgaggttgggccttggccgcctgagcccttgagttggtcacttgaaccttgggaatattgaggtaagcctgggatttccagaggaggtttgggggaaagagaagtggtgaacgctattactgttccctatctagacaccagtgggccgagtggagcagatgccagttgggaccttcccgccctctctttggttattaatccattattgttccctgtacactggtatgagtggatgggggaagtatttagccaagtttttgagacctgtactcggagctaaaatgcattgtcttcctatagtgcgggaccccacaactgtggaggagccgcaggggatactgggtagtacgcagacattatgcactaaatgacaatggctcacatagtgaaaagttattcttttttatttttttttttgagagggagtcttgctctgtcgcctagcctggagtgcagtggcgcgatctcagctcactgatatctccgcctcccgggttcaggtgattctcgtgtctcagcctcctgagtagctgggattacaggcacctgcttccatgcctggctaatttttttttttgtatttttagtagagatgggggggtctcaccatgttggccaggctggtctcaaacttctggccccaagtgatctacccaccttggcctcccaaagtgctgggattacaggcctgagccactgcacccggctgatttcacatttttagataatatgaccacattataaaaatttatgtatttttatataatgtgaccactagatgaaagcaatatacttaggcttttatttcttggttaagttcctacttattatgaatttactctgcatgccaggaattctaagaatttgcatgtattaactcatttgattctcgtaataaccttcacatgcaggagtcactattacagtgactgtatgaatgaggaaagaaaggcactaacagaattgattttatgttacttaggtcaagattttatgttatttaggtcaaggttaattgtgttgttcaaatcttgtataactctactgcttgtctgtctttcttacccattatcgagaagggaacataaaaatcttacactatgactgtagattgtcaatttctcattttaaattaggatcatttttcctttatgtctgccttatgtgatattagtataatgatatcagttggtacatctttttccatccttatactttcagtgtttcggtgttcttatacttgaaatgtgtctgccgtaagtggtgtattgttcaagtttttcttttattatagaaaaatgtattctggaaggtacttttcttaaaattacagtatttagtccattttcatttaatgtaattgtcaatataattgggctaaaatctactatatttccagttgttttttattcgtggcatcaattcacttttctctactttcttgatttcttttagacgaattaagtaattttagaaagttcaccttactcctttattagcttgttaattatgcatgcttttagtattctcttagtaattgcacttgagttgtactacctaatagtacagccacatgttgtttaaaacagctttactgagatatgattgatatacaacaaatggcatataaagtatataatttgataagttttgacatatgtatgacatatatgacagtcatatagacacactcatatatatattcatgtgccatttcagtcaatgaccgaccacatatatgatggtggtctcataagattataatacggtatttttactgtaccatttctatgtttagatatatttagatatgcaaatacttaccattgtgttacaattgcctacaatattcaatacagtaacatgctttgtaggtctgcatcttaggagtaatagtctagaccatatagcctaggtgtgtagtaggctataccatctaggttttgcataagtacattctatgatgttggcataatgacgaaatcactgacgatgcttttcttggaacttatgcctgtcattaagtgacgtatgactgtatatatttgagtggaactatcactgcagtcaggatagtgaacatatatattacctccaaaatatttcgtatgccctcttgaatcctgtcctcctgcccctccccacccctgctccttttaggcatttagttctgtaaattttctcctagccttgctttagcggcatcccatgcattttgatattttgttttgattttaatttaattcaatactacataatttccttttgatttcttttttgacccatggattatttagagttgtgttatttcatttccaaatatttggggattttccagacatgtttctgttgtccaggccaataacaaattcctgacgccatgaagtcaaagatctaactccccagggggagagttatgcccaagaaccatcggtattttgtgttagtggtcattgccagagtgaattccacagtgtttgtgataaaccctaataattccaccagagggcagcaagccaacatgaaaattctattaaaaagtctttttttagagacaagagtttggctctgccgcccaggctggagtgcagtggtgtgacctcggcttaccgaaccctggccccaccgcagactcaacctcccaggctcaagtgattctcccacttcagctccccatctgcgagtagctggaatataggtgcgcaccaccgcacctagttaatttttgcattttttgtagagatggagtttcatcatgtttcccaggcttgtcttgaactcctgggctcaagctatccatctgcctcggctgcccaaagtgccgagatgacaggcgtgggccactgtgcctggccagacagaagttttcaagtaaagaataaatttagctgaagagcagtgtcaaattatttctatccccaccctcctgaattaaatcttcgtagtctctgattctctttgtcatattcttaaccatttggattcttttcagtgcgtctgtgtttgttccttttccccagtatgacccctttctatttttttttttttttttttttttgagacagagtcttgctgtgtcgcccaggctggagtgcagtggcacgttcttggctcactgcaacctccgcctcccaggttcaaaagattctcccacctcagcctcctgagtagctgggattacagatgcctgccaccttgcccagataatttttgtatttttagtagagatggggtttcaacatgttagccaggctggtctcaaacttttgacctcaagtgatctgcccgcctcggcttcccaaagtgctgggattacaggcgtgagccaccttgtccagacccttttctctatctttatgaaaacatctctccagtagatcttcagagtaaaaaaaaaaaaaaaaaaaggaaaaaagaaaagaaaaaagaaaaagaaaagaaaacatccagcaaggtctcggaggaaaaatagaaaattagaagactggagtgagtcatgttgattttctggtgtaaaatttgtatcgaaaccttacataaatactgaagaattcacaagttgtaaatatacagcttggtgactgattttgatatccagacagtttttttcccacttgcacacactccccgcaagaatgcatgctggtttgtaaagtcattaatttactggtgcatcagtggatggctctgtgtcttctggctttatcttggcccagaaagacaggaattaacgttgagcctagtagtctttggcctttgtgccaaagcagtctgtgggccagccttgtgtagtgatcaagcagtatgtttagatgtcaggcatgacacgggttaaaaagccagctaggggaaaaatgggaagtggcattttgcgatctcatcaaacaatcttgatataaacttagagaacaacctcttggcaaatggagagcagctgtaggtttctgactgaatgtgcaagaagaacgtgaatgaaagagatatactaggtgggagcagtcagggtagacttcctggaggaagtggacagtgttgtgtggattcacactttggagatatcaaagaggaagagtattccaagtgggggtaacaaataacaagggaggcaaaaaagaaaagtatgagggaacaacaggatgttgtcaggaaactaaggctgagctgaaatccaggtgacccagagaagccttgagaaggcttgtggcatcttgtggagcaagtggggaacttgctctgtttgagagaatatgcctggaatatatgggatatcatttaaattttctaaaggttatctacaagataatttcagagaatattcgctcccacctcagcgtaggaaacaatgaaaccctgaaacatttatttatttattttccttgcttttcttttttctttcttttttttttcttgagatggagtcttactctgtcactcaggctggagtgcagtggcgtaatcttggctcactgcaacctccgcctcctgggttcaagcaattctcctgcctcagcctcccgagtagctgggacaataggcatgtgccgctatgcctggctaattttttgtatttttagtagagacggggtttcatcatgttggccagactggtcttgaactcctggcctcaagtaatctgcccgctttgggcttcaaaagtgctaggattacaggtgtgagccactgcacccagtcttttccttactttttattttatttatttatttatttattttttaattgatcattcttgggtgtttctcacagaggaggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcacagatctacaggatcccaaggcagaagaatttttcttagtatagaacaaaatgaaaagtctcccatgtctacctctctctacacagacacggcaaccatccaatttctcaatcttttccccacctttcccccctttctgttccacaaaaccgccattgtcatcatggcccgttctcaatgagctgctgggtacacctcccagacggggtggtggccgggcagaggggctcctcacctcccagtaggggcggccgggcagaggcgcccctcatctcccagacggggcggctggccgggcggggggctgaccccccacctccctcccggacggggcggcttccttactttttaaaaatacgtttgtcttcaactattggatatcttcatctaatttctagtgttttttttggttgttgttggcttatttgatttttactttttggttaataacaaaccttttaaggagttacatagactcttatcagtttacttttctaatttgttttctcctgaattctcagttaccttggattgattgtgctttgggttcatcttgctttttcttagtggctactttcagtttccttcctcttcagtttggcaattttttcccttttcaagcaaggagctcctccctgttgaggcgtcacgggtggcgggcaatccttacccggatcctcccacagcttgctctctggaagctcacactgcaccgtaattatgaaacttttgatattgtccctgatggcttctgatgcaagctgggacagcatttgtctgttgataagtgaaaccaagttcctgagatctggctctcttttgcccttctatccaataccagcaaggccctagtttcagagcattttggggacttatgatcccttctagttacctctgcatctgtgccccttttcccctcaaattagttcatagagatttttgaagcacccatgttactcaaataggcccatttttagcatgtgggaggtaaggcctagatgtgaatccctcataagccaggcagatcaaactgtgtgtatgcatgcagatttggcccaggaacactcttctccttcagggcccattgtctacaaggacagaaaagaattcttaaggccattcactatctcacattttctgttatttttctgtcttttccttttccccctacccacagagaaacattagaatcattgccctttagaagagcagaactatgatgcctcctgtcagggatggaacgaggcattccatgcagatgacaacccaaagagagcaagagtggctctatttatatcagacaaaatcgactttaagtcaaaaactgtcacaagagacattaaagtatattatataatgaaaaaagcatcaatccaccatgaagatataacaattataaatatatgcactcaatatcagagcacctaaatatatgaaacaaacaatgacagaactgaagggagaaatagccagccatacaaaaatagtaggagacttcaacactgtactttaaataatggatagaacattcagacagaagattaataaggaaacaggggacttaaacaacattatagaccaaatggaccgaacagaaatacacagaacgttccaccctacagcagtagaacacacattatcctcaaatgcacatggaactttctccaaggtagatcacaagttgggtcacaaaacaagtctttgcaaatttaagagactgaaatcataccatgtatcttttctgaccatgatggaatgaaactaaaaatcaatggcagaaggaaaaatagaaagttcacaaatatgtggaaattaaacaacacactcttgaacaacaattaggccataaaaataaaaaaagaaattaggaaatatcttgagataaatgaaaagaaaagcacaacatacccaaacttacaggataaaagcagtactaagcaaagaagtactaagaggtactttattgcaatacacatctgcagtgaaaaagaagaaagatctcaagtaaatagtctaacttcgtgcctcaaggagaggagaagaagatgaagaagaagaggaactaagcctaaaattagtgaaggaaataacaaagattagagtaggaaccaagaaaatacagaatagaaaagcaatagaaaaaaaatcaacaaattttttgaaaagaataacaaaagaattggttttttgaaaagataaacaaaatcaacaaatccctagttaggctaagtaagaaagagagaagactcaaataaacaatatcagaaataaaagaggagacattacaactgatgccacagaaataaaaacatgaggctataatgaacaattctattccaacaaactggataatctagaagaaatgaataaattcacaaaaccttccaatctacgatgactgaatcatgaagaaatacaaagtctgaacagacttataactaatgtggaggtttagtcaataatcaaaaatgttccccaaacgaagaagtccaggaccagatggcttcacaggtgaattcttccaaacatctcaagaagaattaatgccagttcttcttaaactatttttaaaaattgaagaagagggcacacttccaaatttattttatgtggccaacattatcccgataccaaagccaaacaaagacaccacaagaaatgaaaactgcaggtcaatatctctgatgaatatacatataaaaactcataacaaaatactagcaaatcaaattcaacagtacatttaaatgatcgtacatcctgactgagtggcatttatccctaggatacaagtatggatcaacatacaaaaataaatcagtgcgaaatggcctattaacagggcaaagatataaagataacatgatcatctcaatagatgcagagaaagcatttgacaaaattcaataccctttcgtgattaaacaatttttcaacaaactggaaatagagtctcaacatcatcaagaccatatataagaaaattttcactgttgagtattatattagatgtgagcttttcatatatgggattcataatatgtttcaaatatattacaaagctatagtaattgaaacagcatgggaatagcataaagacaaacacataggccatcagaagagaagagagagctcagaaataaatccatgcatatacagtgccttagtccattcagcctgctaaaacaaaataccatagactggtggcttataaaacacagaaatttatttttcacagttctggaggctaggaaattcaagatcaagtagctagcagatttgctatctagtgagggcctgcttcttggttcataaatggccatcttctccatgtgtcctcatggaattagggtgatggagcgctctgggatttcttttataaggcactagtcccattcataagtgctctaccttcatgacctaatcacctcccaaaggtcccatctccaaataccaacacataggggattaggtttcaacatatgaattttaggggaaacaaacatcagtctattgcatatactacctaaagcaatctacaaatttggtgtgatctctattaacatcccaatggattttttttttacagaaaaaaacctctgaagtataaaaaggaccacaaatagctaaatcagttttgaggaagaacaaagctagaagcaccatacttcctgatttctaaatatattatactcccatggtcatagcagcactatttacagtagccaagatgtgcaaacaacctaaatatctaggatggggaaagaaaatgtggtagtcacataaaatggaatattatttgccttataaaggagggaaattctataatataagacaacatggatgaatcttgaagacattatgctaagtgaaataagccagtcaccaaaagacaaatactgtatgattctacttacatgtggtatctaaagtagtcaaatttatagaatcaaagagtggaatggtggttgccaggggctggggaggggggaaatgagttgcctgtcaacaagcataaagttttagttaagcaagatgagtaagttctagagatctgctgtacaacattgtacctatagtcaacaatactgtattgtacacttaaacatttgctaagagggtagatctcacttaaatgttcttactacaataaaatataattgataaagcaatagaaaaggattcctatacataggattcctatacataaaaaggtcaatacctaatttccatttaattaaaagcaatgaatagtcaatttacacacaagacaatttctgttattgaggcagctataggatatagaagagatttcccaactcactttgcaaggtgcacatagccttgaatccacaagcataatgtaaataatttacttttaagaaactcagacagaaaaatcctataatcatctcaaaagatcctgacatttctttttgataatttaatgcccctttctgatttttgtcaaatactaggaagctaataggtaaggaaaagtccctaacttgataaaaatacctaccagatgcccaaatcaaaaatcatatgaattaggaagttctggagtgcttctcattaaactcaggaacgtgtaatatcgttattaatgtattgttccaccctgttttggagggcctggccaatttaacaagttaggtgatttgataagttagtttaatacgcataacagcatggctgtcccgaggcatacaggaggcgatgggctgagtcctgactgcagctcccccaaggacctgccacgcatggattatacacaaagtctgttcaagtctgttgagggagtgaagggtcggggggcagcaatcccctgtttggcctgccaggtaaagcctttgtaattgctaatggctgggcctgacagattacacataggattttggcctggagcccaaataattcctaaactccatcctttgatttttcagagcccaagcgagaaacataggctaccccatcatggacctgaatgggttggattttgagggtctctgttaggagccaggttattagtctgcagttacaataaatagaccatggtcaggatcaagatcacttccagcatcgtgtacagattaatatgcctggggtagcttaggtaccagaaaaatccatgtttacagaaatgtttgtttgcagcattcagtggcacaggaacaaaatatttatttgtggggatacatccagcattttgtcaaattcactggggaactgcctgggacaggcatatcaatgaatttagtgacttggaagtcacacagtctattctgtaggagagagagaaggaaggttagattcccacttctccctcctctgtaccctggctcatgggttcataggcgctcacgttgggggaattttccccaaccactgtgacatgggtaagggtagcatcttccgactatcctccagggaggtgggctgtaatctggcctggatcctctgatgactaaaaaaaaaagtttctcttctgtacattgatatccatcccttgaaaataaccaggcaaagcaacaaagccactttatggaaaacattgaattagaagcctcaagttgatagtgattattttttgcaggcaaaaaaatccatgctcagcaccaaagggataactgatgaagagggttactgtctctcatgctttgttttttaatagctaatctaatctctcacctatctgagtctttagaaaggaattgaagggggtggggggcccttgtagggttccccagagagactgaggctgtgcaataaaaggaagcaggtagacagtctgatcaaatatgcagcgcaaatgatgactgcccctttgaggaatgccacactgggaccccagactgttcccctgagatgcatagtccaggccgaggttcttttattccctcctgtcagtcacttaaccctgtccttcaattgtctactaaaacactcaatcatccctgctgcttggaggcgatagagagcatagggcgtccatcatatatgccccatgcttgggcccattgatgtgtggcttgggccacaaatctggggccattatcagatgcattctatgcctgggaatcaaccatctaagatctgaaattgtgtcaccgattgattgacctgacctcacaaggaggttttttatttgtttttgtttttttttttgagacagagtctcactctgtcacccaggttggagtgcagtggctcaatctcactgctacttccatctcccaggttcaagtgattcttatgcctcagcctcccgagtagctggaattacagacacgcaccaccatgcctggctaatttttgtatttttagtacagacagggtttcaccatgttggctagcctggtctcgaactcctaacttcaagtgatccgcccacctcggcctcccaaagtgttgggattacaggcgtgagccactgtccccagccactggacttgataaccatccggagtatcatgaacaaagctagaaatctgagtctggttgcaacctcatcatctgctgcttccacttccttatcatagacccaggggaccaccagtgtagcctgccacggctccaggtttggagtgaggcgtaggttccaggcagctcctgttgaccctgctgctgcaggccaggtcagctgtccttgcccaggtgtgaatcatgggcatgtatctccctgctgggcttccgctttgctgccctttcctggccctttggccagagagagcaggcttttctttctgttgcttttccttgtttgttcttttttttttttttttttttgagacggagtttcgctcttgttgcccagactggagtgcaatggtgcaatctcggctcaccgcaacctctacctcccaggttcaagcaattctcctgcctcagcctcccaagtagctgggattacaggcatgtgccaccatgcccggctaattttgtatttttagtagagacggggtttctccatgttgaggctggtctcgaactcccaacctcaggtgatctgcctgccttggcctcccaaagtgctgggattacaggcgtgagccactgggcccagccatttgttctttctaatttaggcctgttggtggttctggattgcaggcctctttcgttttcagtctggcatgtgtgggaataaaaagacagcccagggcacaaaacagggtgttgttcctgcctctgggtcccccgccagtctgcctctactttccacctctcagggttgtgtgattgtctgttgatttattcccagggtatttaggtgtccttagaggggagaagcagggaaaagtgaatctatgccatcgtgtctcggaactggaagtccacccccatccccacacacactagaattgcagaagaaaaataagatgagaacttgagtgaaaaaaacatattattatgcaatcatcaaatgtttggacagaaagtgttcttagacaacctctagtctaatttctcacatttggaaatctggaagttggactaagacctgaatcgaccaccctcacccccagttcagctgactgactccccagcctgtattctcaccattccacaccaggatctgtcctgaggctttgaaaaaatgtgaactgcatgtcctgctcagatcccaaccctcccacaccactttgctaagagtctgttctgtctgcaaaaatcccaaaagttgtgtcaactggaacgcaaaatgttcttcatttgactttcattgttttttggaattttggggggccagggaggagcaagaaaggagctgcaattgcccttgggtaagatttgcttagaattttaggaagaagttgtctgggcacagtggcttactcctgtaatcccagcactttgggaggccgaggtgggtggatcacgagatcaggagttcaagaccagcctggccaagatggtgaaaccctgtctctactaaaaatacaaaaactagctgggtgcagtggcaggcgcctgtattctgctagggagctgaggcaggagaattgcttgagctggcggggtggaggttgcagtgaaccaagatcacaccactgcactccaggctgggcggcagagtgagactgtctgtctcaaaaaaaaaaaaaaaaaaaaaaaaagaagaattttaggaagaaatctatctgattctagaattatctaggctgttgaggatgtgtgtctggtggccactgggacatcagggtgagacttttcttttaactgcatgtatgtgaattaggttgcttctggagcctactgagagctcactgggtccccatagcatccatgctgaaggcgccttccttctgtctgtgaccttgaccctcagctccacatttccccaggggctgcaggatttctcagaatcctcattagcacaacctatttttttttttttttttcctgaaacagagcctcactctgttgcccaatgcagtggtgtgatctcggctcactgcaacctctgcctcccaggttcaagtgattctcatgcctcagcctcccaagtagctgggactacaagcgtgtgccaccattcctggctaattcttgtatttttttttgagatggagtctcgctctgttgcccaggctggagtgcagtggtgcgatctcggctcactgcaacctccacctcccgggttcaagggattctcctgcctcagcctcccgagtagctgggactacaggtgcccgccaccacacctggctaattttttgtatttttagtggagacagcgtttcactgttttagccaggatagtctcgatctcctgacctcgtgatccgcccgccttggcctcccaaagtgctgggattacaggcgtgagccactgcgcccggccaacttttgtatttttagtagagatgggggtctcactatgtttgtcaggctggtcttggactcctggcctcaagtgatccacctgcctcagcctcccaaattggtaggattacaggtgtgagtcactgtgcctggacagcaccacctattagtgaatgacagccttgacttttgaggctaaaactttccacttctttagtatagtaattaaatctctcgctttttctactatttcggtaattaagcaggtaaagaaaaatatccagaacaatataatagggagtagggcaagaaaatcctgaggaaccacgacctgtgggtggatcgagtgcaggggtccttgagtgtagctggttgcaggaaggccccagcagaagggggctttgatgagcatccaccttgtgtaccgagtgaatgtccgtccagatgaggtgcggatgcagctgacaatggaggcgactgtaatggactatcccaagtagcaacatcatcaatttaggttttcagcctgagtgagactttcagttaatactcaactgaaaacaagatgcaaattttccttcagaaatttgttgaaagtgttttcactttggtactattgatctattaaagggctgagatgcagaggagacaccattgtgtaatttctagtggccgctctttttgtccgttatctgttcactgttctatccatgctgttctgccacacccctttttcacttaccaacacatgttggagattgctctctatcatagcatttcctctcctattctctagcctgcctcttcactctcttaatggtatcatttttctgaaaagaagctcttaattctaaaatggtcctgttggtggttttttccccttatggtcagcactttttgtgtcctttttgagtttttgtctactccaatatcataaagacattctcttaggatttctcataaagttttactgcttccttcttttttgagagagtcttactctgttgcccaggctggagtgcagtgctgcgatcttggctcactacaacctctgcctcctgggttcaagcaattctcatgactcagcctcctgagtagctgggactacaggtgccccccaccatgcccagccaatttttgtatttttagtagaggtgggggtcttgccatgttggtcaggctagtcttcaactcctgacctcaggtgatccacctgccttggcctcccaaagtgctgggattataggtgtgagccaccacgccctggtcaattgcttcctttttatatttagattgactatccatctggatttgaattttgtgtgggtaggaaatcaaggctcattttatttttatatggctatcttgttgatctgtcgttatttactataaagacgatccttttttcacttcacctcattgtcacctttacccatgtatcaagtgagaatagagtgtgagactttaaaaaattaatggattattttttaagaacagtttcaggtttagagaaaaaacagagcagattagctgggcatggtggtatgcacctgtagtcccagcttattcatatgcttatttgccatctgcgtatctttttgtgaggtgtctgttcagacctcttgcccacttttcaatcgggttgttttcttattgttgagtcttaacagattagcttaatcagattggcttcgggaggctaaggcgagaggatcgcttgagcgcgggaggcggaggttgcagtgagttgagatcacaccactgcactctagcctaggtgacagagagagaccctgtctcagaaagaaaaaaaaagaaagagcagaaagtagagagttcccatataccctctgcctcctacacttctcccctccccacactttcccgttattaacatcttgcattagtgtggtacatttgttacaagtgatgaaccaatattgatattgtaggggagggcaaatctgttttccttctacccttctaagttcatggctgagaaccctataacagaagacagattaataagagaaaagtgcataaacatatttaagttttatgtgacatggaagcctttataaggaaatgaagactccaagaagcagttacagtttgatgtaggtttgataaagggtggacagttgtggaggatatgatagagcaaagagtttgaagtaagtgtagtccgctggcagaagcttatcaaggcccgtttgtttagttagattcctctctgtgtccctttgtcttcacagataccaccaggtatagggagggcatctctcacctgagggtcttatgacctggcttcaggagaaggtcagaaaacccttcctgcacatgctgcttttgcaaattccttcaccttaaaatattcaatatgtcattgtgttagtctgttcttgcattgctctaaagagatacctgaggttgggcaatctataaagaaaagagttttaattggctcatggttccacagactgtataggaagcatgatgctggcatctgcttggcttctggggaggcctcaggaaacttacaattatggtggaagacaaagggggagcgagacatctcatgtggctagagcaggggaagcaagagagcggggaggtgccacatatttttaaacaaccagaatatcatgagaattctatcatgcaaacagcactgtggggatggtgctaaactattagaaaccacccccaagatccaatcacctcccaccaggctccgcctccaacattaggaattacaactggacatgagtttgggtgaggacacaaatccaaaccatgtcagtcgtggtgccatattttgtggtagcacgtcctgaatcccatcaataaattattctgaactaaagttccatagtttccattagggttcacttttggtgtacatcctaccggttttgccaaatgaataatgccatgtagaaccgttacaatattgtacagaataatttcactcccctaaaaatcccctgtgctgaacctattcacacttcctcccctgagtccctggcaaccactgtctctatagttttaatcagaatgtcacatagttggaatcatacagtatgtagcctctccagattgccttctttcacatagtaacattcaattaaggctcttccatgcctttgcgtggtttgatagctcatttctttttattgctgaataataatctatggtatggatgtgccacagtttatccattcatttattgagggacatcttggttgcttccaacttttggcagttatgaattatgaataaagctggtataaacattcatgtgcaggtttttgcatggacataaatgttcaatttgggtaaatatctagaaacgtgattgctggatcttgcggtaagcatatgctttggccaggcgcggtggctcatgactgtgatcccagcactttgggaggctgaggtgggatcacctgagatcagcagtttaagaccagtctggctaacacagtgaaacctcatctctactaaaaaaaatacaaaaattagctgggcgtggtggcgtgtgcctgtaatcccagctactcaggaagctgaggcaggagaatcgcttgaacctgggaggtggaggttgcattgagccaagatggcgccactgcactccagcctgggcaatagagtgagactctgtgtcaaaaaaaaaaaaaaagaaaaaaaaatggccaggcgcagtggctcacacctgtaatctcagcactttgggaggcggaggcaggtgtattatttgaagtcaggagtttaacaccagcccgaccaacatggtgaaaccctgtctctactaaaaatacaaaaattagctgggcgtggtggtcatgccggtaatcccagcaacttgggaggctgaggcaggagaatcgcttgaacccagaggcagaggctgtagtgagccaagatcacacttgccgttgcactccagcctgggagacagagtgagactccgtctaaaaaaaaaaaaagcttcatgacaaacttccagactttcttccaaagtgtccgtatgagttttcattcccacgagtaatgaatgagagttcctgttacttcacatccttgccaatgtttggtggtgtcagtgtttcggattttagcaattttggcaaatatgtagtggtatctcactgttgttttaatttgcaattccctaatgacatatgatgttgaacatcttttcatatgcttatttgccatctgtatatgtttttggtgaggtatctgttcagatctcttgcccacttttcaattgggttgtttgttttgttattgttgagtgtcaagagttctttgtatatttttggataacagcatggtttttgtttttgtttttgtttttttttgagacagagtctcgctctgtcaccaggctgtagtacagtggcatgaacttggctcactgcaacctctacctcccaagttcaagcaattctcctgcctcagcctcccgagtagctgggactacaggtgtgtgccaccatgcccagctaatttttgtatttttagtagagacgggctttcaccatgttggccaggatggtctggatcacttgacctcgtgatccaccagtatggttgagttttaagagttctttgtacgcttttgggtaacggtcttttgttttgcaaacattttctcccaatctgtggtttgtctcttcactcttaactgtatcttttgaagggggatctcaaagaacatctggtcccccacaacaacatgtcatgtcaggtgagagatgactcattttctcagaaactaggattttgtgtcatatgttgtaaaccacgaaaagttaattttataacccaccttctagatctactgagaatacgtggtgttatcactaacagttttgaggaaagaaataattgcctaattcattttgtagtgaatgtgttttgttactaccacagatactcttaaaatccacttattatggagggggaaaaaaaaggaattttctttacagaaagtgaggagtgaaacctaatggagaaaatatctgtttcagggaataaccctcccaacatctgatttttttttgttttagacaggggctcgctccgtcccccaggctggagtgcagtgatgcaatcatagctcactgcagccttgaactcctgggtttaagcaatcctcctgcctcagcctcctgagtagctgggaccacaggtgtgcaccaccactgcaccaccacacccgactaatttttttgatttttggtaaagacagtatgttgcccaggctgatcttaaactcctgagctcaagtgatcctcccacttcagcctctcaaagtgctaggattataaatgtgagccactgcacctagcctgatcttttttttttttttttttttttttttttttaagaaacagtcactagtgctgtatgtaggttacagtagctatgtaggcccttcagagtcacttcacttttctgagctttcgtttcttcaacgtcttcctgtctgtaagacacatgctcttctacccctgagaccaaaaaatgttaccagtgaggatctaatgatataaaatagggaaaatgctttaaaactgcacagtgcttaacaaatgcactgttattatatcattaaaagtgactcctgggtggtgggaatggttgcataacgacgtgaatgtacttgatgtcacttaaaactggttacaatggtaaattttatggtatatatattttaccacaattaatacattttaaaagatggttcttgacaattattcttagcgtctgaggtgccccatttcttgggtatgggcatatagtgcctcaagaatattggggatcctcacctcttctatgcccaaacctttaagaaaattctgggccaggcgcagcggctcacagctgtaatccaccactttgggaagccgaggtgggtcgatcacctaaggtcgggagttcgagaccagcctgaccaacatggagaaaacccgtctctactaaaaatacaaaattagctgggtgtggtggcacacacctgtaatcccagctactcgggaggctgaggcaggagaatcgcttgaacccaggaggcggaggttgcggtgagccgagattgcaccattgcactccagcctgggcaacaagagcaaaactccatctcaaaaaaaaaaaaaaaattctggaaaagctaggtcagtgacatgaatattggaatcagagtctaacaaactcaatttcttcctttctaaatccgtggtacggattcatgtctgcagtagtttttctgagaaagcagaaggggtaggtattggcaatcaacaagctgcagagtatgcagattgaggtcagtaactgtaaatgccccatgactgtctgatcattttaataccaaaagaaaaacttaaaatcccagttgctaaaatctttgtcttagacaactctttgagcctctccctacaaggcccagaaaggaatgagatagatgtgaatggaatctgttttcccttcccttgccacgctctggaggaggagtctagggcagtagccaaggccagctgccagtcaaggaaaggggagcggccccgttgaatccacaaaccacaccatcctggcccatgggttatatacaaactcccacattggcaacaaacaaagggcatgcacattcaggggattttgctttcactgtgagtgtttatctttgaagggtgtcacatcaagatgaatgggaagggtgtgttgcagttgagctgaggtttggtctttcttggcttttttagggacacttacaggtccaaatctgctttcagccggctggtggacatggtaggagacacagtagtctcaggaccaggcctccaggtgggagctgagattctagagggtggaaaccacttggagattgagtcaaagcagacctgtcctcattctgtgctgggcaggagccagctctccatgtccctgcagctccagcaacacctccggatctttcagcttccctgggactaaggaccatgcacattattaattctgatataaacagtcacacaggcacatgtctcaagatgagggtgagaagttggttacagcaaatgaagtaataatgatctttgtgcttcacaataggaattcaaccaacctgaggtttataattcacttattaacactttttatttttgttgagacggagtgtccctctgtcactcacgctggagtgcaatggtgtcatctcggctcactgcaacctccgcctcctgggctcaagtgagtctcgtgccttgagtggctgagactacaggcacatgccaccatgcccaactaatttttttgtatttttagtagagatggggttttgccatgttggctaggctggtctcaaactcctggcttcaagtgatccgcctacctcaatctcttcaagcgctgggattacaggggtaagccactgtgcctggccataattcatttatcagtcatatatatatacacacacactgggagaatctagggtcagtgccttacaaatggcacaagttgaagccctgagactcccactcctaccctgctccccccattctcagtactgctcctcagatgcctccagcagatcatccatttctgctaggctgggcctgggtacatgcagggagatgtgtacaggggctaagagcagaaacttttgagtgagacactcctgagttcatgcactggccctgccatttgtcagctaattgatgttgcatttaattgcatcatctgtatgtaagcctaataatttatagccatcttagagatgttgtgagcttaaataacatagtagtgaatatttatttatttgtttatttatttatttagacagggcctcgctctgtcacctaggctggagtgcagtggtgtgatcatagctcactgcagccttgacctcccacactccagttatcctctcacctcagcctcctgagtagcttgagacaacagatgcatgccaccataactgactaattttttaaaattttctgcagagacagtgtctccctatgttgcccaggctggcctcgatctcttgggctcaagcgatcatcctgccttggtcttccaaagtgctgggattactggtgtgagccactgcacccacagcctatttattgagaaatgtggaaggcccaggcactattctaagtgctccagctgttttatctcccacagttttgctcagataggagttccaaagctggagctggaagactcatatttttagaaatgttacagttaattctgaggtgggtcagattgagattcatggctatgcattaatgtttaggtggtgactaaccactcagggttttagagacaaacagaccttattctgtcactcactgactgagcgtggccaagtctttcagcctctctaagcctcagtgtcctcatccataaaatgggaccaatcgtagcatccacttctgagaactgttcagaagtggaaatgagctagtttaggtggctgtgtctggcatacgccaatggtttgataagtattagcttgtgcctttattaggccaactcctttttgttaggtgactgagaaaccaaggaccttctgccctttatgcaccagtcactattagtttaaatttgttgctcttccatccacatgattcattccaaatttgaagtgttggagaaagggagttagtatgtcatagaaaaatctctgtttttggctcagcaggactgagtttgactccatgtaactgtctgagtcttagtttcctcatccataacatgggagaacaataccctgaattagagaattctgctgccagaattagagatagttcatgtcaaggtgcaacatataggtaatgtgttattgctggtgttctggttataaaatgtacaagatgtgaaagcaaaagggcagaaaaccctttttaaaaattcatggctgggcgcgctgcctcatgcctgtaatcccagcactctgccaggccgaggcgggtggatcacctgaggtcgtgagtttgagaccagcctgaccaacatggagaaaccctgtctctactaaaaatacaaaattagccgggcatggtggcgcatgcctgtaatcccagctacccaggaggctgaggcaggagaatcgcttgaacccgggaggcggaggttgctgtgagccgagatggcaccattgcactccagcctgggcaacaagagcgaaactccgtcccccgaacaaaaaattcaaatgggaaagagaggcagatggcagagaacaggggaggggctgggcaccgtggctcatgcctgtaatcccagcactttgggaggccaaggcgggtggatttcttgaggtcaggagttcaagaccagtctgaccaacatggtgaatccccatctctattaaaaatacaaaaattagccgggggtggtggtgggtgcctgtagtcccagctactcgggaggctgaggcaggagaatcacctgaactcaggaggtggaggttgcagtgagtcaagatcgcaccactgtactgttgcctgggcaacgcaccgagactccgtctcaaaaaaaaaaaaaaaatgagagaacaggggagggtctagggctcagagctttggagaacagacctcagtagcaccaacactccaggatcaatgctacaaagacacgggttacaactaaactggagaacatggccaaggatgggaactcagcctgagcagggctgagccgagcagggctaagccaagtagggctgagccagaacacttcctccttttttctgaacaatctacctacatttcagctacagggctggctttacccagtccggcgggagggaggagagggctggtctgtgacttcagtgctgaggtttgatcaaggcaaagggaaacttcctattcccagaccctttgcaagaaagaatggcatattacttgccaccgacaggggttattattactaaatggagtcagtataaatgctttccaataaagcatgtccagcgctcgggctttagtttgcacgtccatgaattgtctgccacatccctcttctgaatggttggaaattgggcatctgttcctttaaacaggaaacatttcttgttcgagtgagtcatctctgttctgctttaggagtaaagtttaccctgcagttccttctgtggtgaagttttctctttctctcggagaccagattctgcctttctgctggagggaagtgttttcacaggttctcctccttttatcttttgtgttttttttcaagccctgctgaatttgctagtcaactcaacaggaagtgaggccatggagggaggcagaagagccagggtggttattgaaagtaaaagaaacttcttcctgggagcctttcccacccccttccctgctgagcacgtggagttaggcaggttaggggactcggagactgcgatggtgccaggaaagggtggagcgggtgagtgcctgttgccaaggtggcctcttcaacaggaaaccacaatatttttgtttcttgacttgctctagaaacagggctgtgggggtggggaagcaacttggatctgcccttctgaggacacctctgggtgctgcctggcccaggtctcctgtgtggtttctctctgagccgttgcctctgactttgctactttttcactctgagcagtctccagttcctctgctacctttttgtcctccaagcttccctgccgcctcgaatgcagatacacggtctccctcctgtggacccgtttggagagtccagaagactttatcaatccacttttttttctttttcatttggccctggggccgacggttaagtactttattctgtcattctgtcgaatcacgatgccctgaggtgcacagccccttccccctcttccgtgtctgaagggtttccttttatctctccacccccacccttgccctcctgccctctctcttgttccccaaagacagttctctaatgttttgatgtggattcgtgaatttatctgtatctttgcaaaatgtatttttcttttgtatgtgtacactgttttttaactatgcgatctcaggcaagtaattcctctgtgcctctgttatctcatcattaaatgattaataatgcctccagaggtgactgtgaggcttgaaggagataatacgcatacatcacttactacacgagttagcaattattattgcatattaatactattggtattttattttgctcattctgtttctatttcttttttatttatttattttttgagacaaagtcttgctctgtcacccaggctgcagtgcagtggtgcaatcacggctcactgcagcctcaacatcctgggatcaagcaattttcccatctcagccttcagattagctgggaccacaggcgcgtgctaccacacctggctaattaaaaaatttttcttcatagagatggtgtctcattttgttgcccaggctggtctcaaactcctatgctcaagggatcctcccaccttggcctctcaaagtgctaggattacatgcatgagccacggtggccatccaggcattgatattatgaggccatcttgacctagccctctctggtgaagagtccttttcagatacttcgttcagtcttctcagctatgagtccctaccctctgaaagcttatattctatttggggaaagacaaaaggcagtttcaaagaagagaggtgtttgattttcttttcctacttttaatatcagaaaacatttcatctaactctcagtatgaaggcaatattttgtttactggtatatccctagagcccaacatggtgagggccccaggatttgcttctttgataagatggtaaacccagctttcagctaacttcatggtttcctcagctacactcatatacaaggatcacctttggtaagatggacttaccatcttaccaaagagtttttgcattttagagttttttctttttagatttttttcattttagaatttttttatttcagagttttttctttttagaggtttttcattttagagttttttctttttagagtttttttttttttttaattttagagtattttaggctgctgagggtggaatctggtgaccttggggccacagagatgctccttggctaaaccaggggctttagctctgaaagttcacagccaccctgagaaccaagatgagagggctctgcagtgtccaatctcaagacctctctgaggtgctccatcaagattcattgaatgaaaaaattaaagtcttaatgatgaacccagaaaaatctttaaatcctaaatatgaaatgaaagtgttcttagttacaatccagtccaacgtccttgttttggaatgtggaaatgaggccccaaaggtaaaatggcccatccaaagtcacagccaggggccagtgctcaggtggccaggtgccctgcgtgcggtctcctggaccaccaggcctttttcctgcagctttagaagctttagaaggcactctgctcactcaggggcaagtggtaagcgctctttcccctctagtgtttgtgactcaggagtttcgaaacaggaagtagagctggctggctgtgcccttccgtccttcattagacgtttgctcttgtcttagatgctcagatggtagtggataggcctgtgacgaaggtgctaccatcgtgagagtaaggtaaggatttgcctctttgttaaggtcagaggggccttttgggaggaaggcctttgattctggagttttctaggctgctgagagtgagatcgggtggccctggggccatggaggtgatcctcgtatgtgagtgtggatggggaaaccatgaagttagtgtaagaggtagcagtccctctgagagccttgccgagggccgtgcagtttccagatctgaaggccattctagcttagactgatgaagtcctaggagcttctgaaatgctgcaagtttaactacttgtataaaggcctcatcctgatcccagtcaaacttgtgaaataatagaagccaaaatttaaatctctactgactttgctgctacagctatcctcccaccaacacacatacccaccaacatacacacttgccaacataaacgcacacacacatacacacaaacacacccatgtggtcctactaattcaattatttattttttaaagaaattaaaaaagactgggcgtggtggctctcgcctgtcatcccagcactttgggaggtcgaggcggtggttcacctgaggtcgggagtttgagaccagcttgaccaacatgaagaaaccccgtctctactaaaaatacaaaattagccgggcatgatggcgcatgcctgtaatcccagctactcgggaggctgaggcaggagaatcgcttgaacctgggaggtggaagttgtggtgagccgagatcgtgccactgcactccagcctgggcaacaagagcgaaactccgtctcaaaaaaaaaaaaaaaaaaaaattaaaaagatacagaacagttcaaaaaacaatataatgggaagactagatagacacaatcagagacctgcacttgtggggttaagaatttacaggtgaagttgcaagtttcattctgtttgaaaatgatgggattatatgttttgctgaggtttggacacctttgctgggttgtttgaatgccgtggctgcagcgccctgttatggacatcatgtgcgtgcagaatggatgtctgtcaggttccggggcagcccgcagtctgaggcagccagcctggattggagggagtggcaatactacctgccggttaggggtttgggcctgagagcgagtggctttcaggttctctcaagcttcggatgagatgcaggtttctgcttccgatggcaaatgcatgttttgctttttagttatcactgcaagagctaggatgctgctagaatattactggaatgattgtgatgagatggaatgtatttacagtttaattgtgacatgtaatacagtggtagaatgggactctggaatgagatgctggggcctagattctagcacttcctttgtgaggctctaaccccctctcctatagtggatttgttaagaacttctgtttttgtggctttgttattataaaattttttgaaatgttgttctctaaaaaagttatgattttatgtttttcttcatgagattctttcactgccttccagctgcaagtagaatgacgtctaaatctttgtgatctgtcactgaagcccttgagtgagacacttaaatctggctgtggctctctctcttactagcttatttccaagccgtgatttttcacaacagaaaaatggggacagtaatagtagtttcttcagaggcttttagtgaaatgaggttaaaaaatatttttatgtttatatggatatatagattacaaacatttatatatcatttatttatatgattattataaacacatatttatatttaaatactttggggcataaatatataaaataataaatatacttatgtaatacaaatagacttatatacatttactatttagcagagattatataaaatatatgtattacatggcaacatattcaaatttacatatgttatatatacatgtggaaaaaaaattgggaaaaggccacaaaatgtgaccaaagaattacttccaaatggcaagtttttaagtaatttttattttctttttatacttctctgtactttctctatgaaacaagtgttacttttactgtttttaggaaccaaaaatacaagtacattgtttaaaaaatactagcttaacaaagtttctagcccataagctagtgcagaaaatctaggtcccataaaacaagaactgccacacgatgtctctccccttacagtgctggatggcccgttgttaatggtgtcataaatcctttgcaagtgactgttttctaggtactatgactagagggatgtgtaacttaagcaaaaaacaaaaaacagaaaaggctgactatcatctgacagtgtatcctggaacacctaggccagagaagaagccacgttagcattttcccttctaaatgtcagttatgatttgatggggaaaccacttaaaaagcattgtcacgttgttgaaaaggtaatgaaatgagtgagatgagatggctatggaggacggagctatgcgccaatcttattatatccaaattcatgtcatctcagccttggattgtattgatttttattatatactgtcagaaaatgctattgaatgtgtaacaagagcctcaaaaaggtttattcattttgacaccataatactacttttaggaaattattctaagaaaataattagaggtattcttaaagatttgcgttttaaagtcatcctaaatgtaatcaggaactggctatgtaaattatagcccatctctaagattaagtgccttacagatattaaaacccatgctgtagaagaaaaactaaagacaggaaagtacttacaatacaagatgtacttaccagtggaaaaatccacttatactacagaaatatgatgtgttcaaatataaggaaaaatgtgtatgcataaaatatttggtaggaaagagtaaaatattactgggcatttatatttggatggtggaattatacataattttaattttcctttttatcttttctgtattgtctaaaatgaatacactaagcattgttatcctcagaaaaaaataattgagggatgggggaaaggaagtcctgctttcatttgattctttggttggttttattctgtaagatgagactttaacagaggttagaatgcattaaaaattgtaaagacagttgacctaatggcactaaacagggttagatctagtttagatcttttccagcatgtgaataagaatggatctttaaataaagattttaactaggtatatgttttagaataagtcatacatgtacatggtaaaaattcaaacagtacaaactgtgcagcaaggtatgggaaataaagcagctctcactgtcacctccacccatcagccttctcacactgcacgcccacatctgtgtgtaattctgcttttctttaacattactgaaggaacttcctgtgcattttttgtcagagctcttctgtgaatacacaaaatatgtactgatcaatacattatgtagatcacgcaggctcaaccacattgatcttcctattctttctagtagccaaatagagttccctggaatatgattaatagcttgcctaaatcttctaatgctgataaacagttgtttctgctctttcgttatttcaaggaatgctaccatgaatagccttatatatggttttgagtatacttgtttaagtgaatgtaggaaaaactcttggaagttaaattgtgggccagtttatgtgaattttatattttgacagagatggctaaattacccacctgtttttttgttttgttttggttttggttttgctttttttttttaagagttggggtcttgctacctggggtcttgccacctggggtcttgcccagggtagacctgaactcctgggccacgttggtttattttactgcattcccagggcctagagcaacgattgacacgtgctagcagtatctattggaaattctggccaacttgcaatagacctgattatttctacactgaacatgtctaagatagctattactattcattcaggaaagcccagacaattatcatgccagcagcctgagacagtagccagtaatagcctggtgtggtagtttgctcctgtagtctcagctactcagcaggctgaggtgggaggatggctctagcctgggaggtggaggttgcaatgagccaagattgcgccctgcactccagcctgggtgacagagtgagaccctgtctcaaaaataaaaataagaataaaaaataaaccagcaaaagtttctgccctcacagagcttccattctagtgagagggtagtttgtcatcaggagggtgacgccggtagggctgggggccagctccctgcagggaacaaacatgatcgcagtggggtgggagtaggggatgagtccccagagcctctgtggtttccatttccacacaaaaaaaccactgctgctgtaatcaggagggggaaaagatttttaaaaattttctttcagggaatggaaggaaaggatatttttgaaagtaagactttgaaaactaaaagttttgggtcacttaaaaactcaaaatctttaggtcactttaaaaatatttaatcttggagctggaggccattattctaggtaattagctgggtgtggtggtgtgtccctgtaatcccaactactaggaggccgaggcaggaggattgcttgaacctgggaggcggaggttgcagtgagccgagatcgcgacactgcactccagcttgggtgacagagcaagactgggtctcaaaagaaaaaaaaaaaacgaaaactaaataccgtatgttctcacttaaaagtgggagctaagctatgaggatgcaaagacatacagagggatataatggactttggggattgatggtggggttgaatgggaggttggtcctaataggtcctagtacgtcccctacttctaagtcttccagtctgtcctttgcactttgaatgttaattccaagttggataatgtcattctcatttttacagtcctttcttagctcctcatcacctccaggacaaagcctaaacccctcgccccatggtaatgcggcccctttgtgacatggtacctggctagagcttcatccctttgtcccatcactctccatcccagacactttgtagttactttattgagctccttgtgcctgcctgaatggacttgaaagttcttacctccatcttttacattaattgtttcctgtaagaattgtgctttctcgcattctccccaaaatcccttccccataggaagcccttctcccaggctaagttaaggtttcttcctctacatccctaccacactctggtcacaaccctctaaccattggcttgttttttttgttttttgtgttttttttttttttgtgagacggagtcttgccctgtcacccaggctggagtgcagtggtgcaatctccgctcactgcaacctccacctcctgggttcaagcgattctcctgccccagcctcctgagtagctgggattacaggcacgtgcctccacacctggctaatttttgcacttttagtagagacggggtttcaccatgttagtcaggctggtctcaaactcctgacctcgtgatccgcctgccttggcctcccaaagtgttgggattagaggcgtgagccaccgcgcccagcccattggcttgtttgtatgtctaccttcctaaacagtaagagggaacttgtctggtgttctttttttctctcctgtgctgacagcacaatgaccagtacctagtagttgcagtagcctttgatgaacaagccagcaaatggtacttttcttccttatctgaacataccatttattttgacttagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacaggtgggtggaaactcccattgtgggactgggaggtgtgggttgaatggacagcctctgagctgattggggcttttttttgtggtaccctgcctagtgcctgggaacccagcagtgccacaattctaagcttctacagaaagacagtagtgccttgggtggtcctgctaaaggctgtaaaacttagcttctccccaccctagagagagtgggtaaacaaaggcgtgagagagaaaccacattcagtatcacttgggaggctttgggaagatgtcccaccggagccagattaagaaatttaggggccttatatataattctatagaaatgctaagaccataaaataaaaatttatttttcaaagtgaaacattacttagaggtatgctgaagttataatagagtttttctaagtgttctcatttttttcctctcttatcttgatgcctctcgatatccagattgtgtgcttactttgcccatccattgagtaaagcatcatggcttcccaccctgaaatccccctcccacctgcttgcggatggctatgaaaattttcaatgagatttaagggttttctgccacacttaaagactcgaatgactaagttctttacggagctgtaagccgctggcctggcacatacagctaggcagtctccaccgaggctgcccagttcctgtgagcccggctgtatgacagttctaagcttctataggaagacagtggcacgttgggtcatcctgccaaaggctgtaaaactcagcttctccccaccctagggagagtgggtaaccaaaggtgtgagagagaaaccccattcagttacaacttcatgatgctgtgacaagactttaaaaacagaaacacattgtcactttctctctttcaacatctcctattatcggacactacttaaagcaattttagctttgctttcaggaaacttctactgaagtcttcgttctgggcccatttcattgtctctgtttgcttgttgataactatggcatgtgagatggaaagggttcacaaccagggctgacagctgctgtcctctgatggctcagcccatgaatgctctggtctttctattctcagagactattttttgttttgaggcttgactattttttgttttgttttgttttgtttttgagacggagtctcgcttcatcacccaggctagagtgcagtggcatgatctcggctcactgcaacatctacctccagggttcaagtgattcttctgcctcagcctcctgagtagctgggattacaggtgtgtgccaccatgcccagctaattttgtatttttagtaggacggagttccaccatgttggccaggctggtctcgaactcctgaccttaagttatccaccagccttgacctctcaaagtgctgggattataggtgtgagccaccatgcccagccaaggcttgaccattttgattttaagtgaaaaaagagatattctgggccgggtgaggtggctcacgcctgtaatcccagcactttgggatgctgaggagagctgatcacctgaggtcaggagttcaagactagcctggccaacatggtgaaacctcatctctactaaaaatacaaaaattagctgggtgtggcggctcacgcctgtaatcccagctacttgggaggctgaggcaggagaattgcttgaacccaggaggtggaggttgcagtaagctgagattatgccattgcactccagcctgggcaacaagagtgaaactctgtctcaaaaaaaaaaagaaagagatattctgggtatataagtttcctagggctgctgtaacaaagtaacacaaactagcaggtttaaaacagtttttaaaatgtgttttcacagttctggaggcctgagtcagaagtcaagatgccaacagtgttggttcccttttaagaggctccgaggaataatctttttcatgcctttccctgcttcgggtgggtggaggaatcctcagtgctccttgtcttgtagatgaggcacagcagtctctgcctatgttcccttctctgtgtctaaatctccctcttatgagacagtcactggattaggaattagggcccacctaatccagtatggcctcatctttgtgtgtgtgtgtgtgtgtgtgtgtgtgtgtgtgtgtgtgtgtgtgtgagacagtgtctcactacatcgcccaagctggagtgcagtggcatgatctcggctcagtgcaacctccacctcctgggttcaagcaatcctcccacctcagcctcccaagtagctgggactacaggcacccgccaccatgtctggctaatttttgtatttttttgtagagatggagtttcaaaatgttgcccaggctagtcttgaactcctgggctcatgcaatctgcccacctcagcctcccaagttctgggattacgggcatgagccactgcgcctggccagcatgacctcatcttaatgagattttatctgcaaacgtcctgggtccacataaggtcgcattctcatattccagatagacatgaattttggggaagaggggagaacactattcaaccagtacactagatagctttggtttactagcattgtgaagtctttataaggcacttattcattaaggcgccagttagtcctaaaaacccacagccccagaacaaggaaagccgaggggggtctcatcttgtgcccaccatcttggtcctttgaaggttccacttctgccgcatgagctgggctgaagcaaacagccagtgccagacacagtctgtacctttctggcggagggtcgatcatctattaataaggcaggatctctcttaaaatctttaatgtattggcttagagataaaagggtccgggcaatcctgacttactgcttgttcattatcattgaatactagccagaagctaataaatatgctagggtgaccacttaccattataagaaaacactagacattttattttccagttataattgctacctataaaataaagatcttataaactattcaggttcattactaaatggtgatggtacaagaaagcctataggcttcaataatgaggaaagcaaaagggtaaataccttgtaataaaggtgaaagagtcagagtagctttggattagatccaattttggccaaactgaaagctttagataaacacttctagggtagagagtccatgagaagggggataaggcagatggtaatactgagtaatttctgtttctacgccatttttattttcagaattttacttttctaattaaattttaaagtcaacgtgtttttgtattaaaattattttcctttacaccatagtattgaaaggtttgctgacttctaaaacattcctttgttcacctattcgacaagcatattccaagagcctaaatgtgccaatcacataaatgtgataggcatagattaggaaatagtaacacctatcactcattgagcacttagtgtgttgccaaagactgatttaagtacttcacataaacttatttgtgtaaccctcgaaaccttcctatgatgtggttacggataattatcttcagtctatggacgaggaaaaaatgtgtaacatgtctaaagttaacactgctcaaagatagtggaaccaaggctccaacaccaatagcctgggtccgctgagctcaatcattgcacctcacaaccctctgggtttatgaaaataaaaagggtacggacctggccactaggggacttgaacagtttctaaacagacaattattttctgtttttatttttagtgtggtggcatgatcacagctcactgcagcctcaaccttctgggctcaagtgatcctctcacctcagcttctggagtagctgggaccacaggtgcatgccaccacacccggctaatttttaaatgtttttggtagagatggggtcttgctatgttgcccaggctggtctcaaacccctgggctcaagtgatcctccttctgccttggcctcctaatgcgctggaattagaggcatgaaccactgcaccaggccaacagacaattatgtgtgttatcgttttggggttactaagtcatagtggagtgaatgcagctttgaggatgctcaggcaatgcttgagctgattgttcatggatgggcctctgcagatagacaaggggatggggtgtagcggcaccacagaaaggggtgagggcagggcagctgggtgtgtttggcttcaggtcctttcgtgtttgcggtctggtctgtgatagggatgtattcggagactttgtattccagaaccgaatgcttggccgtcttactgaagataatgactgggagaatactgaccagttttgattagggaagtcatgagccaatgtgcattttgaaaagcataatttccaaaaggcaaagcattttgctattgcaacaaaatctccattttacagaaaaaaaaaaaggaaaacaagatttactcaactgaaataaactgaaagaaaagttgatagaactttaaattgttaagggtgggaaagtcggggaggagccagtagacttctgtgtcaccacaccagcctctttccaagggctcaactcataaaccatgccattaactggctttatgttgaagggaggcctttggaatcaagcccactgtgactccatatatcaaatgggaaattatttgggaaaagatttctaaagtgtctccatttcccaccacagggtcatgctctatcagatttcagaagaagtgagcagatcagaattgaggtcttttaagtttcttttgcaagaggaaatctccaaatgcaaactggatgatgacatggtaagacctggtatcttactgagatttagtcctgagacttggttagccagggggcatttctgagaccaaagagaggggtattttggtaaaagcaacctggattctcactttttaactagaagaagaaagttgtcagcacgagtgttacagatgtgattcctttagaccgaagtgctgctcatgttaattattgggagcaaggcagagtcagaggccgggagaaggaggctgtgcagatgcagcccagacccggcagagctgggaaagactgcggtgggtctgagatatttcctccacttctgcagtccccgaaacaacctgggacctgaaactctgtgtgtatattgtgtctgtgtgttgtgtgtgtatttccgtgtctgtgtgtgcctttctctgtgtatagtgtgtgtctgtatttgtgtgtgatatgtgtatctctgtgtgtctctgtataagtggtgtgtgtgtctgtgtatctctgtgtgtgtgttctctgtgtggtatgtgtgtctgtgtgttgtgtagtgtgtattgtatttatgcccctgtgtgtgtatcactgagtatactctgtgtgtgttgtatctgtgtgtgtatgtgcatgtggtgtctgtgtgtgtgtgtctgtgtgtctgtatgtactcaggtctggagaggcaatgctgggggtgaggctgttccccagggtgtcaccatgatgaccgggctgctgtctcaggttgtttcacagtccccaagtaatgcattcgcaggagatttgagcacagggcctggggactgggtgacatctgacatggcttctcctttatcctctcacttctgtctttctgggccagaaaacatggaatcgcttccctagtagcctgctggctgtgagagaccagcagaaactgtcagaaacttgggaagcaagggcaggtccttggttggagaaattggaaattaaaaaaaaaaatctaatctaaaaaccagtagggctcaatccagattcccaactttatttctcctcctcttagaacctgctggatattttcatagagatggagaagagggtcatcctgggagaaggaaagttggacatcctgaaaagagtctgtgcccaaatcaacaagagcctgctgaagataatcaacgactatgaagaattcagcaaaggtagaaacaacctgacagccgggaatcggcaaaacctactctaaaattgaaactgacaaatcgctccatatcacagttgtttctaatcaaatattgtttggggtttccccttttaattcagagagaagcagcagccttgaaggaagtcctgatgaattttcaaatggtaatgcttggagatacattttcaagatttagttaatttactatctggtacctgcatgtgtcctccccacagccttctaccacatgcacatcttaacgtgcctgctctactttttctttttttttttttttttgtgagacagttttactttgtttcccaggctggagagcagtggcaccatctcggctcactgcaatctccgcctcccaggttcaagcaattctcctgcctcagcctcctgagaagctgggattacaggtgcgtgcaccaccacgcctagctaattttgtatttttattagagatggggttttactatattggcctggctagtctcaaactcctgacctcaggtggtctgcctgccttggcctcccaaagtgctgggattacaggcatgagccactgcgcccggccgcacctgctctcctaagacctgtagcccaagctggcaagtttgaaataggtgcagagttagtcagtagtaagtaatttaacatcattttttctatgtggctttttttttctccttgacgtgctgctcatgttatgcactgagtagctggatttaaattatgtttcataattttcttggttaagtcactttctctttcaacaccttctacactaagtcactcctttcaacttcctttcactttttctacctgataagcgaggctgaaccaagagagagagctctcaacgatctccttcaaaattttgattaatcaaatagtctttttttttttttgagacagtgtctcactttgtcccccaggctagaatgcagtgatgcaatcttggctcacaacagcctcgacctcctggactcagatgatcctcttgcctcaaccccctgagtagctgggaccacaggcacaagccaccatgcccggctaatttttgtatgtcttgtagagatggggtttcgctatgttgcccaggctgatcttgaactcctgagctcaagccatccacctacctgggcctcccaaagtgctgggactataggcaattaataaagtattctttctgattagaaaaattatatacactaattgaagattattttaaattcagagaaatttttacaagtccaagaacaccatcactccattcatattatgaatatttttattgtatttttacgttggctctttgtggtgtgtgtgtgtaaaatacattttggatcactcaaatgtattttaaagattaatgtctatgcaggctgtccttccctttcccctctgcctgctgagcctaaggccttaagaatactttaaggagtaaagtactaaatcattaattcatcctgagctagtggctttattaatgagtatctcacaaataccacaaaaattcaacctggccatgtggagcaatataaaattatggcatttcttggtatgtttttctctttggcgaggagacaacttgatcttgtgtttccagaagcatgttaattgccctgcttgcagaatctctctggcttgaaaggagattatattcatggcagtctgtgaattttcattttatttcatttatttatttgagacagagtctcactctgttgcccaggctggagtgcagtagtgcgatctcagctcactgcaaccactacctcccaagttcaagtgattctcctgcctcagcctcctgagtagctgggactacaggtggctaccaccacgcccggctaatttttttgtacttttagtagagacagggtttcaccatgttggccaggctggtcttgaactcctgacctcaagtgatctgcccatcttggcctcccaaagtgctgggattaccggcgtgagcccctgttcccagcttgaattttcatcttaaaaaagaccttatgttgtcctatgtgctacatatttcattaccagtgtacctttcctgccatgtctcattctagatgtgtctcttcgttgtttgcaggggaggagttgtgtggggtaatgacaatctcggactctccaagagaacaggatagtgaatcacaggtagacggaaacctccaaatccttttttttacattacagattctagttatttaatttgttagcttttttttttttttgctgccagataaactgacaaggggcagaaacttactgaaaattttgagaactgtagaaaaaattcacacaaaaaaagttaaaaatgtgacttaatttttaaaatgtgactccttcagttttctatacatttgaattttattttaagacccgagatgaagatactggaatagttggagggtggagggggtaataagcctcctaccaaatcttctagcagccgtgccagcctggatgggggagtggtttggagaaagagtctagcaggaatggaaaaagccaagccttttcctttagcttaatgtttcaaaaatgcttctccttggtgatgaggtgtaagcagcaaactctcacaatctagccatctctgtgtttttgtctcagtgaaccagcagaaacatgtaatttttaggcataataacttctctttatgtaatcaacaatccaccaaatacatcctgacttattagacgatctgctcctcctcatggtaggaagaagaggaaatcctgaatatctgaagtaggcttgagagagattattcactagtgtgggctcctgagaaaattaccagacctctttcatctgaaagtcaaggattaacccaagtaatgtggtactttctaaacagtatagcatgctacaagcattgtccccactgaagagctaaaaacactgtcttaatatcttagtaaatcttagtatctttttccttttttaatgttttattgagacaggggtcttgctacgttgccaagccaggtctcgaactcctggcctcaagcaatcctcctgccttggcctcccaaagtctgggattataggtactagccaccgtgcctggccaaatcttagtgtcttagtatctcagtaaatacacttaatatgcttaataaatacttagaacacaactgtaaataataaaaacttaacatacttggtacaaacttaatcaaatatttaatatcttagagttaacatattaagataacaggttatttgcccaaagtcataaggtgaagtagaggcaggaattgggcttcctagcctggagtccttttctccacctcaaggggctacgcagacctccaactaaatgctgagtttctcggtactgaaacagccctaggagaatgaataggacacagcgccatccctggccagtactatcaggtactacagtttggataccataacctacagtgtagccaggacctccctgaccagcccatctcttcccagcagccaccgtggtcctgagagctgggttaagccatcacctttaaaatcctgggaccacactgtgcaatgcatgaatgggagaccctcagctgttagccacgaagcacagatgagttcagtagacagccaagagaatcacaagtcatggcgtgggggcagccaaagacattcattcattcagtgactcttgattgagctctcacaagttaatacaccgtagtccctggcacagatgttatgaacctcaaggagtcttctgtatagtatgggaagcagaaatgagaacaaacaataatacaatgtgatgacaacaatattaatatatgtgcaaagtgctcaggaggcccaggtattgggacactgactttacaacgatggggcagaagtctgagaggtcctgtgtgaaggaaataggtagaaactagttcttcgaggaaacgaccccgagttggggtggtgcaatggaaagcaagtcctcttactagggagttgtttgtttacatctctagtgtttgacccacagagtcagctcctgggttgggtttttgttttccagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggtacagtagaacccaaaagagaaaagtaaaatatttcttatgcctatttttttttaaatcaaaagggagagaacaaaagctataccaaaagggccatgtttcaagaaaatggatttaaacatatttccctgtggaggtaaagaacattcttatacatttatcagtttcctgctttttttaaaaattaattttttaaataaaagtaatgtatgtataaatataaaatatcaaatcttactaaaagacataatgaaaagcagtaataagctttgttttgaattcagctaaatgcatagcgcttctgtggaatgtattaggcgatgaaattgctgtggtatcaaagttcttatagaggctgcatttttacaggttgggctgttaagtgcagcagaaattgtgggttcttaacagaaatagcattttcaagtattaaatattaaactggttagcaattcttttgctcagccaaattaagctaagatcaagaacttacaagttaaatgaaaaaacaatttgtagtatgtgaatataaaaagtgactacaacaacaaaaaataaaaatcatccatcaccattgagagattaataattttgatttgatcaaagaacttttggaaatagtgtttatcaggcataacatcaattattgatttgttttgcaaatggaggtaagtttagaaaattaatgtagactgattataatcatcaggagtctgtaatggcccctattaacattttttttttttttttgagacaaagtctcactctgttgcccaggctggagtgcagtggtgtgatctcagctcactgcagcctccacctccctggttcaagtgattctcctgcctcagcctcccaagtagctgggactacaggcacacaccaccacacatggctaatttttgtatttttagtagagatggggttttgccatattggccaggctggtcttgaactcctgacctcaagtgatccgcctgcctcggcctcccaaagtgctggaattacaggtgtcagccacctgtacctggtccctgctaacatttgatttgtttatttaagcaaatctaagcctttaaaaaggcacagagattaagtccattgattacatcattcgtcactatgcgcttggtattgaaaaaaatattttggacccttgatttgtattcttttaaaattaaaacatttctattaaaataacatttgcttctatttctggcagctcattttcttataactggcccatgattgactagtctctggtaggcattcgagtctgtgtgtcctgctttttctgttcctgttcttatgttttatgctgaatgagtaaaagtaggagacccagctgcagaagtcatttctcctgagagactcccttctgtcctgcttcagtgccttcagacttgctttacagtcatttttttaatcaacattccacatttccaaaggatcagaatttttttcacagaaccaacacactgtattagtcttgccaaagtgcttccaaatcaacaagggcctattgcatttcagttatttttttctattcctaatgctagactgtattttttcttttttttttttttgaggcagagtctcactctgttgcccaggctgcagtgcaataacatgatcttggctcaccgcaacctctgcctcccaggttcaagtgattctcctgcctcagcctcccaagtagctgggattacaggcatgtgccaccatacccagttaattgtatttagtagagatggggtttcaccatgttggtcaggctgttcttgaactcctgacctcaggtgatccactcgcctcggcctaccaaagtgctgggattacaggtgtgagccactgcacctggctgagactgccttttgactgatgacttatgtttagctctgatgtgctgacagggacaaaatgctggagaaggaataaaaaaggaataatccaacaaggatcaagagaacaggaaaggagacaatagctaatgaaaggtttccaacaatttgggggagttgaaaaaaaagagtcgaggtaattgacttaacagagaaagctacaacctcactgattacagaggggaacacggaaaggaggcaagcctatttacccccacagaatcctggaaaaattcagcaattggaagtacaaagtgtaggtgaggcaatgagcagaaaacaggaagattctttgaaagcctatataagcctatacaatcctctgattcataccttcctctcatagagccagcaactattcttattctaccatcataaggaacaggaagtttgttttctcataaaattgaaccagagaggctctacacttcggtgtgccaggcccagcaaaggaagcaatgaagcattttactgaacacagagagactgaagaaaacctgctggtggcatggagtcagatctctaaaccaacttggttccaagacactggcagcagatacagacttacctctggagaagctgaaagctctagctaaaatacatacagataatgacatctggaggtttcctaatgaaatgatcaggtccccaaccaatcatcttgctatgaaatccctcagagaacaagccacatccacaaacacagagctttcagtcgactttttaatggactaattagtcaatttatgaatggacaaccaaaggtcagcaggcatttgaagaaaggctctaatacgaaagagaggtagcttggtacggtggcgtgaaaatccagcactttgggaggccgaggcaggcgaatcgcctgaggtcaggagttcaagcccagcctgaccaacatggtgaaaccccatctctactaaaaatacaaaaattagccaggcatggtggcaggtgcctgtaaccccagctactacagaggctgaggcagaagaatcacttgaacctgggaggtggaagttgcagtgagctgagatcgtaccactgcactccagcctgggtgacagagcaagactccatctcaaataaataaataaattactagataaatgagaggcaatgcaaacaacaagaaaaacatgaaacagaatatgaatgaaaaaaagataatgttgagaaaaaagcaaccttttttaatgcttaatattggtatttagtattcttagagagttagttaaaggtccatgaaagaacaagatgttatgaaaaagggacagaacaagcaagtctccttgaaaattaaaaatttgagcaccaaaatgaaaaattcaataaagtagaagataaagtctaaggaagtaggataaaaagacaaaaatagaaaataggagtgaaagataagaaaatttgaagctaaatcaaggatgtccaatttttgacaataagagttccagaaagaaaggacagagaaaggggaaatggaactttccaagaacgaaatgacgcaatctccagattgaaagggtataatggattaagattcacttccaaacatatcataccctagaagcttctggaaagagaaaaaagtaagccaaatatgtaaagtatcagaaatggaaagtcttctctctagcaacactgaaagctaaaagactgtgaagaaaggccttcagaattctgaggaaaaatgcttttggaaatagaactctataaactaaagactcatacaggggctcaaaaaatgtacttctcatggttatgctccagcaaaggaaactgataagaaagaggaagtcatagatggaggaaacagggaacctactatggaagagacagagagatgtcccaggagaagagaaattcatctggcctatggaacagccagttggtattacagcagaaggatgcagtgctctggatggaaagttttccaggaagaaataaaaatgagtcagacaagtagcctgaaaatgttgaaagattttggccagatccattgagcacttggagaaaaaacagtgttaagcatataggaaacaaagcagatgaaaaaataatacaattacaagttccaggaaaggcaaaaaggttaataagaaaggaaacataatgaaagaacattatgtttacatagtcttaataatagaaatattactatgggccggaggtggtggctcatgcctacaatcccagcactttgggaggccaaggtgggtgggtcacttgaggctgggagtttgtgaccaacctggctaacatggcgaaaccctgtctctactaaaaatacaaaaattagctgggtgtggtggtgcgtgcctgtagtcccacctgcttgggaggctgaggcaggagaattgcttgaacttggggggcagaagttgcagtgagctgagattgtgacactgcactgtagcctgggtgacagagtgagaccttttctaaaaaaaattaaaaaaataaaaatattactatggattcaaccaaaacttgtaaataattgagtaagagcccaaatgcttattctccataataagaactcaatgcgaaagtctaaaatttataaatgagtaattagcagtgtacccaaattcattacaaaatggagctcaatgtggaaaaaagtggttaaaaactgaaagtggttgccttcatggaatgtgactaggtaatggggagggatagagaggggataaccttttgtataaggtcttctagttctatcttattaattcatatcttttattttgctatacataaataattttgagaaggtttaggataaaataagttggatcttttattcaaaaattgttttgtttttttctgattatgtaaataatataatcatttttaaaattggttcagtagtaagcctaaatgatagcttacccatcttgtaaactagtttactagagaaaacagaccaacaataacactctctcctttctcatttgcttcagggtttgagaatgtttttagctggtggcaataaatattagaagcctgcagaatccagctacgaatatagagggttttgctcttg

SEQ ID NO: 1569 - DNA, 29681 bp, Homo sapiens
gagtgagtcatctctgttctgctttaggagtaaagtttaccctgcagttccttctgtggtgaagttttctctttctctcggagaccagattctgcctttctgctggagggaagtgttttcacaggttctcctccttttatcttttgtgttttttttcaagccctgctgaatttgctagtcaactcaacaggaagtgaggccatggagggaggcagaagagccagggtggttattgaaagtaaaagaaacttcttcctgggagcctttcccacccccttccctgctgagcacgtggagttaggcaggttaggggactcggagactgcgatggtgccaggaaagggtggagcgggtgagtgcctgttgccaaggtggcctcttcaacaggaaaccacaatatttttgtttcttgacttgctctagaaacagggctgtgggggtggggaagcaacttggatctgcccttctgaggacacctctgggtgctgcctggcccaggtctcctgtgtggtttctctctgagccgttgcctctgactttgctactttttcactctgagcagtctccagttcctctgctacctttttgtcctccaagcttccctgccgcctcgaatgcagatacacggtctccctcctgtggacccgtttggagagtccagaagactttatcaatccacttttttttctttttcatttggccctggggccgacggttaagtactttattctgtcattctgtcgaatcacgatgccctgaggtgcacagccccttccccctcttccgtgtctgaagggtttccttttatctctccacccccacccttgccctcctgccctctctcttgttccccaaagacagttctctaatgttttgatgtggattcgtgaatttatctgtatctttgcaaaatgtatttttcttttgtatgtgtacactgttttttaactatgcgatctcaggcaagtaattcctctgtgcctctgttatctcatcattaaatgattaataatgcctccagaggtgactgtgaggcttgaaggagataatacgcatacatcacttactacacgagttagcaattattattgcatattaatactattggtattttattttgctcattctgtttctatttcttttttatttatttattttttgagacaaagtcttgctctgtcacccaggctgcagtgcagtggtgcaatcacggctcactgcagcctcaacatcctgggatcaagcaattttcccatctcagccttcagattagctgggaccacaggcgcgtgctaccacacctggctaattaaaaaatttttcttcatagagatggtgtctcattttgttgcccaggctggtctcaaactcctatgctcaagggatcctcccaccttggcctctcaaagtgctaggattacatgcatgagccacggtggccatccaggcattgatattatgaggccatcttgacctagccctctctggtgaagagtccttttcagatacttcgttcagtcttctcagctatgagtccctaccctctgaaagcttatattctatttggggaaagacaaaaggcagtttcaaagaagagaggtgtttgattttcttttcctacttttaatatcagaaaacatttcatctaactctcagtatgaaggcaatattttgtttactggtatatccctagagcccaacatggtgagggccccaggatttgcttctttgataagatggtaaacccagctttcagctaacttcatggtttcctcagctacactcatatacaaggatcacctttggtaagatggacttaccatcttaccaaagagtttttgcattttagagttttttctttttagatttttttcattttagaatttttttatttcagagttttttctttttagaggtttttcattttagagttttttctttttagagtttttttttttttttaattttagagtattttaggctgctgagggtggaatctggtgaccttggggccacagagatgctccttggctaaaccaggggctttagctctgaaagttcacagccaccctgagaaccaagatgagagggctctgcagtgtccaatctcaagacctctctgaggtgctccatcaagattcattgaatgaaaaaattaaagtcttaatgatgaacccagaaaaatctttaaatcctaaatatgaaatgaaagtgttcttagttacaatccagtccaacgtccttgttttggaatgtggaaatgaggccccaaaggtaaaatggcccatccaaagtcacagccaggggccagtgctcaggtggccaggtgccctgcgtgcggtctcctggaccaccaggcctttttcctgcagctttagaagctttagaaggcactctgctcactcaggggcaagtggtaagcgctctttcccctctagtgtttgtgactcaggagtttcgaaacaggaagtagagctggctggctgtgcccttccgtccttcattagacgtttgctcttgtcttagatgctcagatggtagtggataggcctgtgacgaaggtgctaccatcgtgagagtaaggtaaggatttgcctctttgttaaggtcagaggggccttttgggaggaaggcctttgattctggagttttctaggctgctgagagtgagatcgggtggccctggggccatggaggtgatcctcgtatgtgagtgtggatggggaaaccatgaagttagtgtaagaggtagcagtccctctgagagccttgccgagggccgtgcagtttccagatctgaaggccattctagcttagactgatgaagtcctaggagcttctgaaatgctgcaagtttaactacttgtataaaggcctcatcctgatcccagtcaaacttgtgaaataatagaagccaaaatttaaatctctactgactttgctgctacagctatcctcccaccaacacacatacccaccaacatacacacttgccaacataaacgcacacacacatacacacaaacacacccatgtggtcctactaattcaattatttattttttaaagaaattaaaaaagactgggcgtggtggctctcgcctgtcatcccagcactttgggaggtcgaggcggtggttcacctgaggtcgggagtttgagaccagcttgaccaacatgaagaaaccccgtctctactaaaaatacaaaattagccgggcatgatggcgcatgcctgtaatcccagctactcgggaggctgaggcaggagaatcgcttgaacctgggaggtggaagttgtggtgagccgagatcgtgccactgcactccagcctgggcaacaagagcgaaactccgtctcaaaaaaaaaaaaaaaaaaaaattaaaaagatacagaacagttcaaaaaacaatataatgggaagactagatagacacaatcagagacctgcacttgtggggttaagaatttacaggtgaagttgcaagtttcattctgtttgaaaatgatgggattatatgttttgctgaggtttggacacctttgctgggttgtttgaatgccgtggctgcagcgccctgttatggacatcatgtgcgtgcagaatggatgtctgtcaggttccggggcagcccgcagtctgaggcagccagcctggattggagggagtggcaatactacctgccggttaggggtttgggcctgagagcgagtggctttcaggttctctcaagcttcggatgagatgcaggtttctgcttccgatggcaaatgcatgttttgctttttagttatcactgcaagagctaggatgctgctagaatattactggaatgattgtgatgagatggaatgtatttacagtttaattgtgacatgtaatacagtggtagaatgggactctggaatgagatgctggggcctagattctagcacttcctttgtgaggctctaaccccctctcctatagtggatttgttaagaacttctgtttttgtggctttgttattataaaattttttgaaatgttgttctctaaaaaagttatgattttatgtttttcttcatgagattctttcactgccttccagctgcaagtagaatgacgtctaaatctttgtgatctgtcactgaagcccttgagtgagacacttaaatctggctgtggctctctctcttactagcttatttccaagccgtgatttttcacaacagaaaaatggggacagtaatagtagtttcttcagaggcttttagtgaaatgaggttaaaaaatatttttatgtttatatggatatatagattacaaacatttatatatcatttatttatatgattattataaacacatatttatatttaaatactttggggcataaatatataaaataataaatatacttatgtaatacaaatagacttatatacatttactatttagcagagattatataaaatatatgtattacatggcaacatattcaaatttacatatgttatatatacatgtggaaaaaaaattgggaaaaggccacaaaatgtgaccaaagaattacttccaaatggcaagtttttaagtaatttttattttctttttatacttctctgtactttctctatgaaacaagtgttacttttactgtttttaggaaccaaaaatacaagtacattgtttaaaaaatactagcttaacaaagtttctagcccataagctagtgcagaaaatctaggtcccataaaacaagaactgccacacgatgtctctccccttacagtgctggatggcccgttgttaatggtgtcataaatcctttgcaagtgactgttttctaggtactatgactagagggatgtgtaacttaagcaaaaaacaaaaaacagaaaaggctgactatcatctgacagtgtatcctggaacacctaggccagagaagaagccacgttagcattttcccttctaaatgtcagttatgatttgatggggaaaccacttaaaaagcattgtcacgttgttgaaaaggtaatgaaatgagtgagatgagatggctatggaggacggagctatgcgccaatcttattatatccaaattcatgtcatctcagccttggattgtattgatttttattatatactgtcagaaaatgctattgaatgtgtaacaagagcctcaaaaaggtttattcattttgacaccataatactacttttaggaaattattctaagaaaataattagaggtattcttaaagatttgcgttttaaagtcatcctaaatgtaatcaggaactggctatgtaaattatagcccatctctaagattaagtgccttacagatattaaaacccatgctgtagaagaaaaactaaagacaggaaagtacttacaatacaagatgtacttaccagtggaaaaatccacttatactacagaaatatgatgtgttcaaatataaggaaaaatgtgtatgcataaaatatttggtaggaaagagtaaaatattactgggcatttatatttggatggtggaattatacataattttaattttcctttttatcttttctgtattgtctaaaatgaatacactaagcattgttatcctcagaaaaaaataattgagggatgggggaaaggaagtcctgctttcatttgattctttggttggttttattctgtaagatgagactttaacagaggttagaatgcattaaaaattgtaaagacagttgacctaatggcactaaacagggttagatctagtttagatcttttccagcatgtgaataagaatggatctttaaataaagattttaactaggtatatgttttagaataagtcatacatgtacatggtaaaaattcaaacagtacaaactgtgcagcaaggtatgggaaataaagcagctctcactgtcacctccacccatcagccttctcacactgcacgcccacatctgtgtgtaattctgcttttctttaacattactgaaggaacttcctgtgcattttttgtcagagctcttctgtgaatacacaaaatatgtactgatcaatacattatgtagatcacgcaggctcaaccacattgatcttcctattctttctagtagccaaatagagttccctggaatatgattaatagcttgcctaaatcttctaatgctgataaacagttgtttctgctctttcgttatttcaaggaatgctaccatgaatagccttatatatggttttgagtatacttgtttaagtgaatgtaggaaaaactcttggaagttaaattgtgggccagtttatgtgaattttatattttgacagagatggctaaattacccacctgtttttttgttttgttttggttttggttttgctttttttttttaagagttggggtcttgctacctggggtcttgccacctggggtcttgcccagggtagacctgaactcctgggccacgttggtttattttactgcattcccagggcctagagcaacgattgacacgtgctagcagtatctattggaaattctggccaacttgcaatagacctgattatttctacactgaacatgtctaagatagctattactattcattcaggaaagcccagacaattatcatgccagcagcctgagacagtagccagtaatagcctggtgtggtagtttgctcctgtagtctcagctactcagcaggctgaggtgggaggatggctctagcctgggaggtggaggttgcaatgagccaagattgcgccctgcactccagcctgggtgacagagtgagaccctgtctcaaaaataaaaataagaataaaaaataaaccagcaaaagtttctgccctcacagagcttccattctagtgagagggtagtttgtcatcaggagggtgacgccggtagggctgggggccagctccctgcagggaacaaacatgatcgcagtggggtgggagtaggggatgagtccccagagcctctgtggtttccatttccacacaaaaaaaccactgctgctgtaatcaggagggggaaaagatttttaaaaattttctttcagggaatggaaggaaaggatatttttgaaagtaagactttgaaaactaaaagttttgggtcacttaaaaactcaaaatctttaggtcactttaaaaatatttaatcttggagctggaggccattattctaggtaattagctgggtgtggtggtgtgtccctgtaatcccaactactaggaggccgaggcaggaggattgcttgaacctgggaggcggaggttgcagtgagccgagatcgcgacactgcactccagcttgggtgacagagcaagactgggtctcaaaagaaaaaaaaaaaacgaaaactaaataccgtatgttctcacttaaaagtgggagctaagctatgaggatgcaaagacatacagagggatataatggactttggggattgatggtggggttgaatgggaggttggtcctaataggtcctagtacgtcccctacttctaagtcttccagtctgtcctttgcactttgaatgttaattccaagttggataatgtcattctcatttttacagtcctttcttagctcctcatcacctccaggacaaagcctaaacccctcgccccatggtaatgcggcccctttgtgacatggtacctggctagagcttcatccctttgtcccatcactctccatcccagacactttgtagttactttattgagctccttgtgcctgcctgaatggacttgaaagttcttacctccatcttttacattaattgtttcctgtaagaattgtgctttctcgcattctccccaaaatcccttccccataggaagcccttctcccaggctaagttaaggtttcttcctctacatccctaccacactctggtcacaaccctctaaccattggcttgttttttttgttttttgtgttttttttttttttgtgagacggagtcttgccctgtcacccaggctggagtgcagtggtgcaatctccgctcactgcaacctccacctcctgggttcaagcgattctcctgccccagcctcctgagtagctgggattacaggcacgtgcctccacacctggctaatttttgcacttttagtagagacggggtttcaccatgttagtcaggctggtctcaaactcctgacctcgtgatccgcctgccttggcctcccaaagtgttgggattagaggcgtgagccaccgcgcccagcccattggcttgtttgtatgtctaccttcctaaacagtaagagggaacttgtctggtgttctttttttctctcctgtgctgacagcacaatgaccagtacctagtagttgcagtagcctttgatgaacaagccagcaaatggtacttttcttccttatctgaacataccatttattttgacttagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacaggtgggtggaaactcccattgtgggactgggaggtgtgggttgaatggacagcctctgagctgattggggcttttttttgtggtaccctgcctagtgcctgggaacccagcagtgccacaattctaagcttctacagaaagacagtagtgccttgggtggtcctgctaaaggctgtaaaacttagcttctccccaccctagagagagtgggtaaacaaaggcgtgagagagaaaccacattcagtatcacttgggaggctttgggaagatgtcccaccggagccagattaagaaatttaggggccttatatataattctatagaaatgctaagaccataaaataaaaatttatttttcaaagtgaaacattacttagaggtatgctgaagttataatagagtttttctaagtgttctcatttttttcctctcttatcttgatgcctctcgatatccagattgtgtgcttactttgcccatccattgagtaaagcatcatggcttcccaccctgaaatccccctcccacctgcttgcggatggctatgaaaattttcaatgagatttaagggttttctgccacacttaaagactcgaatgactaagttctttacggagctgtaagccgctggcctggcacatacagctaggcagtctccaccgaggctgcccagttcctgtgagcccggctgtatgacagttctaagcttctataggaagacagtggcacgttgggtcatcctgccaaaggctgtaaaactcagcttctccccaccctagggagagtgggtaaccaaaggtgtgagagagaaaccccattcagttacaacttcatgatgctgtgacaagactttaaaaacagaaacacattgtcactttctctctttcaacatctcctattatcggacactacttaaagcaattttagctttgctttcaggaaacttctactgaagtcttcgttctgggcccatttcattgtctctgtttgcttgttgataactatggcatgtgagatggaaagggttcacaaccagggctgacagctgctgtcctctgatggctcagcccatgaatgctctggtctttctattctcagagactattttttgttttgaggcttgactattttttgttttgttttgttttgtttttgagacggagtctcgcttcatcacccaggctagagtgcagtggcatgatctcggctcactgcaacatctacctccagggttcaagtgattcttctgcctcagcctcctgagtagctgggattacaggtgtgtgccaccatgcccagctaattttgtatttttagtaggacggagttccaccatgttggccaggctggtctcgaactcctgaccttaagttatccaccagccttgacctctcaaagtgctgggattataggtgtgagccaccatgcccagccaaggcttgaccattttgattttaagtgaaaaaagagatattctgggccgggtgaggtggctcacgcctgtaatcccagcactttgggatgctgaggagagctgatcacctgaggtcaggagttcaagactagcctggccaacatggtgaaacctcatctctactaaaaatacaaaaattagctgggtgtggcggctcacgcctgtaatcccagctacttgggaggctgaggcaggagaattgcttgaacccaggaggtggaggttgcagtaagctgagattatgccattgcactccagcctgggcaacaagagtgaaactctgtctcaaaaaaaaaaagaaagagatattctgggtatataagtttcctagggctgctgtaacaaagtaacacaaactagcaggtttaaaacagtttttaaaatgtgttttcacagttctggaggcctgagtcagaagtcaagatgccaacagtgttggttcccttttaagaggctccgaggaataatctttttcatgcctttccctgcttcgggtgggtggaggaatcctcagtgctccttgtcttgtagatgaggcacagcagtctctgcctatgttcccttctctgtgtctaaatctccctcttatgagacagtcactggattaggaattagggcccacctaatccagtatggcctcatctttgtgtgtgtgtgtgtgtgtgtgtgtgtgtgtgtgtgtgtgtgtgtgtgagacagtgtctcactacatcgcccaagctggagtgcagtggcatgatctcggctcagtgcaacctccacctcctgggttcaagcaatcctcccacctcagcctcccaagtagctgggactacaggcacccgccaccatgtctggctaatttttgtatttttttgtagagatggagtttcaaaatgttgcccaggctagtcttgaactcctgggctcatgcaatctgcccacctcagcctcccaagttctgggattacgggcatgagccactgcgcctggccagcatgacctcatcttaatgagattttatctgcaaacgtcctgggtccacataaggtcgcattctcatattccagatagacatgaattttggggaagaggggagaacactattcaaccagtacactagatagctttggtttactagcattgtgaagtctttataaggcacttattcattaaggcgccagttagtcctaaaaacccacagccccagaacaaggaaagccgaggggggtctcatcttgtgcccaccatcttggtcctttgaaggttccacttctgccgcatgagctgggctgaagcaaacagccagtgccagacacagtctgtacctttctggcggagggtcgatcatctattaataaggcaggatctctcttaaaatctttaatgtattggcttagagataaaagggtccgggcaatcctgacttactgcttgttcattatcattgaatactagccagaagctaataaatatgctagggtgaccacttaccattataagaaaacactagacattttattttccagttataattgctacctataaaataaagatcttataaactattcaggttcattactaaatggtgatggtacaagaaagcctataggcttcaataatgaggaaagcaaaagggtaaataccttgtaataaaggtgaaagagtcagagtagctttggattagatccaattttggccaaactgaaagctttagataaacacttctagggtagagagtccatgagaagggggataaggcagatggtaatactgagtaatttctgtttctacgccatttttattttcagaattttacttttctaattaaattttaaagtcaacgtgtttttgtattaaaattattttcctttacaccatagtattgaaaggtttgctgacttctaaaacattcctttgttcacctattcgacaagcatattccaagagcctaaatgtgccaatcacataaatgtgataggcatagattaggaaatagtaacacctatcactcattgagcacttagtgtgttgccaaagactgatttaagtacttcacataaacttatttgtgtaaccctcgaaaccttcctatgatgtggttacggataattatcttcagtctatggacgaggaaaaaatgtgtaacatgtctaaagttaacactgctcaaagatagtggaaccaaggctccaacaccaatagcctgggtccgctgagctcaatcattgcacctcacaaccctctgggtttatgaaaataaaaagggtacggacctggccactaggggacttgaacagtttctaaacagacaattattttctgtttttatttttagtgtggtggcatgatcacagctcactgcagcctcaaccttctgggctcaagtgatcctctcacctcagcttctggagtagctgggaccacaggtgcatgccaccacacccggctaatttttaaatgtttttggtagagatggggtcttgctatgttgcccaggctggtctcaaacccctgggctcaagtgatcctccttctgccttggcctcctaatgcgctggaattagaggcatgaaccactgcaccaggccaacagacaattatgtgtgttatcgttttggggttactaagtcatagtggagtgaatgcagctttgaggatgctcaggcaatgcttgagctgattgttcatggatgggcctctgcagatagacaaggggatggggtgtagcggcaccacagaaaggggtgagggcagggcagctgggtgtgtttggcttcaggtcctttcgtgtttgcggtctggtctgtgatagggatgtattcggagactttgtattccagaaccgaatgcttggccgtcttactgaagataatgactgggagaatactgaccagttttgattagggaagtcatgagccaatgtgcattttgaaaagcataatttccaaaaggcaaagcattttgctattgcaacaaaatctccattttacagaaaaaaaaaaaggaaaacaagatttactcaactgaaataaactgaaagaaaagttgatagaactttaaattgttaagggtgggaaagtcggggaggagccagtagacttctgtgtcaccacaccagcctctttccaagggctcaactcataaaccatgccattaactggctttatgttgaagggaggcctttggaatcaagcccactgtgactccatatatcaaatgggaaattatttgggaaaagatttctaaagtgtctccatttcccaccacagggtcatgctctatcagatttcagaagaagtgagcagatcagaattgaggtcttttaagtttcttttgcaagaggaaatctccaaatgcaaactggatgatgacatggtaagacctggtatcttactgagatttagtcctgagacttggttagccagggggcatttctgagaccaaagagaggggtattttggtaaaagcaacctggattctcactttttaactagaagaagaaagttgtcagcacgagtgttacagatgtgattcctttagaccgaagtgctgctcatgttaattattgggagcaaggcagagtcagaggccgggagaaggaggctgtgcagatgcagcccagacccggcagagctgggaaagactgcggtgggtctgagatatttcctccacttctgcagtccccgaaacaacctgggacctgaaactctgtgtgtatattgtgtctgtgtgttgtgtgtgtatttccgtgtctgtgtgtgcctttctctgtgtatagtgtgtgtctgtatttgtgtgtgatatgtgtatctctgtgtgtctctgtataagtggtgtgtgtgtctgtgtatctctgtgtgtgtgttctctgtgtggtatgtgtgtctgtgtgttgtgtagtgtgtattgtatttatgcccctgtgtgtgtatcactgagtatactctgtgtgtgttgtatctgtgtgtgtatgtgcatgtggtgtctgtgtgtgtgtgtctgtgtgtctgtatgtactcaggtctggagaggcaatgctgggggtgaggctgttccccagggtgtcaccatgatgaccgggctgctgtctcaggttgtttcacagtccccaagtaatgcattcgcaggagatttgagcacagggcctggggactgggtgacatctgacatggcttctcctttatcctctcacttctgtctttctgggccagaaaacatggaatcgcttccctagtagcctgctggctgtgagagaccagcagaaactgtcagaaacttgggaagcaagggcaggtccttggttggagaaattggaaattaaaaaaaaaaatctaatctaaaaaccagtagggctcaatccagattcccaactttatttctcctcctcttagaacctgctggatattttcatagagatggagaagagggtcatcctgggagaaggaaagttggacatcctgaaaagagtctgtgcccaaatcaacaagagcctgctgaagataatcaacgactatgaagaattcagcaaaggtagaaacaacctgacagccgggaatcggcaaaacctactctaaaattgaaactgacaaatcgctccatatcacagttgtttctaatcaaatattgtttggggtttccccttttaattcagagagaagcagcagccttgaaggaagtcctgatgaattttcaaatggtaatgcttggagatacattttcaagatttagttaatttactatctggtacctgcatgtgtcctccccacagccttctaccacatgcacatcttaacgtgcctgctctactttttctttttttttttttttttgtgagacagttttactttgtttcccaggctggagagcagtggcaccatctcggctcactgcaatctccgcctcccaggttcaagcaattctcctgcctcagcctcctgagaagctgggattacaggtgcgtgcaccaccacgcctagctaattttgtatttttattagagatggggttttactatattggcctggctagtctcaaactcctgacctcaggtggtctgcctgccttggcctcccaaagtgctgggattacaggcatgagccactgcgcccggccgcacctgctctcctaagacctgtagcccaagctggcaagtttgaaataggtgcagagttagtcagtagtaagtaatttaacatcattttttctatgtggctttttttttctccttgacgtgctgctcatgttatgcactgagtagctggatttaaattatgtttcataattttcttggttaagtcactttctctttcaacaccttctacactaagtcactcctttcaacttcctttcactttttctacctgataagcgaggctgaaccaagagagagagctctcaacgatctccttcaaaattttgattaatcaaatagtctttttttttttttgagacagtgtctcactttgtcccccaggctagaatgcagtgatgcaatcttggctcacaacagcctcgacctcctggactcagatgatcctcttgcctcaaccccctgagtagctgggaccacaggcacaagccaccatgcccggctaatttttgtatgtcttgtagagatggggtttcgctatgttgcccaggctgatcttgaactcctgagctcaagccatccacctacctgggcctcccaaagtgctgggactataggcaattaataaagtattctttctgattagaaaaattatatacactaattgaagattattttaaattcagagaaatttttacaagtccaagaacaccatcactccattcatattatgaatatttttattgtatttttacgttggctctttgtggtgtgtgtgtgtaaaatacattttggatcactcaaatgtattttaaagattaatgtctatgcaggctgtccttccctttcccctctgcctgctgagcctaaggccttaagaatactttaaggagtaaagtactaaatcattaattcatcctgagctagtggctttattaatgagtatctcacaaataccacaaaaattcaacctggccatgtggagcaatataaaattatggcatttcttggtatgtttttctctttggcgaggagacaacttgatcttgtgtttccagaagcatgttaattgccctgcttgcagaatctctctggcttgaaaggagattatattcatggcagtctgtgaattttcattttatttcatttatttatttgagacagagtctcactctgttgcccaggctggagtgcagtagtgcgatctcagctcactgcaaccactacctcccaagttcaagtgattctcctgcctcagcctcctgagtagctgggactacaggtggctaccaccacgcccggctaatttttttgtacttttagtagagacagggtttcaccatgttggccaggctggtcttgaactcctgacctcaagtgatctgcccatcttggcctcccaaagtgctgggattaccggcgtgagcccctgttcccagcttgaattttcatcttaaaaaagaccttatgttgtcctatgtgctacatatttcattaccagtgtacctttcctgccatgtctcattctagatgtgtctcttcgttgtttgcaggggaggagttgtgtggggtaatgacaatctcggactctccaagagaacaggatagtgaatcacaggtagacggaaacctccaaatccttttttttacattacagattctagttatttaatttgttagcttttttttttttttgctgccagataaactgacaaggggcagaaacttactgaaaattttgagaactgtagaaaaaattcacacaaaaaaagttaaaaatgtgacttaatttttaaaatgtgactccttcagttttctatacatttgaattttattttaagacccgagatgaagatactggaatagttggagggtggagggggtaataagcctcctaccaaatcttctagcagccgtgccagcctggatgggggagtggtttggagaaagagtctagcaggaatggaaaaagccaagccttttcctttagcttaatgtttcaaaaatgcttctccttggtgatgaggtgtaagcagcaaactctcacaatctagccatctctgtgtttttgtctcagtgaaccagcagaaacatgtaatttttaggcataataacttctctttatgtaatcaacaatccaccaaatacatcctgacttattagacgatctgctcctcctcatggtaggaagaagaggaaatcctgaatatctgaagtaggcttgagagagattattcactagtgtgggctcctgagaaaattaccagacctctttcatctgaaagtcaaggattaacccaagtaatgtggtactttctaaacagtatagcatgctacaagcattgtccccactgaagagctaaaaacactgtcttaatatcttagtaaatcttagtatctttttccttttttaatgttttattgagacaggggtcttgctacgttgccaagccaggtctcgaactcctggcctcaagcaatcctcctgccttggcctcccaaagtctgggattataggtactagccaccgtgcctggccaaatcttagtgtcttagtatctcagtaaatacacttaatatgcttaataaatacttagaacacaactgtaaataataaaaacttaacatacttggtacaaacttaatcaaatatttaatatcttagagttaacatattaagataacaggttatttgcccaaagtcataaggtgaagtagaggcaggaattgggcttcctagcctggagtccttttctccacctcaaggggctacgcagacctccaactaaatgctgagtttctcggtactgaaacagccctaggagaatgaataggacacagcgccatccctggccagtactatcaggtactacagtttggataccataacctacagtgtagccaggacctccctgaccagcccatctcttcccagcagccaccgtggtcctgagagctgggttaagccatcacctttaaaatcctgggaccacactgtgcaatgcatgaatgggagaccctcagctgttagccacgaagcacagatgagttcagtagacagccaagagaatcacaagtcatggcgtgggggcagccaaagacattcattcattcagtgactcttgattgagctctcacaagttaatacaccgtagtccctggcacagatgttatgaacctcaaggagtcttctgtatagtatgggaagcagaaatgagaacaaacaataatacaatgtgatgacaacaatattaatatatgtgcaaagtgctcaggaggcccaggtattgggacactgactttacaacgatggggcagaagtctgagaggtcctgtgtgaaggaaataggtagaaactagttcttcgaggaaacgaccccgagttggggtggtgcaatggaaagcaagtcctcttactagggagttgtttgtttacatctctagtgtttgacccacagagtcagctcctgggttgggtttttgttttccagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggtacagtagaacccaaaagagaaaagtaaaatatttcttatgcctatttttttttaaatcaaaagggagagaacaaaagctataccaaaagggccatgtttcaagaaaatggatttaaacatatttccctgtggaggtaaagaacattcttatacatttatcagtttcctgctttttttaaaaattaattttttaaataaaagtaatgtatgtataaatataaaatatcaaatcttactaaaagacataatgaaaagcagtaataagctttgttttgaattcagctaaatgcatagcgcttctgtggaatgtattaggcgatgaaattgctgtggtatcaaagttcttatagaggctgcatttttacaggttgggctgttaagtgcagcagaaattgtgggttcttaacagaaatagcattttcaagtattaaatattaaactggttagcaattcttttgctcagccaaattaagctaagatcaagaacttacaagttaaatgaaaaaacaatttgtagtatgtgaatataaaaagtgactacaacaacaaaaaataaaaatcatccatcaccattgagagattaataattttgatttgatcaaagaacttttggaaatagtgtttatcaggcataacatcaattattgatttgttttgcaaatggaggtaagtttagaaaattaatgtagactgattataatcatcaggagtctgtaatggcccctattaacattttttttttttttttgagacaaagtctcactctgttgcccaggctggagtgcagtggtgtgatctcagctcactgcagcctccacctccctggttcaagtgattctcctgcctcagcctcccaagtagctgggactacaggcacacaccaccacacatggctaatttttgtatttttagtagagatggggttttgccatattggccaggctggtcttgaactcctgacctcaagtgatccgcctgcctcggcctcccaaagtgctggaattacaggtgtcagccacctgtacctggtccctgctaacatttgatttgtttatttaagcaaatctaagcctttaaaaaggcacagagattaagtccattgattacatcattcgtcactatgcgcttggtattgaaaaaaatattttggacccttgatttgtattcttttaaaattaaaacatttctattaaaataacatttgcttctatttctggcagctcattttcttataactggcccatgattgactagtctctggtaggcattcgagtctgtgtgtcctgctttttctgttcctgttcttatgttttatgctgaatgagtaaaagtaggagacccagctgcagaagtcatttctcctgagagactcccttctgtcctgcttcagtgccttcagacttgctttacagtcatttttttaatcaacattccacatttccaaaggatcagaatttttttcacagaaccaacacactgtattagtcttgccaaagtgcttccaaatcaacaagggcctattgcatttcagttatttttttctattcctaatgctagactgtattttttcttttttttttttttgaggcagagtctcactctgttgcccaggctgcagtgcaataacatgatcttggctcaccgcaacctctgcctcccaggttcaagtgattctcctgcctcagcctcccaagtagctgggattacaggcatgtgccaccatacccagttaattgtatttagtagagatggggtttcaccatgttggtcaggctgttcttgaactcctgacctcaggtgatccactcgcctcggcctaccaaagtgctgggattacaggtgtgagccactgcacctggctgagactgccttttgactgatgacttatgtttagctctgatgtgctgacagggacaaaatgctggagaaggaataaaaaaggaataatccaacaaggatcaagagaacaggaaaggagacaatagctaatgaaaggtttccaacaatttgggggagttgaaaaaaaagagtcgaggtaattgacttaacagagaaagctacaacctcactgattacagaggggaacacggaaaggaggcaagcctatttacccccacagaatcctggaaaaattcagcaattggaagtacaaagtgtaggtgaggcaatgagcagaaaacaggaagattctttgaaagcctatataagcctatacaatcctctgattcataccttcctctcatagagccagcaactattcttattctaccatcataaggaacaggaagtttgttttctcataaaattgaaccagagaggctctacacttcggtgtgccaggcccagcaaaggaagcaatgaagcattttactgaacacagagagactgaagaaaacctgctggtggcatggagtcagatctctaaaccaacttggttccaagacactggcagcagatacagacttacctctggagaagctgaaagctctagctaaaatacatacagataatgacatctggaggtttcctaatgaaatgatcaggtccccaaccaatcatcttgctatgaaatccctcagagaacaagccacatccacaaacacagagctttcagtcgactttttaatggactaattagtcaatttatgaatggacaaccaaaggtcagcaggcatttgaagaaaggctctaatacgaaagagaggtagcttggtacggtggcgtgaaaatccagcactttgggaggccgaggcaggcgaatcgcctgaggtcaggagttcaagcccagcctgaccaacatggtgaaaccccatctctactaaaaatacaaaaattagccaggcatggtggcaggtgcctgtaaccccagctactacagaggctgaggcagaagaatcacttgaacctgggaggtggaagttgcagtgagctgagatcgtaccactgcactccagcctgggtgacagagcaagactccatctcaaataaataaataaattactagataaatgagaggcaatgcaaacaacaagaaaaacatgaaacagaatatgaatgaaaaaaagataatgttgagaaaaaagcaaccttttttaatgcttaatattggtatttagtattcttagagagttagttaaaggtccatgaaagaacaagatgttatgaaaaagggacagaacaagcaagtctccttgaaaattaaaaatttgagcaccaaaatgaaaaattcaataaagtagaagataaagtctaaggaagtaggataaaaagacaaaaatagaaaataggagtgaaagataagaaaatttgaagctaaatcaaggatgtccaatttttgacaataagagttccagaaagaaaggacagagaaaggggaaatggaactttccaagaacgaaatgacgcaatctccagattgaaagggtataatggattaagattcacttccaaacatatcataccctagaagcttctggaaagagaaaaaagtaagccaaatatgtaaagtatcagaaatggaaagtcttctctctagcaacactgaaagctaaaagactgtgaagaaaggccttcagaattctgaggaaaaatgcttttggaaatagaactctataaactaaagactcatacaggggctcaaaaaatgtacttctcatggttatgctccagcaaaggaaactgataagaaagaggaagtcatagatggaggaaacagggaacctactatggaagagacagagagatgtcccaggagaagagaaattcatctggcctatggaacagccagttggtattacagcagaaggatgcagtgctctggatggaaagttttccaggaagaaataaaaatgagtcagacaagtagcctgaaaatgttgaaagattttggccagatccattgagcacttggagaaaaaacagtgttaagcatataggaaacaaagcagatgaaaaaataatacaattacaagttccaggaaaggcaaaaaggttaataagaaaggaaacataatgaaagaacattatgtttacatagtcttaataatagaaatattactatgggccggaggtggtggctcatgcctacaatcccagcactttgggaggccaaggtgggtgggtcacttgaggctgggagtttgtgaccaacctggctaacatggcgaaaccctgtctctactaaaaatacaaaaattagctgggtgtggtggtgcgtgcctgtagtcccacctgcttgggaggctgaggcaggagaattgcttgaacttggggggcagaagttgcagtgagctgagattgtgacactgcactgtagcctgggtgacagagtgagaccttttctaaaaaaaattaaaaaaataaaaatattactatggattcaaccaaaacttgtaaataattgagtaagagcccaaatgcttattctccataataagaactcaatgcgaaagtctaaaatttataaatgagtaattagcagtgtacccaaattcattacaaaatggagctcaatgtggaaaaaagtggttaaaaactgaaagtggttgccttcatggaatgtgactaggtaatggggagggatagagaggggataaccttttgtataaggtcttctagttctatcttattaattcatatcttttattttgctatacataaataattttgagaaggtttaggataaaataagttggatcttttattcaaaaattgttttgtttttttctgattatgtaaataatataatcatttttaaaattggttcagtagtaagcctaaatgatagcttacccatcttgtaaactagtttactagagaaaacagaccaacaataacactctctcctttctcatttgcttcagggtttgagaatgtttttagctggtggcaataaatattagaagcctgcagaatccagctacgaatatagagggttttgctcttgaatttctggttcaaattcttttttttttttttttttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttaagattagggagtggtgatgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcgtggccgggcagaggggctcctcacttcccagtaggggcggcccggcagaagcgcccctcacctcccagatggggcggctggccgggcggggggctgacccccccaccgccctcccggacggggcggctggccaggcagaggggctcctcacttcccagtaggggcggccgggcagaggcgcccctcacctcctggatagggcggctggccgggcggggggctgttccccccacctccctcccggatggggcggctggccgggcagaggggtcctcacttcccagtaggggcggcccggcagaggcgcccctcacctcccggacggggcagccggccggaaggggggctgacccccccacctccctcccggacggggcggctggccgggcagaggggctcctcacttcccagtaggggcggccgggcagaggcgcccctcacctcccggacggggcggctggccaggcagggggctgatccccccacctccctcccggacggggcggctggccgggcggggggctgaccccccccacctccctcccggacggggcggctggccgggcagggggctgaccccccctcccccctcccggacggggcggctggccgggcggggggctgacccccccacctccctcctgggcggggcggctggccgggcagaggggctcctcacttcccagtaggggcggccgggcagaggcgcccctcacctcctggacggggcggctggccaggcggggggctgaccccccacctccctcccggactgggcggctggccgggcggggggttgaacccccacctccctcctggacggggcgactggccgggcagaggggctcctcacttcccagtaggggcggccgggcagaggcgcccctcacctcccggacggggcggctggccaggcggggggctgaccccccacctccctcccggactgggcggctggccgggcggggggttgacccccccacctccctcctggacggggcgactggccgggcagaggggctcctcacttcccagtaggggcggccgggcagaggagcccctcacctcccggacggggcggctggccgggcggggggctgacccccccacctccctcccggacggggcggctggccgggcagaggggtcctcacttcccagtaggggcggccgggcagaggcgcccctcacctcccggacggggcggatggccgaccacccccccccgcctccctcccggacggggcggctggccgggcagaggggctcctcacttcccagtaggggcggccgggcagaggagcccctcacctcccggacggggcggctggccgggcggggggctgaccccccccacctccctcccggacggggtggctgccgggcggagacgctcctcacttcccagacggggtggttgccagacggaggggctcctcacttctcagacggggcggttgccaggcagagggtttcctcacttctcagacggagcggccgggcagagacactcctcacctcccagacagggttgcggcccagcagaggcgctcctcacatcccagacagggcggtggggcagaggtgctccccacatctcagacgatgggcggccgggcagagacgctcctcacttcctagatgggatggcggcggggaagaggcgcttctcgcttcctagatgggatggcggccgggcagagacgctcctcactttccacactgggcagccaggcagaggggctcctcatatcccagacgatgggtggccaagcagagacgctcctcacttcccagacggcgtggcggccgggcagaggctgcaatctcggctctttgggaggccaaggcaggcggctgggaggtggttgtagcaagccgagatcacgccactgcactccagcctgggcaccattgagcactgagtgaacgagactccatctgcaatcccggcacctcgggaggccgaggctggcggatcactcgcggttaggagctggagaccagcccggccaacacagcgaaaccccatctccaccaaaaaaaaaacgaaaaccagtcaggcgtggcggcgcgcgcctgcaatcgcaggcactcggcaggctgaggcaggagaatcaggcagggaggttgcagtgagccgagatggcagcagtaccgtccagctttggctcggcatgagagggagagggagacggggagagggagagggagagggagacggggagagggagagggagaggggtcaaattcttatctatcaatgttatgcccactgtgctctccagctgtggtctgtgaattactgtggtataacgtgactgttcaaatttcacttttcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcggtaagttttgcctactcagccctcctcactgttacactaccttccccccctactccatcacactactatctactcatattcagagcctattagaaagtgctatgtgatttagatcacattaacaggtcagagaactgtccaaggggagtggtttccgttcaactctaaatgtctagctgtagatcacatagctgcatttcccaggtcagttacaaagtgggagagtggcaagtgttaacatccttagtttatagatggaaaagctgagatgctttattcctttattcagcacctcaaaggacaatcagggtatcacagagcaggaaaggataggaaagtcatatactccagctctctgtctttaggccaaaacatgactgagccaattcaactagttttggaaatcttccaagaaggcagtaacccaattcaatgtttaaacatcctccaactctgtcaaaagttctataatagcaaaccatcctcaaaacctcttggtgcattatgggagataaatagcaggttccttctagccctgtatttcatgttttgagtatatgaagagtgagaatttcccgtaacttagatcatgaatctaacttagatttcgtaacttagatcatgaatcctgcaaggtttccgcggctagctaccaaggtagaagaagaggttgcctaacaaaaatgctaagagatcctggtgagaagaaggtgggagtagctgcaggagacgttatactttcacttgccttaagtttaattgcatcaaagatgaatccgcagatgcgatgtcaattcgaggcagagagtattggggggcattgaagcaatggggagccaagtaacgtggagaagagtgagagacacacaggtcaggagagaaagaaaccaactctaatactgacaccgaggtttctgatggtcaaaagagttcctgaataaaccaaaagtaagttattaagctctgagacaacccatttaccaggaaagctggggtaggtcttggtttcgcaccttattgtttcaaatgactgatattttgagagaaagaactacagaactatctctgagcacagcagaggagacagttcatcagttgctttcccccacagacagtcacaatattatgtgatgtatttcagaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcaggccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaatcttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatcttatt

SEQ ID NO: 1570 - DNA, 27212 bp, Homo sapiens
gtagagctggctggctgtgcccttccgtccttcattagacgtttgctcttgtcttagatgctcagatggtagtggataggcctgtgacgaaggtgctaccatcgtgagagtaaggtaaggatttgcctctttgttaaggtcagaggggccttttgggaggaaggcctttgattctggagttttctaggctgctgagagtgagatcgggtggccctggggccatggaggtgatcctcgtatgtgagtgtggatggggaaaccatgaagttagtgtaagaggtagcagtccctctgagagccttgccgagggccgtgcagtttccagatctgaaggccattctagcttagactgatgaagtcctaggagcttctgaaatgctgcaagtttaactacttgtataaaggcctcatcctgatcccagtcaaacttgtgaaataatagaagccaaaatttaaatctctactgactttgctgctacagctatcctcccaccaacacacatacccaccaacatacacacttgccaacataaacgcacacacacatacacacaaacacacccatgtggtcctactaattcaattatttattttttaaagaaattaaaaaagactgggcgtggtggctctcgcctgtcatcccagcactttgggaggtcgaggcggtggttcacctgaggtcgggagtttgagaccagcttgaccaacatgaagaaaccccgtctctactaaaaatacaaaattagccgggcatgatggcgcatgcctgtaatcccagctactcgggaggctgaggcaggagaatcgcttgaacctgggaggtggaagttgtggtgagccgagatcgtgccactgcactccagcctgggcaacaagagcgaaactccgtctcaaaaaaaaaaaaaaaaaaaaattaaaaagatacagaacagttcaaaaaacaatataatgggaagactagatagacacaatcagagacctgcacttgtggggttaagaatttacaggtgaagttgcaagtttcattctgtttgaaaatgatgggattatatgttttgctgaggtttggacacctttgctgggttgtttgaatgccgtggctgcagcgccctgttatggacatcatgtgcgtgcagaatggatgtctgtcaggttccggggcagcccgcagtctgaggcagccagcctggattggagggagtggcaatactacctgccggttaggggtttgggcctgagagcgagtggctttcaggttctctcaagcttcggatgagatgcaggtttctgcttccgatggcaaatgcatgttttgctttttagttatcactgcaagagctaggatgctgctagaatattactggaatgattgtgatgagatggaatgtatttacagtttaattgtgacatgtaatacagtggtagaatgggactctggaatgagatgctggggcctagattctagcacttcctttgtgaggctctaaccccctctcctatagtggatttgttaagaacttctgtttttgtggctttgttattataaaattttttgaaatgttgttctctaaaaaagttatgattttatgtttttcttcatgagattctttcactgccttccagctgcaagtagaatgacgtctaaatctttgtgatctgtcactgaagcccttgagtgagacacttaaatctggctgtggctctctctcttactagcttatttccaagccgtgatttttcacaacagaaaaatggggacagtaatagtagtttcttcagaggcttttagtgaaatgaggttaaaaaatatttttatgtttatatggatatatagattacaaacatttatatatcatttatttatatgattattataaacacatatttatatttaaatactttggggcataaatatataaaataataaatatacttatgtaatacaaatagacttatatacatttactatttagcagagattatataaaatatatgtattacatggcaacatattcaaatttacatatgttatatatacatgtggaaaaaaaattgggaaaaggccacaaaatgtgaccaaagaattacttccaaatggcaagtttttaagtaatttttattttctttttatacttctctgtactttctctatgaaacaagtgttacttttactgtttttaggaaccaaaaatacaagtacattgtttaaaaaatactagcttaacaaagtttctagcccataagctagtgcagaaaatctaggtcccataaaacaagaactgccacacgatgtctctccccttacagtgctggatggcccgttgttaatggtgtcataaatcctttgcaagtgactgttttctaggtactatgactagagggatgtgtaacttaagcaaaaaacaaaaaacagaaaaggctgactatcatctgacagtgtatcctggaacacctaggccagagaagaagccacgttagcattttcccttctaaatgtcagttatgatttgatggggaaaccacttaaaaagcattgtcacgttgttgaaaaggtaatgaaatgagtgagatgagatggctatggaggacggagctatgcgccaatcttattatatccaaattcatgtcatctcagccttggattgtattgatttttattatatactgtcagaaaatgctattgaatgtgtaacaagagcctcaaaaaggtttattcattttgacaccataatactacttttaggaaattattctaagaaaataattagaggtattcttaaagatttgcgttttaaagtcatcctaaatgtaatcaggaactggctatgtaaattatagcccatctctaagattaagtgccttacagatattaaaacccatgctgtagaagaaaaactaaagacaggaaagtacttacaatacaagatgtacttaccagtggaaaaatccacttatactacagaaatatgatgtgttcaaatataaggaaaaatgtgtatgcataaaatatttggtaggaaagagtaaaatattactgggcatttatatttggatggtggaattatacataattttaattttcctttttatcttttctgtattgtctaaaatgaatacactaagcattgttatcctcagaaaaaaataattgagggatgggggaaaggaagtcctgctttcatttgattctttggttggttttattctgtaagatgagactttaacagaggttagaatgcattaaaaattgtaaagacagttgacctaatggcactaaacagggttagatctagtttagatcttttccagcatgtgaataagaatggatctttaaataaagattttaactaggtatatgttttagaataagtcatacatgtacatggtaaaaattcaaacagtacaaactgtgcagcaaggtatgggaaataaagcagctctcactgtcacctccacccatcagccttctcacactgcacgcccacatctgtgtgtaattctgcttttctttaacattactgaaggaacttcctgtgcattttttgtcagagctcttctgtgaatacacaaaatatgtactgatcaatacattatgtagatcacgcaggctcaaccacattgatcttcctattctttctagtagccaaatagagttccctggaatatgattaatagcttgcctaaatcttctaatgctgataaacagttgtttctgctctttcgttatttcaaggaatgctaccatgaatagccttatatatggttttgagtatacttgtttaagtgaatgtaggaaaaactcttggaagttaaattgtgggccagtttatgtgaattttatattttgacagagatggctaaattacccacctgtttttttgttttgttttggttttggttttgctttttttttttaagagttggggtcttgctacctggggtcttgccacctggggtcttgcccagggtagacctgaactcctgggccacgttggtttattttactgcattcccagggcctagagcaacgattgacacgtgctagcagtatctattggaaattctggccaacttgcaatagacctgattatttctacactgaacatgtctaagatagctattactattcattcaggaaagcccagacaattatcatgccagcagcctgagacagtagccagtaatagcctggtgtggtagtttgctcctgtagtctcagctactcagcaggctgaggtgggaggatggctctagcctgggaggtggaggttgcaatgagccaagattgcgccctgcactccagcctgggtgacagagtgagaccctgtctcaaaaataaaaataagaataaaaaataaaccagcaaaagtttctgccctcacagagcttccattctagtgagagggtagtttgtcatcaggagggtgacgccggtagggctgggggccagctccctgcagggaacaaacatgatcgcagtggggtgggagtaggggatgagtccccagagcctctgtggtttccatttccacacaaaaaaaccactgctgctgtaatcaggagggggaaaagatttttaaaaattttctttcagggaatggaaggaaaggatatttttgaaagtaagactttgaaaactaaaagttttgggtcacttaaaaactcaaaatctttaggtcactttaaaaatatttaatcttggagctggaggccattattctaggtaattagctgggtgtggtggtgtgtccctgtaatcccaactactaggaggccgaggcaggaggattgcttgaacctgggaggcggaggttgcagtgagccgagatcgcgacactgcactccagcttgggtgacagagcaagactgggtctcaaaagaaaaaaaaaaaacgaaaactaaataccgtatgttctcacttaaaagtgggagctaagctatgaggatgcaaagacatacagagggatataatggactttggggattgatggtggggttgaatgggaggttggtcctaataggtcctagtacgtcccctacttctaagtcttccagtctgtcctttgcactttgaatgttaattccaagttggataatgtcattctcatttttacagtcctttcttagctcctcatcacctccaggacaaagcctaaacccctcgccccatggtaatgcggcccctttgtgacatggtacctggctagagcttcatccctttgtcccatcactctccatcccagacactttgtagttactttattgagctccttgtgcctgcctgaatggacttgaaagttcttacctccatcttttacattaattgtttcctgtaagaattgtgctttctcgcattctccccaaaatcccttccccataggaagcccttctcccaggctaagttaaggtttcttcctctacatccctaccacactctggtcacaaccctctaaccattggcttgttttttttgttttttgtgttttttttttttttgtgagacggagtcttgccctgtcacccaggctggagtgcagtggtgcaatctccgctcactgcaacctccacctcctgggttcaagcgattctcctgccccagcctcctgagtagctgggattacaggcacgtgcctccacacctggctaatttttgcacttttagtagagacggggtttcaccatgttagtcaggctggtctcaaactcctgacctcgtgatccgcctgccttggcctcccaaagtgttgggattagaggcgtgagccaccgcgcccagcccattggcttgtttgtatgtctaccttcctaaacagtaagagggaacttgtctggtgttctttttttctctcctgtgctgacagcacaatgaccagtacctagtagttgcagtagcctttgatgaacaagccagcaaatggtacttttcttccttatctgaacataccatttattttgacttagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacaggtgggtggaaactcccattgtgggactgggaggtgtgggttgaatggacagcctctgagctgattggggcttttttttgtggtaccctgcctagtgcctgggaacccagcagtgccacaattctaagcttctacagaaagacagtagtgccttgggtggtcctgctaaaggctgtaaaacttagcttctccccaccctagagagagtgggtaaacaaaggcgtgagagagaaaccacattcagtatcacttgggaggctttgggaagatgtcccaccggagccagattaagaaatttaggggccttatatataattctatagaaatgctaagaccataaaataaaaatttatttttcaaagtgaaacattacttagaggtatgctgaagttataatagagtttttctaagtgttctcatttttttcctctcttatcttgatgcctctcgatatccagattgtgtgcttactttgcccatccattgagtaaagcatcatggcttcccaccctgaaatccccctcccacctgcttgcggatggctatgaaaattttcaatgagatttaagggttttctgccacacttaaagactcgaatgactaagttctttacggagctgtaagccgctggcctggcacatacagctaggcagtctccaccgaggctgcccagttcctgtgagcccggctgtatgacagttctaagcttctataggaagacagtggcacgttgggtcatcctgccaaaggctgtaaaactcagcttctccccaccctagggagagtgggtaaccaaaggtgtgagagagaaaccccattcagttacaacttcatgatgctgtgacaagactttaaaaacagaaacacattgtcactttctctctttcaacatctcctattatcggacactacttaaagcaattttagctttgctttcaggaaacttctactgaagtcttcgttctgggcccatttcattgtctctgtttgcttgttgataactatggcatgtgagatggaaagggttcacaaccagggctgacagctgctgtcctctgatggctcagcccatgaatgctctggtctttctattctcagagactattttttgttttgaggcttgactattttttgttttgttttgttttgtttttgagacggagtctcgcttcatcacccaggctagagtgcagtggcatgatctcggctcactgcaacatctacctccagggttcaagtgattcttctgcctcagcctcctgagtagctgggattacaggtgtgtgccaccatgcccagctaattttgtatttttagtaggacggagttccaccatgttggccaggctggtctcgaactcctgaccttaagttatccaccagccttgacctctcaaagtgctgggattataggtgtgagccaccatgcccagccaaggcttgaccattttgattttaagtgaaaaaagagatattctgggccgggtgaggtggctcacgcctgtaatcccagcactttgggatgctgaggagagctgatcacctgaggtcaggagttcaagactagcctggccaacatggtgaaacctcatctctactaaaaatacaaaaattagctgggtgtggcggctcacgcctgtaatcccagctacttgggaggctgaggcaggagaattgcttgaacccaggaggtggaggttgcagtaagctgagattatgccattgcactccagcctgggcaacaagagtgaaactctgtctcaaaaaaaaaaagaaagagatattctgggtatataagtttcctagggctgctgtaacaaagtaacacaaactagcaggtttaaaacagtttttaaaatgtgttttcacagttctggaggcctgagtcagaagtcaagatgccaacagtgttggttcccttttaagaggctccgaggaataatctttttcatgcctttccctgcttcgggtgggtggaggaatcctcagtgctccttgtcttgtagatgaggcacagcagtctctgcctatgttcccttctctgtgtctaaatctccctcttatgagacagtcactggattaggaattagggcccacctaatccagtatggcctcatctttgtgtgtgtgtgtgtgtgtgtgtgtgtgtgtgtgtgtgtgtgtgtgtgagacagtgtctcactacatcgcccaagctggagtgcagtggcatgatctcggctcagtgcaacctccacctcctgggttcaagcaatcctcccacctcagcctcccaagtagctgggactacaggcacccgccaccatgtctggctaatttttgtatttttttgtagagatggagtttcaaaatgttgcccaggctagtcttgaactcctgggctcatgcaatctgcccacctcagcctcccaagttctgggattacgggcatgagccactgcgcctggccagcatgacctcatcttaatgagattttatctgcaaacgtcctgggtccacataaggtcgcattctcatattccagatagacatgaattttggggaagaggggagaacactattcaaccagtacactagatagctttggtttactagcattgtgaagtctttataaggcacttattcattaaggcgccagttagtcctaaaaacccacagccccagaacaaggaaagccgaggggggtctcatcttgtgcccaccatcttggtcctttgaaggttccacttctgccgcatgagctgggctgaagcaaacagccagtgccagacacagtctgtacctttctggcggagggtcgatcatctattaataaggcaggatctctcttaaaatctttaatgtattggcttagagataaaagggtccgggcaatcctgacttactgcttgttcattatcattgaatactagccagaagctaataaatatgctagggtgaccacttaccattataagaaaacactagacattttattttccagttataattgctacctataaaataaagatcttataaactattcaggttcattactaaatggtgatggtacaagaaagcctataggcttcaataatgaggaaagcaaaagggtaaataccttgtaataaaggtgaaagagtcagagtagctttggattagatccaattttggccaaactgaaagctttagataaacacttctagggtagagagtccatgagaagggggataaggcagatggtaatactgagtaatttctgtttctacgccatttttattttcagaattttacttttctaattaaattttaaagtcaacgtgtttttgtattaaaattattttcctttacaccatagtattgaaaggtttgctgacttctaaaacattcctttgttcacctattcgacaagcatattccaagagcctaaatgtgccaatcacataaatgtgataggcatagattaggaaatagtaacacctatcactcattgagcacttagtgtgttgccaaagactgatttaagtacttcacataaacttatttgtgtaaccctcgaaaccttcctatgatgtggttacggataattatcttcagtctatggacgaggaaaaaatgtgtaacatgtctaaagttaacactgctcaaagatagtggaaccaaggctccaacaccaatagcctgggtccgctgagctcaatcattgcacctcacaaccctctgggtttatgaaaataaaaagggtacggacctggccactaggggacttgaacagtttctaaacagacaattattttctgtttttatttttagtgtggtggcatgatcacagctcactgcagcctcaaccttctgggctcaagtgatcctctcacctcagcttctggagtagctgggaccacaggtgcatgccaccacacccggctaatttttaaatgtttttggtagagatggggtcttgctatgttgcccaggctggtctcaaacccctgggctcaagtgatcctccttctgccttggcctcctaatgcgctggaattagaggcatgaaccactgcaccaggccaacagacaattatgtgtgttatcgttttggggttactaagtcatagtggagtgaatgcagctttgaggatgctcaggcaatgcttgagctgattgttcatggatgggcctctgcagatagacaaggggatggggtgtagcggcaccacagaaaggggtgagggcagggcagctgggtgtgtttggcttcaggtcctttcgtgtttgcggtctggtctgtgatagggatgtattcggagactttgtattccagaaccgaatgcttggccgtcttactgaagataatgactgggagaatactgaccagttttgattagggaagtcatgagccaatgtgcattttgaaaagcataatttccaaaaggcaaagcattttgctattgcaacaaaatctccattttacagaaaaaaaaaaaggaaaacaagatttactcaactgaaataaactgaaagaaaagttgatagaactttaaattgttaagggtgggaaagtcggggaggagccagtagacttctgtgtcaccacaccagcctctttccaagggctcaactcataaaccatgccattaactggctttatgttgaagggaggcctttggaatcaagcccactgtgactccatatatcaaatgggaaattatttgggaaaagatttctaaagtgtctccatttcccaccacagggtcatgctctatcagatttcagaagaagtgagcagatcagaattgaggtcttttaagtttcttttgcaagaggaaatctccaaatgcaaactggatgatgacatggtaagacctggtatcttactgagatttagtcctgagacttggttagccagggggcatttctgagaccaaagagaggggtattttggtaaaagcaacctggattctcactttttaactagaagaagaaagttgtcagcacgagtgttacagatgtgattcctttagaccgaagtgctgctcatgttaattattgggagcaaggcagagtcagaggccgggagaaggaggctgtgcagatgcagcccagacccggcagagctgggaaagactgcggtgggtctgagatatttcctccacttctgcagtccccgaaacaacctgggacctgaaactctgtgtgtatattgtgtctgtgtgttgtgtgtgtatttccgtgtctgtgtgtgcctttctctgtgtatagtgtgtgtctgtatttgtgtgtgatatgtgtatctctgtgtgtctctgtataagtggtgtgtgtgtctgtgtatctctgtgtgtgtgttctctgtgtggtatgtgtgtctgtgtgttgtgtagtgtgtattgtatttatgcccctgtgtgtgtatcactgagtatactctgtgtgtgttgtatctgtgtgtgtatgtgcatgtggtgtctgtgtgtgtgtgtctgtgtgtctgtatgtactcaggtctggagaggcaatgctgggggtgaggctgttccccagggtgtcaccatgatgaccgggctgctgtctcaggttgtttcacagtccccaagtaatgcattcgcaggagatttgagcacagggcctggggactgggtgacatctgacatggcttctcctttatcctctcacttctgtctttctgggccagaaaacatggaatcgcttccctagtagcctgctggctgtgagagaccagcagaaactgtcagaaacttgggaagcaagggcaggtccttggttggagaaattggaaattaaaaaaaaaaatctaatctaaaaaccagtagggctcaatccagattcccaactttatttctcctcctcttagaacctgctggatattttcatagagatggagaagagggtcatcctgggagaaggaaagttggacatcctgaaaagagtctgtgcccaaatcaacaagagcctgctgaagataatcaacgactatgaagaattcagcaaaggtagaaacaacctgacagccgggaatcggcaaaacctactctaaaattgaaactgacaaatcgctccatatcacagttgtttctaatcaaatattgtttggggtttccccttttaattcagagagaagcagcagccttgaaggaagtcctgatgaattttcaaatggtaatgcttggagatacattttcaagatttagttaatttactatctggtacctgcatgtgtcctccccacagccttctaccacatgcacatcttaacgtgcctgctctactttttctttttttttttttttttgtgagacagttttactttgtttcccaggctggagagcagtggcaccatctcggctcactgcaatctccgcctcccaggttcaagcaattctcctgcctcagcctcctgagaagctgggattacaggtgcgtgcaccaccacgcctagctaattttgtatttttattagagatggggttttactatattggcctggctagtctcaaactcctgacctcaggtggtctgcctgccttggcctcccaaagtgctgggattacaggcatgagccactgcgcccggccgcacctgctctcctaagacctgtagcccaagctggcaagtttgaaataggtgcagagttagtcagtagtaagtaatttaacatcattttttctatgtggctttttttttctccttgacgtgctgctcatgttatgcactgagtagctggatttaaattatgtttcataattttcttggttaagtcactttctctttcaacaccttctacactaagtcactcctttcaacttcctttcactttttctacctgataagcgaggctgaaccaagagagagagctctcaacgatctccttcaaaattttgattaatcaaatagtctttttttttttttgagacagtgtctcactttgtcccccaggctagaatgcagtgatgcaatcttggctcacaacagcctcgacctcctggactcagatgatcctcttgcctcaaccccctgagtagctgggaccacaggcacaagccaccatgcccggctaatttttgtatgtcttgtagagatggggtttcgctatgttgcccaggctgatcttgaactcctgagctcaagccatccacctacctgggcctcccaaagtgctgggactataggcaattaataaagtattctttctgattagaaaaattatatacactaattgaagattattttaaattcagagaaatttttacaagtccaagaacaccatcactccattcatattatgaatatttttattgtatttttacgttggctctttgtggtgtgtgtgtgtaaaatacattttggatcactcaaatgtattttaaagattaatgtctatgcaggctgtccttccctttcccctctgcctgctgagcctaaggccttaagaatactttaaggagtaaagtactaaatcattaattcatcctgagctagtggctttattaatgagtatctcacaaataccacaaaaattcaacctggccatgtggagcaatataaaattatggcatttcttggtatgtttttctctttggcgaggagacaacttgatcttgtgtttccagaagcatgttaattgccctgcttgcagaatctctctggcttgaaaggagattatattcatggcagtctgtgaattttcattttatttcatttatttatttgagacagagtctcactctgttgcccaggctggagtgcagtagtgcgatctcagctcactgcaaccactacctcccaagttcaagtgattctcctgcctcagcctcctgagtagctgggactacaggtggctaccaccacgcccggctaatttttttgtacttttagtagagacagggtttcaccatgttggccaggctggtcttgaactcctgacctcaagtgatctgcccatcttggcctcccaaagtgctgggattaccggcgtgagcccctgttcccagcttgaattttcatcttaaaaaagaccttatgttgtcctatgtgctacatatttcattaccagtgtacctttcctgccatgtctcattctagatgtgtctcttcgttgtttgcaggggaggagttgtgtggggtaatgacaatctcggactctccaagagaacaggatagtgaatcacaggtagacggaaacctccaaatccttttttttacattacagattctagttatttaatttgttagcttttttttttttttgctgccagataaactgacaaggggcagaaacttactgaaaattttgagaactgtagaaaaaattcacacaaaaaaagttaaaaatgtgacttaatttttaaaatgtgactccttcagttttctatacatttgaattttattttaagacccgagatgaagatactggaatagttggagggtggagggggtaataagcctcctaccaaatcttctagcagccgtgccagcctggatgggggagtggtttggagaaagagtctagcaggaatggaaaaagccaagccttttcctttagcttaatgtttcaaaaatgcttctccttggtgatgaggtgtaagcagcaaactctcacaatctagccatctctgtgtttttgtctcagtgaaccagcagaaacatgtaatttttaggcataataacttctctttatgtaatcaacaatccaccaaatacatcctgacttattagacgatctgctcctcctcatggtaggaagaagaggaaatcctgaatatctgaagtaggcttgagagagattattcactagtgtgggctcctgagaaaattaccagacctctttcatctgaaagtcaaggattaacccaagtaatgtggtactttctaaacagtatagcatgctacaagcattgtccccactgaagagctaaaaacactgtcttaatatcttagtaaatcttagtatctttttccttttttaatgttttattgagacaggggtcttgctacgttgccaagccaggtctcgaactcctggcctcaagcaatcctcctgccttggcctcccaaagtctgggattataggtactagccaccgtgcctggccaaatcttagtgtcttagtatctcagtaaatacacttaatatgcttaataaatacttagaacacaactgtaaataataaaaacttaacatacttggtacaaacttaatcaaatatttaatatcttagagttaacatattaagataacaggttatttgcccaaagtcataaggtgaagtagaggcaggaattgggcttcctagcctggagtccttttctccacctcaaggggctacgcagacctccaactaaatgctgagtttctcggtactgaaacagccctaggagaatgaataggacacagcgccatccctggccagtactatcaggtactacagtttggataccataacctacagtgtagccaggacctccctgaccagcccatctcttcccagcagccaccgtggtcctgagagctgggttaagccatcacctttaaaatcctgggaccacactgtgcaatgcatgaatgggagaccctcagctgttagccacgaagcacagatgagttcagtagacagccaagagaatcacaagtcatggcgtgggggcagccaaagacattcattcattcagtgactcttgattgagctctcacaagttaatacaccgtagtccctggcacagatgttatgaacctcaaggagtcttctgtatagtatgggaagcagaaatgagaacaaacaataatacaatgtgatgacaacaatattaatatatgtgcaaagtgctcaggaggcccaggtattgggacactgactttacaacgatggggcagaagtctgagaggtcctgtgtgaaggaaataggtagaaactagttcttcgaggaaacgaccccgagttggggtggtgcaatggaaagcaagtcctcttactagggagttgtttgtttacatctctagtgtttgacccacagagtcagctcctgggttgggtttttgttttccagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggtacagtagaacccaaaagagaaaagtaaaatatttcttatgcctatttttttttaaatcaaaagggagagaacaaaagctataccaaaagggccatgtttcaagaaaatggatttaaacatatttccctgtggaggtaaagaacattcttatacatttatcagtttcctgctttttttaaaaattaattttttaaataaaagtaatgtatgtataaatataaaatatcaaatcttactaaaagacataatgaaaagcagtaataagctttgttttgaattcagctaaatgcatagcgcttctgtggaatgtattaggcgatgaaattgctgtggtatcaaagttcttatagaggctgcatttttacaggttgggctgttaagtgcagcagaaattgtgggttcttaacagaaatagcattttcaagtattaaatattaaactggttagcaattcttttgctcagccaaattaagctaagatcaagaacttacaagttaaatgaaaaaacaatttgtagtatgtgaatataaaaagtgactacaacaacaaaaaataaaaatcatccatcaccattgagagattaataattttgatttgatcaaagaacttttggaaatagtgtttatcaggcataacatcaattattgatttgttttgcaaatggaggtaagtttagaaaattaatgtagactgattataatcatcaggagtctgtaatggcccctattaacattttttttttttttttgagacaaagtctcactctgttgcccaggctggagtgcagtggtgtgatctcagctcactgcagcctccacctccctggttcaagtgattctcctgcctcagcctcccaagtagctgggactacaggcacacaccaccacacatggctaatttttgtatttttagtagagatggggttttgccatattggccaggctggtcttgaactcctgacctcaagtgatccgcctgcctcggcctcccaaagtgctggaattacaggtgtcagccacctgtacctggtccctgctaacatttgatttgtttatttaagcaaatctaagcctttaaaaaggcacagagattaagtccattgattacatcattcgtcactatgcgcttggtattgaaaaaaatattttggacccttgatttgtattcttttaaaattaaaacatttctattaaaataacatttgcttctatttctggcagctcattttcttataactggcccatgattgactagtctctggtaggcattcgagtctgtgtgtcctgctttttctgttcctgttcttatgttttatgctgaatgagtaaaagtaggagacccagctgcagaagtcatttctcctgagagactcccttctgtcctgcttcagtgccttcagacttgctttacagtcatttttttaatcaacattccacatttccaaaggatcagaatttttttcacagaaccaacacactgtattagtcttgccaaagtgcttccaaatcaacaagggcctattgcatttcagttatttttttctattcctaatgctagactgtattttttcttttttttttttttgaggcagagtctcactctgttgcccaggctgcagtgcaataacatgatcttggctcaccgcaacctctgcctcccaggttcaagtgattctcctgcctcagcctcccaagtagctgggattacaggcatgtgccaccatacccagttaattgtatttagtagagatggggtttcaccatgttggtcaggctgttcttgaactcctgacctcaggtgatccactcgcctcggcctaccaaagtgctgggattacaggtgtgagccactgcacctggctgagactgccttttgactgatgacttatgtttagctctgatgtgctgacagggacaaaatgctggagaaggaataaaaaaggaataatccaacaaggatcaagagaacaggaaaggagacaatagctaatgaaaggtttccaacaatttgggggagttgaaaaaaaagagtcgaggtaattgacttaacagagaaagctacaacctcactgattacagaggggaacacggaaaggaggcaagcctatttacccccacagaatcctggaaaaattcagcaattggaagtacaaagtgtaggtgaggcaatgagcagaaaacaggaagattctttgaaagcctatataagcctatacaatcctctgattcataccttcctctcatagagccagcaactattcttattctaccatcataaggaacaggaagtttgttttctcataaaattgaaccagagaggctctacacttcggtgtgccaggcccagcaaaggaagcaatgaagcattttactgaacacagagagactgaagaaaacctgctggtggcatggagtcagatctctaaaccaacttggttccaagacactggcagcagatacagacttacctctggagaagctgaaagctctagctaaaatacatacagataatgacatctggaggtttcctaatgaaatgatcaggtccccaaccaatcatcttgctatgaaatccctcagagaacaagccacatccacaaacacagagctttcagtcgactttttaatggactaattagtcaatttatgaatggacaaccaaaggtcagcaggcatttgaagaaaggctctaatacgaaagagaggtagcttggtacggtggcgtgaaaatccagcactttgggaggccgaggcaggcgaatcgcctgaggtcaggagttcaagcccagcctgaccaacatggtgaaaccccatctctactaaaaatacaaaaattagccaggcatggtggcaggtgcctgtaaccccagctactacagaggctgaggcagaagaatcacttgaacctgggaggtggaagttgcagtgagctgagatcgtaccactgcactccagcctgggtgacagagcaagactccatctcaaataaataaataaattactagataaatgagaggcaatgcaaacaacaagaaaaacatgaaacagaatatgaatgaaaaaaagataatgttgagaaaaaagcaaccttttttaatgcttaatattggtatttagtattcttagagagttagttaaaggtccatgaaagaacaagatgttatgaaaaagggacagaacaagcaagtctccttgaaaattaaaaatttgagcaccaaaatgaaaaattcaataaagtagaagataaagtctaaggaagtaggataaaaagacaaaaatagaaaataggagtgaaagataagaaaatttgaagctaaatcaaggatgtccaatttttgacaataagagttccagaaagaaaggacagagaaaggggaaatggaactttccaagaacgaaatgacgcaatctccagattgaaagggtataatggattaagattcacttccaaacatatcataccctagaagcttctggaaagagaaaaaagtaagccaaatatgtaaagtatcagaaatggaaagtcttctctctagcaacactgaaagctaaaagactgtgaagaaaggccttcagaattctgaggaaaaatgcttttggaaatagaactctataaactaaagactcatacaggggctcaaaaaatgtacttctcatggttatgctccagcaaaggaaactgataagaaagaggaagtcatagatggaggaaacagggaacctactatggaagagacagagagatgtcccaggagaagagaaattcatctggcctatggaacagccagttggtattacagcagaaggatgcagtgctctggatggaaagttttccaggaagaaataaaaatgagtcagacaagtagcctgaaaatgttgaaagattttggccagatccattgagcacttggagaaaaaacagtgttaagcatataggaaacaaagcagatgaaaaaataatacaattacaagttccaggaaaggcaaaaaggttaataagaaaggaaacataatgaaagaacattatgtttacatagtcttaataatagaaatattactatgggccggaggtggtggctcatgcctacaatcccagcactttgggaggccaaggtgggtgggtcacttgaggctgggagtttgtgaccaacctggctaacatggcgaaaccctgtctctactaaaaatacaaaaattagctgggtgtggtggtgcgtgcctgtagtcccacctgcttgggaggctgaggcaggagaattgcttgaacttggggggcagaagttgcagtgagctgagattgtgacactgcactgtagcctgggtgacagagtgagaccttttctaaaaaaaattaaaaaaataaaaatattactatggattcaaccaaaacttgtaaataattgagtaagagcccaaatgcttattctccataataagaactcaatgcgaaagtctaaaatttataaatgagtaattagcagtgtacccaaattcattacaaaatggagctcaatgtggaaaaaagtggttaaaaactgaaagtggttgccttcatggaatgtgactaggtaatggggagggatagagaggggataaccttttgtataaggtcttctagttctatcttattaattcatatcttttattttgctatacataaataattttgagaaggtttaggataaaataagttggatcttttattcaaaaattgttttgtttttttctgattatgtaaataatataatcatttttaaaattggttcagtagtaagcctaaatgatagcttacccatcttgtaaactagtttactagagaaaacagaccaacaataacactctctcctttctcatttgcttcagggtttgagaatgtttttagctggtggcaataaatattagaagcctgcagaatccagctacgaatatagagggttttgctcttgaatttctggttcaaattcttttttttttttttttttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttaagattagggagtggtgatgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcgtggccgggcagaggggctcctcacttcccagtaggggcggcccggcagaagcgcccctcacctcccagatggggcggctggccgggcggggggctgacccccccaccgccctcccggacggggcggctggccaggcagaggggctcctcacttcccagtaggggcggccgggcagaggcgcccctcacctcctggatagggcggctggccgggcggggggctgttccccccacctccctcccggatggggcggctggccgggcagaggggtcctcacttcccagtaggggcggcccggcagaggcgcccctcacctcccggacggggcagccggccggaaggggggctgacccccccacctccctcccggacggggcggctggccgggcagaggggctcctcacttcccagtaggggcggccgggcagaggcgcccctcacctcccggacggggcggctggccaggcagggggctgatccccccacctccctcccggacggggcggctggccgggcggggggctgaccccccccacctccctcccggacggggcggctggccgggcagggggctgaccccccctcccccctcccggacggggcggctggccgggcggggggctgacccccccacctccctcctgggcggggcggctggccgggcagaggggctcctcacttcccagtaggggcggccgggcagaggcgcccctcacctcctggacggggcggctggccaggcggggggctgaccccccacctccctcccggactgggcggctggccgggcggggggttgaacccccacctccctcctggacggggcgactggccgggcagaggggctcctcacttcccagtaggggcggccgggcagaggcgcccctcacctcccggacggggcggctggccaggcggggggctgaccccccacctccctcccggactgggcggctggccgggcggggggttgacccccccacctccctcctggacggggcgactggccgggcagaggggctcctcacttcccagtaggggcggccgggcagaggagcccctcacctcccggacggggcggctggccgggcggggggctgacccccccacctccctcccggacggggcggctggccgggcagaggggtcctcacttcccagtaggggcggccgggcagaggcgcccctcacctcccggacggggcggatggccgaccacccccccccgcctccctcccggacggggcggctggccgggcagaggggctcctcacttcccagtaggggcggccgggcagaggagcccctcacctcccggacggggcggctggccgggcggggggctgaccccccccacctccctcccggacggggtggctgccgggcggagacgctcctcacttcccagacggggtggttgccagacggaggggctcctcacttctcagacggggcggttgccaggcagagggtttcctcacttctcagacggagcggccgggcagagacactcctcacctcccagacagggttgcggcccagcagaggcgctcctcacatcccagacagggcggtggggcagaggtgctccccacatctcagacgatgggcggccgggcagagacgctcctcacttcctagatgggatggcggcggggaagaggcgcttctcgcttcctagatgggatggcggccgggcagagacgctcctcactttccacactgggcagccaggcagaggggctcctcatatcccagacgatgggtggccaagcagagacgctcctcacttcccagacggcgtggcggccgggcagaggctgcaatctcggctctttgggaggccaaggcaggcggctgggaggtggttgtagcaagccgagatcacgccactgcactccagcctgggcaccattgagcactgagtgaacgagactccatctgcaatcccggcacctcgggaggccgaggctggcggatcactcgcggttaggagctggagaccagcccggccaacacagcgaaaccccatctccaccaaaaaaaaaacgaaaaccagtcaggcgtggcggcgcgcgcctgcaatcgcaggcactcggcaggctgaggcaggagaatcaggcagggaggttgcagtgagccgagatggcagcagtaccgtccagctttggctcggcatgagagggagagggagacggggagagggagagggagagggagacggggagagggagagggagaggggtcaaattcttatctatcaatgttatgcccactgtgctctccagctgtggtctgtgaattactgtggtataacgtgactgttcaaatttcacttttcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcggtaagttttgcctactcagccctcctcactgttacactaccttccccccctactccatcacactactatctactcatattcagagcctattagaaagtgctatgtgatttagatcacattaacaggtcagagaactgtccaaggggagtggtttccgttcaactctaaatgtctagctgtagatcacatagctgcatttcccaggtcagttacaaagtgggagagtggcaagtgttaacatccttagtttatagatggaaaagctgagatgctttattcctttattcagcacctcaaaggacaatcagggtatcacagagcaggaaaggataggaaagtcatatactccagctctctgtctttaggccaaaacatgactgagccaattcaactagttttggaaatcttccaagaaggcagtaacccaattcaatgtttaaacatcctccaactctgtcaaaagttctataatagcaaaccatcctcaaaacctcttggtgcattatgggagataaatagcaggttccttctagccctgtatttcatgttttgagtatatgaagagtgagaatttcccgtaacttagatcatgaatctaacttagatttcgtaacttagatcatgaatcctgcaaggtttccgcggctagctaccaaggtagaagaagaggttgcctaacaaaaatgctaagagatcctggtgagaagaaggtgggagtagctgcaggagacgttatactttcacttgccttaagtttaattgcatcaaagatgaatccgcagatgcgatgtcaattcgaggcagagagtattggggggcattgaagcaatggggagccaagtaacgtggagaagagtgagagacacacaggtcaggagagaaagaaaccaactctaatactgacaccgaggtttctgatggtcaaaagagttcctgaataaaccaaaagtaagttattaagctctgagacaacccatttaccaggaaagctggggtaggtcttggtttcgcaccttattgtttcaaatgactgatattttgagagaaagaactacagaactatctctgagcacagcagaggagacagttcatcagttgctttcccccacagacagtcacaatattatgtgatgtatttcagaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcaggccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaatcttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatcttatt

SEQ ID NO: 1571 - DNA, 2513 bp, Homo sapiens
atgggcaaaggcttccctggaatctcccacactgtctgctccctataaaaggcaggcagatgggccagaggagcagagaggctgagaccaacccagaaaccaccacctctcacgccaaagctcacaccttcagcctccaacatgaaggtctccgcagcacttctgtggctgctgctcatagcagctgccttcagcccccaggggctcgctgggccaggtaagccccccaactccttacaggaaaggtaaggtaaccacctccagagctactaggtcagcaagaatctttacagactcactgcaaattctccatttgaaaaatagggaaacaggttttgtgggtggacaagaaatgcctcaacctcacatccagtcactggaagagccagaactagaaagctcccgagtcttttccccacattcaagagggttgctgggtgcatccatacccagctatccttacagtgtttgggaatggggaatggctctgtcttactgtgggcatggtgggcatttttggcagtgggagagaaggaaaatctgttgattagaagctcagtatgttaattcgactccaggacagctttcagagacagtggctaagagaagaacgaggtcccagggggatctcttgaggtgacttattttgacactctttgggaaagttatctaggagatttgttccataactcattttcccatactctggtgacaaatttactgagtgtatcggtcccactgagccagtgcatagcatggtaacaaacagttctaaattatcaatgacttaacagaattaactaaattaacaaaagttactttctcacttgtactaaatatctataatgtatgggctcaggcttctgcattttatactcaggattctagactgatggagaagttgcccatgtgggggaacattgatggatactgtgataaagcagaagaaagctctcaggagtcttgcataggcaatgcactgtggctcaaaaatgacacccatcactttgtctccttctttattgatcaaaactaattaatgcctccaaccaaacaaaagtggccaagaaatgcaagtctaccttgtgtctcaaaacagaggatggagaatatttggtgaaaattaccatgaccatcacatggccacgtaggtctttataatgacagagctagcatttgtcacattgaccaagctttgtccatacactctacagtaatgatgagtcctcagtgcacaggggaggatgctgaagacacaggacagcatcctccagacacataagacttcagagcagagggattctccctccacctctcgcaattccttgctttctcctaacttcctttacaaagtcatgcttggaaatgtctatgtatcatcatgtggctcatttttttctctgttcattttttttccccaaaattcagcttctgtcccaaccacctgctgctttaacctggccaataggaagataccccttcagcgactagagagctacaggagaatcaccagtggcaaatgtccccagaaagctgtgatgtaagtaaataaagttcaccctcccctagacaaaaaaataatgtctagggcacagagtcaagaactgtgtcacagttgctgggagtcatagactctgatagtttgacctctatggtccaattcattaattttcacaagtgagtgttcactcccagctccctgcctgggagattgctgtagtcatatcaatttcttcaagtcaagagcaaagatggttttactgggcctttaagagcagcaactaacccaagagtctcatccttcctcctctccgtagcaaccctttgtccaggggcagatggtccttaaatatttagggtcaaatgggcagaattttcaaaaacaatccttccaattgcatcctgtatctcccacagcttcaagaccaaactggccaaggatatctgtgccgaccccaagaagaagtgggtgcaggattccatgaagtatctggaccaaaaatctccaactccaaagccataaataatcaccatttttgaaaccaaaccagagcctgagtgttgcctaatttgttttcccttcttacaatgcattctgaggtaacctcattatcagtccaaagggcatgggttttattatatatatatatttttttttttaaaaaaaaaacgtattgcatttaatttattgaggctttaaaacttatcctccatgaatatcagttatttttaaactgtaaagctttgtgcagattctttaccccctgggagccccaattcgatcccctgtcacgtgtgggcaatgttccccctctcctctcttcctccctggaatcttgtaaaggtcctggcaaagatgatcagtatgaaaatgtcattgttcttgtgaacccaaagtgtgactcattaaatggaagtaaatgttgttttaggaatacataaagtatgtgcatattttattatagtcactagttgtaatttttttgtgggaaatccacactgagctgaggggg

SEQ ID NO: 1572 - DNA, 1925 bp, Homo sapiens
gaggaaccgagaggctgagactaacccagaaacatccaattctcaaactgaagctcgcactctcgcctccagcatgaaagtctctgccgcccttctgtgcctgctgctcatagcagccaccttcattccccaagggctcgctcagccaggtaaggccccctcttcttctccttgaaccacattgtcttctctctgagttatcatggaccatccaagcagacgtggtacccacagtcttgctttaacgctacttttccaagataaggtgactcagaaaaggacaaggggtgagcccaaccacacagctgctgctcggcagagcctgaactagaattccagctgtgaaccccaaatccagctccttccaggattccagctctgggaacacactcagcgcagttactcccccagctgcttccagcagagtttggggatcagggtaatcaaagagagggtgggtgtgtaggctgtttccagacacgctggagacccagaatctggtctgtgcttcattcaccttagcttccagagacggtgactctgcagaggtaatgagtatcagggaaactcatgaccaggcatagcctattcagagtctaaaaggaggctcatagtggggctccccagctgatcttccctggtgctgatcatctggattattggtccgtcttaatgacacttgtaggcattatctagctttaacagctcctccttctctctgtccattatcaatgttatatacccattttacagcataggaaactgagtcattgggtcaaagatcacattctagctctgaggtataggcagaagcactgggatttaatgagctctttgtcttctcctgcctgccttttgctttttcctcatgactcttttctgctcttaagatcagaataatccagttcatcctaaaatgctttttctttgtggtttattttccagatgcaatcaatgccccagtcacctgctgttataacttcaccaataggaagatctcagtgcagaggctcgcgagctatagaagaatcaccagcagcaagtgtcccaaagaagctgtgatgtgagttcagcacaccaaccttccctggcctgaagttcttccttgtggagcaagggacaagcctcataaacctagagtcagagagtgcactatttaacttaatgtacaaaggttcccaatgggaaaactgaggcaccaagggaaaaagtgaaccccaacatcactctccacctgggtgcctattcagaacaccccaatttctttagcttgaagtcaggatggctccacctggacacctataggagcagtttgccctgggttccctccttccacctgcgttcctcctctagctcccatggcagccctttggtgcagaatgggctgcacttctagaccaaaactgcaaaggaacttcatctaactctgtcctccctccccacagcttcaagaccattgtggccaaggagatctgtgctgaccccaagcagaagtgggttcaggattccatggaccacctggacaagcaaacccaaactccgaagacttgaacactcactccacaacccaagaatctgcagctaacttattttcccctagctttccccagacaccctgttttattttattataatgaattttgtttgttgatgtgaaacattatgccttaagtaatgttaattcttatttaagttattgatgttttaagtttatctttcatggtactagtgttttttagatacagagacttggggaaattgcttttcctcttgaaccacagttctacccctgggatgttttgagggtctttgcaagaatcattaatacaaagaattttttttaacattccaatgcattgctaaaatattattgtggaaatgaatattttgtaactattacaccaaataaatatatttttgtacaa

SEQ ID NO: 1573 - DNA, 8882 bp, Homo sapiens
ttatggttgcattgagaactttaatggtaagccgatttttcatgtttgccagtaagctcctgtgaggggttgagacggcggaagcttaagagtgcagtgttcctcccctccttgcctctagaggcatgctgacttccttcctggtcacagagccctggcaaagccaaggcaaagccagagctcagaacctagagacttccttttgacaaagcagcgcctcagaagctcttctaggctttagttggggaagctttttgttgttgttgttgtgacggagtctcactttgtcacccaggctggagtgaagtggcacaatctcagctcactgcagcctccacctcctgggttcaaacaattttcctgccttagcctcccgagtagctgggattacaggcgtgggccaccacgcccggctaatttttgtatttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagatggggtttcatcatgttggccaggctggtctcgaactcctgacctcaagtgatccacccaccttggcctcccaaagtgctgggattacaggcgtgagccaccacgtccagcctggggaaggtttttgtaactgctgctgtgtggtagaatctgggcccttcaaggagcgggtggggtaggatagtgaggggaagcctcccaagctaggacaagagcaagcagaaacaggcaaatttgtgtaagttcaggttcaaggactctccatcctagctcatctccaaagagttgatgtactcccgaacccatttcttctctgggttggcacacacttggcggttctttcgggtgacaaagctgtgggagaggagaagaagagggaggatgagaccttgtcagtaccgggacagccagtttgggggatgaagtggattaaggtataaagggaaattatgatgatatcggggtagggcatatttggagctccataagattttatttgtggcttttaaggagagaacatttcctcatctgttggatcaaagggctccaagccagaaacaaatttgtgtgcattttaatcgccttcacacaaatgcatgtagcctgaaaagctaagaggatacggagccttgaagcccagggctgagcctgccaatcactagacttttctcagcacttcctctgctccaggccttgtgctgggtgcttaagatgcagagagaataaggtgtccctcaagaactgagtcatgattgaataagtgggagacaagaagttctttttttttttattttttgagatggagtcttgctctgtcacccaggctggagtgcaagtggcacgatctcagctcactgcaactttcgcctcccgggttcaagcggttctcctgccttagtctcccaagtagttgagactactggcgcccgccaccatgcccagctaatttttgtatttttagtaaagatggggttttaccatgttggccaggatggtctcaaactcctaacctcaggtgatccacccaccttggcctcccaaagtgttgggattacaggcgtgagccacggcgcctggcctctttttttttttcctttgagacggagtctcactgtcacccaggctggagtgcagtggcacgatctcagctcactgcaagttccacctcccgggttcacgccattctcctgcttcagcctcctgagtagttgggactataggcgccccccaccacgcctggctaattttttgtatttttagtagagacagagtttcactgtgttagccaggatggtctcgatctcctgacctcgtgattcacccaccttggcctcccaaagtgctgggattacaggcatgagccaccgcgcctggccgagaagttcttaaaagaacatctgatttggctttagacaacgcagtgcctggcacactcaacaagtgaatacatctgtgcatgggtgggtgaacgaaagatgggcatgaccttgagtcttcatttcaccatttattagtttgatcattttgtgcaaatcacttaaagcctctgcttctatttgctaagctctgaaatgtagatagaaataattctttgcacaattactgtgaagctcaaaggataatatgtatgaataagtttggaaaaataccattcatgtgttgttactagaatgctctgaaacttctcctttagggtggatgagagcaacatgagactaaaagtcctggtactagacactgtggctcaggggagttgagggccatgagataatggcaatgtcaaagcacttgcaccaagtaaccagccagaatgtggaggcctatgagaatcagaggccttatctctatagtcattgatgataaagctggaaatgtaaaagttgggggtcatgagggtcagtccagctgcctgcctcacctgtctgctgggaaactgattctacctgtgcgagaccttgggccttgctagcagcgctgccaattaacacattacttcagggtcagtcctgcctacttaccctttcccattttggcttttcctttaggattttttcctgcacattattcttattattatttgaaatttgaacactgattttacttaagttcaaatactggatatgttattttagagattctcataggaagaaaatcaactatttattgtgcagccatccagaagtttatttatttatttttatttttgagacagggtctcactgtcacccaggctgaagtgtagtgacatgaacacaactcactgcagcctcaacctcctgggctcaagtgatcctcccaccttagcctcctgagtagctgggaccacaggtgtataccaccacacttggctaatttttaaaaatttatttttgtagagacaagctcttaccacgttgcccaggttggtctcaaattcctgggctcaagccatcctcctgcctcaatctccctaaaatgctggtattacaggggtaagccaccatgcctggccagaagtttattttattttttatttttgagatggtgttttgctcttattgcccaggctggagtgcagtggcacaatcttggctcactgcaaccttcgcctcccgggttcaagcgattctcctgcctcagcctcctgagtagctgggattacaggtgtgcgccaccacgcccagctaatgtttttgtatttttagtagatacagggtttcatcatgttggccaggctgttcttgaactcctgacctcagatgaccacccgcctcagcctcccaaagtacagggatcacagacgtgagccaccgcacccagatagaagtttattttttaaatcttattgacccatgcagtatgccacatgattacatagcataacaaaggaattatatgtctcaaacaacacagaaattccgcctttgcttttgtgattactatcacattaaaaaaaaaaagaaatgtattccctagatggaagtattattcccaaatatgttctgatgtgctatgtacccaccttatttaaatatttcatcactcattcattctttggtttaatattttcattctttctctatgcatgtattggtgtgtctgtcaaagtcattaagctcttgtggttctcctgattctgtgcctaacagcattaaatttttttttaattgtggtaaaatattcataacataaaatttaccatcgtaaccatttttggatgtatcctgcacattcttgagcctaaatattttcagacaaagtgaagccttagattgtctggtgagaatgaggatttcttggtttctctttgtgtttccctttcccagcctcactcagagccacttgaccatctctttttctcccaccccggtgtgcagagatgaaaagggaacggaagcaatattctggcctctcatactttctagagtttgtgttcttatttagggtggtgtgagagtttcagacacagaccttgcccttgttcagccgggagtcatacaggaaatcctgccagacttgctgtccctctctctttggcatccttgacctgtggctaggaagtcaaaaggccaggaaaacaatacctgagatgagggtagctcaggcctccatttcctgcccccaacctccccgcagactgtgataccaaagaacagcccctccttgccaagtcttccctccttacctccatttttggcaccctctgcttgcctgacttcctccttctgcctaccccttaagagcggatgttctcaaagctgctgcccttttctcttctttgcgttttttcctaagtctctggccctgggcctggcacatagttgatgcttaatggatgtttattgaatgattaagtgaatgaatgcaattcactcattcattccttaagtttcacctgttatttttgtgtacgcaataatgcatttagatgataatgataataataagctaacatttatgcacctactgtgtaccagagcatattctaagtattttcatcttactgtgacccagtgggggaagtacttctattaccctattttgtagaggaggtaattggggttacgagaggttaattgaagggcctacactcaccaagtgtcatagctggagtcctaacaaagcaaactagctctagagccagtactcaccaaggcaggctgcattgcctttttaaaattgggatacccctttttcccacaaaagaatgtcatattttcagccctaacaccctttcctcagctaccaacccttcatttcaccatcaccactggacatatccacagggttatcttgctggcaccttagctctttcctctttaaacagctctttcacaaggcttaagatggttctacacttctccagccagaggtggaaacctcagtgtcatccttaacccccatttttctcccttgctcttgagctcaaatcacctgctagggcttgcaaattccacctttgaaggtttcaaaagtgtctgtctttgaaacctcctgtctctcctttccttcaggcactgttcagcctccaatactactcacgtggataacaacagtagccgctaaactggactcctgttttctcagctttccctgttctagctcattttacacttgacagctgcatttagcacttttgctgcattttcctgacactccgtgctttcctacatggagactgtacataaaccaaagtagaatcctgggggacagtcccttttcctgatatatcccattccctaggcttttctctgccaggccaaatctctcctcagacagcaccatttgcagcaaacctgtaaatccctgaagctgaatgtgtttcctctctctttcccttgtcatgtttttttttgctgtgtactctagtcattgctgtgtctgtcttgcccctcttattagactatgagtcccataaggttgggctgggacagtggctttagtaatctgtgtctgccaatagtatgtgctcagggaaggattttcttcttttgaaaaatatttgttttcagaaataaaattagtaattgttaaatattaccattatacttaaaaggattcatcagatccaaagtctgtctttgagtacctctaactttgccagtgtcataaatttttggattaaaaaacttcaccctggctgggtacagtagctcacacctgtaatcccagcactttaggaggctgaggcaagagaattgcttgaacccgggaggcaaaggatgcagtgagctgagattgcaccattgtactccagcctgggcaacagagtgagtgagactctgtctcaaaacaaaaacaaaaacaaaaacttcactcttatataagaaacttcagaattgcaccattttcattttttaagtctctaccataaatttcttaagcaattgtcactaatgactttgctatagtagaaagaggaggctctagagatggacttcatccctcatttactgtgcagccttggctaaatcaataaacctctctgaatcttagtttcaatacctgaaacatggagagaattatgcatacttgtcagagctaagtgtaatttaaagatcaggcacataagacatttgacacatagtaggcatttcctatatagtagggtttattatatttttccaaatatactagcttgcatatttaaaggtgaatctcatttccttatttcttctctgatggatggctttttgtttttttatttgactacagttatagatccctgacctctgacctcttctccctagttcctctgaggtttaggtggatttgattgggtgtgaaatatgggggactgtgtgaaatatggggttcttcactgaaggggatgactgacttgatcttccccacataggagcattccagaccatgtttcaagtaaaggccacactagtaaagattggagtcctaggccaggcacagtggctcatgcctataatcccagcactttgggaggctgaggcgggtagatcacgagggcaggagatcgagaccatcctggctaacacggtgaaaccccgtctctactaaaaatacaaaaaattagccaggcatggtgtgggcacctgtagtcccagctactcgggaggctgaggcaggagaatggcatgaacccaggaggtggagcttgcagtgagccgagatcgtgccggtgcactccagcctgggcgacagagtgagactctgtctcaaaaaaaaaaaaaaaaaaaaaaaaaaaaagattggagtcctgggaacatagtccattggagtgggcacgattctctaaggacagcttgtctagtctttttacatgatagcaggggactctgaggctagagatggaggagctgtggctgcttgcagctggaggataggtggaagtgggtagggcatcctctcagaggactcctcagggaacaggctctgggagggctccatggggctgagactcacacgactgctgggttggagcacttgccactggtgtagaaatactccttgatgtgggcacggggcagtgggcgggcaatgtaggcaaagcagcagggtgtggtgtccgaggaatctggaagaggaaaggaaggagggagacccttttattcattgctactgcacacttgacattgtgctggacactttatatgatttatttagaaagaactgttatcttccttgacagaaactgaggctcagagaggtaaagtcacttggccatggataaacagtggcagagtggggattccaatgcctcatctaatccttgagccaagcttgtatccatccctctacaccataaccttctgccctgggctttcagggcctcctcctggcttgtcctgggtcctctggcttcattcttgcccttccagcatcctcaatggatttggaacttggtttctttgagacctagggcaggttgtggggaggcttccaaagctcaggctccatgactcagccaggatcctaagaagggcctggagatgcatattgtatcttgggagctctggttgagcttcagtgagaagggctctcaacagagaacttcttgttggtcagttaattcaagatgacgttgggaagcatcagttgccacttcccagcagaggagtagtttttattttcccagcaagatggaaccaggtttgaataccagtctccccatttcctagctgtgtgcctccatggacaagttacttaacctctctgttttcccatctgtacatcaaggacagctactcaaagaagggttgtgggtattaaataagatgtacaaaaatcggctgggcacggtggctcacgcctgtaatcccagcactttgggaggccgaggcgggcggatcacgaggtcaagagatcgagaccatcctggctaacatggtgaaaccccgtctctactaaaaaatacaaaacattagcagggtgtggtggcgggtgcctgtagtccccgctactccggaggctgaggcaggagaatggcatgaacccgggagacggagcttgcagtaagccgagatcgtgccgctgcactccagcctgggcgacagagcgaagactccatctcaaaaaaaaaaaaaaaaaaaaaaaagatgtgccaaaatcagcacaatgcctgatccatagtaaccatttaattagcttttattatcctctccttgtttttatttgttttttaaatgtattcactctaataaagccacataccctctcataagccaattttttttacatttatgaaatgagagagaatatggctgtctcagggtctcaggaagttttagtttagttaaatttcttagaaaccctgctgctgacaggcatgagtcagacgtgtttcaaagtcagtgtgagctactcatgactactaatctccccaacatgagtccacactcagtgaacacctgtaggccttgagggtgtagaccttaaagacagaaaaactgatcaggagatccctgccatgaagcagcatagagatctctcaaggacaacaggacatatgggtaagacaattcataagaatgtaaataatggggttcagacagtattcatgctacagttgaaaagagggcaaggtgtgggacagtcattgggatggggtaggcattctaggcagagtctgactccaggggctgtggtggtcaagaccaggacttacatggggaggcagatgcaggagcgcagagggcagtagcaatgaggatgacagcgagggctgccgcggagaccttcatggtacctgtgggagaggctgtgcgaggtccacgtgctgtcttgatcctctgcaggaatcctctgcagc

SEQ ID NO: 1574 - DNA, 7179 bp, Homo sapiens
tttattctctggaacatgaaacattctgttgtgctcatatcatgcaaattatcactagtaggagagcagagagtggaaatgttccaggtataaagacccacaagataaagaagctcagagtcgttagaaacaggagcagatgtacagggtttgcctgactcacactcaaggttgcataagcaagatttcaaaattaatcctattctggagacctcaacccaatgtacaatgttcctgactggaaaagaagaactatatttttctgattttttttttcaaatctttaccattagttgccctgtatctccgccttcactttctgcaggaaactttatttcctacttctgcatgccaagtttctacctctagatctgtttggttcagttgctgagaagcctgacataccaggactgcctgagacaagccacaagctggtgagttgtaggcattttttccattactttctgattcataggctcaacgcacctcaaagctggaaatgccgggtctgggtacaccctggggaactgcaaagcctgcacacttggggggaatgatcaagatgagaggcaggggtggggatggcatgtgcaccaggagatgttagagaaaccctgaggaagagcagcgtgcagcaggtgatgggggagagtgggcagcaagcgaggccaggacagccactctgctcagtcaccagtccacacacccaggggctcactctgcccctctgagcacccaaggacgttaaagagctggaactgttagtctaaatataggaccatccaagctctgaaccaaaatgtgtcccttgcctcaactcaggagatccacagaggcagaagtaaggaatttattttctgaaagatagatttctatcagttctgggtgacatgttctgacacttgaaatgacacctaggacagcacatttcaggcatcttgctcattgttcactgtagtagaagctacatgctagccagttgtaaaaatgaaattaagtaatgtgtgcacagcatttaacatagcatctgagcttcaggagcactcaattaatgaccacagttgtgattctttaggcagatgcatttttttccaactttgatcagaggtcttatttagcttctccagatttcaagaatctggctcagtgatatgaaatacaagacttgtgaaaagtgtcaattgcaagagaaatggaaggataaagtatacaggtgggtggaaaagaaattcacagtcactgccagaaaaaaaattcttgagaatcaagtcctgatgatgttagggcttatagttcttattataaagagttttatgtactcattcagtgaacatttattggtgcctcctttagccaggtactatcataagagctgaaaatagaagcataatccagtccttgatcttgaggaacatgctgtgtgtagcagataacataataagtgcttatctagatgcatgcagtgttatgtgataagagtaatatgacagaggatacagattaggcttcacagagaagggggatttgagcaggaggtattgaagggtgaatagaagctcaccaatcattttgggcagaggggcaaggacctgcaaaaccactgaagcatgaaggaaatggtgagtttagggaaaatgaagagaagatggctgtgactgaagcacaggatttgggattggagaagggactggaggtgaggctgaaaagaggcaaactcagaaaagatgttgtgctgggcagtctggacattatctttgaagcccaccacatataagtcatagggctactggaggttttaagctaagagtgactattcaatttcaacttaagagaagataggttgagagggaacatggcttgagatgagccatgagcaaaggaaagactacaacaaagccaggagtgaggagtgtgtgaagcaagaaagtgacagttgaaagcagtgcagaggggatgaatctgagaggcatctatgaggtggaactcaaatgacatgataataatacagggcatttctctgtgtcagatgctgtcctaagtccttactccattgatcttcacagcaactcagcatagttaatattttatgcataaagaaatcggcacttgaaggagtaattggccccagattacactgcctataaggattcaaatccaggtttgtttggctccaaaaactggctcctaattttcagaaggagaagcaacccagggcaatgcccaattttgcttcttaggcaatggaggaatccacaatcggaaggagttttcagcagtgccccatttggggtgggttgaatttgaggtccctgcatgatacccactttgctcacttcagtgcctaaaactgagtatggttcatagtaggtgttcaataagtgttgatgcagtgaatacatgcatggggagatatgcatcaggcaatgggaaattcaactctaaggcttaggggaaagctggagcttgaagacagagctttagaaaacagtagcatagaagggagtaggaaccatgagtttagacaatacaattcaggaagaactttgtagcaaggataaagaggcaaaaaattaaagaggtgagagctaagtgtggtgcctggggaatcttaaggtgtgggcacggggaggagatgccagcaaagaacatgaataaaaagcggtagcacagcccctcccatctggaagccaaaaagaattgtaaatggaggaagttagcagaaggatcaaatacttgaagagggtggaattggaataaaaccagggcatttgaaaaattgggttgtcactgcaatcttaacaagagaagttttggcaggatgatggaggcagaaagctgagagaatcatcagttagaacgtttttgacttcagagaacagaaaatgcagttcataatggctttaaaacaggggcttgtttttctcccagcaatttgagaggccaaggcgggtgcatcaggaggtcaagagaccgagaccatcctggccaacatggtgaatccccatctctactaaaaatacaaaaattagcggggcatggtggtgcacgcctatagtcccatctactcaggaggctgaggcaggagaatcacttgaacccaggaggtggaggttgcagtgagctgagatcatggccactgcactatagcctggagacacagcgagactccgtctccaaaaaaaaaaaaaaaagaaggcagaaggtgaatagttcaagggtgggtttaggactcagtgataataggattctgcctggcttctcatggttctctaggtcttccattcatggcaccatgccctcactaggcatgctgccagagcaggaggggcaggtggagggttctcttgtgtctgtcttatcagggaagaagagctttctcagaagcccccagcagactcccttttcatattatggtccagcaatgagtcacagacctatgcaccacctgcaaaggagccagagaaaacaaacgcccagcgcttttagcctgaaaatgagaatctggtttgctggggaagataaagggtgtcggaaaatggctgttgggtaaatcattgatgtctgccactaggaatgaaaggcaaatcaggaactggcacacatgctttcagggagatggctgcaagggagagggcaaagactgggaagttgcttatgtggtgccagactatttggaagatcatggattgcggtgtttgtgttgtgtggtcatcattttgttctttgtttacagaacagagaaagtggattgaacaaggacgcatttccccagtacatccacaacatgctgtccacatctcgttctcggtttatcagaaataccaacgagagcggtgaagaagtcaccaccttttttgattatgattacggtgctccctgtcataaatttgacgtgaagcaaattggggcccaactcctgcctccgctctactcgctggtgttcatctttggttttgtgggcaacatgctggtcgtcctcatcttaataaactgcaaaaagctgaagtgcttgactgacatttacctgctcaacctggccatctctgatctgctttttcttattactctcccattgtgggctcactctgctgcaaatgagtgggtctttgggaatgcaatgtgcaaattattcacagggctgtatcacatcggttattttggcggaatcttcttcatcatcctcctgacaatcgatagatacctggctattgtccatgctgtgtttgctttaaaagccaggacggtcacctttggggtggtgacaagtgtgatcacctggttggtggctgtgtttgcttctgtcccaggaatcatctttactaaatgccagaaagaagattctgtttatgtctgtggcccttattttccacgaggatggaataatttccacacaataatgaggaacattttggggctggtcctgccgctgctcatcatggtcatctgctactcgggaatcctgaaaaccctgcttcggtgtcgaaacgagaagaagaggcatagggcagtgagagtcatcttcaccatcatgattgtttactttctcttctggactccctataatattgtcattctcctgaacaccttccaggaattcttcggcctgagtaactgtgaaagcaccagtcaactggaccaagccacgcaggtgacagagactcttgggatgactcactgctgcatcaatcccatcatctatgccttcgttggggagaagttcagaaggtatctctcggtgttcttccgaaagcacatcaccaagcgcttctgcaaacaatgtccagttttctacagggagacagtggatggagtgacttcaacaaacacgccttccactggggagcaggaagtctcggctggtttataaaacgaggagcagtttgattgttgtttataaagggagataacaatctgtatataacaacaaacttcaagggtttgttgaacaatagaaacctgtaaagcaggtgcccaggaacctcagggctgtgtgtactaatacagactatgtcacccaatgcatatccaacatgtgctcagggaataatccagaaaaactgtgggtagagactttgactctccagaaagctcatctcagctcctgaaaaatgcctcattaccttgtgctaatcctctttttctagtcttcataatttcttcactcaatctctgattctgtcaatgtcttgaaatcaagggccagctggaggtgaagaagagaatgtgacaggcacagatgaatgggagtgagggatagtggggtcagggctgagaggagaaggagggagacatgagcatggctgagcctggacaaagacaaaggtgagcaaagggctcacgcattcagccaggagatgatactggtccttagccccatctgccacgtgtatttaaccttgaagggttcaccaggtcagggagagtttgggaactgcaataacctgggagttttggtggagtccgatgattctcttttgcataagtgcatgacatatttttgctttattacagtttatctatggcacccatgcaccttacatttgaaatctatgaaatatcatgctccattgttcagatgcttcttaggccacatccccctgtctaaaaattcagaaaatttttgtttataaaagatgcattatctatgatatgctaatatatgtatatgcaatatatataggctcttgcttgatctctccaggaggtagtgattatgagaagggggtggagaatgatgagttccttcaccaggagcaaaggacggggatcgtgtggaaccactgcagaactatttccgaaatcaactaagtggagagagccaggaaggctgcatcagaacccagtaaagcttcttgtctggatctgagctggtttgttttgtgcttgcttttccctgccttgccactcccctcactcttctcttttccccacagcctttttcacatagctcttggctgtaggattgccccactccaaaaaccagtgtgtggaggtccaggagtgagaccaggaaagaatgtgaaagtgactacacaaggactcctcgatggtcgtggaaaaggaaagtcaattggcagagcccctgaagccagtcttcaggacaaagaaggagcctagagacagaaatgacagatctctgctttggaaatcacacgtctggcttcacagatgtgtgattcacagtgtgaatcttggtgtctacgttaccaggcaggaaggctgagaggagagagactccagctgggttggaaaacagtattttccaaactaccttccagttcctcatttttgaatacaggcatagagttcagactttttttaaatagtaaaaataaaattaaagctgaaaactgcaacttgtaaatgtggtaaagagttagtttgagttactatcatgtcaaacgtgaaaatgctgtattagtcacagagataattctagctttgagcttaagaattttgagcaggtggtatgtttgggagactgctgagtcaacccaatagttgttgattggcaggagttggaagtgtgtgatctgtgggcacattagcctatgtgcatgcagcatctaagtaatgatgtcgtttgaatcacagtatacgctccatcgctgtcatctcagctggatctccattctctcaggcttgctgccaaaagccttttgtgttttgttttgtatcattatgaagtcatgcgtttaatcacattcgagtgtttcagtgcttcgcagatgtccttgatgctcatattgttccctattttgccagtgggaactcctaaatcaagttggcttctaatcaaagcttttaaaccctattggtaaagaatggaaggtggagaagctccctgaagtaagcaaagactttcctcttagtcgagccaagttaagaatgttcttatgttgcccagtgtgtttctgatctgatgcaagcaagaaacactgggcttctagaaccaggcaacttgggaactagactcccaagctggactatggctctactttcaggccacatggctaaagaaggtttcagaaagaagtggggacagagcagaactttcaccttcatatatttgtatgatcctaatgaatgcataaaatgttaagttgatggtgatgaaatgtaaatactgtttttaacaactatgatttggaaaataaatcaatgctataactatgttga

SEQ ID NO: 1575 - DNA, 5634 bp, Homo sapiens
tttattctctggaacatgaaacattctgttgtgctcatatcatgcaaattatcactagtaggagagcagagagtggaaatgttccaggtataaagacccacaagataaagaagctcagagtcgttagaaacaggagcagatgtacagggtttgcctgactcacactcaaggttgcataagcaagatttcaaaattaatcctattctggagacctcaacccaatgtacaatgttcctgactggaaaagaagaactatatttttctgattttttttttcaaatctttaccattagttgccctgtatctccgccttcactttctgcaggaaactttatttcctacttctgcatgccaagtttctacctctagatctgtttggttcagttgctgagaagcctgacataccaggactgcctgagacaagccacaagctggtgagttgtaggcattttttccattactttctgattcataggctcaacgcacctcaaagctggaaatgccgggtctgggtacaccctggggaactgcaaagcctgcacacttggggggaatgatcaagatgagaggcaggggtggggatggcatgtgcaccaggagatgttagagaaaccctgaggaagagcagcgtgcagcaggtgatgggggagagtgggcagcaagcgaggccaggacagccactctgctcagtcaccagtccacacacccaggggctcactctgcccctctgagcacccaaggacgttaaagagctggaactgttagtctaaatataggaccatccaagctctgaaccaaaatgtgtcccttgcctcaactcaggagatccacagaggcagaagtaaggaatttattttctgaaagatagatttctatcagttctgggtgacatgttctgacacttgaaatgacacctaggacagcacatttcaggcatcttgctcattgttcactgtagtagaagctacatgctagccagttgtaaaaatgaaattaagtaatgtgtgcacagcatttaacatagcatctgagcttcaggagcactcaattaatgaccacagttgtgattctttaggcagatgcatttttttccaactttgatcagaggtcttatttagcttctccagatttcaagaatctggctcagtgatatgaaatacaagacttgtgaaaagtgtcaattgcaagagaaatggaaggataaagtatacaggtgggtggaaaagaaattcacagtcactgccagaaaaaaaattcttgagaatcaagtcctgatgatgttagggcttatagttcttattataaagagttttatgtactcattcagtgaacatttattggtgcctcctttagccaggtactatcataagagctgaaaatagaagcataatccagtccttgatcttgaggaacatgctgtgtgtagcagataacataataagtgcttatctagatgcatgcagtgttatgtgataagagtaatatgacagaggatacagattaggcttcacagagaagggggatttgagcaggaggtattgaagggtgaatagaagctcaccaatcattttgggcagaggggcaaggacctgcaaaaccactgaagcatgaaggaaatggtgagtttagggaaaatgaagagaagatggctgtgactgaagcacaggatttgggattggagaagggactggaggtgaggctgaaaagaggcaaactcagaaaagatgttgtgctgggcagtctggacattatctttgaagcccaccacatataagtcatagggctactggaggttttaagctaagagtgactattcaatttcaacttaagagaagataggttgagagggaacatggcttgagatgagccatgagcaaaggaaagactacaacaaagccaggagtgaggagtgtgtgaagcaagaaagtgacagttgaaagcagtgcagaggggatgaatctgagaggcatctatgaggtggaactcaaatgacatgataataatacagggcatttctctgtgtcagatgctgtcctaagtccttactccattgatcttcacagcaactcagcatagttaatattttatgcataaagaaatcggcacttgaaggagtaattggccccagattacactgcctataaggattcaaatccaggtttgtttggctccaaaaactggctcctaattttcagaaggagaagcaacccagggcaatgcccaattttgcttcttaggcaatggaggaatccacaatcggaaggagttttcagcagtgccccatttggggtgggttgaatttgaggtccctgcatgatacccactttgctcacttcagtgcctaaaactgagtatggttcatagtaggtgttcaataagtgttgatgcagtgaatacatgcatggggagatatgcatcaggcaatgggaaattcaactctaaggcttaggggaaagctggagcttgaagacagagctttagaaaacagtagcatagaagggagtaggaaccatgagtttagacaatacaattcaggaagaactttgtagcaaggataaagaggcaaaaaattaaagaggtgagagctaagtgtggtgcctggggaatcttaaggtgtgggcacggggaggagatgccagcaaagaacatgaataaaaagcggtagcacagcccctcccatctggaagccaaaaagaattgtaaatggaggaagttagcagaaggatcaaatacttgaagagggtggaattggaataaaaccagggcatttgaaaaattgggttgtcactgcaatcttaacaagagaagttttggcaggatgatggaggcagaaagctgagagaatcatcagttagaacgtttttgacttcagagaacagaaaatgcagttcataatggctttaaaacaggggcttgtttttctcccagcaatttgagaggccaaggcgggtgcatcaggaggtcaagagaccgagaccatcctggccaacatggtgaatccccatctctactaaaaatacaaaaattagcggggcatggtggtgcacgcctatagtcccatctactcaggaggctgaggcaggagaatcacttgaacccaggaggtggaggttgcagtgagctgagatcatggccactgcactatagcctggagacacagcgagactccgtctccaaaaaaaaaaaaaaaagaaggcagaaggtgaatagttcaagggtgggtttaggactcagtgataataggattctgcctggcttctcatggttctctaggtcttccattcatggcaccatgccctcactaggcatgctgccagagcaggaggggcaggtggagggttctcttgtgtctgtcttatcagggaagaagagctttctcagaagcccccagcagactcccttttcatattatggtccagcaatgagtcacagacctatgcaccacctgcaaaggagccagagaaaacaaacgcccagcgcttttagcctgaaaatgagaatctggtttgctggggaagataaagggtgtcggaaaatggctgttgggtaaatcattgatgtctgccactaggaatgaaaggcaaatcaggaactggcacacatgctttcagggagatggctgcaagggagagggcaaagactgggaagttgcttatgtggtgccagactatttggaagatcatggattgcggtgtttgtgttgtgtggtcatcattttgttctttgtttacagaacagagaaagtggattgaacaaggacgcatttccccagtacatccacaacatgctgtccacatctcgttctcggtttatcagaaataccaacgagagcggtgaagaagtcaccaccttttttgattatgattacggtgctccctgtcataaatttgacgtgaagcaaattggggcccaactcctgcctccgctctactcgctggtgttcatctttggttttgtgggcaacatgctggtcgtcctcatcttaataaactgcaaaaagctgaagtgcttgactgacatttacctgctcaacctggccatctctgatctgctttttcttattactctcccattgtgggctcactctgctgcaaatgagtgggtctttgggaatgcaatgtgcaaattattcacagggctgtatcacatcggttattttggcggaatcttcttcatcatcctcctgacaatcgatagatacctggctattgtccatgctgtgtttgctttaaaagccaggacggtcacctttggggtggtgacaagtgtgatcacctggttggtggctgtgtttgcttctgtcccaggaatcatctttactaaatgccagaaagaagattctgtttatgtctgtggcccttattttccacgaggatggaataatttccacacaataatgaggaacattttggggctggtcctgccgctgctcatcatggtcatctgctactcgggaatcctgaaaaccctgcttcggtgtcgaaacgagaagaagaggcatagggcagtgagagtcatcttcaccatcatgattgtttactttctcttctggactccctataatattgtcattctcctgaacaccttccaggaattcttcggcctgagtaactgtgaaagcaccagtcaactggaccaagccacgcaggtgacagagactcttgggatgactcactgctgcatcaatcccatcatctatgccttcgttggggagaagttcagaaggtatctctcggtgttcttccgaaagcacatcaccaagcgcttctgcaaacaatgtccagttttctacagggagacagtggatggagtgacttcaacaaacacgccttccactggggagcaggaagtctcggctggtttataaaacgaggagcagtttgattgttgtttataaagggagataacaatctgtatataacaacaaacttcaagggtttgttgaacaatagaaacctgtaaagcaggtgcccaggaacctcagggctgtgtgtactaatacagactatgtcacccaatgcatatccaacatgtgctcagggaataatccagaaaaactgtgggtagagactttgactctccagaaagctcatctcagctcctgaaaaatgcctcattaccttgtgctaatcctctttttctagtcttcataatttcttcactcaatctctgattctgtcaatgtcttgaaatcaagggccagctggaggtgaagaagagaatgtgacaggcacagatgaatgggagtgagggatagtggggtcagggctgagaggagaaggagggagacatgagcatggctgagcctggacaaagacaaaggtgagcaaagggctcacgcattcagccaggagatgatactggtccttagccccatctgccacgtgtatttaaccttgaagggttcaccaggtcagggagagtttgggaactgcaataacctgggagttttggtggagtccgatgattctcttttgcataagtgcatgacatatttttgctttattacagtttatctatggcacccatgcaccttacatttgaaatctatgaaatatcatgctccattgttcagatgcttcttaggccacatccccctgtctaaaaattcagaaaatttttgtttataaaaga

SEQ ID NO: 1576 - DNA, 6065 bp, Homo sapiens
cttcagatagattatatctggagtgaagaatcctgccacctatgtatctggcatagtgtgagtcctcataaatgcttactggtttgaagggcaacaaaatagtgaacagagtgaaaatccccactaagatcctgggtccagaaaaagatgggaaacctgtttagctcacccgtgagcccatagttaaaactctttagacaacaggttgtttccgtttacagagaacaataatattgggtggtgagcatctgtgtgggggttggggtgggataggggatacggggagagtggagaaaaaggggacacagggttaatgtgaagtccaggatccccctctacatttaaagttggtttaagttggctttaattaatagcaactcttaagataatcagaattttcttaaccttttagccttactgttgaaaagccctgtgatcttgtacaaatcatttgcttcttggatagtaatttcttttactaaaatgtgggcttttgactagatgaatgtaaatgttcttctagctctgatatcctttattctttatattttctaacagattctgtgtagtgggatgagcagagaacaaaaacaaaataatccagtgagaaaagcccgtaaataaaccttcagaccagagatctattctctagcttattttaagctcaacttaaaaagaagaactgttctctgattcttttcgccttcaatacacttaatgatttaactccaccctccttcaaaagaaacagcatttcctacttttatactgtctatatgattgatttgcacagctcatctggccagaagagctgagacatccgttcccctacaagaaactctccccggtaagtaacctctcagctgcttggcctgttagttagcttctgagatgagtaaaagactttacaggaaacccatagaagacatttggcaaacaccaagtgctcatacaattatcttaaaatataatctttaagataaggaaagggtcacagtttggaatgagtttcagacggttataacatcaaagatacaaaacatgattgtgagtgaaagactttaaagggagcaatagtattttaataactaacaatccttacctctcaaaagaaagatttgcagagagatgagtcttagctgaaatcttgaaatcttatcttctgctaaggagaactaaaccctctccagtgagatgccttctgaatatgtgcccacaagaagttgtgtctaagtctggttctcttttttctttttcctccagacaagagggaagcctaaaaatggtcaaaattaatattaaattacaaacgccaaataaaattttcctctaatatatcagtttcatggcacagttagtatataattctttatggttcaaaattaaaaatgagcttttctaggggcttctctcagctgcctagtctaaggtgcagggagtttgagactcacagggtttaataagagaaaattctcagctagagcagctgaacttaaatagactaggcaagacagctggttataagactaaactacccagaatgcatgacattcatctgtggtggcagacgaaacattttttattatattatttcttgggtatgtatgacaactcttaattgtggcaactcagaaactacaaacacaaacttcacagaaaatgtgaggattttacaattggctgttgtcatctatgaccttccctgggacttgggcacccggccatttcactctgactacatcatgtcaccaaacatctgatggtcttgccttttaattctcttttcgaggactgagagggagggtagcatggtagttaagagtgcaggcttcccgcattcaaaatcggttgcttactagctgtgtggctttgagcaagttactcaccctctctgtgcttcaaggtccttgtctgcaaaatgtgaaaaatatttcctgcctcataaggttgccctaaggattaaatgaatgaatgggtatgatgcttagaacagtgattggcatccagtatgtgccctcgaggcctcttaattattactggcttgctcatagtgcatgttctttgtgggctaactctagcgtcaataaaaatgttaagactgagttgcagccgggcatggtggctcatgcctgtaatcccagcattctaggaggctgaggcaggaggatcgcttgagcccaggagttcgagaccagcctgggcaacatagtgtgatcttgtatctataaaaataaacaaaattagcttggtgtggtggcgcctgtagtccccagccacttggaggggtgaggtgagaggattgcttgagcccgggatggtccaggctgcagtgagccatgatcgtgccactgcactccagcctgggcgacagagtgagaccctgtctcacaacaacaacaacaacaacaaaaaggctgagctgcaccatgcttgacccagtttcttaaaattgttgtcaaagcttcattcactccatggtgctatagagcacaagattttatttggtgagatggtgctttcatgaattcccccaacagagccaagctctccatctagtggacagggaagctagcagcaaaccttcccttcactacaaaacttcattgcttggccaaaaagagagttaattcaatgtagacatctatgtaggcaattaaaaacctattgatgtataaaacagtttgcattcatggagggcaactaaatacattctaggactttataaaagatcactttttatttatgcacagggtggaacaagatggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtgacacggactcaagtgggctggtgacccagtcagagttgtgcacatggcttagttttcatacacagcctgggctgggggtggggtgggagaggtcttttttaaaaggaagttactgttatagagggtctaagattcatccatttatttggcatctgtttaaagtagattagatcttttaagcccatcaattatagaaagccaaatcaaaatatgttgatgaaaaatagcaacctttttatctccccttcacatgcatcaagttattgacaaactctcccttcactccgaaagttccttatgtatatttaaaagaaagcctcagagaattgctgattcttgagtttagtgatctgaacagaaataccaaaattatttcagaaatgtacaactttttacctagtacaaggcaacatataggttgtaaatgtgtttaaaacaggtctttgtcttgctatggggagaaaagacatgaatatgattagtaaagaaatgacacttttcatgtgtgatttcccctccaaggtatggttaataagtttcactgacttagaaccaggcgagagacttgtggcctgggagagctggggaagcttcttaaatgagaaggaatttgagttggatcatctattgctggcaaagacagaagcctcactgcaagcactgcatgggcaagcttggctgtagaaggagacagagctggttgggaagacatggggaggaaggacaaggctagatcatgaagaaccttgacggcattgctccgtctaagtcatgagctgagcagggagatcctggttggtgttgcagaaggtttactctgtggccaaaggagggtcaggaaggatgagcatttagggcaaggagaccaccaacagccctcaggtcagggtgaggatggcctctgctaagctcaaggcgtgaggatgggaaggagggaggtattcgtaaggatgggaaggagggaggtattcgtgcagcatatgaggatgcagagtcagcagaactggggtggatttgggttggaagtgagggtcagagaggagtcagagagaatccctagtcttcaagcagattggagaaacccttgaaaagacatcaagcacagaaggaggaggaggaggtttaggtcaagaagaagatggattggtgtaaaaggatgggtctggtttgcagagcttgaacacagtctcacccagactccaggctgtctttcactgaatgcttctgacttcatagatttccttcccatcccagctgaaatactgaggggtctccaggaggagactagatttatgaatacacgaggtatgaggtctaggaacatacttcagctcacacatgagatctaggtgaggattgattacctagtagtcatttcatgggttgttgggaggattctatgaggcaaccacaggcagcatttagcacatactacacattcaataagcatcaaactcttagttactcattcagggatagcactgagcaaagcattgagcaaaggggtcccatagaggtgagggaagcctgaaaaactaagatgctgcctgcccagtgcacacaagtgtaggtatcattttctgcatttaaccgtcaataggcaaaggggggaagggacatattcatttggaaataagctgccttgagccttaaaacccacaaaagtacaatttaccagcctccgtatttcagactgaatgggggtggggggggcgccttaggtacttattccagatgccttctccagacaaaccagaagcaacagaaaaaatcgtctctccctccctttgaaatgaatataccccttagtgtttgggtatattcatttcaaagggagagagagaggtttttttctgttctgtctcatatgattgtgcacatacttgagactgttttgaatttgggggatggctaaaaccatcatagtacaggtaaggtgagggaatagtaagtggtgagaactactcagggaatgaaggtgtcagaataataagaggtgctactgactttctcagcctctgaatatgaacggtgagcattgtggctgtcagcaggaagcaacgaagggaaatgtctttccttttgctcttaagttgtggagagtgcaacagtagcataggaccctaccctctgggccaagtcaaagacattctgacatcttagtatttgcatattcttatgtatgtgaaagttacaaattgcttgaaagaaaatatgcatctaataaaaaacaccttctaaaataa

SEQ ID NO: 1577 - DNA, 6065 bp, Homo sapiens; identical to SEQ ID NO: 1576

SEQ ID NO: 1578 - DNA, 14514 bp, Homo sapiens
ttcatttctcagccttttcttttaaatttattatgcttttcttttcttttttcatttaaaataaggattgagactttgtccccaagtaagtttctcaaatggctacattactgagaacccagacccaagcacaatgctgtagtgggggtgggtagtgggctggcttcagctctgacaaattgtgggggctgatgatctcctttcaggggcggggtgtgtggtgctgggagggatgtcggtgagtagaaggggaatggcctccctgtgggagactccggggccggcagtccctgcccagtccctccctctgcttcctcccactcttccacatgcggaaagggctctgtgcctctcacagcagcatctgaccctctggactgagtcattcggtgtacttgcctagaaggttctttagctctgggactcacaggagtaagaagctcagaaaagcacagtgagtccctgcccagttccaggaagcaatctgaaaagtctggtctggtcaccagcagatgacagttctttcacttagagcaattttgctaagcacacttatttgctttctctggaaaccttcagcactaaatgtgttggtatttccacctgagaaggtatttaactgcaaaaaatagcagaatagccaacaataatagaaatactatgagaaagaaaatgcctatggctgtaatcccacaggaaagcttgacatcagatagcttaactccccttagagatggcgggtttgcacacgtggtctcctccgagccttcaagtttgtgcaggttttctttgtaccatgttaagaaatgaatattcgagcaagtgcagtccagggggttatgacttaaattaatggtgctctgctgggacaagatagggaggagacggggtgagatgatgttaatgctgttggcagccagattgaggtagattcccttaagatggctaagagaatcaatgctgtcgcatgtcaggctgttgtggcttaagtctacatggctcatttttcccaagctgtggaatgcttgctggtctatagagaggagaccacaagaggacaaaatcagaacctccaagctgcccacggtctgaagtaggttggtcttcgtgatagtcccatcttgaaagtgattcccttttaagttgagatgccggagaactggtaggcctgctagaagatgctgattgctggtatcaaggaagcagtaagtgagattcagaacctgaaggaaatggaggttttggaagggactttgtggagcattaatgtgtaagcgggtaaatgccaaatcgaggagttctagctgaggacattctttgaatgcctgactctggagaccaagaggctcattgtggctcaggtttaaggtttgcaagtgggacaggtttttgagttgcagactgcagcagtcagaagcctctatgtcattatggcttaaatcaagtgtctgaaggtttcctagtttctccaagcagccaacaccaaggtgaagtttcttcacgttgcctctgatgtagaggtgtgtaagggaggggaaattggcagcactgatttgacacaattgatcgaaatgatttacactgagaactaatttcttgagcaagttcagacccttcatcccagagggtaaccctttcaagtgagttgctgtcagatccaattcttggagttgggtgaagcactgaaatgtggtggatgagatgtcagagaagcggtgttcctgcaggttgaggctctcaacagacatttcacagagtcccttgagcatggctgaactaatatcttcgtcatcaatgtcctcaaatgttcccagccagagagactgagtagtagagttctgcagaccattgaatataacagacaaatttggagttcctccaaagttcaaactttggaagatcgttgaatcaaaagccccaagctcaatacctttaacattattgccattgaagttcaggcttaggttgatggcctgctccagagacctcatgtcttctctagagatgtagtgtatagcattattctgaaaatccagtactttcagattccgtgctgggaagtctttggggaacttaatggaggaaatatggttgcttccaagatacaagctttccaagttttccagattgtgcactggaataaactcgagattggatattcccgtttggattaagaaaagatgcttcagtgacttgggcccattaagcgatgtttctgccatgaatatcaggggatttccagttaacacaagtgtgcttaattgatgatggctttgaaaagtgtcttcatgtatccagttaatctggcaccttgaaaagataatcgtatttaacaataattcatttgaaaaaagtaaaaaaatactttacagtgacacacattaacaaagtcatcttttgtatcattcaaaatcaaatataagaactttcttcaatatcaacagatggcctattgaaggaattaatgagtagcctcacttctgaacacgccaatctagattttttttccaggtatctcaccccttagattgaaccctcagaggtttgtgcctgtattctaaggaaccatgggtcatttgattgtggcaaaaatcaaattattatttactgttttaagtaatacaaaatatatcatatagaatgcataatagataatatatggtataaaatacatatatatatacacacacaaaaatctgtgtcatcccgggcaagttacaacttttctcaacctctgtattttcatctgagaaaaccatcctggtattgcacctaaaaatactggatcacacacacacacacacacacacacacacagatggcctcctcatctaaccataagttggatgatactacgcaccatggaatctcacactggtgcttttaaagatgaagcggtagtatggatgtggacatcctgtccacagaagctgaagttgaaggacaaaatagaagaagtagaactgccgcaaagggtgcagactgcaggtacacgcagagcctgtcccctcttacacacacacacacacacacacacacacacacacacacacgcagtatagccctttcattttcttcccttattttcttgtaatacttcttcctactggttctcaaacactggctcagcatgtggaatcccaattatgccactataacaaaataatggaactcattttccaatttgtaggggggaaaagtagatggtgtgcttttctcctagaaatttttcttaaatgtaattacccaaaaataaactatgccaaaatttagcatagtttggcatctgatttagtacaagattattttcatttttgctatcagtattccttagaactgcttcaacagtgctattgatgcaactggtttgagagcaatccattttcctctccattggttgatgtttatttaaattacatttcacccacataggagtatttcatggggaggcataaacatgtagtataagcagattgtccctgggccccccaaaaaggtcctgcaaataaattaagcacatactgtattttaacttaaataaaataaaagagcacacaaataactcagatacatacctagttaaatccaaaaaggtaagattcatgagtctgctgaaggttctattgtgaattgtaggcaaaaaattaaagctgaattccaaaaattctgttgtgtttggtagagtgtcagggatttcactgagacctaaattttcacagttatatgttttgttggcttctttctgatgggagaaacaaagtaaattaatattagacttaataattttatagactatctagcaaaattatatatgttttaccttccgagcggcaatcgtacttctagtaatctttaccaaatatacacttgccaaaaacaagatgatgaatgcacattgttaactgtagtactttttttgtaatagcaaaattgacaataaccagactattcatcaatataggactacttgaacaaaacatggtacattcacaaaatggaatcctctaaaactgaaaaaaataaaaaaaaccctccatatattgatatggagtgatatctgggatatatttcaaggtgaaaaaagcaaaatgcagaacaatatatgtagtgtatatagtatacagtatgtagtataatgtacagagtatgccttttgtgtaagaaaggtgtgtgtgaattttcttatatttgttaaaacaaaccatgcaaaaacccaaaaactgattgcctttaagaagagggaagagaccagatagaagagcagggataaatgtgagacttctctgaatgcacttggttttacagttttgattttggttgaatggaaatgtttaatttcagtttgaaacaaacaaatcgaccttagataagcatcaccaaaataagacaatcaaacattacatactttcgtatgtgagacaatgtgaggtatacagcattgtctatgaagtattcttgccaaaaaaataattaaactttaaactcatcaagattttaggtttaacttcacatctcaaagtgatatggtggatttaagtgggacattctatggaacaactgactttgttctatctgtgtgtgtgtgtgtgtgtgtgtgtgaaagagagagagagagagagagagaatgagagaggagatagtgcttgttaaaagatacagagatataagatctacttaagagacataaccatcaaataatacagtagacctcatttagatcctgatccaaataaagcagttcaaaaaggcattttatagactgtcaggtaattttgaatgaggacagtattcaatgatattaaggaattctggattttgtaaatgacagtggacttgtggttatttaaaagaaatgttcttattcttttgagaagcatatttaaatatttaggagtaaaacagcatgatgctggaattggctctaaaataatctggcaaaaaaggaggagaggaatgcagagatgaagtgagtaggcaaaatgcttatgattgtcgaatattgagattctttgttactatttctgtatatgtttaacatttttttcttaacacagtgcttaaaaaaactagcagggtggcatagacctgaggccttgcaatcttgaagtatgaattaattttagatctctgtatttgtaggctgctgataccagacagtaggcttttgggcagaaccctacacataagtacagataacttcctcatcctgtgccccagggtagtcatgtattctgaagcctgccaatcatgtcctaatacaagttatgtgttgaactaagtaggtaaaaatgggaagtggttttttagaagcctgtagaactgtggggtcattatttatctggctaatgctttaagatgaagggtagtggggaaaataggaaggtctgacagggcaggtatgaaagtctgatggagtatattttgcctgtggagtctccttggaaagatatgaaggaaagttcctgctatgctttgaatatgtcctccaaagttcatgtgttgagaacttaattgccattgtaatactaagaggtgaggcctttgggaggtgattggatcatgaagattccacactcatgaatgaattaatactattattgcagggtgggttagttatcgcgggactggactcctgataaagcaagtaagttattgggtggccgaggtaggcagatcacgaggtcaggagttcaagaccatcctggccaacatagcgaaaccccgtctctactaaaaatacaaaaattagctgggcgtggttgcgcatgcctgtaatcccagctattcaggaggctgaggcaggagaatcgcttgaaccagggactcagaggttgcagtgagccaagattgcaccactgcactccagcctggccacagagtgagactctgcctcaaaaagaaaaaaaaaagattgggggtaagttaggcctccatttgctctgtccacatgcttgctttcaccttcctccatggaatcacacagcaagaaggccctcaccagataccagagccaggctcttggacttcctagctcccaactatgagaaataaattacttttctatacaaattacccaggctgtggcattctgtgaagcagcaggaaaccgactaagacagtgaccttggaagcacaagaacaaggacatcccaggaccttgggccagctctcagatcatctcaggctccaggtgagttcattcacccttccagcccctgcctttccttgacacataggggttcaccagaagccccactgagacttccctaggctggaaaagatctactctgttacggactccagatcagtgtcttttcttatgccgagttacaaacagatctgcttagtgagaaacagaactgcacacatcttgctttgctttgaagcaggaggcttttgagatgtcaccattgtaacctcattttctttcactccaatttctgcttagcgatgcactttcttgtagccacagacatgctcatctgcagaaagtcaccagttttctttgatattgtgacaacattataactgtcactgatgaaaatgctttatttatatgtccttgtaatttattcttcattttatagacccaaagtcctccaggcactgccacaaatccacataatgtccttgaaatgcacacttcgcatttaaaacttagatttagctgactggtgggggaaaaaaccacgtgttgccagacctatcctcagtgcccatgaatatggacgacccagagagaatatgtatgtgcagctgctgccccagtagttgcaaaggtgctgattagcttagaggagacattttgcttttctcgtctcctttggcataactgatgtcacatacggttggagaaaagggacttcctcagtttgtctcactctattccggccctacagcaaaaggctcaatgctgtcatttccctccttctcctgaatatataagtgcccatgacacctaaattattctgtgcctcagccttttgtgtgctttactaagcactttactgccctaatgtgatgcagaagattgagaatccaggaggagctctgctaagccagtggcctgagtgagctccttgaaaatagaaagcaggtaaatgaagtagcttggtttcaacccagtgaaaaactgataacgagtggatgacgctaccaagaggatcaaggaggccaccataagcctgtgccataatattgaatcatctctggttaggtggaaatggcaatagatcctgtgcctttgatttctaggagaaagaggcaagtgacaagaaacacagctgataagagaatttagaaaccaaacacattttagagaatgtctagggctcagcatacacgtagcccttcccttatagcttttataatcacaattgtatcatcaaaatggccacgatgatagaggcaccaaagcaccacatgctctggaattatctaggaagcattagattgttttcagactattgtaattttttaaggcaaaaggtacacacacatgcacacacacacactattcttcacattctgtttgattgagagtacactactgacatcatgacccttaagccctatacaccaatgtttatatatcctaaaaacaaggatattatatgactatagtgccattatgaaattcaagatatttaatattgatacaatgtaattatccaacatactgtctatatccaaattttgccaattgtcccattattgttctttatagtaatttttgtttttccaatccaggatcacacattgcatttagttgttatatctccttagactcctttaatctgagacagttcctcagcctttgtctttcacaacatgaatgtcctttgaagaatgcaggcctatattttgcagaatgtcccagttatgggtttgtatgttcctcataatttgactctggttacacatttttggtagaaatactgcattagtaagggtgtgtcattctccctatcaatattcaaatgaaacatttttgagcatgagttctgatagccagggttccagaacagcacaacggtaatgcaacagagagtgaaaggacaagatgcagagaaggaacactgggccccagcagacagcatggccaccgccaggaccacgtgcttctgttactttttccaggcagacacccactaccattgcagtttctcggatctccacatgaccatttcctataaacccagccttctcttcctagagaagtctagaaatgtggttaatttccaaagtccctttctcacctctctgcttctgctggctccagtgcagatgggacttcttgatgtgaactcacacagcgagtagagctgtggcaaggccacgtggtattcatgacaattgcctcatgcccatcactattctaagtcaaggggcattcgcttgggactcactgtgcactgggacctgtgtcatctgctttgtctccagctctgtctcagacctgtgctcccagagctacatctgtatttgcaatcccttttccctctaggtattcatttgcattttctcaatcaggctcttattttcctcccttctgctgtatatctaactccctctcatcccactgtattttctttccttgcaagtgttgaaacattttctaatttggaactctgaatttcactcaagtgcttattctcaccttttcggatttctcatctgcgcttgacacacgcagcagccacctccccatgcatcagaagtctgggacactgacctccaacgcttcctcattaagcatgcctccatccaagatagagcaagtcgactgagccaaatcccagagcaacaattagtctctgaaaacaaaacaaacactccctagagagcacattcctgtaacttcattgtcaatctgattcctccaggcaaagggcattccagttacatgcactttattttctgtttgtctgtaaagtcagactgcttgggttcaaatcctagctctcaaccaccaagctgtgttctctgagcctcccttttcctcaaatgtagattgaagttaggaacttcgccttgcaagtttactgtgaggattaatgcgataatgtgtgtcagcactaaacaagaagagttagcgtttaactggatcatcacaacctcacatcattatcgaaagctattgggaagcccttgtgtctatgaacttggagttcctttcaaaaaagagctctgctaaccagtccccatcccacacctagggactgaagggctcacttctatcacagttttgagggaaaaggatggccaagctgagctcacttgaaaaggggaggcatgcccacattcccaagtaaatatttcaagagtgcatctaaaatgatgccacaatccaaatcacagaacacgaattccagctgttctttgcatatttatcagcttccaaagacttgatacgggtcctaatatttttgcttaagtcacacatatatagggacacaaacattcacagagagagagagagacagagagagaaaacatgtagcatttgacaatggaagaatctatgtagcctgtaggtgttcactgtaatagtctcagaacttgtaggtaggtttggatatttttccaaacaaaaagttttatttaaaaattaatcttgactcctacttgtatgtaaaaaacaaaaacaattttgatccatctaaatgtgaaacctagaaatagcaaataaatacaaaacaataaagcttctagaagaaacatgggataatatcacggtcttgaggtaggcaaagatttcttaaacaggacagaattgtactgaaaatacaggaaaaaaataagttgaggtatattaaaattaagaactttggggccgggcacggtggctcacgcctgtaatcccagcactttgggaggccgaggtgggcggatcaggaggtcaggagatcgagaccatcctggctgacaaggtgaaactccgtctctactaaaaatacaaaaaaattgccaggtgtggtggtgggcgcctgtagtcccagctactcgggaggctgaggcagaatggcgtgaacctgggaggtggagcttgcagtgagctgaggtcacgccactgcactcgagcctgggcgacagagtgagactccgtctcaaaagaaaaaaagaaagaaagaaagaaaaaagaaacagtactgcgtaatttataaagaaaagaggtctaattggctcactgctctgcaggctctacaggaagcacagtgctggcatctgcttggcttctggggaggacttgagacgcttacaatcatggcagaaggcagacggggagcaggcacgctgcatggtgaaagcaggagagagagaatgacagaggaggtgccactcttttcaatgaccagatctcaggctcaggagaactcattatcaccaagacagcaccaagctgtgacggagctgcccccacacgcctcccaccaggccctacctccaccactggggattaaaatacaacatgagatctgggcagggacacagatccaaactatatcagatcccaagtggcaaactgggcctaaattttaaatacagccgagcagccacttgctgactagaggtcacacatgtactctgagtttctgaaaacccccatctctgtttaattttggaactttctgatctcacctgaaccaaccaatcagggctcagctttatcaaccagtcagggtccagctgcaccaaccgatcagaactaagcaagtttgaatccttctgctgcgtaaatgaatttgattgggaagctgagtgggaaaatttctctctatggaggccaagttcctcatttgttccctggaatgcaccttccaaaggctacgtgccaaaggccgtgtctcctcagtttgcgaactgttcattggaataaagtctccttcgtcaaattccacctcagagaacttttattcacaggcttaatagggtaatggcagtcacatgaacatgcagacattatgtggttaactatgcatgagctgaagggggaagaagaaaagaggaaaggaaagcagcttggaagggtgagtaaagttcggggtaatttacccttgaaaaacggccaaacccttaagtcaaaagcaagagtttattcttttagccacccctccttttatcccttgccagcagcctggaaagttccagaatctcaggaataagttccatttttctttgcatcccccagctccctccctagtatccacacagtagcaagggctccctaaacagccttcgaatcttgttcttgagaactcactcacacgtgatagatgaaacaaaagaaaatacagatctgatgctaactgaatagctgacaaggtcatttaaaatcagacttctttcagagggagggctgcaggaatgttgttgtattggaaggtttcagtttcatctggcttatccaaaaaggaaagactttgctgccacacagggctaggcttgcaggccctagaacactgagcaccactcctgagacatgaatagcactgaaggccccagaacaggcagccaaaggactagggggcctcccgctgatgcaaggatttcaaagttaaacttgtaggtgtataagagtggggcatttaaaacagcctgcttcccaatgaggtggaattaaatggtgatgttatcctattggaggctgtctcctggaggtgataacctatgttcctgatcactggggggatggtgcccttattcctacccacttgtcatgcctcccaaatgtctgtatgacattgacctgaaaccacctttgcaaaattatgacagcaagagaaatatgacatagttgactccatcttacttctaacctccagtttctccttggtcattcctgggtgtagaccaagctgaatttgggatgaatttagtttatactttaaccttaaagcaaggatggtaatagcccttcttaaaacaaaagcacctttttaaaactaaagaaaggtcacccgttaggattatgagaggggcttgaatttgcctaagatgttggcatagttactccttactgttcaggagtcatgtggccagaggtcacaagatttgtgacttccccaattactcctgtagataacatctattatagaatctaagatttttttttgagatatctttcagactaaccccacccagactcctgactcaccccatcctgcggcctcacccagaggtggactcagaactaaggaccattttccaaaaccttatgacttcttccccaaccagtcaacatttgccattcccgtgtaccctgcccaccaaactatccttgaaaactcctaatctccaagactttggagtgattgatttgagtaataactctgtctcccacctggcgtggccagtctcacatcaattaaactttctttactgcaatgccgtagtctcagtggattgattttgtctgggcagtgggcaggaagaacttgtcaggcaattacagaccttccaacctgaagggtgaggggacagccttctggggctgatagaaatgtcttactcttctccttctgttatgggctgaattttctctcccccaccaccaaattcatatgttgaagtcctaacccacaggacctcagaatgtgactgtatttagagacagggcctttaaagaggtcattaagggaagctgaggtcatataggtgggccctaatccaatctgactggagtccttaaaagatgaggacatttggacaaacaagaagacaccagtgctcatgcacacaggaaaggccatgagaggacacagagagaagatggccatctgcatgccagggagcgagggtgcagaagcagcaaactctgccaacaccttgatcttaaaattccagcctccagaactgtgagacaatcaatttctcttgtttaagtcacctagtctatggtattcagggtttttttggtttgtttttgttttttggtgtatttttggtttgtttgttttaagacagagtcttgctctgtcgccaaggctggagtgcggtggcacaatcacggctcactgcaacctctgcctcccgggtttgagtgagtctcctgcctcagcctcccgagtagttgggattacaggcatgtgccaccatgcccagctaatatttgtatttttagtacagatggggttttgccatgttgcccagactggtctcgaactcccagtctcaaggcatacacccaccttggcctcccaaagtgctgggattataggcgtgagccaccacgcctggcccagtctgtggcatttgttatgacagcccaagcaaagcaacacacaccttcccagccttcatttctcattggcatgatgcctcctcttggcctgctgctgattccatcctaatgccagaccaacaaggctctgctcacccagctctgagccttaccccagtgctggctttgctctgctcttcctgatcctctgatctccttctagtcctgccccagggcaactccacatctggctattcctggctcttactcttctttttacctcaacccagaccagcagctcaccaagccaccaagactcatggttcctcctgtatgcagcccttgtctgacaggccacgtggtattgatcacttgtggggtcagagaaagtgggaggaagtttgaagcattttagaggatggcaagagacggaggcccttctcctttttctctcattatcccctccaagaacttcccacaggttgataaatattgctatggtccaaaacagaaggtgcaatttggctctattctcagattttcctcctatgggttagtaaaacagatggaaggctgtccaagtccaagagagagccagactcattcagagtgatcttttcaatgctcgaaaacctggcacagcgctgtctttactaattctcaccctgagaggagaccaaaggactcattgggatagaggccatgtgagagtggggatgttaaaccaacagctcccctaggttgaggcaggtttaggggtctgctttgtgcacacagaccctattaatatcttatgacccacttgggattatttgggtggaattgtttgaagaggagaaaaattctctttgcttcctattaagatgccaccagatgatcccctggcagagttctttggctcctttctcacaataatgaaaaaattatatatacaccttatttcctttttaaagacactagatattgggatgccaaggctcagattggactgcgtgctaaatctcaaaattttcagacagtttaatctgcataaagacaaacagtttggactcacctcaatgcacatctgatcccaggaggtgatgactttacagccggcagaaaacagcaccacccaaaagaagcagctgacgtcaaacgccatcacaggctaggattgcttggtgggtttacctaatgcttggagctgagaaatggaatcaaactgtgaaggccctggcaatttggcagccagagaggtactcagaagggtgatcttggaacaagaaatgctgttgactgctcagcattct

SEQ ID NO: 1579 - DNA, 7409 bp, Homo sapiens
aggcccctgcctgccccagcatcccctgcgcgaagctgggtgccccggagagtctgaccaccatgccacctcctcgcctcctcttcttcctcctcttcctcacccccatggaagtcaggcccgaggaacctctagtggtgaaggtggaaggtatgtccaaagggcagaaagggaagggattgaggctggaaacttgagttgtggctgggtgtccttggctgagtaacttaccctctctgagcctccattttcttatttgtaaaattcaggaaagggttggaaggactctgccggctcctccactcccagcttttggagtcctctgctctataacctggtgtgaggagtcggggggcttggaggtcccccccacccatgcccacacctctctccctctctctccacagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggtgagggccgggctggggcaggggcaggaggagagaagggaggccaccatggacagaagaggtccgcggccacaatggagctggagagaggggctggagggattgagggcgaaactcggagctaggtgggcagactcctggggcttcgtggcttcagtatgagctgcttcctgtccctctacctctcactgtcttctctctctctgcgggtctttgtctctatttatctctgtctttgagtctctatctctctccctctcctgggtgtctctgcatttggttctgggtctcttcccaggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccagggtatggtgatgactggggagatgccgggaagcgggggtccagagacagaggggaggggaaactgaagaggtgaaaccctgaggatcaggctttccttgtcttatctctccctgtcccagacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccaggtagagtttctctcaactgggaggcatctgtgtgggggtactgggaagaagtggaagccagtcaatcttagattcccccaacccgagggctactcccagcctcaccccaaaccccaacttccacacagaacactgactccaagtctttcttttttttgacagagtctcgctctgttgcctaggctggagtgcagtggtgccatcttgtcttggctcactgcaacctccgcctcccaggttcaagtgattcccctgcctcagcctcctgagtagctgggattacaggtgcccaccaccacgcctggctaattttttttttttttttgagacggagtcttgcactgtcacccaggctggagtgcagtggcacgatctcagctcactgcaacctccaccttccaggttcaagtgattctcctgcctcagcctcccgagtagctgggattaaagcctggctaattttttttgtatttttagtagagatggggtttcattatgttggccaggctggtctcaaactcctgacctcgtgatccacccgcctcggcctcccaaagtgctgggattacagacatgagccacagggccgggccaagcctaattttgtatttttagtagagatggggtttctccctgttggaccaggctggtcttgaactcctgacttcaggtgatctgcctgccttggcctcccaaagtactgggattacaggcataagccaccgcacctggcctagacttcaagtctttcttccctcgcttccaagacactacttttctgggtcttcacctaccattgcttgcgcctgcccaccagcttgggtggagtcttccttcctccccaactcctcactcttggagccctgggccctcttcttatccctgtctgcacactttcctatttgaacttgactctcaatggcttcttgggtcaccatgccttggtgactctattccaggctccatactcagccatctcctgtgccatttgatatcccatggacacctcaggctcaacagatacaaaatcaaactcaatgtcttccccaagtatagtcttcttggtggcccagtgtaagcagagggcaccaccacctgctccctcgcccaggctaagaacctgggcatccttctttttcctcaccccgtccaacaaactggtcacagtgttctgccaattctctctccatgcaatcctatcatgctatcctaactgcaattcacaaacccaaccccaactttcactccaaacttgatccaagcaatgtgctggatcccaactgtaaccttgcaaactcaactctgcccttcactttgaccgtgactatccttaattgcagcaggaaactgatcattatgctcccctcaatccacacattgcctctgagtacagccatggtttgtccacgatttgctcaaagacactgccccatgtcctgtgccagggtctgtgacaatccctgacctcctgggacatggctccttagagagaggagagcctttctcacagcttgggactttgagtctgtgtctttttttttttcttgagacggagttttgctgtggttgcccaggctggagtgcagtgatctcggctcactgaaacctccgcctcccgggttcaaacgattctcctgcctcagcctcccaagtagctgggattacaggcacccaccaccatgcccagctaatttttttgtatttttagtagagatggggtttcaccatgttggccaggctggtctcgaactcctgacctcaggtgatccacccgcctttgcctcccaaagtgctgggattacaggcgtcaaccaccgcgcccggccgagtctgtgtcttgcctctgtgcctcagacttgcggttccttgagatctcaggattgggacgtaagatgccagcctggggtcctcgtctcatagccccttccccctagtactatggcactggctgctgaggactggtggctggaaggtctcagctgtgactttggcttatctgatcttctgcctgtgttcccttgtgggcattcttcatcttcaaagaggtgagtcatgtccccagtgggtctgtccaaaccctactccatcttccccaggataagccggctctggccagtctgacaaccatctttctttcctcccatccctcccttcaagaccccagaatcctgttctccccagtcttcctctagcctccctcaaacttcccaagcctcttgcaattttttttttttttttgagacagggtctcattctgtcaccccagctggagtgcagtggcacaatctgagctcactgtaacctctgcctcccaggcttaagtgattcttgtgcttcagcctcccgagtacctgggactacaagtgtatgccaccacacccggccaattttttatatttttagtagagacgaggtttcaccatgttggccagactggtctcgaactcttgacctcaaatgatccgcccacctcggcctcccaaagtgctgggattacaggcacgagccaccgcgcccgtccgcctcgcaatttgaactcctgtctcctttgttgaaccaagtgacctccccagcacctggccccacaaatcctcaccctgccaagcagcccctcctctgatcacgccctttaactcccaccagccctggtcctgaggaggaaaagaaagcgaatgactgaccccaccaggaggtaatgcaaccagtgcaccccgcggtaacaccctccaccttcactttatgccttgcacttactgtttcctctgcccaggggttctttgctccgtctctactgtttcaaatactgcccaacctcaaagcccagctccaaagctacctcctctgtgaagaactccttggaaatgatcatctcagactcctctattggctgtcccagcacaagtgatcacgtttaacttctgaaggcctggacagaatcttgagtgggtccgccattccattccaagtcggccctcaccgtgcacttcctcttctcccgccagattcttcaaagtgacgcctcccccaggaagcgggccccagaaccagtacgggaacgtgctgtctctccccacacccacctcaggcctcggtaagaggcaccgcccctccagcctatagctccgccccagatccggggctccacccccactctcctcatccctccaatccgctgtgcgccaagccttctggagctcggaactccgcccccggggcggggagtcccgcccagctatgagccccgcctctagaaccagaccccgcctccagggctcagagccacgcccccaggacccagagcctgaagtcgtaatcaagagcagaacttcgccccagaactgaaggcctcggccctagatttagattccgccccagggttcaaggccgggttcctagacccagagtccattcgcagagcccaaaacatcctcttcccgtgccccgccgcgcggacccttagccttgaccgcccccatctcttctgaccccgtcttacaatgcccctctcaccaggacgcgcccagcgttgggccgcaggcctggggggcactgccccgtcttatggaaacccgagcagcgacgtccaggcggatggagccttggggtcccggagcccgccgggagtgggtgaatgactgggagagggaagggtcgttccccacatggagggggttggagcggtctgtggcccgaatagtggactgggccctggaggagagggggcatgactcggttccccatccccatccccaaacccccaggcccagaagaagaggaaggggagggctatgaggaacctgacagtgaggaggactccgagttctatgagaacgactccaaccttgggcaggaccagctctcccagggtaaggctgccctcccccgtggccccccacctctgcggtggcctgtggactcccatggacacccctccttctccaccagatggcagcggctacgagaaccctgaggatgagcccctgggtcctgaggatgaagactccttctccaacggtaacttggggcctttgtgggacctcagagacttaggtgtaattgcagcgctgtgacactcctagaaggggtccctggagttctctctcttctgccacagctgagtcttatgagaacgaggatgaagagctgacccagccggtcgccaggacaatgggtgtgtgtgaggatggcaacagtccaggggggaggcggaggacacctggaggccaggaggaatagtaacctccctcttccctttccagacttcctgagccctcatgggtcagcctgggaccccagccgggaagcaacctccctgggtgagagatgctttcaatcagactgccttgcccagcttgggtgacctggcctcagctctgacaccagatccaactttgacctgaccctgaccccaaacccgaacccaatcctgtgactcctctcacctcaacactgagccccatcccccatcctgagccccatcccccatcctgacccccaatatttaccccctccctaactgtgaatatcaacaccgatcccaatgcagtatcagcctggacttgatctccacctcacctcagccccagtgcagacctcaacttggaccccagcttactctgcagcttcttcatgactctgactccgactccctccagtttcttctttttctttttcttttttttgagacggagtctccctctgttgcccaggctggagtgcagttgccacctctgcctcctaggttcaagcgattctcatgcctcagcctcctgagtagctgggattatagacgtttgccaccacacctggctaatttttgtattttcagtagagacagggtttcgccatgttggccagactggtctccaactcctggcctctagtgatctgcccgccttggcttcccaaagtgctgggattacaggcatgagccaccacgcccagcccagttctgttcttgaccccttccttagccataatctaacccatatctaaccctgaccctacagctaactggggccccaaactcaatgctaaccaaatcaccccttcccagcacagcatgggtaatgctcctcaccttcctctgcccctcagtcttcctccttaccgtaggctgtacttcccatgccctagcctccaattctccatcccccgcccaagcagggtcccagtcctatgaggatatgagaggaatcctgtatgcagccccccagctccgctccattcggggccagcctggacccaatcatgaggaaggtgggtgcttctgccgctgtcccctgctgtcccctgggctgactttgccttccagcctacttccagtgccacccatgttctcctcctccctggtcctatccagatgcagactcttatgagaacatggataatcccgatgggccagacccagcctggggaggagggggccgcatgggcacctggagcaccaggtgatcctcaggtggccaggtgagctgggactgcccctagggaaagcggggagggagggagataggcacggatggcagtggctgctggctttcagggagggagagggaacagggttcctagggcctggtgggcagggggaggactgctggacccctccccatcaccgtttcttctgcatagcctggatctcctcaagtccccaagattcacacctgactctgaaatctgaagacctcgagcagatgatgccaacctctggagcaatgttgcttaggatgtgtgcatgtgtgtaagtgtgtgtgtgtgtgtgtgtgtgtatacatgccagtgacacttccagtcccctttgtattccttaaataaactcaatgagctcttccaatccta

SEQ ID NO: 1580 - DNA, 7409 bp, Homo sapiens; identical to SEQ ID NO: 1579

SEQ ID NO: 1581 - DNA, 7585 bp, Homo sapiens
tttgtagagagaaaaatttattgcaaggcagccaagcaaggacacaggagtctggcccaaatctgtctctccaagttggaggctggggcagattttatatacagagggtagtgaggcatgatatgattggatcttgtaatgaggggattcaggaggcttgatctgactggatcacgccagggctcaatctgattggatcaaggatcatgccacgtggtgtccacttcttaactcagtccctgttcctcggtctgagcacttaggttccacgtggatttgcacgcttcgttcatctggacatgcccagggtatgtaacttgcaacctgggggtccacgacaactgaaaaacaactcgccattttattacacaaagttgaaccagattgggctgaatctgcggttacaatgtttaccagtttattataaaggatacaactagaggggcggggcggtgccggcaagatggctgcgcccgaaaaggtgacatttccagagaaaccaagccacaaaaagtacagggccgccctgaagaaggagaaacgaaagaaacgccagcaggaacttgctccactgagggactcaggactctcacagaaagaggaggacacttttattgaaaaacaacaactagaaaagctatggggaagagagaggcaaagattacatgaggagtggttgctgagagagcagaaggcacaagaagaattcagaataaagaaggaaaaggaagaggtggctagaaaacggcaagaacaagagcgaaagttaaaggaacaatgggaagaacagcagaggaaagagagagaggaggaggaacagaaacgacagaagaaacaaaaaccggaagctgtccagaagatgctggatcaggctgaaaatgagttggaaaatggcgccacatggcaaaacccggaacccccccttggatttcagagtcatggagaaggatggagttaattgtcccttctacagtaaaacaggagcttgcagatttggagatagatgttcacatgatttcccaacatccagtcctacccttcttattaaaagcatgtttacagtgtttggaaaggagcagtgcaggagggatgactatgactccgaagcaagcctggagtacagcgaggaagaaacctaccaacagttcctagatttctgtgaggatgtgctgcccgagttcaagaacgtggggagagactgggcgcggtggctcaggcctgtaatcccagcactttgggaggacgcggcgggcgaatcacgaggtcaagagatcgagaccatcctggtcaacatgttgaaaccccgtctctaccaaaaatacaagaattagctgggcgcagtggtgcacgcccagctaatttttgtacttttagtggagtcccagctactcgggaggctgaggcaggagaatcgcttgaacccgggaggcggaagttgcagtgagcctagatcgcgccactgcactccagcctggcgacagagcaagaccccatctttaaaaaaaaatagtaattaaaaaataacgtggggagagtgattcagttcaaggtcagttgcaacttggaacctcacctgaggggcaagtatatatgttcagtaccagtcggaagaagaatgccaagcagctctttctctgtttaacggacgatggtatgtacgcaggacgacagcttcagtgtgaattctgcccagtggctcggtggaaaatgatgatttgtggtttatttgaaatacaacaatgtccaagaggaaaacactgcaactttcttcaggtgttgagaaatccaatagagacctctgcttgtctcctcctttggcaagagctccaaggggagagagagggtgggccaccacgatgaatactacaggctgcggggaaggagaaccctagtccagaccattcctacaaaagaaatggggaatccgaaaggaaaaggaagaaatctcactagcacatgtcaaagagccaggagaggcacaattcacctagcagaggaagaaatagtgaccgcagcgggggccggtgcagccgcagtgagaacggccggagccgtcacagccggagccaaagctcctctagatcccaaagtcgtggtaggaggagatcaggtagtagagacagaactgttcagagtcccaaatcccaataaacctgttttattcttacaaaaaataataggccaggcgcggtggctcacacctgtaatcccagcaattttgggaggccgaggcgggcagatcatctgaggtcgggagttcaagaccagcctgaccaacacggagaaaccccatctgtactaaaaatacaaaaaattagccgggtctggtggcgcctgcctgtaattccagctactcgtgaggctgaggcaggagaatcacttgaacccgggaggcagaggttgcagtgagccaagatcgcgccatggcactccagcctgagcgacaagagtgaaactccatctcgaaaaatagtaataataataataaaataaagaatacaacttagaaacagccaaatggaagccatgtataagacaaaggaagatgtgggggtggaaggggttgcgtggagcctccatgccctctctgggtgccattggttgactgggggaattaattccctggtgcttccagcctgcaaaatgagctcttgcaaccagtaagtccccgatcaaaggggtgcaggaggtggtaggtggaagttgaacagatggtaggtttgcatgtataagataacgccccaggggacatagcagctacacatggcaacccaaatatcctaatctccaaaaggaagagagagtggattcttggaacacaagtccacccccaaaggcatcccacaccagctcactcataaagctccaaggatgggccagaaaaacaagctctacaccaggggaaattggaggcatgacaagaaggacagaatgggacccagccttctaaaggaggaagaatctgacaaagaacagtcccagagattttgtgaaggtcgaaggatggagagaaggaactgtagcttaaaagggggtgaagttctgctacgcaggaggggggtttggggtggcaggggctggagaaagaaactgttcttcatccctggagcaggaggctgcggactttttgcagatccagaatttggcaagattacatttgtcgtcgttccagccattgccactaaattccgcgcagtcttcctccccaacgttgttgggctctcctctgttccaatactgcttgaagctgcaaagcccatgcggaatgtgagcctctgtccccgccagctacatgagctgtgtttctaccttctgtcatcttgatgccttaacatctgccctgcgtgtgtatgctggacttgaatccctctgcatacctgataatatgcctgactcacgatgccttgagttcctgcctctcttctcacaacctgtccttgggtggactccacctattgagtgtgtgattttcaaatacaagccaaccagtctggagtccacacctccagcgacctgccttactgggctcttgtactccaagccactatcctgtactaatcaccccaaggccaggtgtcagacagcgaggggcagcccctgtgccccagagcccaaaaaatgcttcacacttcccaatcctaagcctgttcacctggccttgacctttcctttccacagaaaccataataaaggctctggcccacagtcccccctccccaccactctgactcataacagaccctggtgcttccccaggtggcccccagctgtgatgtgtcctctctctagggatctgtgtatatgagaagctattcacaatggcaggtgtctcctgagctggtggccttactggacctcagacttcctattaatacattatattttaatacacctccccggtggcaggctcctcctgcagctctgctggtggaattctaggcacctgccatgctgtctggaagtgggtatgaagaccaccttcctcaactcagtaaaacctccagattcttgggtctagggtgtcagggagttggggaggatccccagggaaagttcaaatcagagtttcacaattccagccccagtggatagggtgccccttctgagatctacctgggcaacagaggtgagccgtccacccattgccacgtgccttcctgatttagatctgaaagtcccatccaggtgaagcggttacttctggaagactgcagctgtaggaagttctggagggtacaggaggagtcaggagggagctctgcttcccattttccaggctctgtctccccatctcttggtaggaagttctgcttgtaggctaacctacagccttctggtatactaggtcctgagccccctcgtgtctgagtccctctcacatgtgtatcccacggcacatgtgtcctgacatgcacacatccatgcacagctggcctctcctcacaccctcttgctaatactgcatgtttatccatttcacatgttctgtgcatgtccatgcacatttactcataactgggcttaatgtgttggagccagaggcaaccatttcctaactgctggtcatgcacatctcctttcagctctgcactgagtgacatcacaacgacagcttgaaatcagccaccatgggaatatttacaccagggaaactggcaaacacgacccatcaggacttcttcctccagagagctggttgttaacctcttgcagcatgctgcaggggtttgcttacatttgatgtttttttccggagcattcacacatgttcagatttggtttgtatctgctctaagggtacttgagactccctcattcatatccttctcctcccttctttccaagtggagcaaaacccctcttctgcaaagtcatctctgagcacctcctccccagttggccagaagccatgccctaggccaggacggggacccccaccaggtgtacctgctcctcagcacttttgattacgacgagctgggcccccacttctttgcaggcggtgatggagtcgtgccagttccgctgggagttagacatgaagtaacagtttccttggaagaatgtccattcccagggacaggggtggcacaggcgttctgttgggggaggctggtcagggctgggcttagattaggttgtccatattcctgtacctgcccagccttcaaggtcttgagagtcagagtccttccttgactgtccacgccgggtagaccattcccctccccacttcccgagaccctcccccatccccatgagaacccaggagtcctggccccatctcctccagactaggagaagttggggctttagaactcagaacagaaggcaggagactggcttaactgagtgcctgttgtgtacctggcccactgtgaacactgagggcaatgatcacagttaccctgtgttctcatttcacagatgaggaaacttgctcaggcagggtcagtgactcaagcaaactcacaccacacaacgaccatctcaggcccaagaagccctggttccagatactcacccactgcagccttcagctgggtcagctcctggtagatctcctgctgcttagatttctctggaagctcacccactgcagccttcagccgggtcagctcctggtagatctcctgctgcttagatttctctggaagctcacccactgcagccttcagccgggtcagctcctggtagatctcctgctgcttagatttctctggaagctcacccactgcagccttcagccgagtcagctcctggtagatctcctgcatcttagatttctctggaagctcacccactgcagccttcagccaggtcagctcctggtagatctcctgcagcttagatttctctggaagctcacccactgcagccttcagccgggtcagctcctggtagatctcctgcagcttagatttctctggaagctcacccactgcagccttcagctgggtcagctcctggtagatctcctgcagcttggatttctctgagagctcacccactgcagctttaagctgggtcaggttctggtagatcgcgtcttgcctggattgttcctgacttatggagctggggaccttggacactgggccaagaaaaaaaaggaactgcaattattaaacacctactgtgtgccaagccttgaactgagccccatagggacatcatttgtgagagccaaggtcttggttaatcccctttgaagatgaagaaaactgacacctggagaaggcagcacagaaggccaaggagagccagattcttcctgtcctcctcctcctccctctcctgtcctgccctagagtggggaggggctgtgggagaggcccctacagacccccagggacaacatcttggctctcagtcccacctccctcccagatctggcagccccaggctgtgtccacagccaaaagccaggcgtggggaccccagaccctcagaacctgcccctgaccttggacaaggagcccagccaagagcgtgaaggagaggagttgcagcaccaggggaccatggccaagacaccctgagagaggatacatgcgtcagcctgccagtgtccccaccggagcctggcccagggagagcctggtctaaatccctcagcaccccaggacccaggaaccccagccccagccccctccactccaacacctgggaatccaggccctagctctaacctccccaggacccagggaccccgtccccagcctccccttccccaggtcccaggaaccaggtacctgcttccacctccccaggacccaggaatccaggccccagcctctacattcccaggtccctggaacccaggcccccagctcccacctccccaggacccagggacccaggacccagcctccccttccccaggtcccagtaacccaggtacctgctcccacctccccaagacccaagaatctgggtcccagcccctacatccccaggtcccaggaacccaggcccaagtccccacctccccatgacccaggagtccaggcccaggcccccacctctccaggacccaggagtctaggcccctgaccccacctccccaggacccaggaacccaggcttcaacttctacctccccagaacccaggagtcttggccccagcctccaccttcccaggaaccaggaattcaggccccaaactcaacctcctcaggtcccaggagtccaggcccctagccccacatccccaggacccaagagtccaggccccagcgtccagctcctcaggacccaggagtccaggagtctctcgtctctcctcccaaactgctaagtcctctctacctgctaagctcttgtatcctcgagtctgtcggaatccaaggcctctcagctgttcctcctctgaatggatagacgtgaaatcagagcctgggcaggctgaggccatggctggccatcccttcccccttcccagaatcccagcgtcccaacccagcctcacccaggaggcccagctgctgcagtcttggttccttggagtcactcatgtcaccccactctcccccagtgtccagaactcctgggggccacagcttttatttcccaccctgtgat

SEQ ID NO: 1582 - DNA, 7585 bp, Homo sapiens; identical to SEQ ID NO: 1581

SEQ ID NO: 1583 - DNA, 7585 bp, Homo sapiens; identical to SEQ ID NO: 1581

SEQ ID NO: 1584 - DNA, 7585 bp, Homo sapiens; identical to SEQ ID NO: 1581

SEQ ID NO: 1585 - DNA, 7585 bp, Homo sapiens; identical to SEQ ID NO: 1581

SEQ ID NO: 1586 - DNA, 7585 bp, Homo sapiens; identical to SEQ ID NO: 1581

SEQ ID NO: 1587 - DNA, 7585 bp, Homo sapiens; identical to SEQ ID NO: 1581

SEQ ID NO: 1588 - DNA, 7585 bp, Homo sapiens; identical to SEQ ID NO: 1581

SEQ ID NO: 1589 - DNA, 87971 bp, Homo sapiens
tgcattttcactgaagcatttattatgcaaaataggaaggctttagcatgccagtataaattaaaacagtagaaaaaaagcagagtagagagcgttttccatccatggcctgtgccctgtaatgacgcagcagtatcctagtacattgacgggtttttcctgtcctgccactgtccgctgggcagttataggtcccatgtgttgggtcttcctgcgaggccttcacaaagatgattttgtcattcgctgaaagcgtgaagtgaatcaacggcctcctcttgctccgcagcactttattcacactgtgtaaccacatgttttttatgccactttgtgcacagctcatcaaggtcagtctgttcatcttctggcccctgtagcacatggtacagttcaatggtgcggcacagaggcctgaggcagggaggctcccgctgccctcgcaggccctggctgaccctcccctgcccgcccaccttcccatgcccctgcagctccctggttgcacctggcctaggctcctttccatctgcccctctgcccggccctctcaccagggaggcacaacatggcccagtacagttaccttgaaaggaggtgaaggtgacaacagaagccaaatttacagcaggagtgaagccactcagacacagagtgatacagacattagggcatgtgctagcatctgcgctttctctggggactttacaaaacagactcaacaactcagctgtgagaggcagtgcgcccgcctcccagggagaacgaggaaccgccaggagacaggtctacctgcaccaccggcaaaccagagggcccaaggccagggccgtaagccctgggagtacactcccttaaagagtgcagggacaacagtctgtgtgtgaaggtttggagctaaatataaccaaagcatcctgtacataaaggggaatacttcagtggctgagaagagtgaaccgggttgtaaatgcttcatcctgtgtctcataatctgggcgtctgcaggtctggcctttgagtggtgaaatcccctggctgttagcgagggggcagggcctgcatgtgaagggcgtcgtaggtgtccttggtggctgtactgagaccctggcgtgaaagcaaatcagaaaacaaagagtgggtcagtagcctgtgtgggcaggagccaacccagaggccaacaggtgtctctgcagcacagccctgtgaccacccacccagcctccagaggcccaggaataatccccctggccccacgggcaggagccttggctgcaacagcttcgttggtagatgggtgctgtgccctgccgggaatggccttgcagcaactcctttccagctaaattctcacccctcttctcagctcctcaaatgctgtgccttacagtgcttgggccccgccaacttcctgctggacctaagagaaaggagtctcccacctcccatattgggcaggaatcaggggggagggcccagacctgctccagagaatctgctgtccctgacacctgggcccaaaggaagcctggacttgtcacagggagaagaggggctccttggcctcagccctctgtgagcctccttcccttcccaggcccggtgattctagtgttttcttggtcacgaacaggcccacaaggctggccccaaacctgctggaatgcctgtccccctggtccaggggccaggaaggagaaggatcaacagcagccacacacaggtaagtttctggggcccttttgatatcactcaactcaggcaagctgggcatcctgacactagagtcagaagaacgagctatgaacagcccatgggagccagaaggagggaaatgacaacccgctggggatcatgttttagagaagtagtttgaccgtgcttagtttgcataattgcctgcactgatttgcaaaaaccaggcacctaactacataacattttctttctgaagctgccatttttcttagctttttttccttcagtcttcccagccaacctctcatcttactaggcctaaggaaatgatgcagagtgagggttctacaagaacccaaagaggcaggataatcacttgtgtggtcctttgcctccatctgcatcggcggggaggctgcgtaccctctggacagctgctgctctgtctgccatggccaagcaaggcatggttggagccaagtaattcgcttgaatggccaagtcccagctgtgctccagggacttattggcagtggcgttgccactggcctaaatgggtgccttgggcttgccctgcccagctgttggcaagagctggtgccaccagcaggcaaaatgtgggggccttgatcttgccccttgtcaggtggtgccccttccactgaagggacgccggcagctcctacctggtaaaggccatcgtgccccttgcccctccggcgctggttgtttgggagtgaaatgagaaaaggattagaaagtcaggcagtcagtagtggcatttctgctcaagggcccctcccaaggtacccaggaagtcagaggtaactgtctcccagcagcacccctgcccctgggagagaaggatcctcaggcccctggtcagaccttcatctctgcagagtaaggtgaggcctggccatgatggggcttgggtttgctccaccccactcagatcctcacagacatcagattcctaaggtctagggcccgcaggacctatattgcctactgcttagataaatgggcttcccttcagctcttaaagttcttggctagtcatttttgctcactgacaaccagctgttttgagcagttacgagctctggcatagtcagttcaatcacgtgcccgtttaccagctagaagaccttgggtaagtcactcaacctccttgtgccttgcagggcacatgtttctcattgggttgttgtgggaattaaataaaactacagagaacccctgcttggaaggggtcaatgcttcactctcaccattttgaaattcttaattgttgatgaacaattaattgttgatgaacaattcttaattgttgatgaattgttttcatgttgtcctgggacctgtggtcctgagcactgaacacggcagcacatattaagcactcgatgcttcctgttattaaaacggacctgcttttgcaaagcttaggctgtcatagaatctagatgtggttttctgtactgaaagagcatcagcccttccttagtttcttatgttctgcccggctgggtgacagccaggttcgccttcacctctgatggccaccacatgggcatttgcagctgggatgagaagtggatgggaaaggaggcctgcagcaggcgtgtctggaggaccaagaggaactccctcggaaattaagaaacagcaacactcacctcgcctttcatcccaatctcactgtaggcctccgccatcttatctttctgcagttcctgcagaagagggcgtggaacactgatttttaccaactaatgcagaaagcagcaggttcccctacaacaggaagcttcttgatccccaagttggcagcagtggcagacagggagggctcccacaatcaaggctccaaaccttatgcacacaaacttctctgcccacaaccagctccagcccacccccctcatcctcagccctttggagtctcctccgagctgccagctctttgcactgagctgaggggctcaagttaggctcaaaaagataggaggtggagttctagacaaagacacggagactgggcaaaacaagggctcacctggagccccagaatcatttatctgagcaagttgtctctttacacagccaaacgggctgtagatcaaccctccctccccacaggaggggcggggaggcatctccttcacagaaggctgccacctgcaagggtctcctgcatggcaacccagatcgacaatcagggttcagggtcacacccaggagggtgaggttgaccttcctataggggggtacactcagaagacttcagcacccaggacaggagcccctcgaaggggccagccacctcgtccttgcctagcttgaccttgctgtgtccccctacaccccaggctgatcaacctgggaactccagcagcagggtttggggagggaagggagattactcggcacttttcagctaaggagactttctagaagcaggtgctgctgcaggccgcaagcaggtgagacattactcgatccaagaagggaaggtctggacagacaaagaccacagagtgaggagcaaccgccttcctctggagccctcctccagcccttcctccagcccttcctccggagccctcctccagcccttcctccggagccctcctccagcccttcctccagcccttcctccggagccctcctccagcccttcctccagcccttcctccggagccctcctccagcccttcctccagcccttcctccggagccctcctccagccctacctccagcccttcctccggagccctcctccagcccttcctccagcccttcctccggagccctcctccagcccttcctccagcccttcctccggagccctcctccagcccttcctccagcccttcctccggagccctcctccagcccttcctccagcccttcctccggagccctcctccagcccttcctccagcccttcctctggagccctcctccagcccttcctccagcccttcctctggagccctcctccagcccttcctccaactttccaaggtcaaatgtgaggtctcctctactcacattgtacaggccttcctgagggttcttccttctctgctaggaaagacaacgggaagacgttagagggagagaaacacaaacccaagccatgaaagtacagcaaaccccatcctgccccctgactgcagtttcctggggctctgccgtctgcctctctcctccctgtgctaccccagccttgcctaggccactgttggggccctcatggcactacatggctcatacttggttacctgcaactggatacacacttcgctcttccagaggggcccacccaagcccagcattgcccagggcaggccatcgggacgcccacacacatcacaagctgacaagtgggacttttggctgaagacaaaaggagtcacataccatcatttggagcagggccagccactggtagtgagtgcctactgaaaggtgccctccccacaccctcctagtcctgacaagaggagaggaggcaagataaacttggatggtgggggtgaggagtggtcaatgaaatcgacagcctctctactgcccattcactctagcaacaacacaaccagcacagggatcagcctggacaggggctggatggacaggcgtgaccactggcagcatctggcagcactgcccttacaccaggacagccctggcctttgtcctgagccctgtgcttaaaaggaccctaacaagtcaaatttaacaacacattaaaaggatcattcagtgtgatcaagtgggattaatccctgggatgcaaggatggttcaacaaacgaaatcaataaacatgatacaccacattaacagaatgaagaacaaaaatcatgatcatctcactagatgcaggaaaagcatttgacaaaatttaacatcctttcatgctaaaaactctcaacaaattaggtatagaaggaatgtgcctccacacaataaaggccacatatgaccaatccacagctaacaccacactcagcagggaaaagctgaagcctttcctccctttcttctaagatctgaaacaagacaaagatgcccacactcactacttctattcaatatagtaacataggtcccagccgagcaattagcaaaaggtgccaagaatatacaatgggaaatgaatggtctcttcaataaacggtgttggaaaacctggatatccacaagcaaaataatgaaattggaccttatctcacaccgtatacaaaaatcaactgaaaatggattaaagacttaaacataaggcctgaaactgtaaaacttccataataaatcatagatgaatagatatttctcaaaagaagacatataaatggctaagagacatatgaaaaaatgcttaacatcactaaccattagggagataaaaagtaaaaccacaatgagatcacctcacacttgttagggtgcgcattaccaaaaagacaaaagacaacaatagttggcaaggatggagagaaaaggaaacccttgaacactcttggtgggaatgtaaattaatacaaccattatggaaaacagtattgaggctccacaaaaaactaaaaatagaactaccatatgacccaacaatcccgcttctgggtatttacccaaaagatttgaagtctgcttgttgaagaaatgtctatactcccatgttgattgtagcactattaacaataaccacggctgggcgcgggggcttacacctgtgattccagattgtagtcctattaacaataaccaaggctgggtgtggtggctcacgcctggaatcgcagcactttggttggctgaggcgggcagatcacttgaggtcgaaagttcgagaccagcctgatcaacatggagaaaccccgtctctactaaaaaaactacaaaattagccaagcgtggtggcgcatgcctgtaatcccagctactcgggaggctgaggcaggagaattgcttgaaccctagaggcagaggttgtggtgagccgagactgtgccgttgcaccccagcctgggcaacaaaagctaaacgctgtctcaaaaaaaaaaagaaaacaaaacaaaagaaaccaataaccaagttatggaatcaacctaagtgtccatcaaagaatgaacagataaagagactgtggaacatacacacaatagaatactattcagcttttaaaaaggaagaaattctgttattcactctaacatggatggaactagagaccattatgccaagtgaaatcagccaggcacagaaagacaaacactccatgttctcacctatatgtggaatctaaaacagtttaactcactgaagcatggacaggtagcatgatgtttaccagaggctggggaatggggggaatggggagatgatagtcacagggtacaaagcctcaattagataggaagagtaatttatttttagatcaacagcacaacatgctgaatatagttaatatgtgagtactatacattttaatatctctaagagtaagttgctaatgttctcatcacaaaaaagttaaagatttgaagtgataaatatgttaattagcttaatttaatcatttcatattatattcaaaaatcataacaatactttgtaccccataaatatgtagaactataatttgtcaatataaaataaataaagacagaggaaggaaggaaggaaggaaggaaggaaggaaatcagaatgaaggggaaaaaacaaagaggaccctaccctactgtggtgtcatccagctgctcccctacccacaggtatacccacaggtatagtgtctacaaagccaagaggtcaaaccccccagggaccataccccgaccatatgtgggttatccaggggtcttgggcccttcctgtatggacctcttcaccaggtctgtcctcttggggcagatggcgtcaccgtatgtgcatctcaggatggccaaggagcagtttgaggggaagtgggtagagcttagacatgagcagtggggtgccacgtccgggggtgaggccccttgagatgcagaatggagccaaggaggaaggaagagggtgcggcagcaagtgggtctccatctcttctcttgtcctgggcccacacatgtgagggtcgagtctggttgcagagtgagctgaggagccctcccccacagcctgggctgagccccaccacacatgcaggaacacacaggaaggtagaggaacccctaccggctttccccccatctcagggtcccggccacgtctcttgtccaaaacatcgtactcctctcttcgtcctagattgagctcctataacagataagaaagtgtcagacacaggacggaggaacctcagaaggatggagccagctggactggggagtgtggtttccctctctggggtggctcataaaaagaggggcaggggctggggaggggatggtaactggtccatctggagaccatcatcccagaggacatctcagagaacacgccttaacatgacagtggatgggatccccaaaggtcaccaagtactataggctgatcagtccaacgggataaggatcaacattctcatgagcaaatagagaagtgggggctcagaggtggtagtcaatttcaccacagtcccattgcacagggagtgtgaaatcgctttcccctcctctgggaagattctaatacattccttctccacccccctctagcctttgcaaattgctgatggcttgggggctcactagtggcaggcactagactaagctcgttccatgcatcaagacattaaagcatgtaatctttatggcgccctttgagacaggtacaattactacacctgttttgtgggttagaaaactgaggttaaacaagttgcagccgggtcgcagaggtgatagctagggaccaaacctaaacccaagactctggcgggcgcgttccctaggtccgaggaggaggctgcccttcctttccggagggtctacggcgaggctgacttacgttatagagctggttctggccctgctggtacgcgggggcgtctgcgctcctgctgaactgcaacacagaaagcaaagcgcgttactgctccgcgagggcgcgcaggggagccggggtgccagggcgcgcggcgacccgagggacagccctactccgctccttggcaactaacaatgctgccctgcctcctggggctgagcccttgcaggggccggggcgtggcagcccctttttctgagcccagttgtcctttttcctcccgcctgtgacacgtgcattcatcacgctggcccaggacccgctggagtttattcttcccgggctagcgccctcgcgcgtgcgcagaggtataaggttcttggtctgcgcccccggggacatgagtattctctaggatcccttcctccggggactctgaggacaatccagggtggatggcggctggtcaagatcccgcctcctatcttgacccccggagcagtgtactgtacgtgcatcactcgcccagccctcagccatcgcccggctgccccggtgcccaggaagcctcgcgttcgcttagtgtcctgagcatctgtgggaagctgacacagcctcactcctgcttcacttcatgccgcttcaggcgggagaaactgcaatgtcttacagatctagagcattggaaacaaccttagaaatcatctagggcagcattttcaaacttaaaacaagaaactcagtaagatttggtttttcaaataaaatattatgccaaagtccaaaattcaaacaagaaatgggttgagaagcactgaagtgatgactgggactggattctcccctttactcctaaattcttccaatctctgcccacaccatgaccagccccacgaagaaatccagggtctgcaaggcaccaagtgaaaaacccacgctctggtcagctccccagttacagatgaggaaagggccttttcaagagaaaggctaacatggccttcattcacacttggaaagaaggacctctgcctgagtgtaagcccctttgtcaccagtagcatcgccttccctgggacactctgatgtgcacacatttgtacggcttgtcatggaggtgcctagcaccaggctctccctcctaccctgtccatctcagccagacactgccacctcctcctcagcccactcaaggcacacacttggctggtccttgctttgctcctggataccaagccccaggcaccacccgagcttgagaccttccaagaccaaggcccctctgaacatccatcaagtgggggaccccgtgccctcctcccaaagcccagtggtacccaccttcactctcaggaacaaggcagtgagaatgacaccatagatgaagaggattccatccagcaggtagcagagtttgggatccagcaggccaaagctctgtgcctctgtgccaagagataaagctggtcagccaggcccaaggtgacgagaacacatccccattaccccagggtggcactaggactgactgaccaaataaatcatgacacggagactatatccaatccccatgcctcagcctgatcacaaccctctccctccctcccacctcaaccagctcctggaaaacctattggcaccaacggcagatgtggccgctgtggggccaaagaacctggggcaatgggaggggaggtggaaacaaggcgagcagatgaggctgttctctgtgcacagagctcctgccactgcagcagaagcccagccatgttagccccggtgtgaaccaagaactctggaagcctcgggaagatgttcacgtctggatgaatggtactcctggcctgaggtgtgtggctctgaggcctacccacagggagacaataggtcaaatgatggtcaaatgagatcatttcaatatctgacagttaactaggacagggagaatctgggttaactctcccccaactccctgcctcctcagtgccaagcactctcccgcctaggacagtgggatctggtgctcggcttcccttccctgttccctgaagggtttcatggccaacagacagaggtacctttggtgcccctccccacctaggcccagcatctccctgtcccctagtcccagctccatggcctcagccttctctgtctcccctcctcccactacacacaccccattcccaggacacgccttgctcttccagactatttgccctgtgccttgcactctctgttccctcttcatgttccctccatttctctccctgaaaccctactatttggtaacatttgatgcatcctacaaaatgcagctcaaagatcccttctgtgttagcttctcccactgcaaatttcccaggggcccctaactcctagtgccatattaacctttgtcaagctgtagttaatgcacgtttagttggcactgccattggagtacaatgggctgaagaatgcagatacactaaatactctggttaaataaaagtttgcatttttgggctgggggcggtggctcacgcctgtaatcccagcactttgggaggctgacatgggtgtatcacttgaggtcaggagttcaagtccagcctggccaacgtggtgaaaccccatctctactaaaaatacgaaaattagctgggcgtggtggctggcagctttgatcacagccactctggaggctgaggcaggagaatcgctggaacctgggaggcagaggttgcagtgagccgagatcacgccactgcacttcagcctggcacacagagtgaggctccgtctcaaaaaaaaatttaaaaagttagtgtttttatttggaacatcattgcactgtgaatgaggagactcagattttagtctgaccatacttcctactaggtaaacgtgcagcaactcaacctgtaaaacagggtgtggtacccatctcactccacccctgcctggtaactagagcagaggtcccaggccagccccgctagtgtctgtctcccaaggcctgggcgccctctggtggcctttggacccagatgagggcagagggagtggaggccatatgtgggagtgctgtcattctttctggctgtgtgatttggggcaggttatgtatgctctgtcagctgcctcttctgttgaacagggtgaaaactaacatttcttcagacactgccttaaatgtaatcatcgtcagatcctcctgccacccacactcggacactgaggcaccgagtattcgggttcagagcacacggtcacaggcagcccaggactgatccctagcagttctcgcccccttcctgcccctgggccagccctgcctacccctccatgccagcaacgttttggcctccctgacgaactatggaagcagatgattcaaaggcagccgccagtgtccccacccccaccaccctgaatccctctgtcccctggcttttgactccaaccctaattcaggacccctcttgcccccaggcagctgatctctacaaacctcccacagaccctgcccagagaccattgatgacccagccactcggacgagagtccaagctctttgtccagccatgttagggctctgccataaccagtccaggcctgaaaagaccacagctttgtgccaccctgtccctctgctcttgtcttttccccccattcttccttgaacacccatatttttctaccccctggcctgctgagctagatctttttctaggcttgcgttctacccctccactcaacacctgttgaaatcagactgtcccaccacctgagcccctgaggaaaaagtgagaggatgtcggttcaagagcctatatcccccaaagcgctctacaaacccaactcctcaggactcagatgcccctccatctaggctgtcagcacctgagaccaatggctgcatcttcattattgcctcttcctccagccccagcatcagagtgcagggcacagggtagacaatcactcgatatcatggaatttttcagggctgaacttcagtgatgaggaagatgctgggcccagccccaggtgtgcctgccctctggccccaaggtattgctggaagtcctcactgacctagggacgatctaaaggcctctgggggacaagccagcccccatgaaggccaccaaagctggggtgactttttgctgtgaggactgcagaggagataaccgtggcgatttatgggactggttgagactcagaagaaaatccaggagaaaatcactcagctgcttgtcacagaaaattagaacagaaaaattactggacagtaaatttagcacaaataagaaatatttctttgtgttgtgcagactcagcacaacacaaaggggcagggggattgggcatgtccctgagataaataatatgaacaagtttccttcctttcttccttccctccttccttcttcctttctttctgcatagttttatgactgatgacaagtgtgctgtgtgtggttgggtggaggagaggatattaaccccaacataattccctgtgtaggaccctcctctcctcggtcccactatacctgtgctgggagagatgggcctgaggaagacagtcatggcccagaaagctccatgcagggatgcaggacctgattcagttacgcaattaattaaatattcattgggcatctgctctgtgccgggaactattgaaatggaatgaactctggattgcgtgcaggtgggttcgagtacttctcttgccacttactagctgtgtggttttggacaagtcacttccctctctgggcctcagttacctcatctattaaatggagggtaatcatatctaccttaagggttgtgatgagaatcaaaagacaatgatgtctgatatttgggtcgagtcttctgagtccctgccctcatggggcttaagtcttagctcttgaggccgcacacaaggtgtaggagcttccctggacaacagacagttttgcaggatgccagctcaaaggcaccgcatcgccactctctacttggtcctggcttcttccctgtgcgcgctcctgtggcttcttcgtatttctaccaattccatcccaaagggaccagcagctgcttcctaggaggtttcagggtattacatggtagctacttttctgtaaaagtggagaagctgttttatttaatgttcctgatccctacccaagagtacagcacccaggagaacctcagcatctgaaaggagccccagagactaatagagcattctcacacagactctcaatccaccgccctctcccctgaggctctgacttaagtggcctggagtggaacctgggcatggggacttcactgcatggccatgaatggattgagattcagacctgcatcattacaggggccacagcatgtgagagggaagccctgccttctgtagagatgcagccataccctacaacaaatgtaaatttctgtcaaacagatgcaataaaattaaagctttggtccttcttatacactgtacttctgaactgtgtattatggaacttctctaagccttcgttttctcatctgtaaaatggggataacaacactacctgtctcattagatggtggtgagggttaaatacgatacttttttttttttttaagtggagtctcactctgttgcccaggctggagtgcaatggcatgacctcagctcactgcaacctctgcctcccaggttcaagtgattctcctgcctcagcctcccaagtggctgggattacaggtgcacaccacgatgccctgctaatttttgtaattttagtagagatggggttttgccatgttggtcaggctggtctcaaactcctgacctcaagtgatctgcccgcctcggcctcccaaagtgctcggattacaggcatgagccaccgtgcctggccaaatatgatacttcttatggggtgaggataaaataaaataattcttatggggtgaaggaccccataagggtatgtgttccattttgccacctattgttactgccatgatttctactttaagcccatgcacgataagttggaaccttcctgccctgtagcaagatcccaggaataggccatgtgagatgctcagaggaggctgggggcagccaaagatgatcacagagtatctaggcatacgggtcattgtatctaagtgttgtgagtctaattagtgacagtgagcctcgccatccctttgtagccttttgtcatcttcattaaaaaaaaagccctgaattcaggaagtctcatggtactgaccactaacaggaagattctggagccccagagtgcaccctgggggagacgcacctatccttacagaatctggtttctctgggtgagatttacttgaattgcgttgtttgtctgtctgtctctgagccagactatgaacttctgctaacagggatcaggccttaatcaacctggtcctgccataccctgaggctgaaaatacacgctggtgccctttcccctgcagtcaacctccttctccagcaaatcctgtttcggagctgggcatctgcgggacttactcacatccaactaataaggattcttctcatttgaactctaatttctacttttaaagtgacttcctgtgtctgatggagttagattcttatgagtgccaggagacaaacagggggctacttttgggcccaattcacaggtggataaactgagatcagaggaatgaagcaacttcaccaaggacacctgcaggttagtggcaaagctggaagggaattcctgggtctcctgactccaggtacttctcttagccttatggcttcgatgcagctgacctatgggctcaggatccggagtttccacctacctctgatttcacagcccttgccattttgcccacttttgacacttagtcacaacggcttgtaaacgttccacttcaagtccgccccccaccactggctctggcaagcacagatggtgccttatagtttcatttgcacctttccctcctcacccgcacatcacaggcttagagaagagcaaagaacataataagtctttgagtcagaaagactctaagactcaaatgtggaatctgccccattattggcttgttttggaacagttttcttaacctctctgagcgtcaattctcctatctgcagaagggctttgacaagaccgatttcacgggtgcagagaaatgaggtaaagtttgtggggtgccctgcacagtggcgcatgctaagaggctctgcaggtacaaggagtgacagcaggggatggccctctgacctcccacaccatcatgccacggttggggacagaacctggccaggtttcccagcccaggatggggatacccactcttcaggggtgtttgaagataaaaacagataatgggggccaggcgcggtggctcacgcctataatcccagcactttgggaggccgaggcgggcggatcatgaggtcaggagatcgagaccatcctggctaacatggtgaaaccccgtctctactaaaaaatacaaaaaaattagccgggcgtggtggcaggcacctgtggtcccagctgctcaggaggctgaggcaggagaatggtgtgaacccaggaggtggagcttgcagtaagcggagattacgccactacactccagcctggacaacagagtgggactccgtctcaaaaaaaataaaaagagataatgggtgtgtacaaagtgcctggcacacagtgggagctcagtagtgtgtagactttctgagaactcctcacttcacaaaatgataatgatgtaacacatgcatgaagcatacagtttagagagctctttgcacttgcatgatctggcttaatcctcagaacaaccttgcacaatacgggcagaattattaccaattctattttgcagataatgacgttgcagctccaataggtcacatggctagagattttctgagtgcatctgatgcaaagtcccttctcaatctaccttatcccagtgcctctggggttcctgtcatatagagagcttcccacctctttcaggagtttcttctttggtaggcacttctggcctctgcttgaatatctctggtgacaggaagctcagcacccagcaatcactggtggagagctctaattttcagagttaaaaaaaaaactttgaacctagttctgccttcagaagcacaaatcacacagatcctccaatttctatagggcagcctttcaaacctcacccccgtccagcttgtttccactttgataggaagcacggcaggtaagaatgaatcctacgaaggcgacaactgcaatccaagtcctggtgttgctactgtgtaatcactgagtaatcacagcgacctcccagggtgtgtgacactcaaatgggaagggcttggtacctggtaagcgctcagtttgtaggcactgatggaatcaatatgaatcacagtagctcatgatccaggtaggagtggccagctttctactcgccaaccttccttcctttgagtccccaactttgagccctgagtcctgctgctgccagctccacccccaggctcaggcacaactggtgatgacattgcagggtaaaaacttagaaaacaggaagtcactgttcttaggaaggcagtggcagcagctatgggtgggggggtgggggcggtgtctgtgttgggcagggtgctgggtgtgatgccgacccattgaccacagcatccaggcacccagaccatccccctcagtgggttgctccctttcatcgaataactaactttcactgcagcagaaaagatataggctagacacacagagtaatagttataaccactggttgaagatttgttctgggccaggaaccacacgtgtgagttttctcattcagtcttcacagtgactctgatttcacagctagggaaactgaggctcagagaagttaataacatgcctaatgtctacagccagggttgaatccaggcacatctggatccacagtccaggtcttaaccaccacttggtactgaccttcaaagacttgctgatcctcagaggtggtgagaggggtcctcaccaggctgtggagtcccttctcccaggatcgaaccattatagcaggtcatattcttgactctacaattagctttctttcattgagggctgagaggccggcctggggggttgacagatacagaaggcctgctaccaaatgtgaggccaggactcacactgcccagtgcttatagcaatgacccactggagatacctcaatcaccctgaactgcagaacgactccagctaatttactggcaacatataatgttttactactctctttaatttgctaccagcctggccaacagggtgaaaccacatctctactaaaaatacaaaaaattagctaggtgtggtggcgggcgcctgtaataccagctactcaagacgctgaggcaaaagaatcgcttgaacccaggaggtggaggttgcagtgagttgagatagcaccactgcactccagcctgggccatagagtgagactctgtctaaaaaaataaataaacaaaaatttttttaaaaagtaccacagcctccttaattctctcctcagtgtcagatttcaaatattcatgtttcattgtaaaattggatcatttgttcaaaactacctacaaattatgtattcccatagataagggttccaagggaagagggaagaacagggctgtatgatttcttaggggtagcgctttatgagcaaatgtttctcttcttgtatttttatttccattaaagttgttatgttttgagcgatactttgtgatcatttttcttttctttttttttttttttttttttgagacagagtctcgctttgttgcccaggctggagtgcagtggcatgatcttggctgactgcaacctccgcctcccaggttcaagcgattctcctgcctcagcctcccaggcagccatgattacaggcacctgccaccacacctggctaattttttgtatttttagcagagacggggtttcaccatgttggccaggctgttctcaaactcctgacctcaggtaatccacccgcctcagcctcccaaagtgctgggattacaggtgtgagccaccgagcccagcctttgtgatcatttttcttttcattttcaagtaaatcaacttaatataaaagtgcagaaaagtaggaaaaaatcagaattgcccataataccactttcaaacacagccattattaatatgatggcagatggctgaccaaagtctttgttatttataaactgtaatcattttacataacaactttccacgggcaggtgcagtggctcacgcctgtaatcccagtacgttgggaggccgaggtgggcagatcgcctgaggtcaggagtttgagaccagcctggccaacatggtgaaaccctctctctactaaaagtatgaaaattagccgggcatggtggcacgtgcctataatcccagctacttgggaggctgaggcaggagaatcacttgaacttgggacgtggaggctgcagtgagccaagattgcgtcattgcatgtcagcctgggtgacaaagtgagactctgtctcaaaaaaaaaaaaatttcctgaagaattgtttttttcatttagtattatgttataatctaagacttcatgttatttcatatattcatatttcatgttactttgtcattttactattaataaatatcctttttaaaggttgcctaataagctttccactatctacataaccattccccattggtgctcatttgtttccaatttttcaccattataaataattctaagatgaacagcttcattcctaaagctttttacaggattggaattccatcaataatagcttgaaaaatgggccaggtgcggtggctcaggcctgtaatcccaacacttggcgaggccaagctagcaggactgcttgagcccaggagttagagaccagcctgggcaacatggcaagaccctccctctacaaaaaataaaaaattagctgggcatgatggtgcatgccttagtcacagctactcaggaggctgaggtgcgaggatcacttgagcccaggaggtcaaaactgcagtgagccctgaccgtgtcactgcactccagcctggttgacagagtgagaccctgtctcaaaaaaaaataagtgaataaataataatactttgaaaaatgaaagctaagactaatagtccaagagataaatcagcaaaagatataaataggcaattcgcagagacaggaaaacagattacttacaaacatataaaaagacatactgggagcagtggctcatgccaatcccagcactttggaaggccgaggcaggcagatcactaggtcaggagctcgagaccagtctagccaatatggtaaaaccccatctctactaaaaatacaaaaattagtcaggcatggtggcatgtgcctgtagtcccagctactcgggaggctgagggaggagaatcgcttgaacccaggaggcacaggttgcagtgagctgagatcgagccactgcaatcccacctggtgacagagcaagcatctgtctcaaaaaaaaaaaaaaaagaaaagaaaagaaaagacagtctcagtgctagccaaggaaatgaaagtatgaagtgacaaagagatgtctcctgtttttcacaggtggtcagagcgggcttcagctgtgcagatctgtcagggaagggcactccgggcagaggagcagaggtggaaaggctgtgtggtggacctgtgcccagtgtctctgaactgcaagcaggggtaggtagcatgaatgaggggaagttctaggagactaggaaagagggcgacaagcgtgtggggttgttaggtagaacttccttggccagtggcttttactctgaatgagatggggaacagctgcagggttttctcttttgacaaggacacattatgtttttatttaaaatatggtaataacatttcaaagaaaaaattaaagccaactggaacaaggcaaggttcacagttgccttgggcccctgggctaactggagatgccccggcaagccccaggacaggcttcaaatcagccctaaaatccaggctatactgccagcctccattacctgtctgcattcagccaaacatagtcattgtcatctcttcttcccctggtcctcaaaaccaagctcttcctactcttgccccataaaccacccagaaagtggttgtttgtcctgaaagggtgaaacccattcactcttttgctccttcctcatccattaacactaataatccctaagcctccatttctgttatgggctgaattttgccccctgaaattcttatgttgaaatcctaactcccaacacctcagaatgtgaccgtacttgaagaaaaggtcttgaaagaggtcactaagttaaaatgaggtcattagtgggggccctgatccaatatgactcgtgtccttgtaagaagacaagattaggtcgggcgaggtggctcacgcctgtaatcccagcactttgggaggctgaggtgggtagataacctgaggtcaggagtttgagaccagcctgaccaacatggtaaaaccccaactcggccgggtgcggtggctcatgcctgtattcccagcactttgggaggtggaggcgggtggatcacctgaggccaggagtttgagactagcctggccaacatggctaaaccccgtctctaccgaaaatacagaaaaattagccaggtgtggtggtaggcacttgtaaacccagctactcagaaggctaaggcaggagaattgcttgaacttgggaggcagaggttgcagtgagccgagatcacgccattgcactccagcctgggcaacaagagcgaaactccatctcaaacaaaacaaaacaaaacaaaaaccatctctaataaaatacaaaaaattagctgggcatggtggtacaccatgaggcttcaggaggctgaggcaggagaatcccttgaacccgggaggcggaggctgcagtgagccgagattgtgccactgcactccagcctgggcgagggagcaagactctatcaaaaaaaaaaaaaaaaaagatgagattaggacacagacatgtacagagggaagatgccgtgaagatgatgtaaagacacagggagagatggccacctacaagccaaggagtggcacctcacgagtggtcatgtggtggccatccttactaggagaaaatgtcacgcactgtgctgggcagtgagggtggaggtgacagacacagatgtagcctcccagccgagcagagaggtgggcaaggaaacaaatcatcccacgagagaggggcacagggtgctaaggaaacatgagggagggacgatgcctgcagtcacgctctgggagtaaacaatgacaggcaagtgatctcctttggtgagcaggttgcatgtttcagttccctccgctcattccaccaagagccccccaacgccagtggacaagtctctcaggttagcagacaacacttgctatatgccaggcacatagagtgtaagatacacacacacacttgcatacatatgtgtatatacacacacataaatagaacaatacaaacatatatgtatgcatgtacatatatacatagagagcaatatgtgtgtgtatgtgtgtgtgtgcatatatatatattatagatatatattatatatatatatattatagatatacagagagaaagacacttattcttacctcttgttgccaacttggacatgtagctttctctggctgactccagggactgatgctgtaacaatcattgtcataccaaacatttgctctacactttcagtttacaaaacccttttatattttttatttcatttgatcctaacaacaattgagtgaggtaagccgggtagatcttatttgctccactttgcagataaagagactgaaggtcagggaggtgaagtgactctcccgcagtcaaacagctcatgtgtcagagcctggacgagaagccaggtcttgccgggcctttgttctttctcacgcagcacactgccctcaagttttgctcttgaaaattagcaccatttcaaaaaaatctactttcgagcaaaccccttatgtcaaaattccaggcagtattttgccatttctctgagaatttaattttttctgaggataaactctcacagtatacagagaaaataatgtaaatgtccatcaactaggaacctgataaattttggtgtattcatatataaccgttaaaaaaaacacaacagataattctacatgtgctaccatgaaagatcttcaagataattaggttttaaaaaaggtggccaggtgcagtggctcatgcctgtaatcctagcactttgggaggctgaagctggaggatttcttgagctcaggagtttgagacatagcaagacccgtctctgcaaataatgacaataacaaaattagctgggtgtggtggcacacacctgtagccccagccccctcctccggaggcttaggtcggaggatcacctgagcccaagaggtggaggctgctgtgagctgtgatcatgccactaccctccatcctgggcaacagagttagaccctgcctcaaaaacaaaaacaaaaacaaaaaaagctctagatacttgtgtatgaaaaaaacactatgtaagctgcatatatatgtatatatacataaaaatatatctagatggagtttctgtttgggatggtgaaaatgttctggaaatggatagtgctgatgattgtacaataatgtaaatgtacttacttcatgtcactgaattacacttaaaaatgaaaatagtaatgttatattattttacaagaaaaaacacgttaaaaatatatgtatatctggagggccgcacacacaaaaatgtcatccacggttacttctgcagaggagccacgggagggggaggctgggtgaatttcacttattttccaccttacacctttttgtggtgtttggaactctaactatgatagtatataatatttataatactaaacaaccaaaacaaaaacaaataacatgaacccttacatcaaagaaggtgtgtgcggcaagattctggcagggcagaaagtggaggaacaggggctggcccatttagcgaagcgctttgcgcccagccctggctcagtacatttctggtgatgacttgccggggtttggaaggacctcagctatacagaactttcacgataatggtatttggtgaatatggttacatttatatatgaacacagaaaaccaactactgctggtaaatagcatgatcactattgttattatccagtgctgtaaggacgagatgctttcaccagcagccgagtgagatgaaagcgcttttccgatccaccgaatcagtcccactgcaactgtaagctggagaccctctgggccttgggagctcaggctgcctgggcaacgcaagggaggacaggggcggagggggagccaggagggccgcacctgcctcgctcgctggtcgccctcgctctgggatccgtcctgccggtcccaggctgttgagggcgcctcctcagagtccctgtggcccccgcagcttccccggaagaaacccgtgcatccatcggctagcccaagcccaagctcctcccggagctccccgagccggggccaggcctccgcccctcggtgcccgcgcctgggctcctcccgctgcgggccgcccgcccggacgcaaggcacagggggacgccccgccgagccgctgcccactgcaccgagtttttcggaggctgggagaggaaatgccacttggattttaaaaccgtcaccgatacgctataggtgaatatttcgctgggattttaaagagacgagcttcagcctgctaagccgcgctcacgccgcctctccgccctggcctccccgcgtccggcttggggccgggtccctcccgggtcaaagctacgccgggtgcactgcgggctgggcagctctcccactacgcccaaagcccaggcggccgggaccgccgtcccaaagtcacaaaccacacccgtgaaggacgccctccgcaagacagagaggaggctgggcctgggaaggaacctccggcccttcctcaccatgcagccaaggtgggctcccagccccgtgttgccgccagccgcggctcccgtgcggttacgggagcagcagccccgccccgccggcccccagctggctcctcgctcgaggtttcctgtcgagcgctgccatccagggcccgggttatcgcgcgtgatctcccatctgagctgctcacacgctgccgcccgcccccacttgcggtcccttgtccccgaaccgcacccgcccccaggcccccgcgctgagagaccagggcgtggatctgcgccgggctccggcgctgggggccgagggtctggtttttagatatcaaaggagcccgacaccagggtcccccagacaggcaaggagagggacccggcctggggcctgccttcggtggtgggcacagtggccaggatcgggcctggctccggctggcccggcacacgagcacggcgacagtggcaagactgggagggccggcgctgcctccttgggaagccccggagagacgcaaccctgagaggctgggccttcccaccccccgccccctcccccttcctcagatagcagggaggaagcgccaggggtctctccgttctcacatagggggactccaaatgtcgtcaaacctgccactctcggaatcaacagctgctttcattttgagccctgtgagcaaaagtttcagggctttcctggcacacatacccagtgcatggagagcgctaaattttatcttcccttctagagtgggacattcctgtgtggagctccgagaatacatgccggcactgcctgtgcctggggctgtgctggctcccacccagctgcaggaatgagggaccacggtacggagggaagtggctgagttgacagccactgatagagctttttcctgattgtctctggcttgagctaaccaggtggcatgacaaagtacttaacaaaaactacagatgcagagaattttggaaatttttaaaagacaggaaaaaaggtggttgaggcagaaaaaggtagttctagagtgagaggggtttctttcctcctcttggctcacagcagaggccaagtccttagcagtgtttccagagcaggtgaatgagactctctgaaggccggcccaggggtctgccttgtaacacgttcccccagcttctcatgtacaccaccactcttcggggaccaccaccttctgggttggatgggtctggaagattctacgaatatatccagccctacctgagcatttgcagaaagcctgctctgtgagggagggcagccccaaagctctctgttgtagacacagaacccaacagggactactggtgccacactctatctcttctgtcagagaagcacccaagtgagccatgactttgacattgcatggccatcttatgttcattcctcaaactttgtcatgttaatgtgtactctctcggggacatcatacctaacacggctgcctgaagatctgcttcgtttagaatatgctagtgaggacagtcctggaatttctttgtctctttccagccctgctttctctacctccagtcgttttctgaggaccggcttggtgggtgctgatgcctgcctggaagacctcacacccacagtgtcttagaagattctgaaagcagtgtgaggtaccagcctgctttagcgctaggagctggcatggtgggggtctcaggctgcatccgcacattctcagcggtgcttttgctcctggaatggagccacaagctgctctgggccatttagagactctaagtggtttgctcagggctatatggaagtgggaggtgggggacctgggcgctctgtagcatgcttagtccccctggcagggttagaggttagttgaccagagacaacgagtccaattcccaaacagaccagaatgaccagcaaaggagaaaagaacaaggacacattgcagccaaaatggagctagaatcttgcctctgtccatccttcactggagttatcctggatggagaaggaaccatatcacctgcaaagcctggaaggggagccctgctgtgaggtgagccagtaagtctgtgagttcaggagggagcacacgcttgtctgtccatctgttcatgagcaggcgctcttgagtcttcctaaatattgcccagagctctccatccagatactgtcctttcccttcctctccattgatggtctccaagcctttcttagctttcatcttcccctaaggattccttctcccaaagctccagcccattccaatgtcaactgcattcgttgtttttgttactctcattgtgtcaaatgggttctttcctatgcaactagattgtaggttgctccaaggtaaacaccgtgatttctagttcctttgtttctaccactgcaggactgtaggaagcccagttgtaggcatcactaggactcagtaattacataattgctcagataattgagagaatgattgattgattagtggtcattaatgccataaaatgaaggaatttcgcccctcacattttcaagaacctatgagttcgaagagacctgaaagaacatttttatgggagcctacaccagtgctatcacctaaagtgcgtgaccttagggaagttgcttcaccccttgtttctgtgcctccaaaatactggtgttaatacagtaatttctgattccttccacctgtgccctgctcagcgatccagtgttcaagctggtcatcaggagaaagctacttatgatttcctaacaagccaccacagaacatcacattcccaaacatgctcttcaccgtccctgctgtccccacgtgcctagccctggtgtgggcaggaatgagtgggattgggatgttttctcacaggtctttctcaggtgaggccccaggctgtgaccaggcccctgccctgcatgtgactcaggcctagcccctgctggggcaggaatgccacccagcacagcatcctactggtgcctgaataaagaatggactggaggttcacctgaaaggggctgccaggtttctgcgggggccagccaacggctcacaatgaccctgtgttcgactcatcttacgatgaaatttttcagcttgacgaacttttactcatctttcaaggctcggctcaaatgttatttccctgggaaaactgcgctactttcagcaaaatgcatttccttttgatgggcatctgtttttttctttctttctttctttcttttttttttttttttttttttttttgagacagggtcttgctctcttgtccaggctggagtgcagtggtgcaatcttggctcactgaaccttcacaatgggcatctgtttctgttctatggagtgacctaaaagtcaagaatcatggagaaattgggagcaatggctcacgcctgtaaatcccagcactttgggaggctgaggcaggcggatcacttgaggccaggagttcgagaccagcctggccaacatggtgaaaccccgtctctactaaaaatacaaaaaaaaaaaaatctgttagctgagcactgtggcgtgcgcctgttatcccagctactcgggaggttgaggcacaagaattgcttgaagctgggagggggaggttgcggtgagccgagatcaagccactgcactccagccttggtgacagagtgaaactgtgtctcaaaaattttaaaaaaaaaaaaatcatggggagaatttattgttaaacagaatattagttacattttcaaataatacagtcaatatgtttttctgtaacctttagatatgttttcaggtgaagtacctctaaatgtaaagaaatgggtccaattgttaattttttttaaaggttcaagaaatacactactttctctggctttttccttacaactcttttttttttttttttttttttgagatgaagtcttgctctgtcacccaggctggagtgcagtggcatgatctcagcccactgcaacctccacctcccgggttcaagcgattttcctgcctcagcctcctgagtagctgggattacaggcacacgtcaccacacccggctaatttttgtatttttagtagagacaggattttgccatgttggccaggcttgtctcaaactcctgacttcaggtcatccgcctgccttagcctctcaaagtgctgggattataggcttgagccactgtgccctggcctcttgtaccttttttacattaacaactggactcgctttaaatgtagagatacttcctgaaatggtgtgtgaaggttgaagaaaaacatgagcatattatttgaaaatgtggctaaagttctgttttaaagtaagtttatggtaatatttctaacttttcagatgctctgtagttcttggcacatttttcactaatatttggtgacaggtctgtccccgttaaaaattgagaattccacaaagcctgggatatgttttattcttctttgactcttcactccccagctaaccaccatgcagtgggcaatcataagggtttaatgaatgaataaatgatcaagtcaggtaggttttccccgaattcttgtctttggggctgaacccagggtaggtttcctggcatcattcctgtgttttctactctccctccctaatcctctgaaagtttgaacaaaaataagattatgggccaggtgtggtggctcacgcctgtaatcccagcactttgggaggctgaggtgggaggatggcttgagcccaggggtttgagactagcctgggcaacatggcgaaatcccgtctctacaaaaaatagaaaaattatctgggtgtggtggtgcgcacctgtagtcccagctactcgggaagctgaggtgggaggatcacctgagcccgaggaggtccaggctgcagtgaaccaagatcacatcactacactccagcctgagtgacagagtgagaccctgtctcaaaaaataaaaataaaaataaagaaataagattatgaccaagagccgtatgtctcagatgttgaagggcaatatacctgtgcttcagaaaaatctgccctgtgtgccaaaatgtgcagaaaggagagccagcttctcagctggccccatgccccactactaactactcccacggcctcggcgagttatttcttctttttttaaaaattatactttaagttctagatgtgaacaacgtgcaggtttgttacataggtatacatgtgccatgttggtttgctgcacctatcaagtcgtcatttacattagatattctcctaatgctatccctcctccagccccctgaccccccgacaggccctggtgtgtgatgttccccgccctgtgtccatgtgttctcattgttcaactctcggggagttatctctgagttactcctgagtctgggctgggagacaccagggggacagggcacacacatttgcaagtttcctattcaggccatgctgtccaggcagccagaatgaagcccagccagagccaaaaggctttcctggaggtgtgtttgtcagtttggcaacccttggtgtgcccagcccacgcgctgtgagcattcgcctatgacgtactttgcgtggatcaaaggccccacaaagcctgccgtgcctgcagctgccacgctggggacatgctggggacgtgggcgatcgtgggctgagaggcagactgctgggctgccgcctcccatggcagctttctcccatgggagggagttcaccttgcggcttccaaactcagccgggccgcccctaggcatgtcacctcttctctttttctctctgttgtcccatgatttgggtcctcaggacctctcacctggacccagggataaatgagatccactatcagagccaatggcagcatcggcagcactctagagctatttctacttgattctaaacctagatttatactatgtgtagccagctagaaatacagatctcactgtagaaaagagactggaagaaattacagcaactgttagcagtggtttcatctctggtttgtgaaattatgggtgatttaaattttctttatgctttcccttattttccaagttccatagtgtataagaatatgtaattttgaaataagagaaaatagtcggccgggcgtggtggctcacgcctgtaatcccagcactttaggaggcccaggcgggcggatcacaagatcaggagttcgagaccaccctggccaatatggtgaaaccccatctttaccagaaatacaaaaattagccggctgtggtggtgggcgcctgtagtcccagctactcaggaggctgaggcaggagaatcgcttgaacctgggaggcagaggttgcagtgagccgagatcacgccactgcactccagcctgggcgacaggctcaaaaaaaaaaggagaaaatagtcaaagtacatttttgatgccttgtattaacctcccttttgtgtcccccaccctcaaaccttagttgcactttaggtcaatgaatatctaaatcactctgcattcttcaggcacacagcagcaggagggaggtgtgcctgataggatgctggattaaagattggttctgaccaattcacagagtataggatgcccacaggaggaaagctgaatatttagcatggtgtaagtctcatgggacttggccactgtcacaggctaactgatgcccaacctgcatggagcccaggccctctccccacctggctctcttcaagcttaggaggctcctcatcccactcagggtttaagattctcctttgatattctaggacatggaccaagttgggatttagggttgctcttgggttaccagccagcgtccctgaagcccctcccaaaatgtcactggggccctgtgaccatagaagaggcctctgtgggccacacagtgagtccagcgatgaagccagaccagtgtggtttagggaacaggccgcagcaatgggcaggaactctggcaaagctgtgcctcctatggctctcctcgacacagaagtcacaacccaggttggggacctaggcgtctctgcatgtgcctgtgtaggagcctgtgtgtgtaaacaagtgtatctacatacacgagaacccaagggagagagctgcacagggggcctgccctggtctaagccagaaaaggaggagaactgttccttttgggggccgatccctgctgggagaggtgtgccagggttcccgccgctgggccatttcccccacctgagttctctctacaatgtccaaagaatgggaccagtaaaagggggccagggcaattctcccaccccctggaaaagtctgccctccctccctgcaggcctgaagcccttccggccctcatcctccccttctcctgtgtcatcctgtcttcagactgatacactccttccctctggttttcctctcagttgtctcttccttgcatttccctccttaattccctcccaccagccttatttttttctccatcatctgtgcttgctcttccatctttactcttgatagcctcattgcctgtctcctcagatagccttgggtgccaggttacctggcatccctggccctaagaatttggggactgcttcttttgcttgatccagctctctctggaggatgggcagtcgccgggccatcccaggaacccttcctgggttctgtttgtggcttttctgcgttgccactgagcatgggttgctctcggctggttagcataggaggtcacactatctgttctggtgcaggaattgtccagggaattacagtcaaggctgcaatgtgacctatggcctggggccagcaagcctttcttagtctccaggcaggccaggtacagacagcaaactcagaaacccacgattacattggctgtcctttatattagcacaccaggatgcacccaattagcagtgctcattcctgcctcccttctgacttcaaatacctaaagcccctcatatctggaagcagagacctgaaaaagtcatcatttctttttttaaaaggagaaagggagagggaggctaacacacatacacttattcacaaaaaataaaagatggtttcatggagttagtctgctgggatatttagaatctaggtttgtaacttgcatctcctttctcttgatcctacatttcagcctccaatttagtgggaacttgaactgaactgtgctaatttattacttggacaccaaagagttattattttgtggaggaaaatcaactttgaacattcaagaaaaaagaccccattgtaatgattggttagaatttgatctggatctacatagattcattttctaaaactattcaattaaggataatgtcaacctattgcctgaatttaaatcagcgattcatttggctaatgaattttcctttttctgtgagtaccgtgtcctacgaatttacaggggatggtcagagaaatggtgacaaagaaaaggaggtttgtttgtttttaatgttttgtttgctgacttaaaaagcacacagccctggaaatggccttctcattactcgagacaataaaacatcccagaaatcctgacactggctaataagacacatgcctttaatgacagcctcaaaaagaagcccctacggtggaaagtgttgtgtgtttgattgcgctagttttaccatggaatgtgccagttgtggctggaagtaattgtcttttcagtggacaacaataaaactgtttttaagttctcttccttagtaaagcctaatttataaatggaaataagaagtttctaatttcccccaagcagatgccactctccttgaactaaaatcaccttgggattgcagtggagtccagcatgaagatgcggttttcctgcgtttccaactcaggctgattgaaggcagcttatttgtttccccaaacacttggctccaaacacagagggctccctgctgagtgatgggttcctaaaaacctgtttttcttcaggggaagatgggtttagttccagttctgaacatctctaggggttgcttcctccaagaacggctcagaaatagtcccctaaggaaactccatggggagaagcttccctcaaactcaggactggctgctttctgctttggacaaggatgctggctcccaaaacaggggcccaaataacttgaattctcaaaagctatttttatctttctcagcccccactcctattctaaaagtagaaagctggggaaacagggtgagtagaagaagaggggtacaaaaaggatctacagagaattttgcctgtagtttttctagctctgaaatgcctggggacagaagatgacaacactaacttgaaacttcaattgtctctgttttaaaggcagacacttttaattagacaaaagcaaagggaaagaagaatagaagtacagttaccgaaaaggccccaagatcgcactatttatctgcagtgtgtgctctgtaaaaaacaaaaacaaaaacaaaaaacaaataacaacaaaaaaaaactgcagcaacttttagagagccacatagtattattccagctctttcttcccctctgtctccattttacgtttatttcctttttattggtttcactatctcttgctttttctcttctccctccaatactcaatcttcctgtccatatatttatttctttccttccttccccacctcctttcttctccttcagagacctatccagacagagaatcatgtgtttacaagcctcatacacagagttgttggagaaggcgccagccccctccccaccaccctgctaggccaacctgcctccagtggccagtcccttataaactggagatcagtgagatagaaagtcactcatagatgccttccaccttccttttttttttctttttcttttttttttttttttttgagatggagtcccgttcagttgcccaggctgctggagtgcagtggtgatctcagctcactgcaacctccacctcccaggttcaagcgattctcctgcctcagcctcccgagtagctggattacaggctcccggcatcatgcctggctaattttttttgtatttttagtagagacggggtttcaccatgttggccaggctggtcttgaactcctgacctcaggtgatccatctgcctaggcctccaaaagttctggtattacaggcgtgagccaccgcacccagcccctttctttcttcttcacctgtagtgttgctctagtttcttgtagctcagcaactgggcagtgaaagaattggtttccctgaattatttgggggaatttatttatttcacagcagcaggaattatttatctagcctaggctgccagacacttctgagcatctagtcatttggaggtcattgatgactggccatgccccctccatatttctctggctacagttaaagcagttctttgagcagtcagctgggtgatattaactcactatctttttcctctgctaatttgagtgttcagatgatgcatggccaggcacatgcacacactcctgacagcaattgccagggaatattgcttttctggactttgacaccagctccaactttgagaggaatttaagtgatatttactgcatagaaattcctctttggagctttgctcttctggttcagtctgctgacaacacgttagatttattctggcatcaactagctgcagagcccaagactcagacttaattaactttatcagggatttgagttgcaactttggagttcgaggctcagcacagatctcagtattactaccaatcacagcacttagaagtacctaaaatcaaacaaatgcacaaacagaagaattcctcccccttgcacagttttctgactatttgccaattaactctgatagcctttagaaaaaaaatcagtttgtactgatccaagctgctagatgttctgtgtattaaatgtaagtccattttaatactgtaccacattcgtctttttttttttaaatattagaatttagaactaatgttgttggggaaatttccattttgagataagctacaggataattattgccttgtcctgctttttatccccaatttttcccctcagttttaagagtcacctgaatattggaaataaaatttaatccagtttcatttatgaggaaaaacgtgtgtatgtgtgtatatacatatggataggtacctatgcaaatgtattttcatatgcacatatatacatacgtgtgtgtaatgaatgccatgcagcaatttcagttttcaagagcgaggcctgtggaaagtcaagtgagtaaagaccaggcaatgtgagcccaacaggctggagccccttgattagttagttaacatgcaaaggcttcgggaggcctagctcctgttctagaagtactttatcctcttcttttttttttttttgagacgaagtctcgctctgtcgcccaggctggagtgcagtggcgcaatctcagctcactgcaagctctgcctcccaggttcacgccattctcatgcctcagcctcccgagtagctgggactacaggcgcccgccaccgcgccctgctaattttttgtatttttagtagagacgggatttcacgtgttagccaggatggtctcgatttcctgacctcgtgatccgcccgccttggcctcccaaagtgctgggattacaggcgtgagccaccgcgcccggcccctttatccttttcagtcccagacctgaaccaggaggcaacggaagatttattacagatgctcattgcggtgcacttttaaaatttatcgtggactccaagcttgttaacaaagatttgccattcgctcctggctaatttcaaggttaacataatctgcttttctgcggcccttcatgcaaacgcagagtcaccctgactcatgaaaccatgccttgctttcccacctgaaaactctcattttccatttggaacgttccaaggacacaaattccaaaggggattttctgttcaacagataattctgttggattggattattactactttccagcctgcttctttgcctcggtgactcagaagatgagcactttgcagttaaatagaaagcgctgaactgtttacgttccctccccaggacactagggcaggttggtgcagagcacagccctaagcgttgggggctggctgttaagagcagcctctccttgggctgctggctttcagtcatcattttggacagttctgagcttctgctttattatcggatttatttgtctgtctgcacatcccctgtcatgctctccccagcctcctaacccacccacatgaaccccagcacagtttgctcgtatcccagtgacctagggcctccgtctggtcggtttaataacggtatggtacttctgtgggctatttcccatcatggacactttctcattccagacatttggtaacaaatagaagcatgagaggcgtattacatgccagagttctccaatccccttagccaattcataattgacttttaaatcatttaggcgcaaaagcaaataataatagcttcagtgttcagtggcgaataaattctagctcatgaaaactgagggagaaggcttagacagtaaaaattaaatatttatgaagatactacgctcacaccgacatataaatgcacatacacatacattttaggcatagctatttatttttaattctttatgtgatacccaatgagaaaagatttccagtaaaaaaaaaatgaggggaagatttattgcctccaaattaatataagaaaacgtccctgtaatagctgtcctcctcccccagtaaaaggaaagaaaaaagatacacaaatattgaattgacaaaattatcttttctctattgtgagaaaggcaagttaatacccataaagaacttcgcactccctcagttgaaggatgctctataaatacaaagcatcgttataatttattattgaacagagtcaattttttcttctgaatcatttttcaaacctctcatagctcaggcctctctgatgggagctctgacatgaagccaaaacacctcttccagacacagagagaccatcaatcagtttaattcgaagactcctcaaagtgagcctcctggtagcccagcaggaactgttttagagtcttcttccttcagttacagtcagtgacttgcatagagagctcaggtcacctggctcatctcaggcactcaccagacacctgggaagggctggtatttctacccttgatactttgctcccagtaaagggaaaccaaggctgagaaccctcacttttctttacccacctttgttcttagccctgccttctgctaaattgtaaccaacaaatccacagtggctaaaattcccagtcatgcagtcgctcctagactgagatgctccacccggctgatttgttgtgaattaagggaaccaaaaaataaagtgctctctttccttccaagcagggaaaggaagctacattcccaaacatagagaagagcaaactgcaataaaaaaaaaaaaaacaggagttcctaccactaaaaaatacgtgatctgttttgctttgttttgtctttttcctggagtgcagtggcacaatctcagctctctgcaacctccacctcctgggttcaagtgattctcatgcctcagccacccgagtagctagcactacaggtgtgtgccacagtgcccggctaatttttgtatttttagtagagacagggtttcaccatgttggccaggctggtcttgaactcctgacctcaagtgatctgccccccctcagcctcccaaaaagtgcagcctcccaaagtttggcaagaagcatttatacatttgtgggactgagtccatttaaatcgtccaaatgtccagatccaaaccatgggcccacagagctaaggagttgtcttggaagatggagacgtatttgattttcagttgtaagatccagttaaacaagggaattcactggagaaggaaatcgagtctttccctgtcctctggcattggattacttcccagtatgcttaagtggttcttgttgatgttgggacacttaactacactcattaagacagtcacgggcattgactctgcattttttaatctgacattttctgttttccaagcgattttattttcaagaacaatgcagatctcccctcctcacccctttttttttcttccaataattaggcctgaaagcagagtgagagataaaggaaagtgttcaagcaaatgatctgaggttctagaataaatatgtcctagtcattacagagctgtttgaaagcctgtgattggcctcctatggtcactggggcacagcctccttggatggcatctctgcctctcctagatgtcttggagagaatcaagactcaggccttggacctcttctctaatcttacacacttcttttgtgatttcatctattcattctcggtactttattttattttattttattttttttgagatggagtctcactctcgtcacccaggctggagtgcaatggtgcgatctcggcacacggcaacctccgcctcccaggctcaagtgattctcttgcctcagcctcctaagtagctgggattacaggctcatgccatcatgcccagctaatttttgtatttttagtagagatggggtttcaccatgttggccaggttggtcttgaactcctgacctcaggtgatccacccatctcagcttcccaaagtggtgggattacaggcatgagccaccatgcctggccttttctcagtactttaaaatatcatccgtatactgttgaccccaccatttagatctacagccccagttctctcctgaaatccagactcgaacatccattcaatatctaacggacaactcagctctacttgtcctaagcagaactccttatttctcccccagcaaacctgccttttccagggtcattgggtaacatgaggaagaatttgatttctcaatccaaaactgggggaaatattttttttatttcctatatgacttttgggcttacagaagtaaaaatgttaattgtaaaaaaaaaaaaaaaaaaaaaaagaaacaaggaaaatacagaaaagcgtggaaaagaaaataaaaattagccaaaaaccaaccactcaaacataatctttaacattttgctatattttcttctaatgtttttttctactgctttcctttttttcaaaattaggatcatatgttagggtttgtgtttgtttgatttttcttagtattacctattttttgactattttgaggtattgctatgtataataatttactcagctatgcccttattgttagaaatgcaggttatcgttgatttttagtattatagtgctgcagtcaacatccttgaacacaaatattttattccactgattatttctttctttctttttttttttttttttgagatggagtctcactctgtcacccaggctggagtgcaatggcacaatctcggctcactgcaacctccacctcctgggttcaagcaactctcctgcctcagcttcccgagtagctgggactacaggcgcccatcaccacgcccggctaattttttatatttttagtacaggtgggttttcaccgtgctagctaggatggtcttgattttctaacctcgtgatctgcctgcctcggcttcccaaagtgctgggattataggtatgagccactgcgctcagcgtgattatttcttcagaataaattaagacacatggaaacatgtaccctaaaagacaaatatatttttctggaaagtaactcacccttaaatttaaagaaaattggctctatctttctggaaagtaattcagctctaaattttctgggctatttaaacttagggctgacttactttccagaaagacaaaaccaatttacattcagcagtttttgagagactctaattcattgtgttctcaccacactgggtattatcattaaacagacacacagcaaacaaaacaactcaacctacccagtaagcaaaaatagtctaattttaaaatttgcatttttttgaatagtagcaatgttgaacatttttttcatgtgttttcttcaccctgtgtatttcctattttatgaattgtgtggtgatgacttttgcttatattttgtttatgtgttttagagatgggggtctcattctgtctctcacgctggagtccagtggtatgttcctagctcactgcagccttgaactcctgggctcaaacgatcttccagcctcagcctccagggtagctggagctacaggcatgagccactacactcggctttatttttcttttgatgtaccctcttacaaagtgatttcttttttttttctttctgtttctttctttttttttttttttttttgagactgagtcttgctctgtcacccagtctgaagtgcagtagtgcgatctcggctcactgcaacttctgcctcctggattcaagcaattctcctgcctcagcctcctgagtagctgggactacaggtgaccaccaccacacccaactaattttttgtatttttagtagagatggggtttcatcaagttggccaggctggtctcaaactcctgacctcaggtgatccactcgcctcagcctccgaaagtgctaggattacaggcatgagccactgtgtccagccctaaatgatttctaagagcgtgttacatattaaggattcatccttttcctatggtatatactgtgaatattttccctctttaccatctaccttttatttggtgtctttggcacatagaagttgaaatttaagtcatcagatttttgcttagaaaatctttcctcattttgagatcaaagatcattcacttatattttcttgggggtactattttcaatgtcctgataaaacgctcacaataaaaaaattaggaagtgttttaggctgcagttcaggttggcagaattatgcctatggccaaatgtgtttgtatgcactcacacacagtgtgtgcacatgcgggaaagcaagtctagcaaaatttattttatctatttaaatgcattacaattaagaaagcaaaatgtggactttttttttcaaggggacagtaacaacgaagcgaagaattctgtttcatagctgggtgagggagggtattgttgcacatctattaggattttgctggctgttgaagtcaggtcctactgcagattgtgtatttatcacagttttctttaaagaagtaaaatcaaagtgggcaaaggcatctgttggaagcgctctaaatatgcagatattcttgagggagacacaacattactaatcttgtgtctgaccctcttgtgtctgatcctgccactcccacacactgtgagggcctgttcggcttggtgtcctcatggcctagtgacccccatggcctagagaggattctttgtgtgtccacacctgtgttgcctgcatgaaagatcagtgaacatttgctagtgtgtggaattccttggccttcccggcagcccctgcccacctgctcctctggcctgaccacctttgccctccagcccacacaagtattctacagctggggccttgaaggatatcagatgtctactccttaggcgtcttcttcaagttttacacacacacacacacacacacacacacacacacccatctgtagtcttacagggagatctattctgaggcctttccttgaagagctgtggttctgtgttcacactccctcttacaccctctgggtggttctctgacctgagatagccagctgtcccgagctgccctccaccgcccagggggcaagtgtggtttctcctgctccctgcttgccatctccttctctctgggcctttctctcctccaaggcccatctgagggcagctgcaacctgcatattgtttcgaaaataaggttgcttcctgcctacctgcagaccacccacgcccacaggctactaggagaaatgtcatttagccgcgctcacagccagtgattcacagagcttctcgccaactccttcaaccccaactgcagcttgagaatgaggcgctgttattattcccattagaaaaaaaaatgggaaggaacagcccagaccaagttcacacagctggggagttcgtgcagaactgggagtcctaggtcttttctgctctgccacaggcaagtccacgttctctctttcagccaagggtcactgtgctctgcaagattatgatgtgtgtctggtcagggtatagaaacccctcacctaagcattcctgactggagaccccccagactttgaggagctctcactgtgaaggggaaccccttcttgcacattgcagcccctcactcctttgctggggggttttactggtcaccagcctccttgtcacactgactcacggatctgctagctctggccttggaaattaaccactacactctcatcttctacttggttgcaccttgcatatctgatggctgctcctggcctgtgcccttttggtcttctatgccgttttcatcttgtacttgtctctggagggctctgcctgctctgcacaccctctcccttcaccacccccggaagactagataaagccgtgtgaaccagagataccccacttccttcttcctaaatatttctctctgatttcattcgcaagagaaatctgcctaattatagatggatagagatactgaatagtctcactgccctctttttcttctccctggctctgagtctgggggtggggctgggaagggggagccagcctcaggcaaagttactgcctgagactttaaagtcagattttaatctccttaatctcctttcccttccacccacccaccagcacagtcaacgcatcactgagacacctgcttgggtaggggtgggagggtagcggtagtggggttagagggtggcagaggcacacttgtttggggtgtggggagaaaaattctgcttctggccacagaacctaactggaggctcaaagagatctttttagataacagtggccaggcaggaatgatgagagtcatgccacagaaaagatctttagtgaaagacaagagccctacttcagaaaactggctgagcccccggtctgggaaggaaatgcacacaaatgggacaccttggcccgctgaaagcacagacaccagcgaagactactggactcagttcaaaaagtatttgggagccagcttgaagaggctcccactggccaacgatggaacaacttgagcatataagaaaaacgactgccatgggttaaaactgtctttttttttttttttttttttgacggagtcttgctctgtccccaggctggagtgcagtggtacgatctccactcactgcaacctctgcctcccgagttcaagcgattctcctgcctcagcctcccgagtagctgggattacaggcgcccaccaccatgcccgggtaatttttgtatttatagtagagacaggtttcaccaagttggccaggctggtctccaactcctgacctcaggtgatccacccgcctcagcctcccgaagtgctaggattacaggtgtgagccaccgcacccggcaaaactgtcaaatatttttatgttcctacatttatcacaaccctaaaaccaaccaaccaacatacttattgctcacccttggaggatgctaaggaaccaaattattacttaactttttactgggaaaaaaccccaccatttttattataaaattatcaaacacacataagagtggaatagtagaatgagcctctgtgcacctgtcgcacaacatcaacgatgatcagctcacggctcttcctgtttttctatatccctacccagtcccctctcccctggattattttgaatcaaatcacaggcatcatgtcattttatctataaataataaatcattataaataaagggaagaaatcgaacacttatcctgggcatttatcagggtaaccaaatagttaacaagggtaagtttctctctatagaaatattccagcaaacaaatgaaaaaggaaagataatccctaatgaaatagaggctctaggcaatgattatcagtggcttttggtgtcaccaaaagaaagagcaggacacatcacaagcctcctgaggaaagtacaataaccaccttgaaatgttcttgctacattaaacctgaatcccatcaacctccagattcaacagccagtttagaaaaaacacaggaggcagaggaacacgttaaatgacaccacagggatgcaatcagcaaaaattcacactgtgggagattctgtggcacaaataacctagcttcgtacagttcaaagaaataaagagaggggtcgggctgtgggggaaggaattctagatatgcaagagacagagaaactgtctttgttggataaaatgaactgtgaagtaaaaaacatgagacagagaaattatttcaacaccaacttgatatttgatgatattaaggaattactgtaaattttgtaggagggataatggtagtatagtatatattttttttctttaaagggtgcttatcttttggaaatacacactaacgtatgtatatgtagtttattatattattttctttacttttctacatgttgaaacaggaagagttgtcctggaaaatagtcctggggtcccccttcagaagaaaagcagttggtgagaagtgaagcgctataacattatgggttgaaatggcgcctttcttgggctgctgacaccttctcagattctgctgagcttcctgagggtggactctgaatcttggcttctcttataccctctggtacaccaggcccagggatggcccactgtgcactctccccaagccctaccaagcaaatagaatgagcctttcagagagctcttggctctgtgtcatgtcttacttagctgcatacttaatctcttaattttctttctttatctataaaataggaccaatgattcttaattcacaggatttttgtgaggataaaatagtataatatataggattcttctctgtgattaaaataacaattcatagtgataataatagctagcagccaggtatggtggctcacgcctgtaatcccagcactttgggaggcctaggcgggcagatctcttgagctgagaagtttgagaccagcctgtgcaacatagtgaaaccccatctctacaaaaaaatagaaaaattagccaggcgtggtggcacatgcctgtagtcccagctacttgggaggctgaggtggcaaagctgcagtgagttatgattgtgccactgcactccagcctgggcaagagtgagactgtgtctcaaaataataataataataacatctaacacatatagaaggtttattatgtttcaggttcattctaagggctttctatgcattatctcatttgattctcataaaaccctatgccgtatgttttatgattatcctcatctcacacgtgtggaagttaaggggcaaagatgtaaaggttacagtgccaaatttgtagtatttgttcttatcatacatagatggaagaggctattggccccactgttgtaatttgagggatagctgaaagctctcctcctgctgaaaatatttttagatagaagcattttggaatccaagagattactgttaaaaggatattactctgagaggggtgacaaattaaacctctgcctacctggaatgccttaatatgaaattatcaggttactctccctcctctatcaggacccttagagaaaataggagcggctgggccaggagaaagcaaaagggaggaagacgttaagaacaaagcccatgaccttgacaattttacctggagcctgccttgagcccaaattccagtggtcagtgccagaagaaagacaaacaaagctgcttttctttttttccaaacagacccagagatggaagatggtcctgacttgaaagtgccatttgtgtagttccagtgcccagagcttccttcctcactgatccctcctgtgggcttggactctggcacactggctgtgaagtgttttttgttttttccttgagacagggtcttactctgtcacccaggaggctggagtgcagtggcgctccagcacagcagatcgtagctcactgcagccttgacctcctgggctcaagtgatcctcccacctcagcctcccgagtagctagaactacaggtgtgcaccaccacttttggctaatgttttattttttgtgtatatggagttttactatgttggccaggctggtctcagactcctggcttcaagcaattcccccgccttggcctcccaaagtgctgagatgacaggtgtgagccactgtgcctggcctggctctgaagtcttgataatttcttgggatatcttagtgcaaaacttggaagccatatggagaaatgctggtgctgatggggcagttgctggccctgctgccaatcctgtgaccagccctgggtctccccttctgtcctgatgactattttggtccccaccaggatgtcatgaaagttctcagcccagctgagctaaagcccttggcaactcttcctttcttctgggctgtgctctgcaggaccaggcaaagaatcaaaaggccagacgagccagaccatagagctgtgaggggctgaagaatgtggagaagcactgtgtttactgcagcacagctgctatatggaaaagccagtgcagctccggctacactgacagctgtctgatgtctctcacacacagatggagaggctgaccccagacttccttgggcaggttacaccacagccgtgcatttgtttctagctacgcagttaatgggacatggaagaaccagacctgcctgagtacctaacatggcaaagggccttcggaacatgaagaatagcagagataagaatgttaagcttagaaaagacttgaggactttaaagctgctttcctatttgaaaggctgtctcatggaaaagagattggacttgtgtatgtgtgtgtgtttggtggggggcttcgagggtttgaacaaggaccagtggaacacgggtcagattggtagaaggaagtttcactaaaaaccaattggagaggcagtagtgtggacaggaacgcagagtctggagtcagactatttgtctccaaatcctactttctgtgcctcttaccttgtctgtgaaggcgagattaaaaagttgtacttatctcaaaaagttgttgtgaggaataagtaaattaatatgggtaaaatgctttaaatagcttggttcatgctaagtactcaataaatgtgaggtggaaatggaaacatctatgatttgataaataaaggcagcaagattcaaattgtatatggtgtaattccaattttgtttttaaaatgcatattattttggaagaatactcgaagaaaataccccaaaatattcacagtggtaatttctgaacagttggattatgagtgatttaaagtattacagtttttaatattgcatattttctagataagcatatattacttcataatggaaaaacatttttattttgctctctatttaaaaaggcatggcatacctaaaaatgtagtgagatcctagttaccaaaaaagataaaccatcctgttactaaaagtattcaaactcacatagctaatggacagttgggttattcatactgtttaatcccaaccatgtaaagaaagtagcacgtgaaaatgcagactggagggaaacaggtggcactggttatggttactctggggatgtggatgagaaattgtttgtttctgtattcttttctgtactttcagagttttctaaattacatgtgcattactttgaaaacggggaggagtgggattaattggaaatgaaaattaaactaaaaagacatttttaaaaaaggagttcagtccagattagcttgaagggccccatagacctgctgatctagtttccccgaccatgattctgtgaccacacaatggtggcgattacatgatgtgacatatccgcctccatctgccacacactacggcccagcggtggccatgcctccccctgttcaaaaatcaccccaggagttcaggtttgtttttgcatcacatcacagacctccccgctccccatcatgtggcttttagggcctcatattctggtcacctcactttccacctgtgtccccagtccacatctcttccatccagccaggtccacacctttgggaactcaccaacacctaccctctccctgtctggactgccgctgatccctgacttggaatgccccttcctcctgccagtccacattctacccattggttgaggttgctccaggggcactgggcttctgcaaacgccagttctttgcctgcaccaaataatttagcacaactgcattctttactgcttcgtgcctctcccctttggcatgagcttcgtgactgcagagccacattttctacttctcttttgcctcatatgccccagaccaaaacatctagcttgctgctgagagcggactcagaatccaaaacagcacgggctggatcactgttactcaatggccactgcatatggtctgatgccccgttccaaaataggccaagaaccgattaggccgacgttctttagatctggaaggatagtagacctgtgagttaaaggtgatttgtcagggcagccccacagttaagacacaatcctgccctggagagaaagaaacagttttctcactttgagcatttcagtgtttggtttagagagctgctgaggtcttggcagggcgatgaaaatgggaaaccgtttagaaagtggaataaaaataaaaagaatagggttaatttagttggagaaggagtggagatgaggccacacaagtctttaatacaccaagaaaaactgaggcagcatgcacgctactggtactacttctgctcttaagaacgtctcctgtccccaacctgcccctgacacccccagagctctcctcctgctcaaccagcctaggagccttccagctaacaagatctcttccagctctaaaaggttgttttgcaatgtcttaaacctgaaacttcaggctgtggagcatgtaaacaagagtgactgtgggatatcctgctcaggtgattttaaagaaaatagggacatagtttggaggatggtttaagcaagaccttttaaacccttttaactcttcagctcaccctgcattaaatcaaatgtgaagataaatgctcattaaacattaaatatatatttatttttctatgaaaacagttgaaagcatttttataattttgcttttgaaattatttggttacaagtaattcatttaattcatgacaagctacaatttcttgacttttattgtgtattcttgggaacatttgtgacgtgataaaactctaagatttacatgtgaaacaacaaggctgacatatagcacaattataacattgtcttagattcgctttctagtacatatattgattctcaaccattatccactaagaggtgttgagctgggtgtggtggctcttgcctgtaatcccagcactttgggaggctgaggtgggtagattgctggagcctaggaatttgaggtcagcctgggcaacatggtgaaaccccatctctacaaaaaatacagaaattacctgtgtgtggtggcatgttcatgtggtctcagctacttaggaggctgaggtgggaggatcacttaagcctgagaggcagaagttgcagtgagctgagatcacgccactgcaccccaggctgggcaacagagagagactccctctcaaaaacaaacaaacaaaaagaggcactgaaaggaaactgtcatttatagtagttagaatactaaaacttggaaatagcttacttctattaaaacaggtagagtcaaacttatacctatattaaaatcatttttactcatttgctttccaaaagatttcatgacgcaggggagaaagttgggagcagagggaggatgggttcatacaagcccatgagaaacatacattttggtgccgtctataatgtgggtgggggcggaaagagaaactcagaatgactgctctgatcattttgtgtgaaatgtcttacttcttttctaaaccatacatttcttgaggacagatgcagtaagttcatcgcacaatccagcagtgagcacaagggtctcattgaattgattggtgcacgtgatactccagatggagccacattgcaaatggcaccactgtccccatttcctccaggaaaagcagtggtggggtggggcggtcacaggaccatacctgtcactgcattcagttctgtgagggtggccagggactcctgtctgccccatttcaaaggggacacactgaggcccagggcaggcagcgatggaacccaaggttgggtgctgagtaggactctaggcctctgaccaagttgatctggggccttctgcagcaggacctgcctgtatcttttactgtgtgtgatccctgcctaagaacctgcccactccctcttctgcctctcaaccaagacttctggggacctttctttttaccctctggacaactcttagaaggaggctcaacctctgaactgtctcagcatgaatgagaggtcttctaggtcctgtgaaaagttctctggcctgaggatgaccatgaacccacagtaggttcagcccccaacaccacccgactggagacaacgccatccctgggtgctctggaatgaagggatcaagctggcatctcctttctcagtgacctttctgaacctaaagctaccaggcccataaattcccccctggtgctcacaagactctgatgatcaagaaagaaggcgggtcttccctcaccaacagccaagaggctgcttgagagtcaaggcagcttcttcagggctttgcctgggtttgttctgaatctgccctggcctctgtgggggtggggtggagtgaacgtctttcctctctgggtgtcttccaaacacacttctgcactaagagttgccactcccttcctttctcccctcagcctctccagaagcaaagcccatgctggctggggccaagggctgacttctaagagtggagaatcgtgactccacagcaggggagacctagctgctatgaaagcaacaacttctagggaggctgggacctcgggcctccagcaccatggaggaccatggagtgaccttaaggaatccttctggacaaatatccaaagggctgtgtgcctattcacctgggagagaggccttgggctgcccgtaccctgggaagggaagatgaggtgagggtagtttatccggcccaggctaccacagcctgttaggacagagcccaggtctattcaaggatgggtgaaaaactaaaatgtggggagggggaaggtctgggtaagcccttgtttggctcatggttttggccctctctgaggtgcctaatctgatccagtaaccacacaaactgggctgcaaaggaactaaccaatattctttctttctttctttctttttttttttttgagactgagtttcgctgttgttgctcaggctggagtgcaatggcatgatctcggctcacagcaacctccgcctcctgggttcaagcaattctcctgcctcagcctcccgagtagctggagttataggcatgcgccaccatgcccggctaattttgtatttttagtagagatggggtttctccatgttgttcaggctggtctcaaactcccgacctcgggtgatccacctgcctcagcctcccaaaatgttaggattacaggcgtgaaccaccgcacccagtgagctaaccaatatgctaatgacttcagttgatcaaccacagtgtccagtgaagaaaatcagggctcttctcagggtggtggtatctagaccctaaaaatagcctccctccccctccctaccctgctttcccaccaaccttgaagattctgatattttgttaaaaattcatgctagtttttcccacaagggagctggaatttattatcatctcctatgttcctaacactggttataaatgtttatttcatttaatcctcagaactggctcagaaaataggccacactctccccatctcatagaggagtcagaggctcagagagattaacttacttgcctgaggtcacacagctagttggtagaggagctcttccataagatagcaaggccacatcacctgcagggcagtgcctgctctgggaggtggcacaatgtgcccagtgatgacgatgacaataactatgaaaggattttatatttgcacagcattttgcagcagtgcccctcagctttgaacccagggcatgcactgagtccaagaaggggttcccctccccactccctccccagcacacatcaccttagccacttccggaggaacaggagaaatggcttgcccacttggctggctgcagtggtagcaggaggcttcctgaacagaggctgcccagactgcccacagcaagtgtcccactgctctgccaccgctggtgccgtgtgggagtcaaggctggggagcctgaatggtgggccaggccgggggccgtggggttcagaggcagagtggagaatacaaaatcgcaggtgagatcacagctctctcaagcctcattcctcgtgccccacacaggcagagtcttgagtcctccctttgttcctttcttgtttctctgggggtaatttggccttttagagaccacttcctttacccccaatcagcagacaccaccagctccctgcccatcttccttccctctgtttcctcctcttccctataggctgactgtgttgtgggggctccttaaagctccatctcagtcacaaggacagcaggggcttctccagctccctgaagtcccctctgtacacccttcccctttgggagcccagaggccaaggtcaagtttctggaggaggaggaggcactgtctggattgctctggcaggagcattttaagagccctgttcagccaggcgcggtggctcacgcctgtgatcccagcactttgggaggccaaggcgggcggatcacctgaggtcaggagttcgagaccagcctggccaacatgatgaaaccccgtctctactaaaaatacaaaaattagccaggcgtcatggcacgtgcctgtagtcccagctactcaggaggctgaggtaggagaatcacttgaacccgggaggcagaggttgcagtgagccgagatcgcgccaccgcagtccagcccggcgacagagcgagactctgtctcaaaaacaaaacaaaacaaaaaagagaagggcttttagaggttcacttgtctctcacaacctcagaagaaaaaccaggcgggatgactctccagctgaggagactgaggctgagggactgcctggtccttggctgtccagggaggggctcattccctgctgctctgctgccagactgttcagaggtgaaagcctcacattggcagaacccaggtatttggtatctagggaacccaggaaataacaatcaggccaaacactggccctgtcctgaatcctttagtccccatccttcagcacccccttgtgagggacaaccaggcacatcacaccctcatggatgcagatggcatggactccttcacttggttacaacccacactcacctggggtcttttctgccttctgtggacctattggaagatctaaggggggcatttgaaaatgaaaagggagcttgcagggagagcagccaactcagcccatccaagagcagacagacccctgcacgccctgctcacagctctgtccctgtgccgctgtggcctggcgctgcgtctggggagctcagtaaatatttgttgagtgaatgaatgaatgggatggcctgaccgcttgacattgcagaaggagaaggacaaagtggagaggctgaggtttgtttttgggtggggaagctcccatcttggattgtagtgggggtggaagcagaagcaaaaacctagtctagggtgtggattgagggagacccaggaaaacgacccactcacacacctgcctttcctgaaacactgagagctgcctgagattagggagctgccttactcctccttttgtcagcatgctggctggcgtgctaggctcccgtggggagggtatcccggcatggcttactaggtggttaacgccagggcagttgggaggtaaattaaggggcacaagctcaggaatccctcctttcagtcctgtcaccagccccaaatccaacccaccaagaatggtgggtataattcatcttaactatttcccaccaaaacaatatgacttttactctctgcctccttctggctgagctctgagaccaagagggctgtggatgttgggggtggggaaagaaactatggagctgccaagaaggttgaacaaccaggtaattaactgaaagaaaacgactggaggctggggaggggagggttaagagtcattgtgggccgccttccagaagcctccttccacggcccccactgccatccacacaccactctgacccctgcaaggacacaccaccatgctccgaggggcaggtggcctcagctctgctgctctcaagacagcaagagaacaggcattgtcaggccaaagaaattagcaacatggaaaagtgagtggaaagaaaacatgttttcatcacaagatcaagaaactggtttggttcttgcaccagccccctcggttgtcaaatgagaagtcaaattcagaagggacacaggacctgcccgaatcaccacagccagagagaggcaactctggggaaagtgccctggcctcggagggagaggaagtgctgcgggacatgagcaggtcacttaacctctcagagcactggagcaaaatcgagggactggacaatttcggagtgttgttgtgaagatcagctgagactgtttatgtgaaaatactttgtaaactgaaaaaaataaaaccaaagagtgtcagcagcagaactagcactaaagcccagatgacctcaggcccagccgccggtccagggcccgcctcgagtttgcggatagcatgatttggcaggcatgccactgacggcaagcagatctgtttcccacgcttcagaggccagtttctgctaccacatcctttcactctggcttatggggcttgctgcctgctgaggggtcagcagagaaaccccctgcaacccccaggaaagagctctggccacttatgcgggccactgcaagctgctctgatacctctgtgtgagttagaaatggcagctctgggtgggcatggtggctcgtgcctatgtaatcccagcactttggaagaccgaggtgggtggatcacctgaggtcaggagttcaagaccagtctggccaagatggtgcaaccccgtctctactaaaaacacaaaaattagccaggcgtggtggagggtgcctgtaatcccagctacttgggaggctgaggcaggagaatcacttgaaccccagagatggaggttgcagtgagtcgagatcatgccactgcactccagcctgggtgacagagcaagactccatttcaaaaaaaaaaaaaggaagaaaacggccgggtgtgatggttcacatctataattccagcactttgggaggccgaggtgtgtggatcacggggtcaggagttcaagaccagcctggccaagatggtgcaaccccatctctactaaaaatacaaaaattagccaggcatggtggtgggcgcctgtaatcccagctacttgggaggttcaggcagagaatcgcttgaattcgggaggtggaggttgcagtgagccgagatcgtgccactgcactccagcctgagagatagagtgagattccatctaaaacaaacaaaagaaaaaacgaagaaagaaaaggcagctccatggcaggcaggttcaggccagctgatgccccttcctccaggtgggcatccctggacccacactgccagggagcaggtacaggcaagtcccaggacccactggcagcctcagcctggcacctccatccaatgcttaaaccgcataaccttactggaggcactgaccaaagtaggctccgatctcagtctatgaggcaggcacaacccaccattccaacaacactaattgagtgccatttcatgacacaacagcattatcaaaaagaatgagtaccaggctagcagtgagaagtgtgggtcctactcccaccacactaccttgtttttttcgagacagggtctcactgtgttgtccaggctggagtgcagtggcacacgatcactgtgcactgtggcctcaaattcctgggctcaatcaatccttctgcctcagcctcctgagtagctgggattacaagtatctaccaccacatctgactaatttatttttagaattttttttgtagagatgggggtctcactatgttgcccaggtcagtattgaactcatggcctcaagcagtcttccccactcggcccccaaagggctgggattgcaagcatgagccactgtgtgccagccccacaatactactttctagctgtgttcccctgaggaactcattcaaactcagtttctccagctatcacatggaaataacaattgttaccccaaaaggtttgttaaaggcacaaatgagatgataatatgagcactctattgtaaagtggaaatcaggatacagctataagagatgatgatcatacattctaagaaaattttgaagataattttactgctaagatgtgttaaagaaaaataattcaatgatacctgttaaagcacagtaaggcagacttcattcaaaactgtcatgataggtagaaggatgattgcaatggggtcttgcagtgggacagaaagattgggctcaactccaagtacagcaagtgggcatttatgccaaggagcagagtagggggtcaatggatagaaaattcccaaaaagagtgagagggattctggctaaaccaacctaacaggactctagctgaacacaggccagggggatcagacctcacctgggggatggagtgggatgaggaccctgatcagacactgaggggaaccggatattgaaggttgatggttgtgctcaactaactgggcagagttctttgctaaacctggattttgcaagaaagtacacagatgggcctaggagaaagtttggaagcctgattaagtttttgtcaagcagggaatctttagcagttgacataatgacaatattgagagatttttgaaaaatattctctctgatggagcccaacaagtatttccctttctgcatgtgcgtgcgtgtttttatgtcacgtacgtgagtatgttcttgtagctcagacagctccgaataaaaacccagggaagcgagggtgtgctgagcccagggagggcctgccaggagggttttctgaaggatggctgtgggccgggcctcttctgagagggctgagggcagctgcttcccttgccgtttgattcattagtccacacctcgtggagaggtaacttgaaaggcagcgccgagaagcacgtaatggatttgtgaggttttaacaccggacagcagacaaaagactaataaaaatccggggcaggaatttcccaagagggaagtgtcacagtggaataaaaatgaaagagataaaggagagttcctagaaggatccaaccccccttccccaccccaaactctgcttataggttcttatatgataatttaaactatatatgatattaaattagcactccaatagcaaaaataaaagtgttcccacatcaccttctttgaaaatatttatttaaataggatgaaatgttattgagggcttttgtgtctagaaacagggttaattaaagatttcctgcctgctttgtgggtaggtgacactctcattgagatagcagcaatgccctatttagtggtctctcagctttctttctattcatctggtttggtagtggaattccatgggaagtttgaccctattcagtgatgagagaagcaaaatactgttgttcacctagaggctgtttgctcagaaaaacagggtgtcagagacatgggacgcaaacccagagtgacatagcgcagggacttggctcacttttctgagatctgtaaaatgtgatgtgactggctctcagaaaggaggctgaagggttcctgcccgattggttttcaaagggcaagagccccgctgctgaggagctgcggctttgttagacaaaagcccagggcagccccctcctgggctcagcgttttccccacctccccctttctcacaggcggtttccctgaaatgaaagaactgtgatgcatttgcgccttcaaaagcagtttttaaaatgcattaaacccaagattgaataccacccagttcggcctctgacctgtgcccgcgccgaggtttctgggcagccaggcccagggaggaagctggccttttggccccaggaggcagagccagtttagctgcctgtgcccccccaccaccccacccctttttttgaccttctggcccaaatagggaactgtggagcgctcatctttgtgtccttgctagtacacagcctccctgtgaaagcaagcaatgtccccaagcaaatccatatatccgggacctacggcggcggaaagatcgggtgcatttggaaggcacggggcctggcctcacatttccaaaagcagtattccagactctgcctgcaaagcttctccaccttccccgtcatctgacctcatctttcttaatttttcttctctcattctttctatcttcccctctctatctctttcttcctttagaaattatatttgaggccgggcgcggtggctcacgcctgtaagcccagcactttgggaggccgagttgggtggatcacgaggtcaggagtttgagaccatcctggccaacatggtgaaaccccatctctactaaaaatacaaaaattagctgggcttggtggcgcacgcctgtagtcccagctactccggaggctgaggcaggagaatcccttgaacctgcgaggcggaggttgcagcgagccgagatcgcgccactgcactccagcctgggcaacaagagcgagtctccgtctcaaaaaagaaaaaaaaattatttttgaaggtcgggtacagtgactcacgcctgtaatcccagccctttgggaggctgagacgggcagatcacttgaggtcaggaattcgagaccagccttcgtctctactaaaaatacaaaaattagcctggtggggtggtgggtgcctataattccagctactcaggacgctgaagcaggagaatcgtttgaacatgggcaggagaactgtttgaacatgggaggccgagattgcagtgagctgagatcacaccactacattccagtctgggttgacagagcaagactctgtctcaaaataataataaataataataataataataaataaaaagaaattatctttgaaagaactcatataagcaggctaaaattaatttgttaatttgtcacatttaaaatagtctattttattctatatttacaatttttgaaatcctagttttggcacgtcttgcctcttaaaaaatttatatcaccctttactcgttggaatggctacttgtttaaaaaacagaaaatcacaagtgttggtgaggatgtggagaaggaatgccgtgcactgtgggcggaaaggtaaaatggtacagctgttgtggaaaacggtttggtggttcctcagaaagttaaaaatagaactactggccgggcgcagtggctcatgcctgtaatcccagcactttgggaggccaaggcgagtggatcacctgaggtcgggagttcgagaccagcctgaccaacatggagaaaccctgtctctactaaaaatacaaaattagccggacatggtggcccatgcctgtaatcccagctactcgggaggctgaggcaagagaattgcttgaagccaggaagggaggttgcagtgagccaagatcatgccattgcactccagcctgggcaacaagagcgaaactccatctcaaaaaaaaaaaaaatagaactatcatatggtctagcaattctacttctggttctatacccaaaagaattgaaagcagggtctttaagagatatttgtgcacccatgtttatagcagcactgttcacaatcactaaaaggtggacgcaaccaagcactcattgacagatggatggatgagcaaaatgcggcagatgcatacagtggaatattatttggccttgaaaaggaaggaaattcagacacatgctaccacatggatgaaagttgagggcattaggctaagtgaaataagccagacacagaaagacaaatatggtatgatttcacttatatgagttacttaaagtagttaaaatcatagagacaaaaagtagaatagtggttgtcaggggctgggaggaggcgggaatggggagttatggtttcatgggtacagagtttcagtttcgcaaaatgaaaagaattctagagacggatggtggtgatggttgcgcaacaatatgaatgtacttgacatcactcaactgtgcgcttaaacatggctaagagggtaaattttatgttatgtgtattttaccaggcaaaaaaacaaacaaacaaaaaacctggaggaaaaattagcagcctgtgctatgaaaattgcctcaggtgtaagacagtcttgtcagtattggagcgtgctcacagttgacatgtgtgaaggaccaggagagccggaagaggtcagcaggctcagggggtgctgttagcctgtttcaccgacagaaaggcttaacccctgcggcgccaactagaccaggagaccttgcctctctattattctcccactggctgttgcttatttttgttagtccaatattttccactgctctcagagacaaaggtaggcaacagtttgcaaaatttagacgcttatgtgtgcacaaaggaaaaaaagaagaaagaaagaaaacaacagtctggtgagcttctgtgaagcttcttaactagcagggaggggaattttcctttctggtcacgtaggctgctgtcttcggcttcgattcgtaagccacctcccaagcccccattagccccaggtaggggacatcccatccccctaaacctccttcttgaactgacagttcacccctagaaggaggtgggaaaccactcagatccatctcaaagggatgcctaccagggtaggtgtgtgggaggaaggctgagcccatgctgtgttcaggggcccccccagaaggtgtcagcctggaggaacatgccccacagttataaaaggcatcattccaggagctatcatggcgtctgctaggggcagagaggaaggggaggcaggaaaggggctgagtattttggggctgtatgcttattgttctacttttctgttgaagttattgcagttgctgccctcaaatttttcctgcctttctccacccccaattttgccctattttccctaatttttctcctttttttttttttttttttttttgagatggagtgtcactctgtcgcccaggctggagtgcagtggtgcgatctcggctcactgcaactgccacctcctgggttcaagctattctcctgcctcagcctcctgagtagttgggattacaggtgtccaccactatgcccagctaagttttgcatttttagtagagacagggcttcaccatattacccaggctggtctcgaactcctgacttcaggcaatccgccagcctcggcctcccaaagtgctaggattacaggtgtgagccaccgcacctggccagtttttctccttttgtcccatcttcctttttccttctccatctgttcctttctgcttctcagaataagcatctctatccttagcttcaaatcataaacaacttagaaacagttacttagctgagtactgtctctgtgccaggccctgtgctgagggctgacattcattgtatctttgggtcctcacaacagccatatgagataggtgctattgtgcccattttatagttggggatactgaggcttaggaaagataaagtaacttgtccaagatcacacagctggaatgtggcagagctaggatttgaaccttgacagtctggctagaagggaccttactgatcatctctgtccaaatcctccataatgtacagaagaaaacaggaccagaggcatcaagtgacgtgtccgaggccccacagctagttaggggcagtgctgagaacaagaagctggcctcctaattctgagattcttcttgtttaagaagcattttccataggtgggcatctgctaggcttctttatctagaattattaattccaggaagcatgtgccctggtcaggcacagaatcagcaaaaaccccactggagacccaaaataccctatatgctctcaccattgcagaatctgttgtgtctgcaggtgcagcctccgggacccaggactttcttctcagggctctgctgagttgggtgggggaggctggaggctgcaaaatgatgacagagcttggggctatgatctggactgggtacccagagctaataggagaagaggacaagcagggggacagaactgagtcaggagacactttagacgatggagggttgggggatggaggtggctagtgaataaaacacttctgaagggtctttgctgcctgtgttgatggccatgatcaattcggatccccagggccagttcagcaaaacctctgtcaacaaatagaggatttgtttaatcttttctgaaagagtccgatgttatctaagtgaggactggccaggtaattggaacgttctagagactgttgggttgacttggatttggggtcaataaacatagcggctccactacactagtgtgaggaggacctcgggagaaatcgcatagctccctgggctgcagttttcccatctgtgatatggggataatgtcctcaccctgtcgacctcatggggctgctgtgagggtcagatgagaaaatgggtggggaggtaataattagtgaacagcaccattcaaagctacagtggtcttattgctgtgttttcctaattgtattttgcactgtggctttacacagcccatgtctctggattgttaaaaggatcaaaaaagatcatgagtagtgcattcctcggcattttgtatctcctataattcctggatacagataaatgtttattaaagaatgtgaaggtctcatcaaaaaccaagcatgagaggcaagacaattattacctcagatcacatacgccttggatttcagagctggaaagagggttagagacctattccaggactttactctacagcaaagcagtccgggttccagagagcccaggtgacttgccttggctgggctggactctgttctctccccacctggaccttgtgtccgaggagcagtgttggaccctcaattcagacaaagtgggaaggcagatcccaaggaggggagggctggtggcccaggtggctgcctggaagataccatcacttctcatgctgtcttaggtgaactttcaaagtccagcgtaagaaaaagtttccagcaacagcattgtggttagtattgcaggctttggagtgagacagtcctgggtttaaatcttggctgtctacctagtatctatgtggtctacgatatgttacataacctctctaagcctcagtttcttcaactgtaaaatgaggatatcctgaggttgttaccttacagtttgctgagaggaataaatgcaataatggacgggtgtgctcaccccagagcttgggactgggtaaatactcataaatgacagaggtgggagtagttgttacagtaacctaccagagggaagaagagtgtgctcccgtttaatccttatcacctacgcagtgcttggcatataggagcgcaacagatgtttcttgaacaaacatcactaagtaatgcctacttctgcccttattccccctcagcatgttccttgcccagctgctagaatgatcctgccaaaacatataatcatgtatcttttctgctccaagtccttgacctccatctcacttagagcaaaatgtccttcaagcttgtttgcaactgtcactctctccccaaacccccagaactcaatacgtctgacctcacctcctactggccttcccctcactcataccacctctttgcagttccaggaacatgccagtctgcactgccacctccgtcttctccaggttcccacttggcttgctcgctcacttccttctgggtttgactagaatgccaccatcttagcaaggacatccctgcataccctacccaaaactgtatccccacaccaccagcctgacacttcctatgcaccttctctgtgttatttttcttctcagcatgtatcacaactatctacatatttttcagtttacctcgtttattgcctgtctccgtctttaattgttagttctatatgggatctgggattttgttgctgctgtggttcagtttgttcatgattgtttcaaaagcacctagactgttcctgctacatagtaaataataaatattggttgaataaataaatgaatgaatagcattagtagtggtgtttgtgtgtttgttcattttgtatggcaagaattgtgaaataaagcagaaggaaggaaggtaggtaggtaggcaggtagtgagttgctcatcacagtagtgttcccagaagtctggatttccattcatcaaagaagctatcgagtgtgagttctgttggaagagaggttggactagatgattttgtaggtatcaccaaatgtctgactgctgcaacagcttgagtctgctggggtcacacaagaatcactagagccctgcaacccccctgctctttgggtcagtacttgaacctgcctgagaggggatctgcttaaaagcagcagcttgtctccggatcctgaagcaaggaggttttgcatctctctggccttgaagatctccatcccgtggagagtctgactctacagagcgggcagagagtaggaagaaggaacctagacgatctctggctgggccaagagagaaattagcaaggccagctgacaaactgggcctcctgcatggggctgagaagtgggtaagggttgggagggagaagggacataaccagggataaggcaagacaagaagtctaatcagggactgagtcggttagaagtttaaggattgttcctaaatggttatcagctccatctgttggacagcaggctggtggcaggggtgtgggtgacgtgtaccacatcacccaggagatctccatcagaaggagatagccctggaacttaggaatctttacggggaggcgggtgatgaaaaaagcaggccccggagagcggggacactgacagtgaggggagacctagcaaccctactgccaggagtgcattccaaagaaatagccacaaatgtgagcacagatgtatgcacaggaatgtccacagtgacactattcataatgcgtccaaacatgaagccatctaaatgtctgacaaaagacagtggtaaaataaattacggcattttacaggcactaaagttgatgtagagacatagttcatgacagggagagatgaccatgatttattgctaagtaaaaagaacagttacgaaataaaatgcacatatccaagcctagaaggacagtcaccaacatactaatcagtcttgggggtaacattttttaaaatgatttttattttctctttgttcttttctaccttttccaagttttccccaataagtatgctttgaccttgtaagatatgataaatatcatcttttaaagtgtggtgttttaggttctcaaagcagaaaataaagtccatttcattttaaataggatacagtgaaatcgctgactacaggtcctctttcgcttagttctcgttttctttagtattctagggcaggggaggctttcttagtggcaaattactactttcagggggagcattaaataaataagaaagtaaaggttgtaaatgttgttggtatttgatttggaaacagtatgagttaaaataagatataggatgaggatgcatcctggcacaacagaaaaagcactgggctgagagtcagtcctgggttacagagctagaaccgcaaactctccaaggaacaaactcagtactccctcttcaaggggaacctaaccctatccataacctgaattccacctacaatatctttctggctcagccaccagctttgtgattctgccatctcctttctgagggccagtgaaacaaaggagtcaaggcaaaggggatctccaaggttctttacccagcacagattccatgatgcccaagggagaagaaaaaagatgccaaaaaagcctcctttacggcttgacctcggactgtcctggccgcatagtttactgagggtctagacttttctccctggttcctgctacagatcttgctgtagatgggtgatggtgccatagcttgatcttggggaccctgggatgtggcatcttctgccagtcctgttctgttgtgtctcccccagtcctggccaaaggcagtggcttctgttgctgctcccgtcaagaagtgccttcctatcctgcccatctgctcacatttctatcactgcagctcacagacttcggttgtctttcacaccccaggtaagatcaactgctaaaaccaacaatgccttgacatccttctacatgaatccacatcttcctaacatctattttggaatgctcaggtccctcaggagtcagaagagcagggacactgggtgaggccaggtgaagagggcctcaagggagctgaagatgagcacaggcttcagggactgtcaaaagagtcttgcgatcagccacagacagacatggccactggcaccctcctccatggagatgcctcagacactctatttggcctttctacctttccattcagtcattcatttttgtaaaatgtacagtaatcgaaaacatttattacagtgctgctatgggcctagctccatctgggcccattacacacattttctttaattatcccaatgaccctgcaaggtaggtaatcttcattttataaagaagaggacagtttcagagaggtcaagaaacctgcccaagatcacgttgctgggtagtgataaagccaaaactttaatttaggtctgattgcctcatgaatctatgctctttgcactttctgctgaaactgacctccctcaaccttaccatctagacagaaatgcagatggcggacacaagaggcacttgcaaaccagggacacccagagtcaagtggttgctttctatggtttacggctgtcctccttgggaagaaccatcccaaaagccatgcgcacacggggctcctgaggacatcatttcagcttgtgtcaggaaagtgcttagcagtggatcaattgccagtcttctggtcaacctaatgagcaaaataaagtcagcctgaattgtccatcatggcctaatcatcacggagtgattgatcaacacaaatgatgactccaatccactggttctcaaccaggggcagattttgcccccaggaaacatttggcaacgtctaaagatattttgagttgtcacaacttggggagtgctactgtcatctagtgggtagaggtcagggatgctgctcaacattctacaatgcacagaacagcctccctggtgcccacagccacagagaattatctggccccaggtgttttagtgcagaggtcgagaaaccctgctccaagcattcgatcaagagggacttgacccagctggagactaaccaaataccagaaagagcagctgttttatttctgggaaattgttgctagggttaaactgtatagatttagccacgactgaaggtgtccacatcctgttaagctagatggtgggcattgtgtatttttttccagctgcccttattcaagagtggcccctggaatttacttagcctttctttgggttaaaatcaggaatggaaaatttaacctctaagaggaaaacaaacagaaaatgaaaagtaggcgtaataatggaagcttaggtgcaaattttagtgcagggtattccttcctgtaaggttactcaccccactcctccaggccacagatatgcatgcacagcctgcccacatgtaactgtgcagagggagagcttagatttgaatccagaagaatggaattcaaaccccaactctactgataaccaatcttgagcaaatcacttgccttcttgaagtttcagttcctctgtcagtaacagaggccatacccacacatccccgagggctgtggattttgcatacagtaatttacataaaagcactggcaaaactacaaagtgtgccataactgctcacctgacgacaatcacacacacagagggcttctcctccctggggcacgtgggttctctttattagatttttccacattatcactgcctatgtaaagcttctcctgggtgatattctatttcttatgctgcactggagaaatattctctatatcttgaaatggaaacgctgaacccaacttattttactcatgacctaaatgagattattgcttccaagaggacaatatatcgcactaaaatgagaatgctcaggatgattaggtggagagcatttatgatgcagctttccattctccatgtgatgaaaacttgacatgacccaatgctttattgtcctacagtaattcctgtcacttttatccagactcatattgctctttaattctagcctattttcatctttccttaacaggacatcagatcttggctttcacaatcaacacagtttcaaaggttatttataaaatagtttaaaataaaatatgccatgctttgattacaaccagcgcttctggtatgaattagagaggtggcctgtacacatatgtgttgtttattagcttttatctgatgatctcaaagcactgacatcaattctaacacacatggtttcttataattaccacccccctacacacacacccatttatgcagggcagaattattttgaggacaaatgagctacgtattgtgatgtgctgtgagtttctgagaatagaaactcctatgactaaactctccatgaacagagcaaatcagagaataacagcaaatgcttttatcgctcaggcagctcaatcacatttggttttccatttcactctagtaagagggttatcggccttgaggataccccccaagaaatgtttgtgatttttgttttaagctcagcccctgtaccatctgctcactgaggccaacttcccatcccagctgtgtggctgcctaagtcagcctggtgctatgggatgggaacaggcagaggtggggagaggcttacagactcattttcaaacagagatggaaaactgggagtcagaagaggtggaggtatatatggacccagccatccgacttctgatcctattgttcttttttttttttttttttttgaccgagttttgcacttgttgcccaggctggagtgcaatggcgcgatctcggctcaccacaacctccgcctcccgggttcaagccattctcctgcctcagcctcccgagtagctgggattacaggcatgccaccacacctggctaattttgtatttttttttttcagtagagacggggtttctccatgttggccaggctgatctcaaactcccgacctcgggtgatccacccgcctcggcctcccaaagtgttgggattacaggcgtaagccactgcgcccggcctcctattgttcttaaccaggggtcatacataccccaccttcctgcaatgacaaaagaaagtcaaggtcatccctgtacatctgtctggcctatacatctgttttgtaaacaagcaggtctcactagaattaacttttttcttaactaaaacacactcacacagttttcccttgcaattcagggctgaacccttctccagttcctcaaatgcttattggctacagaaagctgcagaaagaaatggtcaattcctagtgtctctttcaaggagaacgtatttgcagcatttcttaactcagaacagaactggagccacccaccccacaggtggagccctggcagctgtgacctggaaacacaactgtgtttgttcttccctcaccagccaaggagaccagaaggcaggaggggccagccacagctgccacctttgcctctcctcttctcagggtccgtatgccacttcagaccactgtatgtggagccgagatgtcagagctggagcagagaagaggagcacgcaggtagaactgtctaaaatccaaaacaagctctgcccgcttgaattgccactcagattcatttcaagactacaaaatgtgcaggcaatgtttttctgaagggcaaccccggtgctcccgagatgggaggcaccctcccttctgacacgcatttattccatcttccggagataaggaggggacagggctggctcagcaaccccacaatctccgtctgggccagtcatctcagcaggtgcttgacaggcaaccaggctggaagagaatgcctctgcagtatgctggaagtgtccttcccctaatgccacctaatggcaaagccctgtgcatttattgcatgtgaacgtgtcctcaacacccattgagccacggtgtggtgcacggccatcagcgttcaaaacgaataaattgagccaccctagaaacaactcccccagatagtcttggaagaagctgggaggcatattcttagatttaagcaagaaattacaatgttgactcaaatcaggatttttgcaagggacttgttacactgtgctagggaaggttcacaatctgtctgtacctctgaggtaccatctttaaaagggtgtcttacattgagttctgctagaagctgaccctgaaacaaagattagagtttagatagtttattttgagagatgattccagaaaccgttggtaggtgttatgggttgaactgtgtcccctcaaaagatattgaagtcctaacaccctctgaatgtcaccttatttggaaatagggtgctttcagattatcaagttaagatgaggtcattagggtgggctctaatccaatatgactggtgtccttataaaaagggaaaaattggacacagagacagccatgcacacacagggagaatgcagcatgaaaatgaaggcagagattgggatgatgcatctacaagccaaggaacaccaaagattgccagcaaccaccagaagctggggagaggcttgggacagattctcctgcacagccctcagaaggaaccaaccctgcagacaccttgactttggacttttagccttccgaactgtgagccaataaggttttgctccttaaaccactcagtttgtggcactttgttaaggcagccctaggaaatgaatacagtaagaacatgggaagtgaggcaggtgaaggaaggaatcattatgaggttagctactgtggttaacaactggaacttcatcctgctggcaagtcccaggaaactgtggaacagctacctcagccttacacaggaggggtggcagcttgcgtctgctcctgccggtattcaaaatgaaccgactttaggaggtccccctggggcatttgtcatcaggctgaggccatgccctgaattgcaaagtttcctcctcctcctttttgcattaaatcctacccattcatatcctacctcccaggatgctttcctttaatcctctagcccagctttctcataacttcctcttagagccctcactctgtattctgcaggtcacttaataggtgttccctgaaaaaccagatgccaagaggggtgaaattaatttccattgcattgcataactctatcttcctcccttccccctgggaacgtgtaatgcacatttgcagacagaagttttggaaaagtcctgcacttaaacaacaacaaacaaaacccttcttcagtgcacttaaactactgtttccaaaatgtacattccttcttttttgtagtatagtattaacatcttgctgaacatagattggggaagagtgcctttgttataaacgtcactgaacacattgtttaggagccaggtccttgggacaaggaagggtgacacatctgagcaggtggcaacagggtctgcctgggaccaggaaccatggggccaggtgaggacttggcctggaggaggggtaggctaccggttagggtgccaaaggccatgcccccctacccccgcctcttcatctagcctgagggtgggaagtgagtttcagggatggggtagggattagagtcacggctggtgtttcctggttttctggggcagaaaatcctattcctaccaccagatcttccctttgctaattcccttctccatgtggcagacaaacctcaactcctccctccaagtccgtgacaagcaaatatgagggagacccttacctctgggctcccggggtgctgtgtataggcaatgcggttcatggcggggggagcgagggcaggctgcctggggccaaaggctggctgtgctcctgctagccatggacccccagggctgaattccccacctatcaagtggggacatcaataaaagtgccacaggattagttgacctaatgcatgcaaacagcacataaaacaagccccggcatcacaagtgttcacagttaccacccctctatcactttaccagccaggcatatccctctcctctagaaatgtgagtactttgagagcagcaactgtaatgcagccgctgacatacaatcgcttgctcagaaaatacactgaaagtgaattaatgcgcagctatgttctgcattttatttctatctctgataatatttctgacgatgaaatgtatgattaaaacaggcactcttcactaacaggaaaattacttgtttttctctcattggttttagtcttctctccccagctggcatagcctaacaggacacaccatcactagtaaaggctagtttgcctgccaaggcctaagatcagtgggtcactgtccttatggttaccatggtcctggacagtcccagcagagaagcagagatgccattgatttattggcacaaagaggcatttatctgcctctccttgtcattaacgggacgctagggcagtggggcagtgggaatctcagttagaatgggcttcattaaaaagcccttaaaaggaaacccttctaaaacctagcgatcaatcttgcctaccttttgggatctcatccgttggtgaacaactgacaggaaaatctgggcacgtctctatttttgaaaagttaatatatctgtcgattctacaaaaatccaataaatgaaaattcatactcatgaaaacaagtagattagaagaagagtcctcacaataccaaataactcacgacagcttttctttaaatattctacctatatttacatattattataatattctcttgcacaaaaccttccaagggcttcctctggtgagtgaagattcccttgtacatagctgacattttcttttctttttctttttttagagacagggtcttgctctgtctcccagcctagactgcagtggtacgatcatagctcactgcagcctggaactcctgggctcaagcaatcctcctgcctcagcctcctgagtagctttttttgttgttgttgttgttgagatacggtttacataccataagacattgtctgagcctagatatactaataatacatggtatttttgtcacttcttcactcattaaacttttactgaacatctttatagactaaaagcactctggctaaatttacttgtatgtgtttgcatgtatgtgtgtgtctatagctttcttgctgcctgcctgcctgcctgcttcgtttctgaaaggattcaggtggaaggctaaattcatcttctctggaaggcagcatgagtgcagctcatgtggggcaaggcacaagggctgcccctcgccctccggcagcctgttgcccagcaggtaggcaggtcagggcctatggcacaacagggcaaaaaatctaacaacaatggccacttggcctgcagaagctggagtggagggagaccaaggtaggcttctcagcagcactgacagctatctggtagggggagtggggaggggtttcctcactgtggggatgatccaatgcctttttgtaccccctgaaacagttgaaagccatccccttcatggacaggatgagctaaggtggcccagccacctgcagctcttttgtggctgtcattctagtgtagggtctcatcacacacacctgagacccaagtggctggctccagaagtgccatttacttataacagggcagcttgtcagcccagaggacaggcagctagagcaagaatcaaaagtcctgggtttaagggctgaatttgccatttgcttatgacatggcaatttcttgatctgtattatttttctctagggccatcatttctcccctggtaaaatccagaagtggaacttgaaggtatctataatactttccaggtcaaatattccgagattctgacataccagcccagtcccactctggtcacagaaaatcttcccagagagacgccatctttcttttttcttttcttttcttttcttttccttttcttttcttttcttttcttttccttttcttttcttttcttttttcttttcttttcctttcctttcttttcttttcttttttctttctcctctccctcccctcccctccccttccctttctttttctctcactctgttgtccaggctaaagtgcagtagtattatcacggctcactgcaacctccgcctcccaggctcaagcatttctcccacctcaacctcccaaatagctgagactacaggggggtgtcaccgtgcccagcgaatattttctctctctctcttttttattttttttgtattttagaagagacaggtttttgctatgttgccaaggcttgctgtctactcttcttatcactgaaggtagaactaagtggcagcaaccctaacccctaccccagcctaatcacgatattgccacaggccacttctgactacaaagtagctacactttacatgagagatgcattcctaaagactttgcaaaattctgattaatttatcataggaataaatgtaaaatcttacattatcttgaatactacaaatagtgagaccttatgaatttttagattgcatttttttcaaatttacataattcagaactccattaaatatggcttattgtatgttccctctgattttttttttttttttttttttgagatggagtcttgctctgtcgcccaggctggagtgcaatggtgtgatcttggctcacggcaacccctgcatcccaggttcaagtgattctcctgcctcagcctcctgagtagctgggactacaggagcacaccaccatgcccagctaattttgttgtttgtttgtttttgtttttgtatttttagtagagatgtggttttgccatgttggccaggttgatctcaaactccggaccctgggtgatccacctgccttggcctcccaaagttctgagattacaggtgtaagccaccacgcctggcctgaattttttttttttttaaccttcaaagagaaggaatggtgattggagagagagatgatgacccagggtcaaagttggtagagaaagaccatgggtttgaaggactctacagggaaaacatggagagccaggtgaaccaggcctcttttctgaccccgtagagaggacccagcaactcaatactgtcttcctttgttgatcattccacatagaattttagatggttggccaattagaaggttagatttctattcttttctttcttaactgaaattattccagacttgaatgctgctattaaatgttcaactccaaatttaaaaatctctaaataggcagcgtggtggcttattcctgtaatcccagcactttgggaggccaaggctggtggattatatgagcccaggagtttccaaggccagccagggcaacgtagtgagaacctgtatctacaaaaaaagaaaaaattagtcaggcatgatggtgcacccctatggttccaatggctcaggaggctgaagtggtaggattgcttgagcccaggattttgaggctgcagtgagctgtgatcacacccctgcactccagcctgagtgaagaagggagaccctatcttaaaaaaaaaaaaatccctaaatagcaaattctctctatctcttggcatataggagccattttgtgctcttcaaaatggctgacaggaattttctgaggaagctatggtctgaaaccaaacgaggaattaggtcagcttcaagtctgagactttgtgtttacagccatagctaaaaactaacagatgtgtcttccaaaccgacaaaatcaagaaattgtcatgaagatcaaaaatggcttccaaaatcttaccctccgtgtcctccccaccagcccctttggactgcaagagcttgtggctataactctattcacagcccatttctggtttccaagtagctccctttccaacaagagattacaaagctttgaaaattagaggcaccccaccactcccaccccaaagagctattgcgcgacgagatgctccgttgaaatggaaggagtttgctttatagcagcctccctcatggaattatagatgggaacatttaacaatacagcatttgcaatgggcaggtgagagctggctaagtttttaaaggggatttcacaggccaggtcagcagggagatggatgggtgagcgatggtggatacaattatttgactttctgagctgttcttttgaagcctctatgtttaatagaaagaaaaaggataatcctctttgccaaccttttgtagctcaatctttattgttcccaatgaaacccaaagaaaacggacaagattcattttgtccagaaagcatttgtgtattttatgtaggtctgggctttgaagtgttgatagttaagtgggagaaaagacaaagatttctctcgactctgtggaaatcaaaggaggaatttctgaagctctcttggctgactcaaaagtcctgggtggtatcctccatatatgcttcctttgctactaaactcagcatggaaattagcacaggccccacacaatgatgaaaattagatgagaccataaagaagtgagcctgaagacaaatttagacttttttgcaaaaattgagaacatggtttccgggaccagggacactttcttgtgcttatgggctctcaatcatttaaccttcatcttcaaaacactggcctggccagtgggctggttgagccaaccatctacaggactgttggtttgatttggggcacatgagaggtgcttggtaaatatttactcaattggtaagtcaagtggcctgtcagatggtttaaataatcagatattaaaaatcatggctgggcgcggtggctcatgcctataatcccagcactttgggaggccgaggcaggtggatcacttgaggtcgggagtttgagaccagcctgaccaacatggagaaaccctgtctctactaaaaatacaaaattagccgggtgtgttggcacatgcctgtaatcccagctacacaggaggctgaggcaggagaatcacttgaacccaggatgggggttgtggtgagccgagatcgcgccattgcactccagcctagtcaacaagagcgaagcgaaactctgtctcaaaaaaaaaaaaaaaaaaaaagaaaagaaaagaaatcattatccatctggttatcttgatgggcaaagtaggtcattgggaaccaccttattggattgtttgccaacctattccgagggtgaaaaaaaaagaagattaaatgcgtgtttgcctattttagccaaaatacataggatggacactgtgggaagaactggtgagaatttggggagctgttgacattttccgctgacagataaatgttcctgaaactatctgggtgccgagtctcttctctgggaacgcctcactctagggaactatttctgttgggtttttgaccctgaattctgagaacaacaattttccacctgcttgtgtcactttaacgctggtaacaatgtcaacagtgggtctgggagatccccatacatctgggcttagaattaaggggtgaacagggtttccgcaggtgggggatggagtggcgtctgcattctaagtcgggagaattgagaggaaggaagctacaaaaaaggaaagaccccaggcttacttggaagatgagagacctctgacgggagtcaggccagaccaacctgaaaagtctatgcagctatgaagaagccactcacacctctccatgatccgacagaggttttcttgtctcccttctccacagaatccctggaacatgatctgtgacatctctgactttctgctcacctactcagaacccagactgccagccctgagttgaagtaatgtttgcccttccttctatggagctgtcctgctgccaccaaactcctcctaaacacacacaccatacatacaaaatcactcactgctgcacataaaaacacatccctgcagatgcaggcacacatccatcagcatacaggtgagcatacagtgcaccacacacaccaacacatgcacacctgcacatgcatgtcaggacacacctacaaacacacagcaccacatgcgccagcatatgcccacagggggcacagacacctgcaaccaccagagcctatgggtaaatacatgctggcgtgcacattgccaacacccacactgacctgcaacccctggggcttgggctcaggcttttcacgtgatgggtcacctggctcagctgccttctccctgcagcaggcagctcaggccagtaaacccaggggaacaggttgcaacctctaccccctcccccagcctgtcttttctactctttcccctatcatacttctctcccatcatgcccagcccagatgatgaaagggcaggtctaactgagggctgtcattcacattctgtcttggagccagtacaattttgcatggtggggaattagcaaaatacaagaagacacagtagactctagtatctacagcaaaagaggggggtaggggtttgttaatcttaaatggtgatgttggtttccattctgagccctcctccccacctgccatggcttggcaaaggcaacagcacctacagcccatcacagacatcctgctgcagcacttgaatacttcccctcttcccaaccctcctctcagccagctttgggggtggcccactaagagtctcagatattcacatctccagctgtttaatgcttcatgcatttgttctgagcaccagaaaaccatcttttgctttgctccagtcaacagcacaaggatttgcactacctgcaccgagcctgcaggtgaaccccaggctaaaatatgacgtaaataattgtgaatagattatagacatttgtcattcaaagataactctcccagtcctggaggagttagtgaaaaaacaaatctcaattcagagtctgtgcgtgacggtgtgctgttcttttagagaatctcatacacataaaacctttcacaccatatggagatccactcttaccaagcagattaattacaggcaatttattcagggcaaaacctctcaaatatgatttaatttacattttacttataacctctgcatacagtggggtggtgagcggtgtgcatacctgcacacacaggagtgggttgaactgcaaattgaggcgcatccctctaaggaagttccagaatagatgcattttctgagagtaaaatggaaactatggatttatcagctttggagaaaatgtaagttctccatttagaaccatcataatacgttctagaaaaacatatagttctatattaataacctaatattcatactcagcagaaaatgtatattaaatgagaatattcagcatcaaaataattattttttactgtaaaaattgagaggaaaagagtaagtgcttagtaaggggaatacctttagaagtaggcttcagaatccagtctttgggtatatgatggtgtacggacctgggcgagcggctgcacactgttcaaggtgcagaccctgtacgagggccccgagaaaccatgtttgaggcctggttctactcgtaggcaagtcaccagacctacgagcctcactttcttcatttacgagaagagatagatcctgctgctttttctgctatttgccataggatggttatgaggatccagtaaacaaaggcatggaaactcattttgcaactgtaaagggatggctgcactcagagaacggcggtctggactggcaagggtcctgcttgtctttgttctaatgctttctatttatttttttctccttgagcctgaaaattagttgctgagtagcacaaatcaaaacaggcaagcaaagtggacagtgcaaacgcctaacattttcaccactgcaatttggctgcttcgggcagtaatttgctttctcttcaagtctgttctcaccaaccgaagtccttgcacggcccccaataaatctgcagccgacgcacaagcagaagggatggactttgtccttggatttttcacagcagaggctcccacttagaatgttaaaaatattgtggtaaggtgagagcccagatttaaaaagtatttggagaggcaaggaagaaggaagttcaggctctgaattctgagagccaatacctgtggggtggggtaaggatcgggggctgagtcattaaatgttctttaaaactttgtaatttcaagaccacacacaactcattttgtagctaaaagggatgttcaatcctctcataatttatctcacagatgctaaaactaaagcctagagagaaatttctgcccaagtatacactgcaatgtaatgacagaggaagaaaaaaagcatgtcagtccagtgttcccccattattgcattgggaaaatgatattctattttgcagattgggaaactgaggcacacatgctaatggttctggctttccaagtgccttttgtgtttaggcacttccgaatcagatctccactccacagtcccctgcgtgaagaggcaccattgccgccatctcacagaggaagaacagggctctgaggtcgggaggggaaggcggctcaggacttctggctccagagcctcctctccttccaccatagtgcctgctccagaggagacacaaaggcttggagatggtaacagagagttagagaaacattttctttccttgatgggattgttttcaacagaagtctagagcatcctgcaaaatgctgttttactttaacctattctttcaaatgtcattcctggatttgcccaagaaagtaacaaaagctacatatgtaaagattttcttgtaggattagctaaaataacaaaaatcagaaatagtccaaatgtacaacaataaggaaatagtgaagaaaatacgatgcatggatgctatggaagcttacatagcaattaaaaacaatcacaaaggctaaacatgaaaacaatgcttacaataaaatattaagaaaaaaagcacttgaaactttttaatgatatgttttatgttttgattatgatatgacttatgtttttatgttaactataaaaagatagtaaaattttttacacttgtaaaaaatgttggattggaatataaagaagtgagaatgcaatattattgggctggcttggtaggaattttgaaaaaaatttaattaaattttaacttccgtcagtgatttttatatctttactaaaatatctcaaactaagagaacagaaaaatgttggctacctgaaatatttatttagtaacctggatcaaaccagactaatagtaagtatcttgcttttttttctttctatattttgaggaaactgggtgattggatactgtggtttatactataatccagtcttttgctacctgatgcctttcattagtttatttttagttcattagttaacaatctccaacagtgttagccttgcttattttccgctttcctccggtgttaaagcctaatcagaaaaaatgagcatatttctttatttttagttataatgttagttgaatcatatgaaattatcctttttgtagatctgaaataaacaaatagtggaaatttcatatggtccaaccagaaaactttaataatggcagggttttatcttaaaccatccttacaactcatttcaaataattctaatcactcaaactgccctgtcccctccactggtttaatttctggtttttgttttgtttttaaaataacattgtttaatactacgttctctagaggaaaggtccaaacaatgccaattcaatatacccaccaaataaaccattaaagttaatttaatcgtatgaaaacatctagatttccttcattcactcaccttttaattcattcaacaattcttattttattttattttatttatttttttgagatggaatcttgctctgtcgcccaggctggagtgcagtggtacgatctcagctcactgcaacctccgcctcccgggttcaagggattctcctgcctcagcctcccaagtagttgggactacaggcacgtgccaccatgcccagttaattttttgcattttttagtggagatggggtttcaccacattggccaggctggtctcaaattcctgacctcaggtgatccacccgtctcggcctcccagagtgcattcaacaattcttattgataattattgcacattgactctgctccaggtaccatgctaagtgctgggtagagctgtgagcgtgacaggggcgtctttgttttcagggaacttaaagttgttttttagaccggaagacatactatgtacatgcgctgactaaagcgatcattttgttttgattaacaggtctaatgaccggtttaatttttttttttaaccatattgaatgtttgttcaaagtgacgaacaccatcactttagtgttaataaaaattagccttggccgaagcagagctaagaaatttattttgaactatttccggtatttattaaatcaattatctgacctatataaggtcctaagccttagataaataaggcttgggagaaacgattcccaaagtgcgtgtttggacaactctaatctaagagagttccctcagggcaactggacccttctaagtaaagcacaagacacaatgctgggtaacttttgactggaaaagtatatatccaacaataattacatgtatttttttaaagaacaaaagcaaaaatacaaagaatttaaaattaaatacagcagtggttattcacctaagccagagctccccaggaccgtttctgggggatgcttagcagaagcagatgtgatctctaggctagtaagcctgagaaacgctaaaattgaaaaatgaaatagctcatttggatgagcagagctaggcgattggagggcgaaacaatctgatggtgaaaatgccattgatgaaaaatttgtactggtatcacttaaaagcttgcctcacattcacctcccagcaattttagcaaagatttagtgttcaagaagtttgcatttagatactcagtcgctgtgcacccacaatagccctttggcttcagaatctaggtggccacccggaccagtgatgactgggtggattttgtttctgattcctttcaaagtaatactttgaaaaacttttgtctatgagccttatctaagatagctaaaatgtcagtctccacagaggcaaagtaagtggcactgagaagtaaaaaaatccagccaatccccctgccccctatttgtggaaatggggcacagcccccatcttgcatatattttttcagacatgtttttacttcgggagaatattcccctacagagtaagtatctttaaaaaatgaaaatggtggatgtaacagtcatcctatgaccagccagagctttgctgctttttcactatcgggcctacctctgcaatcattgttatgtttctgtgctggtatgggtgtgcccagaaatcagaagagggatgagttggattgcaacagatggagaaaatgcccactgctgctttataacatattgaaagcaaatgaagaatcccagccatgggtttccatctcctgttttgagaacaagaagacagtccgagatgtaataatagtaatagtaaatacaatgtttacttattggctgtctactatgtattggacacattacattacttctcattgtcacatctctgcaaagaaggtattacaagtctttctttagaggtgagaaaactgaggcccagagaggttaagtaacttgcctaaggttgcacagctaggaagcggcagcactgggacaccacctgaaattagcctggctctttctaccacgtccagccaccttcctaaaagcagagccactcacaagcctggaagctttgcattccccaaggctgcatgtcagagctccatctcctcactgataaaagacaaacaccacactgaccgctgggtgcattcttggctactgcagagtagggagttagaggcactgagggctctgcaggcacaagtgtgcccatgccactaggcacgccatcttaggatcttctggcctcaagccctggtgactgtcttggtagattctctctcagggaggcctcctcatgtggacagaccaggtcatcatttgctttgatcctaataatctgggcatttccaaagaaatgcaaatgcaacagcttagtaaaaagtagacattttaaaagggatgtatgcaatgggtcacttaactgagcaagaaaagagagaagacctgactgaaattctatgtgcggcctttcctccggggagactgtggaggtgtcccctcaggcagcaaaagcaccatcgcagccctcggtgtcaaggcctctctgagtcgcgctttgccttaccgtacctcgtttctgggctaggatattttgaaacacttttgtctattagctttatctaaaatagctaaaatatcagtctccatagaggcaaagtaagtggcactgagaagcaaaaaatccagccaatgtgcagttttctcctcctgccccctatttgtggaaatgaggcacggcccccatcttgtctgctgggtggggttctgtttaccacgcttggcagccaccgccacccaacaatctttcatttttctttctaacttcactttgcccctaccttggtctctccaagccgaacacaaatggaccagtgaggaaactgcaggtaaagaccctgaaaggttatatgagctccctggtgtggtgtctcaagcctgaagctcagaggctggagctattgcccctggctgtctcccctgaagtcactaaattccagcgttctgggtccccttgtccccagcacacaaggatgggctgctctgagcaagctcaggcaccctcactctgccacactgtgtgtgtgacttagaccccacaaggcttttctgagaaaacagctgtgacctgacagaaacccctgcagctgcacgggcctcagaatcccccgaggcgctggcccgggctgtgcctggctccctggtgggagcagaagtgcccatggcctctcctgccctcccaacagggcccctaaacaaattcccacacccaggtgagttaccaggagcgatcaggtgggccgaggacatttgcttgcttcaccttccctgtttctttagattgaaattcagcctgccccacttctcaggaagatgccacgaggctgatccccctgagcagtttgtcctgtcctcttttcactggttttcttcctcattacctgggctagaaaacatggtggaagctaaaggcttgcagcaaagctgggctcccacgatcgggaatgaggtgaggagcaagcactcttgttggctgggcgctgctcgtggtggtgacttaaccaggcacatcgtctcatctgccccgtgttctgtcaatgccgggccctctggctgggctagatggccgcctaaggggcaggctggggtgagtcacggagcctgggatggtgcgtcacccggcagtcccaggcgtgggtgtggggacagccatgacaaggctgagcctagacacggacgcttggccatgaggtggcgaaggcgctgtggaggctgccacccggtgcttcctgcctgtgcccctctcctccttggttaccccacttactcccgggcccattggagtgtttcaggccatgaccttgactgaccaacaaaatcttctttgttggcaaaggaagaaagaaaggggctgagtgacggagccagccagagggtgaaagaagctgaagggactagaacgtcgcagcacgaaacatggcctggctgacattttccgatcctgtccagcttctgtgaaacactccctctccgtttctctaccctgggcctgcctcggttgctctcttgcttccttcttccttcctctcttatcactcgaaaaatctgtacctggaggagctgtgtattctagcagctggctctgaactgatgcccaactcggctgtgacggagcagatgccagcaccgggccggacccctcactgctcacttgcccattgatttgaggagggcaggatttgaaggagaccccagcccctcaccaccctccactacccacacccactcccctacacatacacaaagagtttctagaagttccctgccgtcgacacgtcggccctacctgtaatcggcaactgtgcctgcaggatggccgcggtgaaaagcgccttccacttcatcttgtcctttccctcagaaagaggctgggaggcagaggctgaggcagcggtggccgggacggttaggagaaaaggagtctctgctggttttattctgcagctacctccccaggaagtggaggactgtggggcctttgagaaagca

SEQ ID NO: 1590 - DNA, 87971 bp, Homo sapiens; identical to SEQ ID NO: 1589

SEQ ID NO: 1591 - DNA, 6834 bp, Homo sapiens
cggaaggggaagggggtggaggttgctgctatgagagagaaaaaaaaaacagccacaatagagattctgccttcaaaggttggcttgccacctgaagcagccactgcccagggggtgcaaagaagagacagcagcgcccagcttggaggtgctaactccagaggccagcatcagcaactgggcacagaaaggagccgcctgggcagggaccatggcacggccacatccctggtggctgtgcgttctggggaccctggtggggctctcagctactccagcccccaagagctgcccagagaggcactactgggctcagggaaagctgtgctgccagatgtgtgagccaggtaagagggggccttggtaagggccaggtgagtggcgaaagagagaggactggggttaatacagtaaataggcgcagggtgagactgagctcaagcaaggagggaaatcctgcagctgtggggaggcaccaccttgaagagggcagagaaccagcccttctcaggccttgatcccttaccctctcctcccaggaacattcctcgtgaaggactgtgaccagcatagaaaggctgctcagtgtgatccttgcataccgggggtctccttctctcctgaccaccacacccggccccactgtgagagctgtcggcactgtaactctggtgaggtgggcaagggtgtgtaggtggggacgatggacaagcatctgggggagcaaggctggtgacgggtttgggggtgcaaggaggatgacggggccaaagctttggccttcttcaaggctcacagcaagtggagccaatgctgggaaatgcggcaccctaggtggggcatgaattaacgtgggcagacatctagtattccaggaaagggataaatagaatttgagggattggtgagaacgggtctatggataggatcaagacaataaaatgagagaagtggctctatgaccccagatttcgggcaagcaacccccaaccaataaactgactgtgttcccagagtgcacatgtgcaggttggccattgggaatttggaatacatctttctaaggaaataacaaagcaacccaataggtaacaacctttttttgcacaaaagccaatttgagaaaatgagtatgtatgtagcctgtgtttttattttatagttccaaaaaaaaaggttttttttaaactaagaagtataatatctgcagttgtgcttatgaatgctgttattatttctccatcttcgctacaatttcagaaactacggccagtatacactagaatagcaggctttaaagtggcccctttgaacaaatgttctctagcaagacactttttagaaccaggtaactgtaactattaaactacctacttgcaaaacgtgtttggtgtcactgggtctcttggtactgggttttgttttgtttagtttagagacaaggtctagctctgtcacccaggctggagtgcagtggtgcaatcatagctccccacagccttgaactcctgggctcaagcaatcttctagtctcagcctctgaaagtgccaggattacaggtgtgagctgtagtgcctggtcccgtaaaaacaaaaacaaaaaccaacaccagatgtggtggctcatgcctataatcccagcacttgggaggccaaggcagaagggtatttgcatattttgtagagacttgagcccaggagcttgagaccagctgggcaacatagtgagaccttgtctctaaaaaaattggctggtcatggtagtgcacctgcagtcccagctacttgggaggctgagatgggaagatcacttgagcccaagaggtccccaagaggtccaggctgctcacatcactgcactccagcctgggtaacagagcaaaaccctttttcacacacacacacacacacacacaaaaagccagagcagtggctcacacttgtaatcccagcactttaggaggccaaggcaggcggatcccttgagcccaggagtttaagaacaccctgggcaacatggcaaaaccctgtctctactaaaaatacaaaaagttagccaggcgtggtggcacgaacctgtagtcccagctactcagaaggctgaagtgagaagatcacttgagtccaggaagtggaggctgcagtgagccgtgactgtaccactgcactccagcttgggagacagagtgagcagagtgagaccctgtttccaaaaaaaaaaagaaaacaaaagcttttccattgcaaatcaaccaaaaaggaacgtctttaatacacaagaaatattcttcagtctacttaacttaaaaatgtaactgtaatagatgcttttctcttgacagcggccccggcagggttggaacttttcctagtcaaaacccccctactcactctgcagacccttcctgaaggtcttcgccccatactgagcccatcttcagtcccttcacttgttccaaactagcccaatccatgacccttctctgggagctcagccaatagatcccaaagtaccacagcagcacctggctgcagaaggacccccgggaaatgcagtcaggggtgagaagatgggtgggctgaatgagctcggccctctctgggccttagtgctggcatctatgagatgaggacatgcctgaagtcagcctggaattttgagcccaggttatacctggtaaatagaactcccaggtctccggatactcaccactaaaacaatagcacctcattgtttttgttttgttttgttttgttttttaattatactttaagttctagggtacatgtacacaatgtgcaggtttgttacataggtatacatgtgccatgttggtgtgctgcacccattaactcatcatttacattaggtatatctcctaatgctatccctcctccctccccacaccccacgacaggccccagtgtgtgatgttccccttcctgtgtccaagtgttctcattgttcaattcccacctacgagtgagaacacattgtttttaaccctccccagcagcttctttaacccctccatttcccttttggcggagacccttgtcatcactcctctctaccaccagtgctctcccctcctgcactgtcccaggcttcctcattcttcccttgcaggtccttatccaacatggctcacaattcctgggaagccacaaggaaaccaaattctagtagcaactcagagtcagcattcattagcaggtcacagggccataaggatgccaagaaggaatttgtccctctccttgtcctgacaaaaggcataagtagaagaaaattgttaggtttggttatgacctttgacattctctctttgacatcctccctttctgcacccctcttccacctgtcagggcacctagggctccccgggtccccacaagtgtctgccctaaggcccaccaggctttcttgcagcctgtcccacatctgggtgtcactgccttcctctgaatcaccctcctctcaaaccagccgccagcgagcccagcccagcccagctagtgccctaccacacccgcccccaggataattaacacccagccacccagcatcggacctctacacttgagcaaaatgtatattttaaaggcaaattctcacgcctgtaatcccagcactttgggaggccaaggcgggcggatcacgaggtcaggagattgagaccatcctggctaacacggtgaaaccccgtctctactaaaaatacaaaaaattagccaggtgtggtggcacacacctgtaatcccagctactagggaggctgaggcaggagaatcacttgaactcaggaggcggaggttgcactgagccgagatcgtgccactgcactccaacctgggcgacaaagcaagactctgtcaaaaaacaaacaaacaaaataaaggctaagtaactgtaatcaagtaactatttattatttatttattttagtgtatccacaggttgtgcagccatcaacactatctaattctataacattttcgttaccccagagaaacttgtaccccttagcaatgactccccatttcttccccccaaccaaccccagccccagccccagcccctgggaatccctaatatactttgttttgttttttgttggtggtgtttgagacaggatctcactctgtcacccaggctggagcgcagtatcatgatctcagctcactgtaacctccacctcccgggctcaagcgatcctcccacctcagcctccccagtagcttgggcctacaggtgtgcaccaccacacccagctaatttttgtattttttgtagagacggggtttcaccatgttggccaggctggtctcaaactcctgagctcaagcaatccacccacctcaacctcccaaagtgctgggattacaggcgtaagccactgcacctggctattttctttctttcttttcttttttttttttttttgagacggagtttcactctgttgcccaggctggagtgcagtggcgtgatctcggctcactgcaacttccacctcccgggttcaagcaattccctgcctcacccggctattttatatttgttgatctgctgctggttatgcctgtgagccaaatttgtacaaattcttaagctttacaatcatgcgtgcctctctgtacgtatattatactttaattaaaagttattaaagtattggggccgagcacagtggctcacgcctgtaatcccaacactttgggaggctgaggctggtgcatcacctgaggtcaggagtttaataccagcctggccaatacagtaaaaccccgtctctactaaaaatacaaaaaattagccgggtgtggtggcacacacctgtaatcccagctacttgggaggctgaggcaggagaattgcttgaacccgggaggcagaggttgcaacgagccaaggtcacgccattgcactccagcctcggcaacaagagcgagactccatctcaaaaaaataaataaaaaataaaaaatgtatcagggagtacaagagaaagtcatataagctctttctacttttcatggtttctatgtctgaacccatgaatcttccttctgaaaggtccaactttcttctttaataacaataataatggcaaaggcattgggggaccgtgagcaaagggcaggcctttgcaggggtgggaatggaaagggaagcacgtccctagaggtgggcctgggatgggggttgggggatgaagcaagtggaccttgaaggtctccacaggtctgagtgtcctatgctccctgggcctctcttcccccaggtcttctcgttcgcaactgcaccatcactgccaatgctgagtgtgcctgtcgcaatggctggcagtgcagggacaaggagtgcaccgagtgtgatcctcttccaaacccttcgctgaccgctcggtcgtctcaggccctgagcccacaccctcagcccacccacttaccttatgtcagtggtaagttccaggcaactctctgtgccatcacgtggggtagcggtgataccccaaccagtactccccactcctacccctagataaggtcagcctgtttctgccttcccatcccatccagcacctctcaggccttcagatgtgccctatggggtcccctgctgctactcattctgtctctgtttttccagagatgctggaggccaggacagctgggcacatgcagactctggctgacttcaggcagctgcctgcccggactctctctacccactggccacgtgagttttctccttaatccccaccgctagagagaatgcatacacgaggggccaggagggaagccagacagaaagctcctaggattagggataagaggaggggaaaaagcagagtccactgtttaggagaggagttggccaacggtggcgggtgggatagaataaggtgggggaaaggggagaggcaaggtgacaggagggctgggctgagggagccaagggctagaccctcccctaacccctgtgtgtcccctcctattacagcccaaagatccctgtgcagctccgattttattcgcatccttgtgatcttctctggaatgttccttgttttcaccctggccggggccctgttcctccatcaacgaaggaaatatagatcaagtaagagacagaacacaggcctccggtcctgcccctgcaccacaccccactggctcaaccccactgcccacgcctggaatctcactgaaacccaccagctccacttcaccagccttggtcctaccccttctctccccttagctggcgtgctcctgacacccctcccccaagcgcacccgcctctacccatctccttctcccgtctccccctgcccccactgctggccaagactcatcggatctccttctgcagacaaaggagaaagtcctgtggagcctgcagagccttgtcattacagctgccccagggaggaggagggcagcaccatccccatccaggaggattaccgaaaaccggagcctgcctgctccccctgagccagcacctgcgggagctgcactacagccctggcctccacccccaccccgccgaccatccaagggagagtgagacctggcagccacaactgcagtcccatcctcttgtcagggccctttcctgtgtacacgtgacagagtgccttttcgagactggcagggacgaggacaaatatggatgaggtggagagtgggaagcaggagcccagccagctgcgcctgcgctgcaggagggcgggggctctggttgtaaaacacacttcctgctgcgaaagacccacatgctacaagacgggcaaaataaagtgacagatgaccaccctgca

SEQ ID NO: 1592 - DNA, 12517 bp, Homo sapiens
gtggtaagaatctagtttattttacatgtgactaattggtctgtgctgcatggttatatactcctggattatagattagaagtctccgaagtcacctctgtgaaaagcaagctatcattaaacatgtctgtttatcaatcaatcaataaataaaatattgtttatttggggatacatgctgaaaatcattttattgatggggtacaaaataaaaaaaaaaagcagagactactgaattagaaatatacattttttcaggcacagatggaacatttacaaccacatactaggccatagagcaaatctcaaacaaatgccagaggattcatatgtattcattttctacagctgctacaacaaattaccacaaacttagtggttgaaaacaacccaaatgtattatgttacagctctacaggtcagaagtctaaaacaggcctcaccaggctacaatcagtgatggcaggtacagctgcccctggaggctgaagggtcaaatccatctccttgccccttccagcttctagaagccgcccacatactgaggctcatggccttcttcttccaacttcaaagtcagcaacatcttgatccttctcatgcagctgcctctctggcgctgtctcctctgcctctttgccacttacaaggatgcttgtgattacactgggtctacctggataatgcagaataatcacccattgcaaggccaaccttgattccatctgcagccttaactcccctttgccatattaacatgcagttcaggggcgcagatgtcctcgggggaccaacgtgctgcctgccatgctacacagacagagtgctcgggccacaataaatttaaaattaaaataataaacaacaaaaagttaagccccacagatctggaaaatttgtaatgcatttataaatgaaatataggtaaaaataaataataacgggaaaagcaaatcaacaataatgaaaaaaacaatatagcaaagctgatgagatgtagctaaagtagatcttcaagggaagtttatagccttaaatgcatatattagaaaataagaaatttctaaattaattaagcatccaatacattagaaaaagaatggcaaagtatgccgggtgcagtggctcacatctgtaatcccagcactttgagaggccaaggtaggtggatcacttgagctcaagagttcgagacaagcctgaccaacatggtgaaaccacgtctctactaacaatacaaaaattagccaggtgtggtggcgcacacctgtaatcccagctactaaggaggctgaggcaggagaatcacttgacctcaggaggaggaggttgcagtgagccaagatcatgccactgcactccagcctgggcaacagagcaagacagcctaaaaaaaataataataataacagtgaaacagctacacacaagcaaatcaagttctaccaggctttcaaggaacagattatccctattgtatataatctgtatataaaaaaataaaaaatagcacttaaaaaacaagtggtcaaagcaaggaaaatagaatcgtgtcacagaaaccaagggaagtaataattctcatgtaggtggagagctgccagatcccacatatctctgttaaactttgcttcctggatgaggcactccctaccccttaaatccccctattaggggtatagacacctatattgcaccccaactctctccttcatagcaataatgaccattactaactaattttaattttgttttgttttttgggttttgtgagatgaggtcttgctctatctcccaggcttgagtgcactggcatgatcatggctcactgcaacctcgaccccctgggctcaagtgatcctcccacctcagccttccgagtggctgggaccacaggcacgtgccaccacacccagttaatttatttttattatgtgtagagacggggtgtcactctgttgcccaggctggtcttaaactcctaggctcaagcaatccttccgcctcggcctcccaacgtgactgggattccaggtgtgagccgcctcacctggccaattttacatttgtctttgagattatatgatcgatgtctgactctcacactggtgtgtcaactccgtcagggcagaaaccacatatttgtctgtttgtttttcatctttgtgccccattacttggctggttcctaacacaaaatgaatgtgcaaaaaacgcttgtcaaatgaatgaggaggtctaaggggccttgagccctctgacgtttccattttataattgtggacagagccgctacagcacaaagctgagctggaccatccaatgtttagccagtgccttacgtgctaggagacactgggagctgtgctgggcttctgaggagtgggcagaggctggaaatacccatagttggtcagtctcctgtgtcacccagactggggaggtgcagaaatgaaaattacagagctgcgaggacccagaacctcattaatgagcttaactcactgtcctgaccaggtggcctctcaaagccttgctgggaaggaggctttaaggtggtgggggcagcagtgctggtggtggtcatcgaagaaagtgggagtcggggaggaagcaatggggagcaggggacaaagagggccagacaaactcagagcttcaggtgatgagactcaggaagcctaagtcaggaacagtgattgcggacatctttgtcccataacagaacttcctcctaaggaaaggtcttgcagagactggtcctgctgagcgctttaacaggttattgattcataaaaattggagaaaaaagacaaagtctgccacacctaacagccttctgtttagagctggtttagaggaaactttaagcaagtcttgtgtccaacaatttgggcctgaggcagggtacaggtaagggaacagacaggagacacggaggcaagaacaagactttagctgaaagagaaatcagagccagaggcagccacaagaacacccaacctactggaactcatgcaggtggacagcctgcccaggacttgccctgagtgggaagcaaagagcatcttatctagattttaaggagcagggtgcccctggctgacatctaggctacagtcactgggccaggtggagggttggtcaggccctctcaaaagtcatgagaggccaggcacagtggctcacgcttgtaatcccaacactttgggaggccgaggagggcagatcacttgaggccaggagtttgagaccagcctggccaacatagtgaaaccccgtctctactaaaaatacaaaaaattagccgggtatggtggccggtgcctataatcccagctacttgggaggctgatgtataagaatcgcttgaacctgggaggcaaaggttgcagtgagctgagatcatgccactgcactccagcctgggcaacagtgagagaccctttctcaaaaaaaaaaaaaaaaaaaagaaccaaaaaaagtcatgagagtcctcagagttctcaagaagggctgctgtgggcctgtttctggaaaggaaagaaaagcagggagctgttgagaaaataccatatgtttttatgccccagccaggcatgggggagaggctgaccccaaaagagaaagtggttgtgtgagatttcaaggaagatgtcagcgggctgcatcccagggcctctagacaaaaggaagggcccagccaggcatggtggctcgtgcctgtaatcccagcactttgggaggccgaggcaggcagatcacctgaggctaggtgttctggtccagcctggccaacatgacaaaaccccatctctactaaaaatacaaaaaataagctgggcgcggtggctctcccctgtaatcccagccaaggtgggcggatcaacttgaggccagcctgaccaacgtggcaaaactccatctctactaaaaatacaaaaattagctgagcgtggtggcacgcacctgtcatcccagttactcaggaggctgaggcgtgagaatggcttgagcctgggagacagaggttgcagtgagctgagattgcatcattgcactctagcctgggtgacagagtgaaatggagggaggaaaaaaaaaaaaaaggaaggtcccgtccagggagccagcctaggatggggaaggctcaccagaagtggatgcaaagagtgctggagatgagctcattctatttgcctaggaaagaaaaacgtccagaaacctggccttcctcctcttggccgaggccctccaggaaagccaggcagaccctgctcctgctctgaccccctggagaagtgatatgtagaaaagaggagatgggctttggcccagaggacagcagcgttaggctagtgagcagttcccagtcggttcaaggttgctaggctcagcgaactgcaagtccctgttcgacaagtttcttcctaaaggtccccagttcctcatgattcttctgagggtctcatccaccctcccagggcctgcagtcagctagccaccccactgccccatgcctgcagtgaacacatttaccacaacctggaaatggctggtgacagaaaagtcctcacggccacaacactctctgcggtgggaattcaggtgccttgcctgatggtgacaaagctggttttgcataaacagctctctgaatcacacccaaatgtggcttctgacttgagtggacccccatgaagagctgcagagggggctgggaaaagacaagagaatggagaaaatgaggagaaaggaaactacagagtgagatagagaacatatctgacaggtgtgaccacagcagtgtgacatttatgaacagtgtggaaacaacggcaaagcccctaaattaaaaacttcctggggaaataagccactccacatatcggttgctgaggaaagagtggaggaggctgttgacccgtgtgtgtccccatgactcaaagagggaaaagtctagctgtttccaatatcccgaaatcagtcttgctgggagaactgggaaaataaaaaagagatgacccccgtaggaagctacctttaatcccaagtgcccaaggctaggagagaagatgctccaggcgatccaggacaccagtgactgacacagccagaggtgggaaaggggaggataaagatggcacaaaagtgaggagtgagcaagggtctgagagggaaggccatgtgggcagtaggtggcacccacatcagagactgacatgaggattaaaggagagcataggtgatcggtcagagtgtgacagaagagaggcagctctacaccccttgcttgcaattctgagcattctgtagcaaactcgtttggccatcaaaccagacctcaattgagacaaggctatttaagcttcctcccagttggtgtaaatattcaatagttttgctgcagaaatgttgcgtttgattatgagactaccccaactccccaagggtgttttgtggtgctggtttctgtataaacctgaaaaattctgaattccaaaacttatctgacccccaaagtttcagataagagcttgtggacctgtgctcaattctggttctccttccttctttcaactgttgtctgtgaaaggagggatgcaggtatgggagacaggagtcctgcgaattcgtctgtaaactgtggacgggggggtgggtgggggggggtaacgtgggcacctttgtgcacaagtgcatgaataggaggggtgagcaactgtgtgtccatcacctttttgtcaaagaagcaggagtcagtgggctacgtgcttcatgagcaggagaggcggaaactaaggaaggctcatgtgttggaggaagcatgtttgaagagcagcaggtctcacagagtttgctctttaatactctccccagcacacggaaggggaagggggtggaggttgctgctatgagagagaaaaaaaaaacagccacaatagagattctgccttcaaaggttggcttgccacctgaagcagccactgcccagggggtgcaaagaagagacagcagcgcccagcttggaggtgctaactccagaggccagcatcagcaactgggcacagaaaggagccgcctgggcagggaccatggcacggccacatccctggtggctgtgcgttctggggaccctggtggggctctcagctactccagcccccaagagctgcccagagaggcactactgggctcagggaaagctgtgctgccagatgtgtgagccaggtaagagggggccttggtaagggccaggtgagtggcgaaagagagaggactggggttaatacagtaaataggcgcagggtgagactgagctcaagcaaggagggaaatcctgcagctgtggggaggcaccaccttgaagagggcagagaaccagcccttctcaggccttgatcccttaccctctcctcccaggaacattcctcgtgaaggactgtgaccagcatagaaaggctgctcagtgtgatccttgcataccgggggtctccttctctcctgaccaccacacccggccccactgtgagagctgtcggcactgtaactctggtgaggtgggcaagggtgtgtaggtggggacgatggacaagcatctgggggagcaaggctggtgacgggtttgggggtgcaaggaggatgacggggccaaagctttggccttcttcaaggctcacagcaagtggagccaatgctgggaaatgcggcaccctaggtggggcatgaattaacgtgggcagacatctagtattccaggaaagggataaatagaatttgagggattggtgagaacgggtctatggataggatcaagacaataaaatgagagaagtggctctatgaccccagatttcgggcaagcaacccccaaccaataaactgactgtgttcccagagtgcacatgtgcaggttggccattgggaatttggaatacatctttctaaggaaataacaaagcaacccaataggtaacaacctttttttgcacaaaagccaatttgagaaaatgagtatgtatgtagcctgtgtttttattttatagttccaaaaaaaaaggttttttttaaactaagaagtataatatctgcagttgtgcttatgaatgctgttattatttctccatcttcgctacaatttcagaaactacggccagtatacactagaatagcaggctttaaagtggcccctttgaacaaatgttctctagcaagacactttttagaaccaggtaactgtaactattaaactacctacttgcaaaacgtgtttggtgtcactgggtctcttggtactgggttttgttttgtttagtttagagacaaggtctagctctgtcacccaggctggagtgcagtggtgcaatcatagctccccacagccttgaactcctgggctcaagcaatcttctagtctcagcctctgaaagtgccaggattacaggtgtgagctgtagtgcctggtcccgtaaaaacaaaaacaaaaaccaacaccagatgtggtggctcatgcctataatcccagcacttgggaggccaaggcagaagggtatttgcatattttgtagagacttgagcccaggagcttgagaccagctgggcaacatagtgagaccttgtctctaaaaaaattggctggtcatggtagtgcacctgcagtcccagctacttgggaggctgagatgggaagatcacttgagcccaagaggtccccaagaggtccaggctgctcacatcactgcactccagcctgggtaacagagcaaaaccctttttcacacacacacacacacacacacaaaaagccagagcagtggctcacacttgtaatcccagcactttaggaggccaaggcaggcggatcccttgagcccaggagtttaagaacaccctgggcaacatggcaaaaccctgtctctactaaaaatacaaaaagttagccaggcgtggtggcacgaacctgtagtcccagctactcagaaggctgaagtgagaagatcacttgagtccaggaagtggaggctgcagtgagccgtgactgtaccactgcactccagcttgggagacagagtgagcagagtgagaccctgtttccaaaaaaaaaaagaaaacaaaagcttttccattgcaaatcaaccaaaaaggaacgtctttaatacacaagaaatattcttcagtctacttaacttaaaaatgtaactgtaatagatgcttttctcttgacagcggccccggcagggttggaacttttcctagtcaaaacccccctactcactctgcagacccttcctgaaggtcttcgccccatactgagcccatcttcagtcccttcacttgttccaaactagcccaatccatgacccttctctgggagctcagccaatagatcccaaagtaccacagcagcacctggctgcagaaggacccccgggaaatgcagtcaggggtgagaagatgggtgggctgaatgagctcggccctctctgggccttagtgctggcatctatgagatgaggacatgcctgaagtcagcctggaattttgagcccaggttatacctggtaaatagaactcccaggtctccggatactcaccactaaaacaatagcacctcattgtttttgttttgttttgttttgttttttaattatactttaagttctagggtacatgtacacaatgtgcaggtttgttacataggtatacatgtgccatgttggtgtgctgcacccattaactcatcatttacattaggtatatctcctaatgctatccctcctccctccccacaccccacgacaggccccagtgtgtgatgttccccttcctgtgtccaagtgttctcattgttcaattcccacctacgagtgagaacacattgtttttaaccctccccagcagcttctttaacccctccatttcccttttggcggagacccttgtcatcactcctctctaccaccagtgctctcccctcctgcactgtcccaggcttcctcattcttcccttgcaggtccttatccaacatggctcacaattcctgggaagccacaaggaaaccaaattctagtagcaactcagagtcagcattcattagcaggtcacagggccataaggatgccaagaaggaatttgtccctctccttgtcctgacaaaaggcataagtagaagaaaattgttaggtttggttatgacctttgacattctctctttgacatcctccctttctgcacccctcttccacctgtcagggcacctagggctccccgggtccccacaagtgtctgccctaaggcccaccaggctttcttgcagcctgtcccacatctgggtgtcactgccttcctctgaatcaccctcctctcaaaccagccgccagcgagcccagcccagcccagctagtgccctaccacacccgcccccaggataattaacacccagccacccagcatcggacctctacacttgagcaaaatgtatattttaaaggcaaattctcacgcctgtaatcccagcactttgggaggccaaggcgggcggatcacgaggtcaggagattgagaccatcctggctaacacggtgaaaccccgtctctactaaaaatacaaaaaattagccaggtgtggtggcacacacctgtaatcccagctactagggaggctgaggcaggagaatcacttgaactcaggaggcggaggttgcactgagccgagatcgtgccactgcactccaacctgggcgacaaagcaagactctgtcaaaaaacaaacaaacaaaataaaggctaagtaactgtaatcaagtaactatttattatttatttattttagtgtatccacaggttgtgcagccatcaacactatctaattctataacattttcgttaccccagagaaacttgtaccccttagcaatgactccccatttcttccccccaaccaaccccagccccagccccagcccctgggaatccctaatatactttgttttgttttttgttggtggtgtttgagacaggatctcactctgtcacccaggctggagcgcagtatcatgatctcagctcactgtaacctccacctcccgggctcaagcgatcctcccacctcagcctccccagtagcttgggcctacaggtgtgcaccaccacacccagctaatttttgtattttttgtagagacggggtttcaccatgttggccaggctggtctcaaactcctgagctcaagcaatccacccacctcaacctcccaaagtgctgggattacaggcgtaagccactgcacctggctattttctttctttcttttcttttttttttttttttgagacggagtttcactctgttgcccaggctggagtgcagtggcgtgatctcggctcactgcaacttccacctcccgggttcaagcaattccctgcctcacccggctattttatatttgttgatctgctgctggttatgcctgtgagccaaatttgtacaaattcttaagctttacaatcatgcgtgcctctctgtacgtatattatactttaattaaaagttattaaagtattggggccgagcacagtggctcacgcctgtaatcccaacactttgggaggctgaggctggtgcatcacctgaggtcaggagtttaataccagcctggccaatacagtaaaaccccgtctctactaaaaatacaaaaaattagccgggtgtggtggcacacacctgtaatcccagctacttgggaggctgaggcaggagaattgcttgaacccgggaggcagaggttgcaacgagccaaggtcacgccattgcactccagcctcggcaacaagagcgagactccatctcaaaaaaataaataaaaaataaaaaatgtatcagggagtacaagagaaagtcatataagctctttctacttttcatggtttctatgtctgaacccatgaatcttccttctgaaaggtccaactttcttctttaataacaataataatggcaaaggcattgggggaccgtgagcaaagggcaggcctttgcaggggtgggaatggaaagggaagcacgtccctagaggtgggcctgggatgggggttgggggatgaagcaagtggaccttgaaggtctccacaggtctgagtgtcctatgctccctgggcctctcttcccccaggtcttctcgttcgcaactgcaccatcactgccaatgctgagtgtgcctgtcgcaatggctggcagtgcagggacaaggagtgcaccgagtgtgatcctcttccaaacccttcgctgaccgctcggtcgtctcaggccctgagcccacaccctcagcccacccacttaccttatgtcagtggtaagttccaggcaactctctgtgccatcacgtggggtagcggtgataccccaaccagtactccccactcctacccctagataaggtcagcctgtttctgccttcccatcccatccagcacctctcaggccttcagatgtgccctatggggtcccctgctgctactcattctgtctctgtttttccagagatgctggaggccaggacagctgggcacatgcagactctggctgacttcaggcagctgcctgcccggactctctctacccactggccacgtgagttttctccttaatccccaccgctagagagaatgcatacacgaggggccaggagggaagccagacagaaagctcctaggattagggataagaggaggggaaaaagcagagtccactgtttaggagaggagttggccaacggtggcgggtgggatagaataaggtgggggaaaggggagaggcaaggtgacaggagggctgggctgagggagccaagggctagaccctcccctaacccctgtgtgtcccctcctattacagcccaaagatccctgtgcagctccgattttattcgcatccttgtgatcttctctggaatgttccttgttttcaccctggccggggccctgttcctccatcaacgaaggaaatatagatcaagtaagagacagaacacaggcctccggtcctgcccctgcaccacaccccactggctcaaccccactgcccacgcctggaatctcactgaaacccaccagctccacttcaccagccttggtcctaccccttctctccccttagctggcgtgctcctgacacccctcccccaagcgcacccgcctctacccatctccttctcccgtctccccctgcccccactgctggccaagactcatcggatctccttctgcagacaaaggagaaagtcctgtggagcctgcagagccttgtcattacagctgccccagggaggaggagggcagcaccatccccatccaggaggattaccgaaaaccggagcctgcctgctccccctgagccagcacctgcgggagctgcactacagccctggcctccacccccaccccgccgaccatccaagggagagtgagacctggcagccacaactgcagtcccatcctcttgtcagggccctttcctgt

SEQ ID NO: 1593 - DNA, 24801 bp, Homo sapiens
tgtgtttcagtatcactttaattgcagtatttaaacacatcactttgtattcagaaaaaatatctacccaatactctcttctctggaaatttctatttccaaccgtcattgaaaccaggatccctgctcaacccctctggaaagaaatcaacagcaaacaaggacctgggtcacccacagaagaggcagctggtgataagggttaggagctgatctgggctatgaccatatgggggtgcagagcaaggaaggggctcagggtgagggaggcagagacagaaaagcatctgttgggggactgaggcaacagctcaacccaggagtcggcaggagggaggaggaagccatggagatcagaggataaggctaggatccagcctcagaggaagaggatttttcggaagagtacaggtgagaggctcagctccaagacctggtcccatggtcctgcctactttgatccagagggagaaaaaggagcccaaaaagagtttctgtgtggccccagagagactagaactgagctgtttgtcctaaaacttgggaggcctgttctaggctccagccagaaaactgtgcaggactctgcaaatggtagagggggcacatggagctcagtggaacttagagaacaagggaggagctggtgaccaagtccacagtgtcttggaggagagatgagggaagtggttcaaggcaacacgtttttctggctatatcattacaagagagcaggtgcaaaaggttactttggtttcctcaaagtagagaaagaaaatacagggaagaaacggtaaaaatcaaagcttcctgggagaaaattgtagcctagaaaagctcatctttcccctgggggttcctgtattgcggcagagaggagggggtaggggaagggggtcctgtgtgagtgctgcaaggccatcgattgttcctgggagcttctccagaccttggctttcccccgtcacacgtttacccaaagaagaccagagtctggctccagggagccgaatgtgtaaaggacaggagtttacctgcccctcctcaaggtgtagggccccaagaacagcctctgaggtgtgtgcagtggggaagggttgggcgtaagagatgtcacctccagcatgggggtagcacgtggtcagatgcagagaggggtgctctctcggacactgcccagccttgccccacctagccgagtcacaattcggtatcagccaccacgtgttgtcttgctgaatggccgtttctggaggtggcctggccggtcccgttttcctgagcccctcggttcacactggcctttccctgagcctcaggggaggtcccaggtcctgagctatagccctggcctccaccgttttccgtgtaataagggtcttcgccctagacagtgtataaataaagtagcattatctggtaagcagggctgtgagacactggatgggagaggggcccaaacaggaagtgggggcaggggtgggagaagggggagggggaggtgggaggaaggatcggagggagggtgcagctgcatgtgcagactcctttcttcctgaagagtggtcagggttccagctcctagaggagaaaggacataggagaggcaccacaccatgccaccgcagctcggcagccagctcccgcaggaaaacgggcagttccaagaagggtgggatgacctccccagggtaggggacaggccagaggccaagattcagacctcagccttgtcctccctcatccagaatggcaaatggggattctccttccgtatacctccttttgagcaagggggcacccactgggcatttaacacggttgcaaatacagtgtggctgattaaacagcctgttctggtggccccaagctgaactatcccagaaaacataatgaatagatgacacgaatcatctgctaccacaccgagtaggtgggctggcaccattactgtcccctccccagtttgctacataatattttgaatcttccaccgattactgtgtgtgcacacatgcatatctttatgtaagctcacagaagggctttttctagtatttctcctcctgctccatgacatccactgaactccccagaaacccactatcttcctcatttcctttaccctggcccccagaactgaccagcctttctcctgtggggctccagctgcggcgattcatcaggaaatagccagtgatgcccaagacagccagcagggctcccgaggtgaccagtgcaatcagggtcttttgggaatagctctggtggcttgcaacatcttgctcagtgaaatctaggatccccagcttgaaaagaagacaaagaagatacagcctgtcacttgccaaaagtggagcccagcccgctccagccctctgtgtgtgactcaacagtgaacagatgcttgagggcattgacctcaggaatttttgaaatgggatttgagactgacgtctcttaattcagtcataccccaccatttttggttcaagactagaaaggagaagactcagagaaggatggtaggtagaactggggaagataatgacttccccccttactccagggagcccccctgccccggcattccctctcaggcccatcatctcagaggacttacctttttcaggtcagattggtgctttttcataagttggagtttgctggaaatttctagaattagaaacaagggttgctaaatctaaagagaaaccagcttatcctgctccaccctcccatgctgttctagaagatgctctgatggccagggtggtccatctcggggggaccgctcccaaagccagccaagtccttctccccagcacctgtggtctctctggatctaagatgccccatctccacccaggattctctaacctcagccctactccttccctgttcccccaggcagaggtgcaccttacctgttctgttggccaagaccagcagtagacactgaggcctcacctcagactgggcaaggagcagggagcatacctgggccccagcatcagcatcagcctgctcctccccacacagcactcgggccaggccctctcccctgtccttcttaaactccgcctgggaagacagagaaacatggagagcaagagatgaaattactgctctgccctaaactgcacccagagtctctgattacagtcatactcttaccccgtccgcaagaaggatccttgtttctaaaattccaacagaaaaaaaaaaaactgctaactgtatatgtgcaacaacacaataagaaaaaaacctaaataatctcccaggaccaaaatccatatcttctagtatctaagatgttagagaacaaacttaaaaaaattgtctcgttgaagcattgcccatgtacacatatgcaaattaaactcaaaagaaatggccaaaaacagaaaatattaataatgcaataataactaagagaaaatattctgtttcaagattacagcagtccccaatgatggaagaaaagccaagggaggtgaggaggagagaacaaatctataatatacactcagtggaaacctcagtggcctcctccctctttctacccaaaggagtctcaaaaagtgcattgctcaaactgaaatggcatttttgtctcgtcttccatctctgttttccattaaaagcatggaacccagttttaatgaagttcatagatttttcttcaggttgctgactgggccatcagacccaggaatttggactcagaagaaaaactctgataattcttcaatagtgagtcagaatttattccagcagcctccaatcagagtgtcctcctcccctgaacaggaaaggaattgaaactaagactttctcttcagtccggatggcagatggcagagaaggaaatgcctgaacagccctgacaactttcctgttaggggaaaactgctggggtgtgtgaccatcatcagaactgggtctctgtggaggagaaagcttcctgtttgcgggcagggccgctgcttgcaacaaggccacagggtcctcccagttggaatggagcctgggtattttcccactgctgtgacccaaggcaggaaaacccaggctcctttgctcctacacaaagcaaggtcaagattggcctcaggacccagctggaatttgaagcagctgagggaaaacaactgggcttggataaggccaggagagtgtggttagccaaactccaggtcacagagacacgagcccaaactggagcctcaaaaaacccccaggaaacaaggctacagagaaatgagttctcaggccactgctgcttcattcctcaggaaaaggagcaattctgcaggtctcccagtaagtccttggatagacgttctaactctggaaaaatccgtttttctgaacagcatttgaactaagtagtctgaatgccacactgaaccaatcaacagtctccacctctctaaacccagttgtctcaggggagccttacatggcttccccttgagcacccccgctccccagcaccgagagtctggatgaggaggagggggtttcttgcctggatgactctgggcttctgaagtatctccagttgaaataggtctgcttcccaagagaggcagagggacagggctcctgcaggttgtaaactagccaaaccaaatggcaccttcctccacctgctgagtgcaagaagccacaccttgacaatgtatcaagccctgaatataggacactgcgtgaaagcctctgtgcaagtgtcatgtgtatgtgtgttgtattcatgtgtcatgtgtaggggggtggggattgggaggtatctatgaattccaccttgtcaaagctttcagtttgcatgtacggcaattaaaatgatggatgccaaccaggcgcggtgactcatgcctgtcatcctagcactttgggaggctgaggtgggaggattacttcagcccaggaattcgagaccagcctgggcaacacagggaaaccctatctctataaaaaatttagaaattcaaccgggtgtggtggcatgcacttatagtaccagctacttggggggctgaggtgggagggtctctccaccctgagaggttgagtccactgtactccaccctgggtgacagagaccctggctcaaaaataaagaaataaaaaataaagtaacagatgcctatgatatccaggcacagttctgagtgctttccatatattaactcatttaggcctcacacgacctacgagattggtagagttattctactaattttgtagatgaagaaatggaggcgtgaagagactccagaggccagagctactgccatggtaagcaccataagaaaggtacaaccaaagtgctatggacatactaaggagcgtgaggacacgtctggttaaggttagcagacacatgtcactataggccttgaagaatggctggagggtgagcagaggaagccagtggggaagagcatttggaactgaggccccacctccaggaagcccaagatggggacagcatgcattattccacaaccctcatttcaaagagaatgaagaacactaccttctccctggtattcactatccttcaagactcaactcagtttctacctcctcaatgaagctggtcctaccttcaaccagactgggcatcaatccttactctgctctttactggattctttgcaagtcatgcaactagtctgagtgtcatgttcctcagctgtacactaggttgttgtggtgactaaatagatattgtatgaaagtgtccagttgggtgcagtggctcatgcctgtaatcccagcactttgggaggccgagatggacaaatcagatgaggccaagggttcgagaccagcctggccaaaatggtgaaactttgtctcttctaaaaaatgcaaaaattagctgggcatggtggtgggcatctgtaatcccagctactcggcaggctgaggcacgagaatcgcttgaacccaggagacagaggttgcagtgaactgagatcacaacactacactctgcactccggcctgggcaacagagcaagactctgtctcaaaaaaaaaaaagtgtccaatgtggtgttgagaatctagtgggcactagataaatagcagctgctactatcattattaataatagtaataccttatataccatatcatctagagtctacatattgatcatattctatgcattgttattgtcatttttctgtgactagattgtaagactcctaagtgtgtgttggggggagtgcacattatagcatttacaacccagactgcatgaaccgtggcaccaaacaaaagaactcagggaattgttgttcaacttaacatcccaaccagttggcctccacacagggtccctccaccccttgcacagtttcttggactagattcaagggaataatagcggccagcctcccactctggaatccaaccgcatcagtgaattgtgtttgggccccaagaggagcaggtggatcctgaacaaagcacaatgcttctccggacacttggaataaacatcctcccccaagagaggctgtgggcaaacatcacgggagagtgggcaggaggaagacacagcctcaccattttgttcatgagaatcagatttacaagctcctaactacatcagctcacacatgtttctctgcaaacacaataaacccatctaacctctctagagtagcattctcaaactttgcaaagactcttaacatcaagcattgcaatggggacggagatgggggtgagggagggacaggtatttttctaatgacctttaagatatttaagatattaagatcctagaacgctgagattctaggatcaatcatctcccccaaccccttttaatataattttatctattttggtgtgagtttgacaatgcaggtgaaaacgctattttcacatagaaaatggaataatgaagggacctgtttcaagtcacctaacaagtgggggcagctaacgaaggatgagaagtgagatcgtttccagattgcaggctttttccagtagacacaccatcttcataaatccttcatctgtaacttatgttttccgcatggaaactgacctttagtgcaagctggaggcagcctgcctcagatgaagtcaatgtgaataagagtaaagtgagctagctgagtaattacaaactctgcatataaacagatgtggtactaaagataggtatacaaattggcggacaaaggacttgactagacttttccccaaagaagatatacaaatggccaacaaacacatgaaagaggctcaacatcactaatcatcagggaaatgcaaatcaaaaccaccatgaaataccaccgcatacccattaggatggctgctattttaaaaacccagaaaataacacgtgttgatgaggatgagaagaaattggaacccttgtaccctactggtgggaatgtaaaacggtctggtggttcctcaaaaattcaaaaatagaattcccatgtggtccagccatttcacttttggatatatccccaaaaggactcaaatcaggttgccaaggagatatttgtacacttatgttaaaagcagtattattcacattagcctaaaggggaaaaagcccaagtgtccatcaacagatgaatggagaagcaaaacaaggtttacacttacaatggaatatcattcatccttaaaaaggaaggaaattctgacacgtgctacaacatggttggactttaaagacattatactgagtgaaatcaaccagtcacataacaagacaaacactatgactctactcatatgaggtacctagagtaggcaaagtcataggaacataggaacagaaagttgccagggtctggggagagcagggagttgtttcatgggtacacagtttcagtgatggaagatgcagacagttctagagattggttgtacaataatgtgaacgtacttactactactcaatggtacccttaaaagtggttaaggtgatgacttatgttatgtatattttaccacaattaaaaatattttggtgggtttctctggacaaatgggtgtagcataatagtataaagtaatcttacattttggaaactatttggggaaccacaaccacaaaaactaaattaagctgacactgctgccaaaagaatgacagttagactcaggaagacacatcctactaatgagggtgctgagatatggtaaaaggtgtttgagatgagagtggtatcaccttcccttcccctggctgcctagagatgatggctggggagcaaaaaaaaaagagtgattgggatagacatgtctacagaatgcacatacagaagacacgcctacagaatccacatagggtgagctaacatattggtactcactatgtgtcagtgcagaatgagtgtctggatagctagactcatgcacatatattcctgttatgggcatatattagatgaggagcataccaacatacatcaaggatgtgatgctcggggaaaccaaatccttcctgctcttcaccagggtattaggtagggcctgaggctcccaacattagaaccaataccttaaggccctctgacaccgaaagtacaaatccaacctaaggaaaattaggaggctctgcagcattcgcagcttttggaacagattgtttatcagacaagcagggagtagggaccaaggaaaggtcatcttggacataatcgggagctgtggctaaacattttggaacaggatagcaagctgaggataaattaccttggggagtagcaggaggctttgccgcatgggggctgaggatgaggagccctcaggaagaaaggggatcaacactggtggagagaccaggggaacaaaagcactcatatgagctgccacagagttgctttatgaaggggcagtgtggatggaagtcttctttggcataggaactggaggggagctgctctcttttcacatccccactcacagatactacctcaatcttagaggaacatgcagagaccttctcagctgtggcacgaagtaggccagacagcaaagaccacagcagagttaggaggaattatttctaaaagagcagtaagtttctggcacttttctcatacagtgacccaagttacatgtgagctttgaagagcaacagaaaggcaaaggctctgcagttaactctaaattccaggcacaaagaattagcattctggcacatacctgtgtgatacacagcaaaatgtatgctccaccaagtcgatggggttgcagggggaaagatcgtcattttccttggctacaactagcaaagaacttgacaattttttttctaatgagttgagttgaaaatcagcatcagaaacatgctgcatgttacttgtacattgtatgttcatgtttaagttaactattttgcagactgcatttagttattctactatgcaaactcatgtcttcactatttctgttgtttttagatgtcctaagttaaattctttcaggtataatttttacaaatttgtaagtcagagagacccaactgatgatcgtagtaaaactaccgagttagaatggaaaaaataagtaatttaagccctctacaggctgcgatctttccagtctatgcatgccagcacatcacatatgtgattcccttagatggatccccaacttgtaagaaaatgttttcttctgtaagtaaataccactctttccttcacctcatccttcctccagagccatgttactgttaggaaattagatttactgaaacaaagcaaggtctgccagaatcatttaaaataacacaattccctgtacattctttccaatgcagtaagacatgaaactgaaacaagaggcataactactaaacaggaggagaaaagcaatatattgtagtagataacaagatagcttaccttaaaattgaaaggaatcaactaaaaagctcctagaatcaataggcaaattcaagaaactggccaaacccaaaataattgttcaaaactctattaactttttaatctatcagtgacaatcaatttgaatatatagtgggagatctatgtgacaaataggcctatgacatccatcaaatctagagaaaaaagctaaagaaacaagatgctgagagatgcaaaagaaaaccagaaaaaatgaagaaattttagagcaattacaattcaaattttaaagcattttttttgcatttttttcaaaaagaaaaaaataatttacattttttacagtgtaataaaaaaagatctgcctgactggatattacaaatactgtagtaaaaacatacaataattttgaaaatttaaaataggcaaaagtacagacaaactgaacaaataaaatatgtctgaagagtatgccctaagacatataaaaacttaatataagctaaaggatacatcccatgcaacagaagagggagtcattcaacaaataatgttaggaaaaacggttacatggaaaatataacattacagcaaaataaattctatatggattaaagagttacgtgtaaatatttaataataataaatgaaataataaatgaactgacattttaggtgactagtttatatctggtgagtgagaaggactttcttaaccaaaaagcaacttaaatctgactctctcagatttaaaagtactacagaggaggggaaaatttaaaaagtactatagaggagggggaaaaagtactatagaggatggaaaaataacaaaatttattaataattaaaattgttattgtcttttttgcccaccagatggggcctcttactccctaaacagaaagctcagtattaaaggcaggctgaccaagctaaactccccggacccctactcaaatccagtgcaatccaagaaggtttaagggtgttcagaagggatggaggaaagggacaggggcgggaggaagaggttgggtggggggttgacttacacagctggaggtcttattttgctccaggcagatgccctgagtcaatttcacttctctgatgcctgaacatttgatttctgcctgtattaaaacaaaaacaataacaaaaacaaagtaaataagccagtatctttgctcctcatttctttcccaactttttccagtttgctttctgtgaggtgctctcttaggaggttttaaggaaaaggacatttaaaatttgtcaggggactagagatttctaatagtcatactctcgtctatttcatatctatcctcatcagatgacaaaacttttgttactagcctgggcttactggcaagcagctatttgcaaccttggtaaacactggcttggatggtgcaggactgggagaggggaggatcttttcccatttgggttgttttctctccagtcaatcacaaacttgcaggaaggccatataggcaaacagggataatggggtggaccagcagatgctggggtacctgttttttctcctggcctccaggactctccaaattcccattttggctcttttatttatttatttatttatttatttatttatttattttgagatcgagtcttgcccaggttagagttcagtggcatgatcttggctcactgcaacctccacctccctggttcaagtgattctcttgcctcagcctcctgggtagctgggactacaggtgcatgaccacacccagctaatttttgtatgttttggtagagacggggtttcaccatgttgcccgggctggtcttgaactcctgacctcaagtgatctgcccacttcaggctcccaaagtgttgggattacaggcatgagccaccacgcctggccctggctcctttaaaaacagaaagcagaaagatccctcgggcatatctcatgactgaggccctcatattttctgtcctgcatgctgaaagctgttgacagtcataggccctaaggctgagaaggccaggctgagctcaccatccctggtctgcccagttcctgccattgccaatgcccccctttactgcctctctgtgcctggcacaaccaccaaaccctctcatgtagaggaaatgttatttgtcctaaccattgtgggagaagcagccccagcaaataagcaatagttgccaaatattcccaaagggaaatggtgtcctggtcaaagccccactgataggtactagaaagaaccagaggattggatggatctctgagaatcccgtttactctctattccctaaaatgcaatacccaaagcctggatgggccttaccacctaactctacccctttcctcctctttctacttctcccagcaatatttaaactgtgtatttccgtgctgattcccacatgacccaaatcccactggcagggatgaggagaggggtggagggaaagaaacagcttgcctgcatacatatgaagtgaggggcaatctgccatttttggcccaattcacccaccttgatgtcacttaggataggagaagatgatgtatagggtttagtgggagatgttgcaaggctagtgctagtggttgaaaggtctgaaacatttccaggtgacaggctaggcttcaaggttgtctctggagttgaaacgttggctggggtggtgaacactgtgctgattacagaggtctgtgactggacagaagagtttgtgtttccataaactgaggttatcacagaggtagatgtgaatttgactgtcgtttctggaagagaccaaaacatgggtgtgcatgtgtgcatgtgctcatagatacacaaaatctcaggtcatgatatgggcatgcacttcaacacagaaaagggagtttggggagttaacagttacttcgtgtcccatccctgaccaaactcatttcaagctgttggaacaagagctagaatctagaatgtattagaggtgtcctgaaactgaaatagatgctggtctaccttagagaagccaaagacccccagtttggacctgtacccaccttctttcctttagaagagatcggagatctctattgagtcttctgatccttattttatcactaagctagactcagcatgagagaaggggtatggaggcattactgatcaggatcagctcccaagacatgggcctgagaaaactgtcactgaaggaagaattatctagaacttacttcagggcaccctaagcatgatactcaagtcattaatactagggacttgtataatttcctctgtggagaggggagcggtctgaaaacatcctaaatgctttacccaagcatcaccagcatctctccgggatctgacacaaatgctgtttttacctgtgatgtttgttgtggcctcattgccatgttgagacacagggtgcaggctggtacttccaagggtactaggtgttgtagtttcttggtaggatacatttgtagaaacatttgaaaatgttccctgggtaggtaactctggggtagcagtaccgttgttgtcaagactcatgaacccagaagctatagggaaacgaggaggaagaatcagaacctaaagatatcagcctggtgatatcacctgatgcaatttcctgacttcaggtagaattcgtctagaacattccctgctgccccttgttggcagcaacaagaacatactcctggacagtggattaatttcccactaccaaatttgccctgaggacatagggaaggaaagatttatatgcatacaaatgtctcatacagtattatttataggagggaaacgtgaacaactaaatgaattatgataggataagtgatatatgcacttaatataccataatcattatataatcatataaacaaacattagaaagaaaaaaattataaaaactgtagcaacgtggaactatgaggtgatgttcatagtatgtttagttacatactaaaatataaaattacacctgcataaatattgcaaagatctaatgtgtgcaaaaggtcatgcttcttttttcttttcactgtatcctcttttttggtcactctccatccagtatactaactcttggaataatcactagactcactgtctctatgcgatccccttaaaaatctatacttctcagacttcccattcccatactcccctcatccttttgctcatggccttcaaacccattcgcctttccttttcttcttttagcatgctctgacctaggaattcagctaatgaaccagggaacacaaggtctggtttctcatcaatgtagtgggaaggtagacaagctttgttctggctcttccaataactaaccatgtaatttaatgcatgtatgtatctcagctctcttacctcttaagtaagggtcttttctggctaccttacatggattgctgggataaacaatgagataacaaatgctaagttattatagtattatagtataatgttttggatctcatttttctctgaagatcttcatgagtgtctttgcacatctcttctgtatatcctgggatacatacttttttttttttttttttaagacagggtcttgctctgtcatcacagcacccaggctagaatgcagtggtgagatcatagctcactgtaaccttaagctcctggcctcaagtgatcctcctgtcttggcctcccaaagctctgggattacagatgttactcaccattcccagtcagtatcctcattagacacaggaaggagaagcttcttgactgaaccctatgcctcaaagagcccacaccctgtcctgcttcctgtgaggaccaatcaggatgtaccctctcttctaggtcatactgtggggaccagaagtcctagcacttcttgatcaaatggcactttgctcacatccacgatgggccgcttctcccagtccatcctgctaaggggaactgcagcacaagggtgtacacccccaaggcccagtggtggccaaatgatgactgcttgcagggagaagagttagtgcttagtgcttaagcctgtgggtggggtgtcccaggcacacatgcaattgccttgcaatgtgagccagagtcatgggtagaaagtagatgaagggaagtgggctggggccaggagccatctcttcctgctaagctgcactgtggcagtgaattccaagaatctgagcatcccaaattgaaacttggccttccaggtgatcacgaagatatgtttgtcaaggtaagaggatagaagatattttattagttagttggcctgacttacaaccttgaaatgtttagaaatatagtatgtaggcctctgttgtactcttgccttgggccttgtaaatgttaagggtgaacttggtatccagagttcataaaggcagttgcatcttcaaggaagagcctctgagggtcccaggccaccctaaagcttgtctctaaattttcctgattgggatctagatctgtacttttcagcgatttccaggtaaacagcaaggtagaatgacatctcttgtttccctcaggatcaagagggaagttagacttttggcttcacggccatcaacctggggccaagaacggtttccctaaaggtgatgacaagggtttcactctctcatatctgcttccttccacaacctgctgcaagcagattgctattaatggtgactgcagcaatcgtgtcttactgttatgtgtcaggtaagcagtggggagaaggaatatcactatctctgtcttagagatgaagagcctgaatcaccaaggtgctgcccaaaaggaaggccatagttcatgaagggaagcagcaatggaacactgacgtttagctgactcttgagtagatgcaacaaggaggttaggctgggtctaaactgccaaaaaatcggaatttattccccacatctctgtagagaaaaggatgggctcccatctggcttaaacaggaggtgggttgatcaaaataaattgatgcagaagccaatccaggcttctttcctgtttagatgggaccctctcaccactctgactttaaggtcagattcatctgaattcatccaagggggcagtattcagacactgaattaaaggatcaccttctcaagacaccattccaagactcctcttcttgcctgctctcttcctcttcgcccccagcatactgattactggggaccccatctggtccaccctggcccagcccttttctctctccagaggaagctgggcctgactgagatgatgtcatgcttttgaatcccctcccccgaagggcctccttcacctagacaaacacttttgaacttttccagatgtggagtgagacctgctgctagttctgaggacagaggtgcctgttccagaagagcaaagcaactctggacccaagccagctactgacccactggggccaggctcgcagctgcagcagcccctccacccaccaccaggccgagcgctgtggaatgagtagcaggatccacctgcaaatgagaaagggaccccaacttcagagtcagggctctgaccccagggtgagcagagcaccctctgagacaccagggggacaggacaagtgggagggcagaaagaccaaactgagtgactggaaatgcctgagctggtgcagagcaaggggacaccttagccaggggcctggagccaatcctggcataaacactgcggcacagcagggagagtgcatcttttaggttcacagtctctagagccctggaggaatgacatttatgagagtcaagactgaccacagatctctttttatcctgtcttcccacacacatccatggcattaaaccatcaaacactgacctttctttatctgaccttctgactcccaactctgtaggggagtagcaggagcctaccagtcagtgagagcttgtcacatcctaagagacaattgatgaaacctccactctttttcattctagatgggaggaacggtccctacccacaaggctacaagaattatagtacaatttaaagttgaataaaaagctctcttctgttgtttacttctcagtccatccttattaactgtgtttccctagggactccatttgacccttagttactctagttgatctcaacttatgaactgggagcaagggaggagacaaggtctcaagaaattagtaaaatgaggattctaagagatgtcacaaaattcatgtagtaaaagtcatgcactgaactttcaggtacttcttcagagtcaattattcttgttttacacataattctaataaccctggttatctgatatcctagctaaagttgaaacgtaggaagagcctattagaagcaaataataaggagaagcaacagctgaaaactaagaaacagaaataaatgaaaagcagacataagtatgaaaactcacaccagttttcttgaatcatttatggtaggagtgaataggttagatatctataccttaataagcattaatgatgtcactgagttgcaacatagccacgacatgttcatgatacatctgagtcataaagtccttttcgggggggtattctaagaaagcaaagacatgtgcaatacattttgaaaatatttctacctgccactagtaaattgaagactcttttgttctttaaagtgagtttgcaaatcctcagcgatccagaaagctctgctaccaaaataactaaatccccatattttaagagactgagttttcctatacttggtcttgcttttcacagccctccttagttttttcctggtgctgtttcctgatctcctagcctgccagtcttattttgcccatgctttcatattctagcacctggatcaagaggagtatctcgaaggagttcctgggaatcttagtccatagagttacagaactaggatgaagggacatgccagcctctgccaggaagtaggccgttgggagccacagactgtatcaccaggaaggcggtatagcccagagacaaagagctcaggctctgcagccagacaggccacattcaaaggcttctttaccatgttttagctgtggtttgggaagttacttcaactctgtaaacctcacctgtaaaacagagataaaagtagtccctatgtcttagctgttttgaggaacaaaggagctaagaagtagaagcagttatcctgtctggtaaaagttcaagaaatagtggatatcttttgttttaggccccttccttctgcttctcagtgggcatgagatacttatttctgtgactcatctgccacaaaatcatatatgctgcttcctcaggataggtctaactgtcacctcagtaagaatataaacttctaaagtgctggagccattcttattcttatgtgttttactcctggtgcttagcacaatccttggagtttaggaaaagcaataggattggaggacaactgtggcaggtgtgttcctgccagctacctctagtcatggcagtcttgttctcatgttatattttaagggggaattaattaaattggggagtgttcatgtgaagataaccaggattaggagagttctagaaaccaagtcatattgttgagggtctagtgttatttcatctagatggggggttggcaaactatggccagtgaacctaacctgactcaggggttgtgtttgtatggtcagtcagtaaagaatggcttttacattcctttctttctttttttcttgagacagtctcactctgttgcccaggctggagtgcagtggcacgatcttggctggctgcaaccactgcctcccaggttcaagacattctcctgcctcagcctcccaagtagctgagactacaggcatgtgccaccatgcccggctaatttttgtatttttagtagagacggggtttagccatattggccaagctggtctcaaactcctgacctcaggtgatctgcctgcctcggcctcccgaagtgctgggattgcaggcatgagccaccgtgcgtggccggcttttacatttctaaaagtgtcgtaagataagacaaagtagaccatccatcagaaaccatatatggcccctaaagcctacaatatttactctctggccctttatagaaaaagtttgctgacccctgatatggaaaagaagaatttggggaggaaaaataaataactttctttaagatgcatgttatttacactggttgagcacccctaatctgaaaatcagaaattctaaaatactccaaaatacgaaactttttgagtgccaacatgatgccgcaagtggaagattccacacctgacctcatgtgacaggtcacagtcaaaacacagtcaacactttgtttcatccacaagtttattaaaaatattgtctaaaattatcttcaggctatgtatataaggtatacaggaaacacaaattcatgcttagacttgggtcctattgctgagacatctcattatgtttacacagatattccaaaatctgaaaaaatctgaaatttgaaacacttctggtcctaagcattttggataagggatacattcattctgtgtattcattctcatttttctgcagtgccagtgatgtgcaaaggatctcgctcagtgctgtggagagtacaaaatgagagctggatctctttcctccattaggtgttagtgtcattgtcatttaaatcaatccctcaaggagtttgtaatctagtggggcccactagaaacatcttcaggtattgtcatgaaggaccagattaaatctgtaccagcccaaagaatagaattagaactaatgattagaagttatgggaaggccaatttcactgcaatccaaggaaaaagtgtaaaatgatgtagctatttataagaatgaaatgagccactttgggagacaagtgatccatccatgcttcctgcaaacactcaggaggcatccgtgttagggggctgtccaactctgaggcctaccatgaatttcagtcatcctagactagaacaagggactgagcagatgccttcttaagcttcaaaggctaagctaaggtgtgagtatatataaaccaagggtctgtggcctgagggttcccagtgtaccgagatttctgttttatattcaaatagcatgtcttggccagacaccatggctcacgcctgtaatcccaacattttgggaggccgatgtgggtggatcatctgaagtcaggagttcgagaccagcctgaccaatatagagaaaacccgtctctactaaaaatacaaaattagctgggcatggtggcgcatgcctgtaatcccagctacttaggaggctgaggaaggagaactgcttgaacctgggaggcagaggttgcggtgatccgagatcacaccattgtactccagcctgagcaacaagagagaaacttcttctcaaataaataaataaataaataaataaataaaatagcatgtcttggaccccatccacttactgtggaaccctaattattttgaagattctctgggcacctacatttctccctgtcacctcttcctccattttaccagcaccacagactcctgggttgtggctccatggctcaatggctccctgtccgcactagtataccacttcaccgtaagttagccaaggtaaagtaagttactttaccctccccagagagccactaacacaaggctagtgtgtgtagccagtatttactgaaaggttgagggcatggaacgagattacagggcagcccaggggagacaatggcataaccctgaaatattagacattactgtgctaatgaagccatgtattaaaaaaaaatttcctcccaggtcttttccatcctccacccaccactgtcctgctatgactccaggcacctctccaccctttatatgctcttcctgggctctggagtcctatcagccttgtgtctcttgtgcccacctaaacacaaggcttcacttcattttatcatgctcagcaattcagcctcctgcctacctttgctcatccaggattgtctggggttctaggctttgtcactcaaagacctcttaagacattttcttaaatcagctgcctagggatgccactcctctctaagaagtatcagtttgatttcatttttccaaataaagaagaagcctacttcccaattaagcccaaaggccttttccgttgcatctgaagggaagtaactcattccgacggactccaagagcacaggtactaagaagtacacctttatatgcatccctatttgtttgtctctccatctttccaacatgcacgcatctttctccttagcacaacgtccagctctgggactaaaagtcatagataatatgttttcatttattagctaaggagggaagagaatgttctcattagagaagtccaagcccacaaaaatatggaattctcacagccctggcgactgtgagaattttcttctggagggtggtgttgtgttctttttccataccttcttatttttaattctccacactgcaagccatttagttagatcaaccaaagtcaatgagagagggaggcccaagtacctgagagtggagttgggtaaccatccagccctgaaagtaaacccaggccctccagctcagggtctaaaggaaatcaggcaatgagaccaacggtaagaagtggaatttgttcctcattttcatttgttttcgtaggactctgcagctgagtttatctgctgcagtttggcacttcttgccctaagctttttgagacaaagattgcgaaggaaggagatgaggacaagggaatgaggaggcccaggaggtggagccaaagggataagaaaaagaggccccaggcccctgtgtgttttatcagccgaacagaaatgctgctgaagacatgcatctgcaaaggtggtgccaactgggttgggtctacaagtgcggagcactggggaccactgaattagtcagaggtccccaagcctgctcctcctctgtcgccatatggcagagattcaaagggtggagtcctctcccctctggaaaatagctgataaaattcttttcccttttatttttcccctcttacatgtagccctggacaggatatgggtgtggggtcagcaggcacgaaggacccaaaggaagaagaggaatgtgacggggagggcctgggggtgttgttagagtgaggatagggacaggccttggaaagcttggaggaaatagataccctgagcctgacaaaggggttccctaattacctgaaaggcttcctgctccagccagcactctggcagtgctgcctggtggcccttgagccccttaccctgactctgctctgtgatctcccccacttccaacaaagacagcccacttctggttagttgcagtgcctatgcacatgccaccttctcaaagggacagaaaaaaagaacttcccaaaacaagctctttgttggggtaaatgatgagaaaacaaaccacagaaatcccctctaccctaaattttacaataataatagcatttctgcaatggccctatggtagcatttcaaggtacactcagttatctcatttatcccacaatgtatcccaggactgaaaatgactcctagtattaacaaaacaaaacaaatccaagcaaaaaccctagaaagctcttgggaagggcataaaactacaattggctcaagtagtctggcaaggctgggaatggggccttgtgcctcatccctccccaccaaaagctgggatattctcagcatatcagtccaaagttttgccaaggttgtgttgctcccccaaccccaacctcggcaggccaaggcgagactggcacttaccagctgaggaaataagaaaagggtggacctcattcggctgaggaccaggtcatcacaagctgtgtagccaaaggagaatggagcatctgattggaatctgcaccactggccaactcacccctgtttttttgttttttgttttttgtttgtttgtttgttttgagaaggagtctcgctctgtctcccaggctggagtgcagtgccaggatcttggctcgctgcaacctccgcctcctgggttcaagggattctcctgcctcagcctcccgagtagctgggactataggggtgtgccaccatgcccagctaatttttgtaattttagtagagatggggtttcaccatgttggccaggatggtctcgatctcttgacctcatgatctgcctgcctcggcctcccaaagtgctgggattgcaagcgtgagccactgcgcccggccgactcactcctgttatgagggcctagtctagcacccactctagaattttgaaacctcattgatagcttttccttgccccaaagcacacatccaggactgccaaacagggcaacccaaaacttctctcagagcttcctccagcccaggggcagctgtccccagctgggcggacccaaagatggacaacagaggagactgggaacaaagaggtctagtccaggtcactctgcagggccacagtgggtggcccttaggatgtagtgagagtacagaattgggagccctagagtgctgtaagcaaaagggagagcaatgtacaaagtttcaaaagtttcaaaccttccaagtgcaaagagatgaggtggagaatgtcattccccaaggaaagtaatcgagtataaatatttaccgggtgcctattttttttttaaccgaagtgagagcaagaccttaagagtaaggatatgtgtaggtgagtgggggcagtgttctaacccatccactagctttagaacttggagcaggggcagaggaagaaaactccaaaaggtgacaagttttgaaatttgtgcaggggtgacggtttttggtaaggcgagcgaggctgggcgcagagcaaattctgtctacttctacctcctccgcggtggggttgctgaagtgggaattcaaactcagcttcccaatcttaaatgcaaggtttttgtttggttggttgtttggttttgtttttccttttcacggactgttcattccgaacacccctggcctgggacctggagcctcatccctgattcgcttccctcgaattccttaatgtccacttctggctctcccagtccctgtgcaaggtgggcacaccggccccttcccagcaatccgctccgtgtctatactttctgaatcaaccaagagccacaaaacttttcctgcttctctcctccccagtctcccggttctggctgcaacttcgcactccgcgcctctggcaaccagaagagaccctggcatctccaaagcgctttatctcagtccattggaaccagtcgtgctgaccgattcacacctcggctaacgcacactcgcgggggtgatggccttcccttcccctcccacccccgtcagctcccaggtgaggcgctggccccggggggaagcagctgtgggcggcagtgcgtgggttgggcaggggtcccttccctccgtgagactctgctctgctgttcagcctcccagaaagcctccaccctccccgcggcgaagccaagcggccgcggcgcgcgggcggtactcacgcagcaaactcagcaagcaaagcgcggtccagccccgcggcatcctgggccctgcgcgcgcgcccctgcggaccagcatccttcccgcgcggctcctagagagacgcaccgagtggaagacactactcggcttggccaggacgcgctcttcccgccccctccgcccgggagaggggtgggggattcttgcttttttcctctcttctcccctccctttttagtcttggcaaggcagcgcctctccttggctgctactaacttgagctcccctggttggtcccaaaggcggagggcgttaggagggaggctgggttgccgccgtcgaggccaaaaaagg

SEQ ID NO: 1594 - DNA, 24801 bp, Homo sapiens; identical to SEQ ID NO: 1593

SEQ ID NO: 1595 - DNA, 3671 bp, Homo sapiens
ctgagtgaaagaggatatatttattggctgagcaagaagggaaggtacagttggtaatggctgcttctagaagccaccagtctcaggttcacttgttccgagcccagtttcctccaaggtggctgtactgagcatcatctcgatctcggaggggctaagagaggagaagagaaaacggtcaggaggcagggttagaactcttcaaggaagggccccagcaggccctgacgatgagagctcctgcctgacctctccagtcacacccagcaatgaactccccagtaggacccttcccacgtgcaaacagcattcagtgtgagcctctctatccccacttaccctcccttcattcctgcctccttcccctcaacgctcacctgatagacctggtcattcctcaacagagcttgtgtgtcggcagctagaagaaccagagagagacatcaatggcctagcagatgggactgtgagatccaccctcccacaccctcagaagtctgcatgagtgatatgaacacacaagttctttcaacagtcaaagttctaggagtctttaggagattgcaagagtaactcccagctgagactaaacctaccaccagccccattccttagctggtgcataagctcactggtacacacacacacacacacacacacacacacacaaacacactctcatgctctgctcttccactaacccccagacagccttccagtctcatgtccagcaaagcagaagactcccaaagcaaggagcagagtggcaatgacatcagtgacaatgatgccagccacggtggctggatccagctccacacagctctggcacactgtgggggaagggaggagagaggagaggttgagagcctttaagatcagggaaccatcctctgcctcctagggcaacccttagatctcttatgccaaaacccaaacttcaataagaccctgggagaaaggcctggtgatgggcttgccacaccttcctccaccctgcatcctaaggaatccctgggaagagccaagaagtaatctcagcttttgggaccttgaacaaggtggtgggccaaacctctcacccaaccaaggctgcagtaacatgacccctactgctctgtcttgctgagttaagctctctcttccactttgaaggtccccaaatctggcttgtaccattacaatagtgacctcactttgtttagagaacagatgggttcaccatatccctctctagccagaaagttctcacatccagaagccctatccattccaacccaaagggttcaggaagcacgtacttcgataatgaacttgcacggtagattctttgtccttgtatatatctgtcccattacacctatatattcctcgtgggtccaggatgcgttttcccaggtccagtcttgtaatgtctgagagcagtgttcccaccgttccctctacccatgtgatgctggtattgcaattcacaaacactctgtcctcaagttcctctataggtatcttgaaggggctcactaaaggggaaaaaatatcacagttggagacagctctttgatctgcaccaagccctttgttctgcggaagctcatacttaacagagaccattttcctggtccaggacagtttatggcttccatcaagagagacagaagtcacaagaaaaagccttcagaaagttccccaccaactgcaggggtcaagggggacatgaggatgccattcaagcagaggacaggtcttggggccttggtgcaaaagaggacccctcagagcaggattgacccaagcaccttcctggaaatgaatccagaccactgatgaggagtagggggagcacggaccactgaagcacctggaagatgtggaaagacagaagaacattcctcgattggaaatgtctgcattttttcttcaaggaaacatctaattccacttcccagccatctacaacactcccacttcagcttcttatcctcatccttcctcattgcccctgctccattgacaaccaagaaagcggggctctcaacactgaagcctttcccagggccagggatggctgtgggtggagaccagctggtttaccagcccctgaattatcagccaagtggtccagaacgggaccagggcaaatcccatgtacagttttccacccttggttagaaggaggagaacaggaaaaaaattttattgaatccatccctagagctcctcacaagtcaagtcttgtgggagacttttagggctggaggtgagtgcagcaacattccagatgcagtgagttcctctgacagcctgagcacatctccacaggccacagaggcactacagtctatgcctccaaacacagggaaaagtggaggctacattcattcatcctgggcttcacactaagtcccaaatttggatacaagagcatcttctagaaaaccctgaaacagctgttgctcacacttctgaagcaggttggaagtatatgcatgtatcctcagggagacacatgcacatcaaatgcttcacgtcctacagtcgcgtcctcttcagggatctgtctccagtggaaatcctgagtgccctagtgcagccaactattaggtgaccattggacccagtttgcttagtgttgaaggggttcctcggacatgggactttccattttaaaactgaaattggcaaactgagatgagttaaaatcctaccatgtaacaacccctcaaatcttccctccgtcctgctcaacctaaagttaacttctcttaaagcattcacataagtgctaggacatgcctccagggatgacataatcatggccaaacaaacaagagtcctgattccagaggccatcaggcctaaaaggagtagtgcaggaagctgtgctcccatggccagtcccagattcaggtacatacgtactgagctattttctgcagatctctggcctaaggccttctgagagacattctaggcccacatgcacccatggctggagtcagtcaaagccaagagcctgtttcccagactctatgctacatcctgcccctgccctcctgacacccctggggtgcctggtgaactgaagctagcaccgagaagcacttttttttttttttgagataaggtctcacaggttgcctaggttggagggcagtggcatgatcacagctcactgaagccttgaaatcccgggctcaagtgaccctcctgcctcagcctctcaaatagctgggactacagttgtgcaccaccatgcctggctaattcttttgttttttgtaaagatagagtctcatcatgttgctcagactggtctcaaactcctggcctcaaaggatcctcccacttcggcctcccaaagctctgggattactggtgtgagccaccgtgcctggcaagaaacactttcaagtgggcctcactcccatcagtaatgtccctctcaggtcccttcccccacccacctggagtagccttaccttgcgagagaagggtagccagtaccaggccagagagaaacgtgctatgttccatctcccagcggaactcatccagtagataaagccaggtcaccgaactatcagcctgggtgagagctgccctcccctagctgactcacaggtaccggaaagaggagagtgggggaggaactagaagatgtctgcttctct

SEQ ID NO: 1596 - DNA, 3671 bp, Homo sapiens; identical to SEQ ID NO: 1595

SEQ ID NO: 1597 - DNA, 11596 bp, Homo sapiens
tattgtcagagtcctcttgtttggccttctaggaaggctgtgggacccagctttcttcaaccagtccaggtggaggcctctgccttgaacgtttccaagtgaggtaaaacccgcaggcccagaggcctctctacttcctgtgtggggttcagaaaccctcctcccctcccagcctcaggtgcctgcttcagaaaatggtgagtctctctcttataaagccctcctttttcatcctagcattgggaacaatggccccagggtccttatctctagcagatgttttgaaaaagtcatctgttttgctttttttccagaagtagtaagtctgctggcctccgccatcttagtaaagtaacagtcccatgaaacaaagatgcagtcgggcactcactggagagttctgggcctctgcctcttatcaggtgagtaggatggagtggaaagggtggtgtgtctccagaccgctggaaggcttacagccttacctggcactgcctagtggcaccaaggagcctcatttaccagatgtaaggaactgtttgtgctatgttagggtgagggattagagctggggactaaagaaaaagataggccacgggtgcctgggagagcgttcggggagcaggcaaagaagagcagttggggtgatcatagctattgtgagcagagaggtctcgctacctctaagtacgagctcattccaacttacccagccctccagaactaacccaaaagagactggaagagcgaagctccactccttgttttgaagagaccagatacttgcgtccaaactctgcacagggcatatatagcaattcactatctttgagaccataaaacgcctcgtaatttttagtccttttcaagtgaccaacaactttcagtttatttcatttttttgaagcaagatggattatgaattgataaataaccaagagcatttctgtatctcatatgagataaataataccaaaaaaagttgccatttattgtcagatactgtgtaaagaaaaaattatttagacgtgttaactggtttaatcctacttctgcctaggaaggaaggtgttatatcctctttttaaaattctttttaattttgactatataaactgataagtcctctctacttcacagattaagaaattgatactcaaaaaagttaaataacttgttttaaaccacatagtaagtgccgaagccaatctgtgagaccaggactgtttgtactctaaatggctgcaccacatgaggcaaaatggctcgtgatggttttatttcaaagacctagaaaacactatcacagctggtgctcccgtctcagacccacagcaacgatgtctccacttcctgcttcatcttgggtttctcacgtcttgaatgtgcacacaaatcacctggggatcttgttaaaaatgcagcttctgtttcaaaagacccagactggaaatggagattccgcatgtctagtacgctctcaagtttattaatctgctgctggtcctaggaacatattgagtagcgaggggcaggatgtgactcctgtaaggagtggccaggcattttcttagagacctgtgttataaagtatgcttttccttaaaaaaaagaagaaggaggaggaggagaagggccaggtgcagtggcttacgcctgtaagcccagcattttgggggaccaaagtgggaagatcacttgagctcaggagttcaagaccagcctgggcaaagtagtgaaaccccatttctacaaaaaattaaaaattagccaggcaaggtggcacacacctatagttccagctacttgggaggctgaggtggaaggatcacttgagcccaggaggtcgaggctgcagtaagccatgatcaagccactgcactccagcctggagtgtctcaaaatagataaataaataaataaataaataaataaataaataaataaaagagacagtatcaaagacccaatcacctctagacatctggcatcataggaatgtgcccagtctgctctggggataggaaagtggggatcctgtctccccctgtgtagaggtttcagtaaaagaaaggcctaggtgtgcagaaagctttcaggcaatgccagggaaactgatcattgtaatgaatccagggtattgctgagtgagggcatcctggagggcccggtggaaatgtggtcaggctcttcaatgcacaggccctagttgatgagtaatcagggtttcaaatatttccatctctgtctcaagcagaaaacaaatggaaaaactgaaccaccagaaaagcagagccagagatggaacaagaatcccagtgtttgtacccaaccaagagcgtgtttttcttccacagacaccaatgttcaaaatggaggcttgggggcaaaattcttttgctatgtctctagtcgtccaaaaaatggtcctaactttttctgactcctgcttgtcaaaaattgtgggctcatagttaatgctagatgcttccttcctctatttccccccaaatttcctgggaacccctggtcaataccagcagtaagttccactgttctagggtgtagaaatggctgtgacccagcagcaagagggaaggacatcagatgtcatcagtggtcatactgcaacacagccctttttctgtttaggaatgcaggtacccacaacatttactaacactttttttttcttatttattttctagttggcgtttgggggcaagatggtgagatatgctttctttctttcttttttatgaaatcaccccatcattctttgtagttatgaatggagctttctcttaggcctcccacagaacttccacagaggtcaggaaaaggagtttctgccatctacccctttgactttcctcacaagtctggagatatttctagcccagaagagggaagcaacagaggcaggaaataatgagtcttaaccatacaaaagaaaaattgagacttaaatgaagttgaaagcactaacagttttcatttgtttgcatttcatatttgatgtgagattctgcagaggagacgtagccagaatgcatgcacagggttactctggataagctgctggggcaacatttggatgtgtgttcagaatcacatgtctgaatactctgaatatatgtgtgtacatgtgtatttatgcaagtgcacatgcatatgagtgtgcccggcctgaacttactctctcaaccacagcggtagagtcaggagtgttccaacattggaagcccctctattcaatcagctcttccaaactgagtgaaccaatgttgtatttaatggcaaccatggctggacaccatggctcacacctgtaatcccagcactttgggaggccgaggtgggcagatcacttgaggccaggagttcgagaccagcctggccaacatggcgaaaccccgtctctactaaaaataccaaaatcagccagacatggtggtgtacgcctgtagtcctagctactcgagaagctgaggcaggagaatcgcttgaacctgggaggcagaggttgtagtgagccgagatcacaccactgcactctagcctgggtgacacatcgagactgtctcaaaaataaaataaagacaaccattatgccagcctagattccgccatgctgcctaatttgtagtgtccttaggagccatttttgtaaatagtcatcagataagatgtaaggcccataacagctttttctatgcagctgagggaattggaagatccattgtttcctaagagttgagggaagagtcccaacccacgggagcagggtctgatcttcattgccgatagaaacattactaatggcttcttactgtttccttttcaggtaatgaagaaatgggtaagaagatttccactctatctagcaaaagttttcaaatatggaatgaaatgctcatagagtacaatcacagtaacaaaccctgagaactaaaactattaaagggaaaatacaagtatctttcaatgggatccgtatgaaacttgcctgtatttgttgctagctgtcatgtcagattatagctgtgcatatatgtatctctgatcatacacatatggatgtgggttggagctaccatgtgtttttgtataagccatgaaatctttgaaggcagacagagacagtgtctcatttacctagcccagtgtctggcacatagtaggtgctcaatgaatattttttgaatgaataaatgaacaaacatatgaacacattgctaattacctcccctcaagaagctgatggtcttgtgtgagagacaaataattgaaaatatagtgagttgcatgttataatatgggtagatacagagtaaaatgaagtataaagaggggagtggtcaactctactgagtgtcgttgggaaaggttccctgggggaggtggtccttgagctgaattttaaaggataagcttatgttttagggaagaaaaatattttatgcagaagagataaagctgtatagtatgaggataagagtctaactgagctagatcagaatgtttgaatcttggctcaactctctacttgctgggtgtgtttgagtaatttacctaacttttctgtgccacagcatcatcatggtacaatggaaataatagtgctacctaacttgtagggttattatgaggaccaaatgagtaattcatttaaggcacttagaacattatctgacataaaaggcagtaggagggccgggcatggtggctcacacctgtaatcccagcactttgagaagccgaggtgggaggatcacctgaggtcaggagttcgagaccggcctggccaacatggtgaaactccatctctgctaaaaatacaaaaattagccaggcatggtggcaggtgcctgtaatctcagctactcaggaggctgaggtaggagaattgcttgaacctgggaggcggaggttggagtgagctgagattgtgccattgcactccagcctgggcgacagagcaagactctgtctcaaaacaaacaaacaaacaaacagacagtaggtgaattttagctattaatacatggaaagcatgctgactatagatgataagcattaaagtttactgagcatgtatgttttaggcattgctctaaatattttacttgaatttcctcatttaattcttccaacacccctactgtacagttaaggaaacaaagcctcaaataaatacagaaataaacaaaaataagtaaacaatccagtcctggggatataaatgcagatttaggccaagtgccatggttcatgcctataatcccaacactttgggaggccaaggcaggaggctcgcttgagctcagaaggttgaggctgcattgagcaaagattgtgccactgtactcgagcctctgtggcagagaaagaccctgtctctgaaaaaattaataaatagaaatttaaaaataaaaaaattttaatgcagatttatatgataccgaagttcattttctcaaccattatgaaatactgtttctggatatgtataaaatctttgtgagcacacatatctttttttaacttaactttcattttaaattcaggggtacatgtgcaggtttgttatataggtaaacttgtgccatgggggtttgttgtatagattatttcatcacccaggcattaagcctggtacctgttagttatttttcctgatcctctccctcctcccaccctccaccttctgagaggtcccagtgtgtgtcatttccctctgtgttcatgtgttctcatcatttagctcccacttctaaatgagaacatgtggtatttggttttctgtcactgtgttagtttgctaaagataatggcctccagtcccatccatgttcctgcaaaggacgtgatctcattcttttttatggctgcgtagtattccatggtgtatatgcagcacatttttttatccagtctaccactgacaggcatttaggttgattccatgtctttgctattgtgaatagtgcacaatgaacatacgtggagcacatttctgtctaagcacagacatctagacccttgtgtgagcatgagttaagtctaagctctgctactgaatttgtgccaataaaagttgtgagcaattttctttacatttttttcaaacaaacacacccagcagagtataatgtctatgtactttatttatgatttctagttcatttaacatgtctaagaaacatccgtgttgaaaaattatttataaattaaaataatataaactatctactgtccttatactcaactcccaattataagcaggtggaaaaacctggagaatgttttgtttacattctgtgcagtctttgtcagagggctgcctgagcaactgggtcagagtttagttctgctctgggagtagcaggacctcaagaaggaaaggaggaaaggaagtaactttttcttgagcacctgctatgtgtcattcactttcaccttcataatccatttaattttcgcaaaaactttgtgaggttggtgttttatctccatttccctgataaagaagttgaggttcagcaaagttaaatgacttgccctcagtcacacagactagggcagatccaggattcaaactcagggcttctgactcttgagtccagagctctgtccctgacagcagcagcactgcctctcctctcttccagctgttatgtccagactgtagcagaacccagtgttccagccacaagttttccaggaaataataaaggactcctagctccacctcccagggcaaaaatggctgctgtgggaaacacaggctggacctacgaatggcattagtggtttattagttgatttcagttgtccacactaataggcctccctctaacaaaaataattgagagctgattatgctcagatataatgtaaagtgaagccactttttattggaagaagcattccctcaaaacgtgtagagtatttcacattatttaaaggcaaatagagagaaaattatatggaataagaacaaagatgtttcttctctattatgagggactcagttctgagaaaggattttaaattgtaagaaataggtaagtccacgaatcagtgattcagtggtgtggagagctttatttctgagaaggccagtagcgctcccttctgacaagcaaatctaagacctggatgacagatgacttcctgcatttggttggttcttttgtcattcatatctatctgtaatacagttctggctaatttaagaggataagcttgaagacctctggaatttttcggctttaggactttaaggctttctgagcttcagtagatctagatctaggagctcatgctggtatattctgaatccgatgtatctgagttacatctatgagctacttaataaatatatctatgagctaaatctcataggctaagcatgaacctcacctccaagactcggggttcctaaatggatgagaccctctttgggaagtcttgtgggcagtgtctaattccactagaaaagttttacctacaatttaaacttaaaccatgatattttcttactgctgtttccttttttcattttcaggtggtattacacagacacgtgagtttattggtcttttatttatgccctgtctgaggatgcagattggtgggtagatgagaaggaactgattgagagagattaaccccaagaactgatatcttcccagcattgcattctcaactccattttagaaaggttccaaatagggacttctgtgggtttttctttacatccatcttacccttcccaagtccccatgtccctgcgtaaaccctaaagccacctctcaaaaggttctctagttcccttcaaggttctctagttcccttcattccacatatctcctcttccacaccctctagccagtagagctcccttctgacaagcaagtctaagatctagatgacagatgacttcctgcatttgggtggttcttttgtcactaatttgccttttctaaaattgtcctggtttcttctgccaatttcccttctttctccccagcatataaagtctccatctctggaaccacagtaatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgagggcaagaggtaatccaggtctccagaacaggtaccaccggctctttagggaggaccattcaaaagggcattctcagtgattttccctaacccagctcacagtgcccaggcgtctttgcgcttcctcccacactcaatcctgggactctctggtaccacacggcatcagtgttttctggaatatagattaaacaccaatatgaggcttctgggtaaccccagtctgtgcgagatctaaaatagcaactccctaagagacaggactgggtcatttgcaccgcatcacacccaggttcatagcacaccaacatgagtttatctaatgcttcctccagagataaatttttcagaaaggtttgcaaaaaacactcaaggccactatagtaaaatggcataagctaaggtataataataaaataataacaatacttaacatttattgagtgcttattaagtctcaagcactgtctgtacccaacacttatcaaggattctttttcatgtaatcctctcaacaactatatgggttaagtatcattttattcccatgagtaaagggatgaggaaacagagggtttgtgagttgaaaacacatttcacgcttctcacagctagtgagtaataaagctgggactcaaacccagggctgtttgactccagtgcctctacccacggccaccactctttgcttgtcaatgttgttctaaacatattgaagggggggctctgaccgtggcaagcgtgtgagtagtaaggggagaatggccttcatgcactccctcctcacctccagcgccttgtgttttccttgcttagtgatttcccctctccccaccccaccccccacagtgtgtgagaactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggggtaaggctgtggagtccagtcagaggagattcctgccaagggggacgaccagcctgggccagggtgggtggcaagtccacagctaggtcagaacagcttctctagagcttctatgcacagcttctattactgtgatgacaagatctcaacagacggtttcaaatctcacatcactcccctccttcccatcctagaaaagtgcaaaaaagtttatgaaagtgatgggcttcctcacatacctgtcaatgcctgcagtcatccgattccgcccctaagctgtgggaagagagactttgatatattagctcctgccttttcctttcccttcccctatggagagaaacaatgggaggatcttgagctgaggaaagtcacaaaatgatgagaagagtgtagggtccttagagatgaatgaaagaaaaaaaaagagaaaggacgtctgaacagaaaagggagcggtagaggagagaacaatggggtttgccattctctatctgggtctcactggcacagacagtgctgcaagattggttccctcatgggaatgaaatgtttcccctccttcctccgcaggacaaaacaaggagaggccaccacctgttcccaacccagactatgaggtaacgtgggatagaaatgggccaggacgctggaggggatgtccctccaggggggaaggaaacagatgggatggcccatcttgtctgccagatgcctcaaagcccctcactcagggcttccattacaaccctctatgtgccacctctgcgtccttcatggtaaaacaggactgtctcaaaggctgcatggcttccacaaccatggagaggtggaagcttgcaggagacatactcctctttctctggcttattcattgactgggatacagccatggagaatattatatatgcaaattctaacacaataaattctgggctgatattccaccagcatgcaccagtatagcgagttattgaaatattaaaattatataaatattatataaaagttattgaaatattaaaatactcattgggaaatagccccaaactttgctcaccccaacccacccttacacacacacatacacacacacacacacacacacacacacacacacacacacgtgaccagacatcccagtccctcccctaccgggctgcctcttgagttggggtaacaaagagttaatgcctggcatggcagaggatcaccaggattgttctagttgattggtatgtgtgcactcctagttgttaaatattttcactatcacacctggatatactcaacaaatatttgttgagccaaatactcaacaccagccaaacacgtagtatttactttagcttaagcgaattatttagccctgacagaagccctggaatgtgggtctttaagttcctatttttgagatgggaaagctgaggctcacggaaggaggtgaccagctcaagtctcctaccgtccatgccaaattagaattccagcctgcctcctgacttcaagtccaaagttcttcccacgcactaaagctagctcttcagtgtcctttcttaggaggtacttcctcccgcaccactgaccgccccctctctatttcacccccagcccatccggaaaggccagcgggacctgtattctggcctgaatcagagacgcatctgaccctctggagaacactgcctcccgctggcccaggtctcctctccagtccccctgcgactccctgtttcctgggctagtcttggaccccacgagagagaatcgttcctcagcctcatggtgaactcgcgccctccagcctgatcccccgctccctcctccctgccttctctgctggtacccagtcctaaaatattgctgcttcctcttcctttgaagcatcatcagtagtcacaccctcacagctggcctgccctcttgccaggatatttatttgtgctattcactcccttccctttggatgtaacttctccgttcagttccctccttttcttgcatgtaagttgtcccccatcccaaagtattccatctacttttctatcgccgtccccttttgcagccctctctggggatggactgggtaaatgttgacagaggccctgccccgttcacagatcctggccctgagccagccctgtgctcctccctcccccaacactccctaccaaccccctaatcccctactccctccaccccccctccactgtaggccactggatggtcatttgcatctccgtaaatgtgctctgctcctcagctgagagagaaaaaaataaactgtatttggctgcaaga

SEQ ID NO: 1598 - DNA, 9439 bp, Homo sapiens
agtctagctgctgcacaggctggctggctggctggctgctaagggctgctccacgcttttgccggaggacagagactgacatggaacaggggaagggcctggctgtcctcatcctggctatcattcttcttcaaggtaagggcctactaggggtctggaagcctggggaagggctcaagggaagagcccatcactagtgagacaggaatattggtatccctaaccttcagcctacctctgctgtcaccttagagttcaaagaagggcaaaatggaggctcttaactgttctctgctagagagaaacagtgtcccatggaggagaaggaatccttgtctctgaaaaatgcaaacagagtacttaaatggctgaagagaggaccctgttaccgccatcttagatttgaatgcagcccaaaagggcataggccaagaaactaaaaggaaaaagtatatgttccctacttcagagctgggggctagcagtcgacctaggaaatgtccattcactcagttgggcagttggccaattggtcaacaaagatgggtgagaccctaatatgtgatatgccatgaggaaataaaaatgaataaaacacttatgctctacagaactcatagtctcattggagagattagttttcatggtgccagactgagtgtacagtatagtatgggtgcctgcatgaatactccattggactatccaataggaagtggatgaactgggttgatgcctggagtctggacatcctgggaaagttaaaaccatggaatttgctgaagtcacacaagtactatgtgaggaagagggagctgaagatggaacagtgagggcaccaattttaaggggcagttagagaaaaaaaaacattccaggaaagagataaaaggagaatcaaagagctgaaataatcaaatgtatgcactaccttggaaaccaagagagtagagagcttctagaagaagagaattaccaagagtataaaatgttaaagagagcccactaatataagaatatatttaaaagtttaagtctgcgggatgtggcagaatatgcatcatgggtgatttagcacagtttcagcagggtattgtgagtggaagccaagtgaaaattggtagaaggtgaaggtcaggtgatgaggtcagcaagtgtagactattctttaaagacatttggatgaggagggagaaaagactgggtggtaggtagaggaggaagtagagtctaagaataaatgtttttgagggtgagagaaacttgagcacatttctaggctaaaggagaagatgatgagtagagcaaggtcctggagttgatggtggaaggacagagtcaagagtggggtcaagagcacagagaggaaggcaacgttaccctctaagaccaggagaaaggaagtgcaaacggcactggccacaaataggtttataaagggaaaggaagctaaaggagaaaggacaataacaacttccgtgttctaaaaaatccaggtgggaggcaatgccacctgctgaaactgagctgggtgatgaccggttgggagacttgaagaggacagtgagagtttagaatagaattatttctgagagaaatgcaaggaaaagtcaggtaaagacaacacaggttgaggagcaactctcaagcctgggtgaggtggctgcatatcatggaaagagcatttgagttcagcagtagaaaacctgagctctggatccagcttggacaccaatgagctatgtgtacttgaacaactcctccactgtctgggagttctcatgccagccaatccagaaatgtggcagggacgggcatggtggctcatgcctgtaatcccagcactttgggaggtcgaggcaggtggatcacctgaggtcaggagttcgagaccatcctggtcaacatggtgaaactctatctctactaaaaatattttaaaaattagtggggtgtggtggtgggtgcctgtaatcccagctactcaggaggctgaggcaggagaattgcttgaacccaggagatggaggttgcagtgagccaacacggtgccactgcactccagcctgggcgacagagtgagactccgtctcaaaaaacaaaacaaaaaaaaaagaaatgtggctatatgaactcttaagtcctaaaaggaaacctcactcagatatgcaacattaaaagatgtcaatcagccaggcacagtggctcatggctataatcccaacactttgggaggctagggagggaggatcatttgagcccaggagttcaagaccaacctgggcaaaatagggataccctgtgtctacaaaaactacgaaaattagccaggcatgttggcatgcacttatgccagctacttgggaggctgaagtgggaggattgcttgagcccaggagcttgaggctgcagtgagccatgatcacaccactgcacttcagcctgagtgacagagcaagaaaaaaaaaaaaagatgtctcaaaaaaaaaaaaaaaaactatgtcaatgatcagtgcaatctccttccctgaatccaatttagaatgaggggtctctgtcttctctcggtcttctgaccaggtggtcaggagaaaaactagttagaaacctctttaactgtttgtcttgccttttctcccatttgctcatttattcatttgcacattcattcaacaaataaagttcctaccatgttccagacactgcactggatactgttcaaaaataatcccgccctgcatgaggttctaagacagttcacttcttgtatttccattatactttgactcatgaccgcctctccctatcacacacactccacctctagccacactacctctcttgtccttttccaaagctgcatcttattcagctattctttctactcagaatgactttctctatctggtatattcttgcttactcttcaaggcccagacaaatgtcgtttcctctattaagctttccctgatcctcacccttggacaaaattaatagcttctacccttttttcatatgcagtcatataagcactaaaagataatgtatacattctattaaattaattgcatatatgttttaattttttcacttcattcataaactttggaagcagcagttgattcttcatatcagcactcttttctttcataatatctaattattttaggtcataatagtcctcgttaaatgtttggattaaatctaattgaattgaattcaagtgccagatctctgtaatatgtctaccatgcaactctactaccctaaggttttgtttgtctgtttgtttgtttttatttttttgagacagctttaacacctaggctggagtgcagtggtgcaatcttggctcactgcaacctccacctcccaggctcaaccattcctcccacctcctgagtagctgggactacaggtgcataccaccatgcccggctaatttttttgtattgtctgtagagacagggtttcgccatgttgtccaggctggtgtctaactcctgggctcaggcaatctgcccacctcagcatcccaaagtgctgggattacaggtgtgagccactgctgccagtcaactctgagttatgagacagatttgaggactaattgaaaagctaacttccctgggacatccagggtttttataataaaaggatcaccaaggctgaatattttataaggaactcagcctaaaggttttggatagtgcacacccactccttgccagggcattagctgctcaagaagcagagtgttctggactggataggcaatatccttacttacatatactacaatacaattctgatgctaaccccccaaattagtgtcagaccctacaggttaagagcatggttcccaaccagattgccctcactttaaatgccagctacaagttcagggtaccccagaccactcacatttctgacaaactgcctgcaatcttaaggattcccatgaccctcctcattgataatttgctagaataactcacagaatttaagaaagtgctgtacttcctatttcagttttattaaaaaataaaataaaatcagaaccagctaaatgaaaagggcaaggtctaggagggtcccgaacacagagcctccgtgccctctccccgtggaattagaacacatcgcccccagcactctcccacactctgccagcacattgatgggttcaccaaccaggaagctccaccaagtttttattgaggtatctttacataggcatgattgattgaatcattggccgcttgactgatctcaatctctaggatcccttcctggggctgataccactagtttcaaagctgcaatcctcttaccatatggttggtcttgaccagcaccatcctgagtcattgccatgcataaactcaggtatggtctaaggatccaccacagataacaaagccactcctgtcactcatgaaattccaacggttagaaacaccctcccaggataccaggacaaagatgagacaaattgtttattatcaccttgaattcaattgagtgatttagtctacaatccggaaaactaagtatagatactaccattttcatggatttggatctttcttcatcttggcctcaaataaccatggaaatacttcagggcatctgaacaactccatgcccagctaatactctatctctcttctgtctttacaggtactttggcccagtcaatcaaaggtaggagaaatggcttctttctatactcagactcagaatattgacggaaatttggcttcctacaacagtagtcctacaggagcgaacagtttagaatgaatgaaatgacggggatagagaggtgatgtctctattgtcaaccaaatcagtgacctgacataacctgttccgggcagcttgcctgtagctaagcatttaactggtctcttacaggagaagcaggaccctagtagctagggacacatctcaaactgtgacccatgaaccagtaggtattggcgtcacctgggatcctgacgttagtctctgtcaatccttctctttagttcatctattctacccaaagtgatctcatcatctggtatgctgttagcagtttcttacctgtatagtatcttccaaataacatgccccaaaatcccaaagttttacccctactaattacagcaatgtctcttttattcttcaccccctgacgcagatattggcgtcacccgagagcatgttagtaatgcagaatctcccctccccagaactactaaatagcacctgaaattttaacaagatccccatgtgattcatgtgcacatcaaagtttgagaaacactactctaatgatctcctggtatgcagaagcagggagaatttcagaggcaagatccttaatagaaccacggcttttctcatttcaggaaaccacttggttaaggtgtatgactatcaagaagatggttcggtacttctgacttgtgatgcagaagccaaaaatatcacatggtttaaagatgggaagatgatcggcttcctaactgaagataaaaaaaaatggaatctgggaagtaatgccaaggaccctcgagggatgtatcagtgtaaaggatcacagaacaagtcaaaaccactccaagtgtattacagaagtatgtaatcccctttggtctgtttgttgtgaaattaatcagtatttgctgttctggtgagctttttatctggggtgaaagtggaaatagatcctcaacagtaatattatcgcctgttctcttaatttcagcttgcctcttttaaaatactgtaagatacttccctcaccctattgaaaaactacagccagtcctgtaaaattttgtttacctttgggtgggctccatggattcaagcaattcagcactgagttgaatgaaggggttggggagacagaggtgatcataaggtgagcagcagtgagaactggagcgcagtggagcatgaagagtatctagtcttccttctgttccagatacttcctggtagttagactacatgggcttccccaggaatcctgggggacttaagagcatcaagatgcattgagttttggcgcaaggatcttcccttgccctgccacccacagaggaaaagcctgctgccctccacagcggcattattgcagacaggcaggagaaaacgaaccaggaaaaacaactttcgcaacctgaaggtttgtctctccttttccctacagtgtgtcagaactgcattgaactaaatgcagccaccatatctggctttctctttgctgaaatcgtcagcattttcgtccttgctgttggggtctacttcattgctggacaggatggagttcgccagtcgagaggtaaaagaatgctcttagatgagagatgggaccacctgagaccctcagctttcctcctaccattatgtacccaatggaagagactgagttggtgcttcttgctagtgtgcatagttgggtgaggctgtatttctctgagacaggagaaaggatacttggtgttatcacagcatgttcacctgtctcaagatacagctccctctgtgaaaaaaaaaaaaaacaaaaacaggcgcagtggctcacgcctgtaatcacaacactttgggaggccgaggcgggcagatcacgaggtcaggagatcgagaccatcctggctagcacggtgaaaccccgtctttactaaaaatacaaaaaattagccgggcgtggtggcgggtgcctgtagtcccagctactctggaggctgaggcaggagaatggcatgaacccgggaggcggagcttgcgtgagccgagatcgtgccactgcactccagcctgggcgacagagcaagactccgtctcaaaaaaaaaaaaaaaaaaaactattttaagtaaacccttacatacagaaaagtgaatcacaagcatacagctcaaaaaaaaaattcacagagcaaatacacccatgcagccagcacataatttaagaaagacaatattaccaatgccattgaagcccctcttgtggtcacttccagccactacccatcctcaagagtgagcattgtcctgacttctaacaacaaggattaactttgcttgtttttgtcctttatgtaaatggactcatatactaagtattcttgtgagtagcttctttcactcaacaacatgtttatgtgctttatccatactcttgtgtatatataaaactcttattgttatttagtattccattttgtgaatataacccaatttattatgcattctaccttgtgtggattctgtttcttttttgtgcagcttcagacaagcagactctgttgcccaatgaccagctctaccaggtaaggggatgaagaataaaagagacattgctgtaattagtgggggtaaatctttgggattgaggggcatgttatttggaagatcctatacaggtaagaaactgctaacagcataccagatgatgagatcagtttgggtagaataaatgaactaaagagaaggattgacagagactgaggtcaggatctagtgagcacaagttgaagaacacactgagagggacacacgaagaaactctcgacaggctgggcactcactatagacaggccatggctcatgcctgtaatcccagcactttgggaagccaaaacaggtgaatcacctgaggtcaggaattcgagacaagcctggccaacatgatgaaactctgtctctactaaaaatacaaaaaaaattaaccaggcgtggaggcgcgcgcctgtagtcccagctactcaggaggctgaggcaggaggaccacttgaacccaggaggtcgaggttgcagtgagctgcgattgtgccactgcactccagcctgggcaacagagaaagactccgtctcaaaaaaaaaaaagagagagagagaaaaagaaaaaagacagagcctccatctccttgtcctctttccatcctcaggaccatgaagtacccactccaaattctcacatataaaaaacattcaataaacatgcatcaaattaattaatagaggatggaaaaaatgacttatgactgtgctgtcctttccagcccctcaaggatcgagaagatgaccagtacagccaccttcaaggaaaccagttgaggaggaattgaactcaggactcagagtaggtgggttcttcaatgccaattctaataaaggacccttgcatcaactgccctcgcaattgcttctaagtctagctcccttccctaagcggctataagcatcagactctggggatcagggattgggacgtggtttggggtactcttttctaaaaattctggggccatactgattgtcttggcctaggtaaatatgaattttatgtatctgtaaatcctgtcagagcagggcctcaagccatagagatgctgaatattaatcttaacctacatttgaatttctcattatctacactattaacattttgggctaattaattatttgtgatgaggggctagcctgtgcattgtaggagttatggaagcatccctggcctctctccaccagatgctggtagattgtccagtgtgacaatcaaaaatgtgtccagacattaccaaatgtgtccaaacatcacctccagggcaaaatcacccttagttaagaaccactaacccatattaaccttccaatcaataaatcaatcagtcagaagttatgatttaattaatctatctgaagtttctatcaggaagacagggttgaaagcattatttgttttttttgaacaaattgcaatttttcttttttcagtccaggtgttctcctcctattcagttcccagaatcaaagcaatgcattttggaaagctcctagcagagagactttcagccctaaatctagactcaaggttcccagagatgacaaatggagaagaaaggccatcagagcaaatttgggggtttctcaaataaaataaaaataaaaacaaatactgtgtttcagaagcgccacctattggggaaaattgtaaaagaaaaatgaaaagatcaaataaccccctggatttgaatataattttttgtgttgtaatttttatttcgtttttgtataggttataattcacatggctcaaatattcagtgaaagctctccctccaccgccatcccctgctacccagtgaccctgttgccctcttcagagacaaattagtttctcttttttttttttttttttttttttttgagacagtctggctctgtcacccaggctgaaatgcagtggcaccatctcggctcactgcaacctctgcctcctgggttcaagcgattctcctgcctcagcctcccgggcagctgggattacaggcacacactaccacacctggctaatttttgtatttttagtagagacagggttttgctctgttggccaagctggtctcgaactcctgacctcaagtgatccgcccgcctc

SEQ ID NO: 1599 - DNA, 11479 bp, Homo sapiens
gccaaggctggggcaggggagtcagcagaggcctcgctcgggcgcccagtggtcctgccgcctggtctcacctcgctatggttcgtctgcctctgcagtgcgtcctctggggctgcttgctgaccgctgtgagttgtttttgccccgaccagacgggagttgggagtggggaatgagaaggaaagggaaggaagacttcggggaagaggccttcctggctgatttttgtgggggcaggagggtgggtgggagctgggcaaggtgcccccgctcctggctgaatggggtgggctgcctctctcttctcccgggctggggtcccgggagcggcctacaggggccgctcagggaaggcactggctgcccaagcgtgcctagacggcctggacgggtttagggagcctcagaggctggccacacagagactggtagggggttcagagggcgggaagtgaggcggaccaagggaaggggcgggtctggcccgtttcctgtccccttcttattgtggacagatgccagcctctgtaagtagttatcatctccttgccagctggggctgccttcttccagggcatcttgtgggaacaagagatgggtgcagaggcccaggtacttttgtgagaaggcaaggagcttttaacatcgccttccaccccgaaccgtatcttgggtgttccaacctaggaggaatccccagggctttgcctttttctcctgaatttaagatgacataggagacccctggggagatgaacagtttatgggacacaataaagggttaggagaccagagttctggttggctctgacagggctggtgatcagagggctggagaaaccaggggtttctccaggcaccagaggggctcagagccaaccaagcatatctccgggattttcagaagcctacacttgactcactttttgtttaaatgtatttttgtagttcctcattctggaggctgggaatcccccaagtacctggctccttcatcccagcccctctggcctccccctactttagagggctgtagattcctgcctgaagcctgggcaggaatgacccatggtatcaaggaaagcaagggaagcagcaagggaagagagggagtggggaggctgctttggtcccacagctttcactttcacctgaagcaatggctcttagggaacagggaggcagggggagggcggagctggaaagaggtaaaggggggcccttgtggtaggagtggagaaagagccagaggaggtggggtgaagggtgtgatccaggcttctcaagagcagagtttgccctcataactcccaactttggctccaggtagaggctgggctgtgacaacaatgtcagaagctatctattgagggcttcttgtgtgtcaggctctgagccaaacactgcctgttttctttgtctgatttctcacaactcccccattatacagatgggcaaattgaggctcagaaagggggattgtcttgccaaaggtctcatagctagctaatggaagaacctggttgtgaatctacatctgcatgattcccgagcctgcctctcagatagtgagagtctccaagctctggtcctgagctgttttgtggcagaaggaccagaactatggggagtgagaactggagattgacagacttttaggggagcgttttatttctcatgtgtttgaagatggtatcaaggactttcctatctttgggagtgtgggagctccacgttcacaggatggtgtcttgcaatgagctggtggggggcagtagccttttctacttcctttcccattttgggtaagacacatttctgtaagtaatttgctgagatacccaggttgaatgagagccaccagttaggtaggattctggacagccagccaggtagccgggctgcttgccatatatcatgcaagcagaaacaaatgaatgatgattaaaattgccatttaatgagcacctactatgttcctgacactgtgctaggccatatacatgtattctttcttatcttcgtaatccaacctgcagggcaggcattattactcccattttagagatagagaaactgaggctaagagaagcaaaataactagtaagtgttacaaagtcaggactggagtctaaagctgtctgactctcaaacttgtgttcttttcactggctgttcccaaactgtgggacagttttaaggagcacatggacatagaattaaacatacacttactttacagttcttttaaaaatccttctcattttttcaaagaggaagtctctggagctagaatagagttaatgcctctcaaaggcttgctaatccttcttttaaaacaaaaatcaagagcaggcctgggagggccttcaacaagcaaacaaccagctgggttttaataaccttgttttgtttccccagaatttatttttagggttaccttttatttatgagaagtgatactggttcttgtctcttggcaatgatgtgaggtttacatttaaagtaaatgtaccggccaggcacggtggcttgtgcctgtaatcccagcactttgggaggccaaggcagtcagatcacttgaggtcaggagttttagatcagcctggccaacatggtgaaaccctgtctctactaaaaatacataaattagccgggcatagtggtacacacctgtaatcccagctactcaggaggctgaggctggagaattgcttgaacccaggagatagaggttgcagtgggctgagatgatgccactgcactccagcctgggcgatggagcgagactctgtctcaaaaaataaaataaaagtattgaaattaacaataagtaattaatagcatgggtggtacctggatgtagtaaaatggtgaagatgaaacacaagttgatggagagaggagcattgagacctgagttctcatttggactctgtcactgtgagactctgggcaagtgaccctcctctttggtgctcagtctcaactatctgtaaaatgaaagtgtgagtttacccttccagctttacattctagcattttatgagggaagggctggatgaacagatgatgaggagttggaggaagaaaacatgatgggctttggaaaggagcaggaagggaagcagaagaataggaggaagaggccaagtgctaaacatagccccaaacagcactgggaccagctgaagtcagccagcttcaggactccaggggagctgctggagtccccatatcctatgggatctttgggaagaggaatgactcaggcatcaagccccaaggaattctgttctgttcagagaatattgtgagtttacagtaccattgctttgtaaaaataccagaatgattctctgggtgcgattataatcagctcagttgacaatttacttgaaaacaaacatgccaaatatcatgcaggttccactttctgttttgacttgcacttcagtttgcagcctctgtcctggatgacttttacctttctgctgaagaagttgcaacggagatttcaagatcccttcaaattgcacaattctgtttttaggtccatccagaaccacccactgcatgcagagaaaaacagtacctaataaacagtcagtgctgttctttgtgccagccaggtgagatgccaaccctctagccccatcatggagtccccctttgctttggtggcagacgcagaccccatatgttaactgtaaactcaaatctgaaacgacccatttcccagccctgcttcactgtcagaatgttctggttccctctctaccaggtaaaactctgtctaccctgaactagggatcccagcttctccatcttcctcgcctgattatgaaggatccaagactttcatctttgaatcccctaccctaaagcctggcctgatcattgtgtggttagtgtctgactcatggagttggccagagccctccctcatttcctgatgttttccaggacagaaactggtgagtgactgcacagagttcactgaaacggaatgccttccttgcggtgaaagcgaattcctagacacctggaacagagagacacactgccaccagcacaaatactgcgaccccagtgcgtgcgctgttgggaaagggacgcttgggaaccgggctgatattcccgacaatgcagccattctaattttatgtagccagggtctgctctgattggttggagtccgggctgtactgatcattaaatgatttgattgccatctctacttggaagagggtctgaggaagaaagagcaggcaatgtggggagtgaggctcagagcatggcccagcagggggttcccatccttcctgcccttctcttctcagacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattggtaagtggctcatctgggaatcagttttggagggggacagaggagcttagggcccaaggtgaggggctgggcagtgggcacttagccccagaggcagaggaagcagaggctccaacctatgtcggtatccccactggagtgagctgcagacgggaccttgttcattctgccttctgccatggggatctgcctttgaagggcaatgggagaagtcctcctggggactgcagctgtcgggggcagtaccacatcgggggaagagtgctcaaggcaggagctcttcccgtcctgcctggccactggctgccttgtgagccggacaggtggtccactgtgatggttaatgtccccctccccacccactcccagctacaggggtttctgataccatctgcgagccctgcccagtcggcttcttctccaatgtgtcatctgctttcgaaaaatgtcacccttggacaaggtataagcactcatcccttgtgtttcctgctctaagagtggcatggagctgcctccattctctccagccacctgtcctgtccctgctcccagaggtccacacacactcatgtacttgtgaagcatctgcagagtggcctcatggccaaccagacaggcacatttccacattttttttgcctgctgtctctttgaggtaatagacactgttgatctctcgcttcatgagagcctcctatcttgggggtattgggacacttattttagctttccttctgcccctcctgcttctcctcagttttcctcgtcttgctttcaccttacctggctttctagggctttctgggctctgggtgctcaccctgagggcctccctctcttacctccaactccaaacccacaccaggtcctgccactggctgtctacgtgttttgggaacttactgtctccactgttgtcactttagtttgggcctcatcactgtggtctgggtgatgccttttctgcctcctggcctccctgcctctgtctctcccctcctgctggttctgtctccatcctcttgccaacatgagcgttcgacagtttctttcaaatcatgacactctcctatttgagatgcttcctgtctctctgttggaactaagactccttagcatggcacccaaccttcctgttgcatttcctgctctctttcctgcatcgcatagcttcatgctacttgcaatcctctgaacacactgttcattctcttccatcaaactcatctgcctggaataccttaaacatgggccccaggccaggcgcggtggctcttgcctgtaatctcagcactttggatgccaaggcgggtggatcacttgaggtcaggagttcaagaccagccagcacaacatggtaaaaacccatctctactaaaaataccaaaaaattagctgggtgtggtggtgggcgcctgtaatcccagctcctcgggaggctgaggcaggagaatcacttgaacccggaaggtggagtttgcagtgagccaagatagcgccactgcactccagcctgggcaacagagcgacattctgtctcaaaaaacaaacacctgccccattaactttttgcatttgatttttaaaaatgggcaagataggcacatgggacagaaggcacaaaagagccaaagtgatgtctttctcccatccctgccccttaggctcccagttctttctggagggagccattgttccttgcatatccttccagagattctacatataaacaaaccaacacacacacacacacacacaaacacacacaaaatttccctccttttacttttgcacaaataggagtatacattttatttgttaactgtctgcctttccctaatagattgaaaattccttaaatgtagaaacttggccttttttttttcttccattgatacatcccctatacctggaacagtacctgacgcatggtaggtgcttaaatttttactgataaatgttgactgataactggaggcaccactggtatagtttttttttttttttttttttttttttttttttgagacagagtctcactctgtcgcccaggctggagtgcagtggcgcaatctcggctcactgcaagctctgcctcccaggttcacgccattctcctgcctcagcctcctgagtagctgggactataggcgcccgccaccacacccggctaatttttttgtatttttagtagagacggcgtttcaccgtgttagccaggatggtcttgatctcctgacctcgtgatccgtctgccttggcctcccaaagtgctgggattacaggcgtgagccaccgtgcccggccaccagtggtatagtattaatggaatcagtgcattggcttacgtatctgattacagctcagtaagtgtgtgaccctcactgagcctcagtctcctcatctgaaaaatgggaatgaccttcatttcacaaggcttgagctaaaaacatgtaaagtgtattgtaaattcctgaatgctctactcatgtaagactaaagtaggccgggcgtggtggctcacacctgtaattgcagcactttgggaggccgaggagggcagatcatgaggtcaagagatcgagaccatcctggctaatatggtaaaaccctgtctctactaaaaatacaaaaattagctgggcgtggtggcgcacatctgtagtcccagctactcaggaggcggaggcaggagaattgcttgaacctgggaggtggaggttgcagtgagctgagatcgcgccactgcattccagccagtctggcgaaagagcaagactctgtctcaaaaaaaaaaaaaaaaaaaaaaaaagactaaagtacatggtttcttcaaagcttctctctctttctcccaccttagatgatttttcctttgcaatgtcctgtgtccattccgccccactcctcctggggccacctggaccaggtcttcatcatctcatatctatatgtttgctgtgtctcctggctggccactcttctgtaatttctcctcctctgagctctctgggcagctgaatcttctcactagtgaagtcgcctggttggatgctgatgagactgaccagctgaatccagttgaaaacttcacacttggcagtgatctggttctaaagacacaattttccatagtttcctaacaccatcctgcatgccacctgccttatttccccacatcacatcgtcccacttagcgggactgcactgctgatccaaattttacatcctttagggcccactcaggtcatatgtcctcagggaagtctttctggaagaaccttaaaccagaggttctcaacagggggcagttttgctccctgtggaacgtttgccaatgtctggacacatttcattcgtcacaaacggagagggggatgctacagggatctggcggatagaggccagggatgctgctgaacatctgcaatgcataggacagcccacccccacccccacacccccagtaaataatgatccagcccaagtgtcactggtgctgacgttgagtaaccctatcttaagctgaactcatcatctctccattccagccttggtggattctgtctcctctgaaccattcccatctcactttagcctacctagatcacaaagcttggcactcattatagactcccctatttattactccttcaagatgtgcaagaatcttttctctgcacttttaagttctgtaagaagagtctgtgtcgttcctataataaccagcataggacgttgcacgtgttgtgtgctcagtgaacctggatttgttgattgttgactgactcactctagagttggaaatcttatgcttggggaaacttaatatctctttctttctctgtgtgtgtgcatttgtgcacgtgtctgtgcatagctgtgagaccaaagacctggttgtgcaacaggcaggcacaaacaagactgatgttgtctgtggtgagtcctggacaatgggccctggagaaagcctaggaaggtgggaactgaagggggagatgaggcacacaggaacactggatgggaaaaaggggaggggaggcagtttgggggtgtggtatcacagctctgccacttatcttgggagtctgggcaaatcacttcccctctcttagcctcagtttcttcatctgtaaaatgggatgataacagcacttccttagtaggttttgattttagagtgagaaggttggcctacagtaaagatcagataatgtaaatcagtgaaaaaggtcaggggtaagaaaattacattctctttacctaacgctaaatgaccagttaatgggtgcagcacaccaacatggtacatgtatacatatgtaacaaacctgcacattatgcacatgtaccctaaagcttaaagtataataataataaaatttaaaaaaacgaaaaatacattctctttgctttttctcaaaatgtactttcctctttgtagggctgggactagaatgaggtgagcaaggcacttgccctcgggcgcaatatttaagaaggtgccataaaagtgtagtaatcaaggtaaattcattttgatgcaatatttttaaaaataaaaattaatgcaaagaaatccatgatgagcaagatagcaacattttaaataaagaacaggatccgaccctgtgtttgcatgaccctgcctcactcacctcaccctaatcctggccctggttccagtaaaaggaataggcagccagcctgcaggccgtagtttgctgacttggtgtccgcctgatgattttcaaaatatggcattaaaagaatgtttaccttgatgactgagtgttttggacatccttttcaattttgtcctgaaacaatttcatcccttgcctcacgctagtctccgccctgccttttggtctttcttttattttcccactttgaaaaaaaaattcggcatgagaaatactttacctttcccctccactcttctataccaaaagcaacatgcagacatgaatcatgctagacctcggcattgggcagagagcagggagtggcggggagcatggtgagcaggtggtgacagccactgccaccactcgcttctagatggttcccaggtggggaggctgccaactggaacccagtcttcccagtttgtaagagaaatcagatgtctaggtttgaatatgtgatctcccagtttaaaaatgtcggcaaatatttccaaacgttaagaaaatgttctggctcctttaaagacatctgccagccacatttccccaaggaccgcggtttgaaccttctgatgtagatgagctctgacattggaagattctggagtctgacaagtcacagcaggttgagggtagggagaaactgcaggtgaggggtgcatgctgaagtcctgatttctccaggtccccaggatcggctgagagccctggtggtgatccccatcatcttcgggatcctgtttgccatcctcttggtgctggtctttatcagtgagtcctcaggtggggaggtgttgggggagggaggggagaccacctgtttcttatctggcctctccaactccccatcctttttttttttttttttttttttagaaaaggtggccaagaagccaaccaataaggtaggtcacccctgagaacccgggacagagttttgacaaactgggaagatggcctcacggttgcctatggggcagtaaaactgattcagagtctgtctctgcagccagtggggtggcagcagaattggggactgtcatccccacccaccatgctccttccatccagagctcaatcccccacagaactgcccctggcaccactggcagagcctaacactggctgttcttcactcctttcctggcattcaacgcgtggggagctgcatctttgggccttggggctgggtcaaatgggtgggagcaaatgtggcagccccttaagcccactggctcccactctggaagctcttcgtcgcccttggtgtggccagcagggggcaggaggcacccgaggaatcagcactgacccgccgtctgggaaaggggggagggcttggggaagggatccgcttcccagggaggggctcctcagaggcacagctgcccctgctgctgggggtgacctcacaccttgcctctccaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaacagaatctcaaaaacactgttgagtaaggaaaaaaaggcatgctgctgaatgatgggtatggaactttttaaaaaagtacatgcttttatgtatgtatattgcctatggatatatgtataaatacaatatgcatcatatattgatataacaagggttctggaagggtacacagaaaacccacagctcgaagagtggtgacgtctggggtggggaagaagggtctggggg

SEQ ID NO: 1600 - DNA, 11479 bp, Homo sapiens; identical to SEQ ID NO: 1599

SEQ ID NO: 1601 - DNA, 12214 bp, Homo sapiens
actttgacagtcttctcatgctgcctctgccaccttctctgccagaagataccatttcaactttaacacagcatgatcgaaacatacaaccaaacttctccccgatctgcggccactggactgcccatcagcatgaaaatttttatgtatttacttactgtttttcttatcacccagatgattgggtcagcactttttgctgtgtatcttcatagaaggttggacaaggtaagatgaaccacaagcctttattaactaaatttggggtccttactaattcataggttggttctacccaaatgatggatgatggtagaaaccaaatagaagaatggtcttgtggcataatgtttgttgcctagtcaatgaagtctcatattcttgtctctggttaggatcttgggatctggagtcagactgcctgggttcaaatcttggctctgcccataccatctctgttatcctggggcaagtgcctcagtttccacatctgagaaatggggatggtattggtgtccatttcatagattaagtgagtttagccttgtaaaaagcttaggagggggtctgatacatagtaagcactatgtacgcactagctataattatttgctaaagttctgctttaaaagtaagctatttttttatggagacagcttttttcttttaaatttccagctaggcaagaagagcgtcaatttgatctaaaatttcataatgcttcagattaacatagacatggataagtcccagaatttgcagtcttttagtaaaagtagcattttctgtgtaattcttcacaagcactgattgtagttgcaggatgctcagtctccctctgagatgttttacatttttaaatggttagacttgcaggaacaaaagagcagagtaacttagtaggctgttttgcattcttaggaaaagaaaaccatcaggacttattttgttttcatgtattttttcacttccactgaggagtataattggctggtgttgacaaaataccaatcatagatgtaaaggagaaagttgattagttttctggctgttcctaaaattctggatgcaggaactgtggctagaaagcatctggatgattgcactttatcagggatacttgagtgtcctctcttaggatctggacctagaattaatgtcatgagatttttctaacaggataaggtgaggtagtgagggctgaagtcatccactgggttatccaaatattaggtttcactgctgacaaaagagggggcttctggtctggttggttatttgtgtttggcctgatgtgctctgtcaatcaaatgtatggacataggcctagcttctaaaggggcaatagtgacctcagtggactgatatttaccgtactatttacatgtgctcttaattacagcagaagctgccagctaactgaatcttgttttgaatctaaaaaatctactcttaaagcaagaaaatggtataaaattagttgataatgcaagtgaattctgtacatttaattattctaagacattggaaaataaaatatcttgttactttgaggataaaagatgatttctttaaaaatgcaaatgttttctacaaatactaaagttaaaagggagagagatgtaattagaactcgttaactgacacattgcaaattaacttctttttataaagcactgcatcacaaacactaaaatgaagtgggcaaattagctctgcagaaaactattttctaggctgatgtttataatgaccaatcattactgaagcaatgagaaatgtgacaattacagaatattgctgctatagtatgttgaaaaaatatgcattttgtagtgaacatttagtagaatagctctgatttctacctggagtttctgataacatgacatcttaattgctgtcttttatagatttttaaactgcaaatacaaaatagcaatcagccaatataataacttattattctccatttatgcctgaaagtcctcctcttgttgatgccgtggaaatgaatgtagaggcagatatcattagctgtattctccttccgaatgacatttatcatatccttgttattccaaaatagatagaagatgaaaggaatcttcatgaagattttgtattcatgaaaacgatacagagatgcaacacaggagaaagatccttatccttactgaactgtgaggagattaaaagccagtttgaaggctttgtgaaggtaagcagcttaattactggtaaaagtgtcattgaaatattttactacatttgctagatcgggaaactgacaatgccaatgtttaaagattggttatagacacagacacacagacacacacacacatatatatgcatgcagatatacacacatacatgggtgtgtgtgtgggggttaaaaaaaaaaaacacaaagacactctctggggaaaatacacccttaggggcacagtcacacatatttgtcagcttacatatgcagctaccactaggcaaaatgatgaagtccaccaagcttggtttttgcattgctgtgtctccccatccaaaccttgatgctctcgcactggggacccagagtctgatccccatttcccagggaagcaatagccgtcaacagctgccgtggcagcaggccacaagtgaagggacacctgaagactggtaacagtctctggtgcttctctgatgatggaattttaggtgtcctgacagtgagatctttcccttttactggggagagaggtgcagggaataagtaatagacattctcagtgtcgctcaaaccagactccatataatatcacttgctcatgaagcccgcccactctatggccggtcatgaccagaggcacagagggttcaaagccttttagcccaccaggctggtagctagcatgaagtcactgcagtgactgtggcttataacagatacctaaaacaagaatttttagaacctttacattaattccatcatcacagacatagggtctaggggctctttctcctgaggcagaacatcaagagttctttctgcctatgtccctttcagaacactgagtcaaatacccttgggcctcggctcacttaggggtcatttctaggaggcagcactccacattgaggacagttctgggccaggtgggtgggtatctgggtaaaccaacaggaattagttctcacatatagatgatgtgtaatttaatgcaggcgtaaaagggttaagatcttatttctgatcttatttctgccctcctgtactgtcaccgaggtgccatttaattcattagtgaagactctaacagcttattcctgagtcacctacggagaacagaatgtggctcaaatccgctgcttgctttcaggttctttacactaatctaggctttagatgaaactcctaaaccctttctttgcaagactggccagctaggaaaatgatttgagtttcttcggttcttcgaggatttgggccagtattacagagtattggaagatgttaccagtttaaatgtgaataaaggcactttcaaaacaatggctaataatccaaataacagactgaatgtgcttggctatgtgactttgggtaaataacttcacctttctgggcctcagttttgtcatctataacatgagaagacagattatctgtaagggcactatcagctctgacattctacaattatgtgataagccttcagttccctccaatggcagtgagagtggcttgtcagtccccctcgtttcttacggagacttttacggttgaattgtcaattcctcacgtcattatttcaggttggctatgtatgtaaagctcccaaaatcagctaccgaggataggagtaaagaaaacagtcagtttggcctccctgcttatgcttgtatgaaaaaagtgacagctccaaagtttcatattcttaaaaggcagatcttctcaggcatgtcagccagggccccagggatctcctccttacatgcaactaaggaggctccttgtctctactgcagcaggtgtggaaccctagtcaacaccacctatacctaggattacgtacaatgagtagatacaaagtcctccagctacccaatcctcccccaatgacggatcccctttccaatacgctttcccccaaatttctcaccctaaaacaaaattcgagactttgaaaaaactcaataggacaattatagaatagctccagattagattcatattttcttagctaatgttagtaggctttctttccgggccacagtctggctgcacctaagcaacctcaagtttgaatttggagtctttgaatcaggtcttgatggggtcttagaagtcatcagatccaattctcaatccacaacttcagtcttctctccacctcctgactaagtggtcatccaatctctgtttgaacatctctagtgacaaggaactcattatctctggaggcaggtagcactaatctgtcattttgggggaaagatggtattcagggctcaagtgagggtaagcagaggtattattttgaatagtataatttcatattaaaacttacaacccaccacacctctgctagatgttcagttccatgattatttgcccaccaatgcctgcgatgcctttgagagagccaaagcatttctatttcaagttaaagggcaacctgtccatacctgccacatggaactcccactaagagagaaataacccattctggattttctgaaagtccactttaaaaagtatttcagttgaggtggggagtgaagcaagaaaaaaaaaaggctctggggagtgtggttgggcgaaagttcacggaaaggctaggctgggctcatgaaacacgagctttgctgacttcatgttttcatcttggccaggcctcaacaccaatgcaacaacttagcctaaaagtatctcaaccttgatcaccacactctactttttgaaaagacactaaatagtcatttgtttacttgtgatctcacaaacattttcctgtcaccacatcttcatagtgccgcgcttcagctcaaatggaaagttgaagctctggggcccatgtgagtgttctgaggctcaggttcccctggaggctctatgaactacgcccttaaatctggcaactgagctgggcctacagccagcactcaacagtgacagcacaaattccttctggaggaggaaataaaaggaagggtcctatagacaactgattccaggagtgggaaggagcacaggactttgattatcataagatgtgaaaatactactgtcttcttcccttgtgtgcagaggatagacagatggaattagctaagcccagcctatgaatgccatctcacagtttccactcttggtttaaacctcagcttctttgggtgacctcataatgaccagttaagccctccaggccttttgttcagtctctttaaaatggcagcaacagcctttatcatcttccaacctgtgttgatggaagttcctgttagcttctttaaatacctctagacttccttcagtttataagtgaaaagaaaccttttaagaagtgtcgcacttgcctttgaacatcaacaccattgggagatggcctgtgtttccgaaatgctgattattctaagtaaatacagtgcaactatcaataagagaatctcttcagcccattgaaagggatagcaaaattaaaaatgtctgagggtcttttcatagtctggcatttctccccaaggtcaaacttactattatcttttcctacaggatttcagaccaaatttattctaatagatacacaccatgctttatgtttaataatattccatataccagttcccagggtagaatcatctccccattcggcattatttgtcaatatctgtcaaagccaaggaggttgaggtcataggaagggtcaggatcacagcctctggtctggagagagcactggaatggagataataaggcctggattttacttccagattctcccctgggctttctgggttgttggctcatctgtcagatccatggactcccaattggcatgatggaattaatgacaggatctgagtctatatgataatcctcaccagaaacagacaacagagtaatgacagatgcaaaacgaatgataattttaaaaccccacagcagagcccctgtcaaaatgacctcttgcaatgcttcttattttaggatataatgttaaacaaagaggagacgaagaaagaaaacagctttgaaatgcaaaaaggtaggtttgctatttgctaatttctatgaatgcctaaaaactaaaaggaagctttaggctgatcatattgaacaacccagtgttgttgcatcagggaacttttagccctggaaataaaacaggaacacaattgtcaaattgacaccttctctggtccctgtgatttggaaagactttgtacatatatatttatgaaaaaaggatgtgttcctttaatgccgatgataccaaatctgaagaaatcccattatgttcaataccttaatagaagcaaccatacagcctgataccacctacagtggaataagaagacaggaaagtcatcatttggtaacagtggcattcatcactcattgataacagtttttcatggggcacagtggccggtggagcctctgggatcaaggagtgacaatgtcacagtgttctattatttgcccggttcttaaagtgagagcatcctgaacatctcagggttggaagagaacttgagagttctcaaatccagcaccatccccacaacaaaaatctccttcacaataacactgaccgtccagcctctgatcaaacatgtcgagggatgaggcaccttccacctcataaggcagcctgatccgtctttgaatggctctaataataccaagattactatactactccagagaagtctttcctcctcaagtcaaactttgttcctataatctccactcattggtcccagttctgctctttgaggccctagtaaacaaagtataattgctctcctacccagcagctgtccagatatggaagacagcaatcatggtggccaagccttgactgagctttttcttctccaggctaaagatccctgatgtcttccactgtttctcctatgaccctttccaggacctttcttctgccactcacctccttttcttggacacactaacgttttcctgttcttttagaatgtggcatcgcaaaccaatacaataatgcgtgaagtgacttcagcagcagattatgggaaagacggggtgttgttagagagaattttatatcacaaagttggtgaacatgatgttatggcttctgcaaatttaatacacacaaaaacatacatacatacagggatagagatactattttctgaggcaaagagagtactcagaccttgccttaactgttgttctggatactaaatggtcatccgacttccatgaaggttttatcttcagaatgactgcaagatatgttgagtaatagtaccacgctgtctgttaattacagagaaatctgaggaaacagtttatgtagatgctgcctagaagtcttcagggaaatgataatattaaccaaactggtcatttaggtcatgcaatttaactcaacatttatagggcacttacaaagtgcccaatatcaggctcataactggacaaaaagaaacttccacacagtctctgcccttagaagattgacacatctcattagggagcagggctttaacacaagaaataattaaagacagatacaatagttcagccagttgcttgaccaattcagaaaccataagaatcttactaagtgtgcagactttggagcccactaaaatccccagtgtatggagttgttcctaaaagcaagattcacggtatgtttaatgaagaccagtgtttttagcctgtgtcaatctatgcaaaatggaatcgagtattgatcaactgttaggagaatgagaccgatggaaacagccaattcaattactcagatattagaaaccaacttttccttcagtgggagagatgtcagaccattttatctttccttttatataatctatttttgcacagtctctattacacagttgtagaactggaccagatagttttgtgggcagtttttgcattattttagcctgacagtttttggttccatttcaggtgatcagaatcctcaaattgcggcacatgtcataagtgaggccagcagtaaaacaacatctggtaagtcacacagcatctgagcggtagccacccaaggggaaaggctgggatgccgaagtcatgttacctaatggttaaactcctcttttcccctgggacccaatttacaaacctacccctacacttctcctattcccttctttgtcttcaaagtgagttcaaatgcacagatgggacttagagggacaaaaggaggtggaatgcaatctggatgttctcattatgttcttgctcaatggctgattctaaatgatgaattactgggtggagggaccattgttctgacaacatagaagaaatggcatgtagtgacctcctgactgggagcatccctcctcctaacccatcttcactgtgtggaaatgggcctcatggggtatttcctgccatctgtcaatccctgtatgattaagctcagcctcactgaggccaacctcagggaaagtaaaggtaaaatcattctgtaaagatcaataggtcccaagacgttacattttccaatgaagtaacaacagacgacatattgtgatcttttcaactctgaacgattttatttccatatacgttctgccaccattctagcctttagatattttttcccaaatgtgcatcttgcgataactggtgccaaagaatatgtcgtatctgataaatggatggaaacatgcacgctaacataaagtctcccatcaacataaaggcaagagcgtcagaggagtctttgaaaaattctacagagtgctccggaatggagttctaagcagtgcatgtgtgtgtgcatatgtgtatgtgtgtgacagggagagaaagagagatggacagagagagaaaaaagacactgcttcatctctgaagtggcttgggcttctcagtaggcgtaacacatggacagttatcattatcatggatcatggtaccaaagtaagagcactgaatagggagtttttgaacactgggattcaaggaccatgaccactgcttgctgggtgaccttgagcaagaccctttacctatgcagcagttttctacttcacctactttacagggtggctttgagcatcaaatcagctaatgtggccgaaagtgatgctgtcgagtgctgtacaaccgtaaggtgacactacttagtttacttcaccatggcttagatgtcaaaagggtgacataaagcccctcactaataccagttagttacacaatatttaataattttgtcaagtaccccttctctcttctggatcagatgacaacaacagagaaatctcctagaagaatagcttcccactggtctttttttgcctgtatctaaacccttgatcttggatatatttcatagagctcagattctcccaaaaggcttgtaatggatatcagtcctacaatatcttacagtctgcatcacaataggtttccaggggatcagatgggaagacagtaacattccacccccaccccagtcccaaacctcttcttcctacctagccatgctgctaaaatcttgccctacatcccacagcaagtactaaaattaggtaaggacgtaccaaagtaaacttactgaactaaaagattgagaacctgccctttttttctcaataaaatggttcaaaagggcaaacattctaatgaagcattgtttctggagtggtctggagggcccggatctgtcaggcatttcaggatgcctccctattagtaaagggcgagtcttaccaggtgggatcttgtgccctgatagacctaagactatcgaataggaattattttttaaaaagctcaaggaagcaaacacatcagtactttcacttttcctcaaccctcacccccatcagtcagtctagctttctgtgggagctgagatttcaagtcgggtgcacacactactttgaacccactcaacatctcagccgagaaaatggcacactgttggtgggtactctggcttagccacaagaatactggtactttcaagttggtggcgcccactacaatgggagatcaaaacataccgtgaaatgagcacacagtttattttcatacttccttgcctaattttagtccttgctgggggaggcagatcaggtttgcaacagcatgatcaggtaggaagaaatggggtcttttctctgtgctgaggctgagctaggtagactgacaactctctgactttgtaaaattcaaggcaagcaaggtattcatggtaatattagcaaaaatttggtccgagtaatttggtatgtataatttatgatgtcaaattttgaaatcatttgtgccttcttaagttcaaggcaaattggctataagaactctaacgagagaaagaaactcactgtgatctcttactttatttaatcttcacaagtctctgaaatatgctccaatatgagccccgtgttgcagatgaggaactgaagctcatggagatttagagacttgcccaagcttaaatagagcctagattggaacatggctctgtctgactctgaagcccatggaaggggccttgagaatccatccctatacaaagccaatatccaacattaaactatattttttgtcagaatgtgaaccatgctctgcttcacctcaccacaaactttccctttctttgtaacagtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactctgaacagtgtcaccttgcaggctgtggtggagctgacgctgggagtcttcataatacagcacagcggttaagcccaccccctgttaactgcctatttataaccctaggatcctccttatggagaactatttattatacactccaaggcatgtagaactgtaataagtgaattacaggtcacatgaaaccaaaacgggccctgctccataagagcttatatatctgaagcagcaaccccactgatgcagacatccagagagtcctatgaaaagacaaggccattatgcacaggttgaattctgagtaaacagcagataacttgccaagttcagttttgtttctttgcgtgcagtgtctttccatggataatgcatttgatttatcagtgaagatgcagaagggaaatggggagcctcagctcacattcagttatggttgactctgggttcctatggccttgttggagggggccaggctctagaacgtctaacacagtggagaaccgaaaccccccccccccccccgccaccctctcggacagttattcattctctttcaatctctctctctccatctctctctttcagtctctctctctcaacctctttcttccaatctctctttctcaatctctctgtttccctttgtcagtctcttccctcccccagtctctcttctcaatccccctttctaacacacacacacacacacacacacacacacacacacacacacacacacacacagagtcaggccgttgctagtcagttctcttctttccaccctgtccctatctctaccactatagatgagggtgaggagtagggagtgcagccctgagcctgcccactcctcattacgaaatgactgtatttaaaggaaatctattgtatctacctgcagtctccattgtttccagagtgaacttgtaattatcttgttatttattttttgaataataaagacctcttaacatta

SEQ ID NO: 1602 - DNA, 39495 bp, Homo sapiens
agcgagctcctcctccttcccctccccactctccccgagtctagggcccccggggcgtatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgagtaggggcccggcggccggggaagcccctgggctgggtgggaggtccaagtcggtctctgagacacgcacaggggccggcgacttggcaggtggggagcttggcccgcggtcgtggttcccgccgtcctgtgcctttaaggctctcgccgctcaccagcatttggggctcctgctgtgtcggcccccagctgacttggctttaggggtcggcgtggagggttaaagaggccccggctgggtttgcggagcagccaagcctggcaaaatcgaaagggagggctcaaagagactgtatccttaacccccaaaaagctggtctaaaaggatgggaggccagaccgctgaccgttccccactctcgacagagtccagccgtgtggagcacacgatgctgcaaacttgcatgtcatctctttcaggtgtggcatttcaagggggcttgtgtcttgaaaacagcaactgtgaggacacttgatagtcatttccttcagttctgcttttgtctccctaggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtaagttcttcatctttttagaaaagttctgggaatggaatgtatcttaaatttatttttatatacctttggagtgactagtaattgatagttctctagcgttactaaaccccagggtataccctgttggcacgtcacactccagctaattgaagacatttaccaccctgagtaggtcctgctgcttcattaagagtttttcttcctaacactgtacctcttgaacgaactagtagagaaaataaacaataggtattgtttagggagtaaacatataaaatatatttggcaattgccttgagacacatagcgtaaatgatatgttttcttaagtattttataaagtaggacttaccaaatacaactctgtggtggcatttttaaaagctctcaatatttacttcaaaatctgttatacttgtacatatttatagggtacatgtgatattctggcacatgcatacagtgtgtcatgatcaatcagggtaattggatagccagtacctcaaacacttggtgtttgtgtggagaatattccaaatcttctcttcttgctactttgaaaaaatatatgtatatatataaattgggatatatatatagggagagagatatatataattgggatatatatatataaggagatatataattgggatatatataaggagatatatatagggagagatatatatatatagggagatatatatatatagggagagagatatatatagggagagagagatgtataaactgggatatagacaggtagataggttgattgttaaaaatgaataagaggcccagtgaagagttgtttgggggctaacacagtaaccgtgtttgatactgatacctagtagaattaaaagaaatgaagatttcttgttttaggtgaatatacatacagtcatccacaccttatgtgccctttgatttcataaaatatatattggcattatcttggaggaaaaaaatctgttacttacatagccctgtattagctttgagatatatgagtagagataaagataaagagacccgataacctgactttgaacaacttaaatcaatagaagctactgtaaatacagaaattggcacaaatacctttagaagccatgcgtgaaataggctttaactttttatttttatccacaatagaggcagtaggatgaagtacatagtctttgcacatgtatcatgttttaactcttccccatgttattactttatccaatcctccaaacaaccttatgaggtaagttggggctcttacactctttttatggcggaggagacagaccccagtagtttaataacttcctcaagagcagcagcttttacgccaaaaccaaggtgtaaacttgggtcttctgactacaaatccaatgatgacccttccacttgaccatgcctctctagattcacatttgtgggcaatctgtttacagatgtaaatactttatgtatacaatttgtgggcaatctgtttacaggtgtaaatactttatgtatacaattgactcatccttgcccccagggctcatgggaattaaatgagtttgtacgtaaataaatattagctgctattattgttgtgcaggacattagtccaggggtctggaaataccctattcctgtactgtatggtgctgtgtagttctttagggcagggtaaggaaaccaacatttattgaatgccagaactgggccaggcaacttaaatttttttttttttttaagtggggatagtgatatgtgtgtaccaactctacttcctaagcctctagtaactaggaaacaaagtatacatgtgaatacatttgctacattgcaagtgccatggtgatattaatatagttaagtactaaatatgcgcaaagcagtaaagaaagggggttattagggtccagataattaaatatagattataaaacaaaaattgatactacattttttgttgctgcttttgttaatacttttaggtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaagtgagtaaaattttttaaagtattttcaaccatctggtgtttgggggaaatagtatcccttccttcattcatgctagaactctatgtgtatatattattatataggatgtttcttgataggaccatgagtgtcaatttattttgaattagactaaatatttatgtggtaggaatacttattcattcaaaaatttcacatttaattagtttgaggttacctaaaataaaacaagtatatattctaaattcgttgctttttcaaaacttattataaagagaaattagaattaaagaagtctaagggtcaggcatggtggctcatacctgtaatcccagcactttgggagacagaggcaggtggaccacttgaggtcaggagattgagagtagcctggccaacatgatgaaaccctgactctactaaaaatacaaaaactagctgggtgtggtggcgcatgcctgtaatcccagcttcttggaaggctgaggcaggagaatcccttgaacctgggaggcagaggttgcagtgagctgagattatgtcaccgcgctccagcctgggcaacagagcaaaactccatctcaaaaaaaaaaaaaaaaaagtctaaggataagaaatatcaatggttcagatgatgaatttacatatatgtgcttgataattttttcaaaatttttacctgagctttattgaggtataatcgacaaatattatcttaggtgtacaacatgatgttttgatatatgtgcacattgtgaaatgattaacacagtcaagctaattaacatatctaccacctcacatagttaccttctttgtgtgtatgcctgataatttaattttaaaaaatcaatttgtattctattctagagaaatcatgccctaatccgggagaaatacgaaatggtcagattgatgtaccaggtggcatattatttggtgcaaccatctccttctcatgtaacacagggtaagtttgggcatactaaaaccctgtatttaggaaatgagaaaacaaattaggacttaaggtgagattgttagtttcatgactggtattcacagctagtagcaattaaaacaatccctctcctcaaagacccttcatcatgagctcatcacagttaaatttagtaaaatgggggcaagaaaggaagatttcttaaaccaccagaattctctaaattctgatttcagtaaatatgtgattcaatataaaattttaaatgtgattaataaaaaaatttgagatgatgatacttgcagaaatcttcaaatgttaaatactaaaccaatctttagttgacctaaataatgaatttgcatgagtttttctatatgcaaacaagctgttacaaaacagcatgagttaaagacattcctagtgtgaaagtattctaagttctttgataagttctctgtatagggagaaggaactcattcattgagtaccatcaatgtctcagacactgttgaaaactttacatttattttctcatttcatatctgtaaattaaataattctattttactctgtgtgtgtccctattctttataaagtaaaaatatcagtatcacttgtctcctatacgaaacacagatattggttaggtcatgaacacaaaatctgggaagtactttgaaccctttaaatataagtacattctattattctgtgaagcccatatttagaactcagaggtataaaatgttcaatcatctatgtcatttaaaaatgtttaaaacacttttatgctttctaacatattccccatgcaaataaaaaatgtacatgtcttatctgtttttactctttggatgtcacgtttttaaacttaatttttcttttcctttaaactactgtgtggacttttatcaactactgttttatattcacctaattgtgtagtaaatattttaagataataacctggagaatttgaggaaagtcaaatatgtgtgaatgtaacaaactcttttttcttcccctgttgctttaggtacaaattatttggctcgacttctagtttttgtcttatttcaggcagctctgtccagtggagtgacccgttgccagagtgcagaggtaagagttaaaaaatctaagcactcagattgtgaggctgagtactcaatgataaattaatttctgccccttaagaatattagcacagtgtgtatttgtagcaaacccacctttcaatatatgagtgctttgctaattttaagaccttttctagtgatgttccttcatttagcagctgtgaagataaaccagcaagttttctgagtcccaattcccaaattgtagaatgaggattaaaaacaaacttaggtttgtattgcacttggtcatttattgtctaaccattacttctaaagtcaagtatgataggtgaaagatttccgccccacaattttgtgtaagaaaatagtgtcaatcagagggtctgtaagacttgaccccatatcctaaaacaagtggcaatggaaggcatttaaccaggtctcttatttcaaacccagcatttttctaaaatccagtgttgcctacatgctgcttcttaggattaaaataattaaccgagataattatctagaggggttttaaggtgtgatatattcttatcattagagagataagcttataccgtcaagaagaaatactgtgtctgtatttgagaatcttctcaaagaaagatatggtgcagaaataatattataaatggatatatatccagtcaaatttatgtcaattagagacacatgtctcttggaaattgagaggaataaaatacatgcaacattttaaaatgtaggcttgctttctttccatccttctctctctccacacacaatgtgccctcctgcaaatgacttctgaaggccctattgtcaaaattattgataagttaaagtttttgtatgttactaggggaagaaaactagagtagatttagtgtaatttatcaagcatttatcgattgacactctggtaggcaacgtgtacggtcaactgacacgaagacaaataaaatgaagccgtgccattaaggagcctgtccctgccacacccaccatgtgcccttctttttgagatgtcatactactaccttttttttctcattgtagttgtttttaaatttttcatcattgctacccagtagcacctttcccattttcgttgtccagtaagagacattgtaaatgatagtaaattaaagatagaaaacaaggaaaagctgggccatatcttttgtttgacccaggcaacatgtcacaaagttcagacaaacagtctcccatctgaagccagtattttcacaagcacctgctgtgtcatgaatttgacagaaatgcaaacccactttatcttcctgcttgcacatctaggccacagccttgcttccctatctggtgtcttgaactccatgctgaatattctgatgttcatgttttcctccttgactcttctatcctctctgtgactcagcaaccactgacatctgcatcctgtaggaaagagcccctgttcttaagcaatcccagtgccttcaaatatccctataaggccttacttctttcaggatcattttgattttccacataacttgttttgaccataccaaaaagattgaatggaaagtgaattcttaaacaatgtactgcttcacctcaagtatgtagccctagactataaacacatgaggttgcttcagtgtccatgcgtgaatatggatacgaagaaggaaagaacagtggacacattcactaattgtctatagttatacagaaaacagaggtgctgctagtttacctctgaatagagcctcactgtcagaggacctgtttgcttatctctctgccaatgttttctttttcaaaattttagttgactgatggtatctgctaacctagaatcaatccctgctatatgactatcatgccagacccttctctttatcttaactccccacatctcatccctaaatcattgtgctttacctcctcaatctgtttttcaaacttgtgttttgctctccatctgtatatttctagcatagtttattattcctcctgtggactattgcaattagggccacccctaacattttcagggcccaggcaagaatataaatggaggtcgctggcctaagacccaccttgtatcaaatagcccttcctcttcccacactgtatgggttctctggtgcacataagcggacaactcagcctacatacccaagacatgtccaccacatccaccataacttgtatccaccctccattgtctgttgggttagaggtgagtatatcagcaggatagaccaccctcaagaacatggaccagtgggagggaccctctcaggccctggaaggggtgttggcacagggaattctgggtgctagttcctggagcatgttctggaatggaggagaagtcgtaggacaggctgtcattgagtatatgctatcagcctacaaacatcccaccaacaggggagaaatgcatccagaggagggccagagcacagccttttaaaatgtggggtttgaggcagcaatcttagttgcctgagttcaagagtgacactgatagcaatggcctcctgcctccattctttcactctattaatgtttcatccatattttacccagagcgatctgaaacacagatgtgacttagacatctatttcctccttagagcttattcatatctcctatcacttaaaaagcccaaattccttagtatagtgtacaaggcagccatggtctacctactgcttgacactcaggtcttgccttcatgttttatgccttatacatgcaaactgctgtggtttccatgtacctcttttttttcttttttttaaattgagacagggtctcactctgttgcccaggctgaagtgcagtggtgcgatcacagctcactgcagcctcaacctccttggcccaagtgatcctcccacctcagcctcccttgtagctgggactataggtgcacaccaccatgcccagctaatttatgtattttttgcatagacagggcttcctcatgttgtccaggctggtctcgaactcctgggctcaagcagtctgcccgcctcagcctcccaaagttctgggattacaggtgtgaaccaccatgccccgctgccccttctttacttagctatattttccttactaagagttagttccctagcccatcagaaagattcccaggctggctacttcgggatgacccttgcattttttattgaaatcatttctgaatcttttttcccactagcttttaagacataggaactatatcttgttcagctttgcgcttccaattataaaaaaatgcctggcgtgtgttaggcactcagaaaatgtttgaactgaaccaatggtgtgtgtgtctctgcacactctaagttagtgtaaatcagaacagcttgttgttgctgcttgttttgatccaagaccaaagagtgattgataaatgtgctaagtattttctgtgttcttaagtatgtttggtgtaacataatttggcatacacacatattaaattgccttcattcttaaaaaaaaaaaaaaggacaacaacatcatgcctttagattatgtggaaccattgaattttttctcagggtaactgccagggagtggtccctttttacagtataactaaaaaaacttctgcttgtatttattttgtaagttcagctgctcagtaagattgttttgagtgaagtctctgtgagtccatatgtgctaaaaatttttactctagaagtcaaaatgtaatcctgacatttaagatctctgctgtatccaaaatgatctatacttaactcttaaacatgctgcttgaattttcaactccttgcatttgctagcgtttccctcttagagtgaagagcaacgctttctccgctgttctctctcaaaagcatggtacatattaggtttaaactcaagttctatttccctgcccaagtcttctctgactacactgctttcatctctaaaatcctgcagcattcacttttcctagcaccgttttgatatgcacacatcttactataatttttcttttacatacatgttctgaatcttattatttctatgaattggtctcaaggttagcatttgtcttctacaccatttgcattcaaagctcccacatactaccaattacttaataggcatttataagcatctcttgttggtaatgctgaatttagaaaaatgatattttgatttctttaaaatataatctttaacatgttttgatcttatttgtaaaaatactttactagttttatttatttaaaagatgttggaattgttttttaagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggtaatcactttggatagttatatttttgctttattcttaccctcaggtctatatgtgggttgcagacattcaatgaaccccctaagaaaaaaatgtaaaatgtttacatatacatatttgtatttttctgtgggacacaatttttctacagcttctcagaagggtctatggcttgtatacacacacacacacacatactcacacatattatgatgtgtatatataaaataggcctcatatttttggcaaatttgcttacatttgctgttttataccatgttgctttcagtaagttaatataggtactttgtttatacaaagagatataaagtggtttattggagggagaatcttagattgaaggctctagatagtgatcatacctgttgcaacaactgggaaactcttgccatctgttgacttcactgaattaacattcaattcttttctgcctccagaatttctattattatccattctccttcatccttctagacgtttttctttcaatgtctttttatacccagaaggtactctcagaatccttcgaactgctttttaaatatattttaaaagaaatatttagaagatcagtgaagctggactaaacattgcctagtatcaataggtggcgtttaagtagtggtgaataccaacatgactcaagcatttgagtatttacttttataattataattgaaattttattagtatgaattttaaaaattccttattaaaatagatttttattataagtgttatacatagacataatgacataatattaaagccagggagatgagtacaaaatgggaagtgaaagtctcttctctatcactagtcctactcggagaggtaacaattttttacaaattcttttgttttattctagaatataaataaacatacaaatattttttatttattatatcaatggtgtgggtattcatttatctaaccagtcctctattgatgacaatttaggttttttgttctagtttgattttttttatgaactattattacaaatgatgctataatattcttgtacatctgtcactgcacatatatgcaagtacatttgtacaataaattccttgtagtataattatttataacaaaggtatgtgaattacatttttcatgcccattagtagcactgctttttaaaagactgtaccaatttagtctcccactgatacaacatcattgtggtgtttgcacctttaatgataatgattgttagggagatttgacaatgtaaatggtaaaaatttgtattatttgaattcatttaattatgaagtttagtgtgtgtgcttttttaatttggccatttgatccagttcatatttatttttccaagttttattaaatgatcagttatttagagcttaaaaaaccatatggaagtacccaagtaggtcatggcaggctgatgcttccattaaaacgactataaaatctcaatagattaccaaaaaattatattttttaaggcataagatacagctgtggaagcaacaaggtctgaatgaactaaaattcctgggggcaggtggtgaaggcaacccatcctgatgtaaggcagttttccctagggacctttgctgattctgaacctggactaaggattcaccttgacccagacaaaagaccacttctaggaaagagaaaccagcaaagctttaatggttatggagggatagggtaatacactggaaattgaggccctcaaatgcagaaccaatttttcctaaaggccatttgcaaattttggggctgcatgtgaggctgggaaggttgacccagagcttctaaagtacaaaatgaaatctctcagaacctgatggtatttggatagcatatacccaccagaggaacaggcttttatctagcataccacaggtctcccctttagcacatctgtgctcattttgaaactgtatagggaaggacattaggtggctgggagaactctgaaggacagacctggatctcctgccaccttccaaaggtgaaacaacaaaaatccgccaggctttcagtcagaagcccggaagggccactcccaaggaacagaggcaagagcagaagtagatggagtcttactgaaactgaaacccagctcaattcctaataggttgaagatatgattacctcaatgcagtctgcttatcagaaaggcatatcatatcatccggatggtttatatacaatgtttggcatacaacaaaagactgttagatatggaaggaagcaagaaaatgtgaccaaatcaagagaaaacaaaaccaaataaagaatatccagataattgagttagcaaatgagaaccttaaaataactgattaacaagtttaagatgataaaagaaaagagaacttcagttggaatctgcaaaaatggtgtaaaatgaatattctacaactggaaaatatctgaaattaagaacacaatagataggtttagctattcaggcagagcaggaaacagtattaggaactgaaagatcggttaaaaatacccaaactgatgcacaaagagaaaaaggaatgtgaaatatagataaaagtttgagacatttgagacatgttaaactgtgctaacacattaggaaaaagagaaagtgagacaaaaaggaagaggggaaggaggaggaggagaagagaaataggagcagaagaaatatttaaaatgatacttactcagaattttccaaaactgataaagtacattagccaacagattcaagaagctctctgactctaagctgaataaaaataaaaccactttagcaaaaaatctaactctaagctgaacaaaaataaaaccactcgtagcaaaaacaaacaacaaaaacttcaaagaagcaacagtataactgattactgctcagcaaaaaatgatgcaaaccaaaagacaataagaagaaatctttaaaatactgtaagaaaattactgttcacctagaattttatacccagttaatatatccttcaaaactgaatgcaaaatagagatgtattcagacaaaaaccaagaaaactttgcactagcagaccaaacatgcacagaatgagaaactaaaggaaattcttcaagtagaatgaaaataatgccaggtaaaacatgaaaatacaaaaggaaatgaacagtgacaaggataaatgaatactgagtttacaaacagtgaatgtaatgtcctgtggggtctgaattatacatagaatacaaatgcacaataacaatgcgaaaggcagaaagaggtaaattcatttaaaggttacacagttctagcagtactgaaaaggtggtaaaagtgatagtttgcataattgacttatagtctaataaatattgtgatctctagggttgctacaaatgaatgacagaagaatacataaatcacaagctaataaaagaataataatggatatttaatccaaaagagaacgagagagagagaagcagaaaggaacacagaatagatgggagaaatagaaaactaataaggttgttgatataaacccaagtatgtcagtaattatgttaagtgcaatttgaccaagattgtcagacttaaaaagattttaaaaagaacctagttctttactatttacaagagacacagtttaattacaagaacacagaatagttgaaagtaaaggatggaaaaatataccatgcaaatattaacccttcaaaataagctgacacagttacattaatatcaatgtatattttaagatgaaacagttcataatgataaggaggccaactcaacagtaatatatcataatctggaatctatatgtacttgataaaatagcttcaatctatatgtagcaaaaatggacagaaaaaatagacaaatacacactcatagttagaaaattccacacctatctcaatagctaataggacaagcaaccaaaaatcagtgagactaaagatctgagcaacaattaaacatatatacatatgagaccattgaatctattaggaccgatgacaggtatgttttttcaagtgcgcatgggctatttaccaaaattgaccctttgctgggctctaagctacaatacattgcaaaagattgaagttattcagagcataccttctagccacagtggaattaaactagatgtcagtaacgaaaagataactaaaaaattaacttctaggaaatttaaactctaaggtagtatatacattctctggatcaaaactgagaactaacttgatagaacaaagaataatttagaatagtttttatataggagggtcttagaatgaaaagttcataaaaaaactttacttatcttaataatgattatcattgtttgagtgcctgctaaatgctgttacctgctaggcgttttactcaatttatcccttatagcagcctgtgagataggttaggaggcagaaaaaaatgaccgataccatctgagttcctagggcatcccgtgtgtgatggggctggcaacagtcatcctggatgatgtaatctcttgcttcagggacagacactgtgaaatagcttactcaattatttcccttaatccttcctcaataataattactcaatctgttctgcttttatcctcattttacagatgaggaaactatagcttagaagggttagggacttgctagagctcactaatacgtggtgaaatcaggcttcggcactacccaatactgcctcaacaggggactttgtataagtgacccaatggcagttgggctctgaagactgaaaaagttgctctgctgttagatttatgcttttcagaatatgttcttaatgaaagtttcacctgacttgttatctagtctgaaatctaaagaggaactggtgtatggaaagttggtaaccagcacaagagaattaaaaggagttatttttactcagactcgagtatcactttaaacaagacgtgaaacaaaacaaattctcaggctcattaaggttaagtgatagaaaaggctgtgactgtctctgttggcttagttgttctagaacaacatcctgttgttctttagtattagcacaaaagataatttgggagacaaaatagagatgtgccacagaataagatcactagtgactctttgatttgtttatttcacaagaagcagcttaagcacctcagtatactttggtataagtcttctttagttacccataggtataatttatatcaaagcaaacgcaacttagaacttcagctccttgagaaatactcaataagagttggtttcctgaaagtcatacctaggtgtttgtggggagagagaaaggatagccacagagcaagcaatggctaagaatgttaatgtggccagcaatatttagctaacttgtttctcaaccttttctttcacaggaaaatctctaacttccaaggtcccaccaacagttcagaaacctaccacagtaaatgttccaactacagaagtctcaccaacttctcagaaaaccaccacaaaaaccaccacaccaaatgctcaaggtacagagactccatcagttcttcaaaaacacaccacagaaaatgtttcagctacaagaaccccaccaactcctcagaaacccaccacagtaaatgtcccagctacaatagtcacaccaacaccttagaaacccaccacaataaatgttccagctacaggagtctcatcaacacctcaaagacacaccatagtaaatgtttcagctacaggaaccctaccaactcttcagaaacccaccagagcaaatgattcagccaccaaatccccagcagcagctcagacatctttcatatcaaaaaccctatctacaaagaccccttctgcagctcagaatcccatgatgacaaatgcttctgctacacaggccacactaacagcccaaaaattcaccacagcaaaagttgcatttacgcagagtccttcagcagcacgtaagtccactaatgtacattccccagtgactaatggtctcaagagtacacaaagattcccttctgctcatattacagcaacacggagtacacctgtttccaggacaaccaagcattttcatgaaacaaccccaaataaaggaagtggaaccacttcaggtcagttgacactgttcaggtttactgagtatggatctaatgtgctatggtggaaatatgaacttgaccaagattgcaggattaaatggtctctaatttattgtagccagggtttttcatactaatactttttactttatttggaagcggacttggattgtactagggcaaatctttaaaaaaagaaacatttacaataatagagaaaaagactgtggccccattaaaaaaatgctaaattaagattggtaaaaaaaaaaaaattctgtttcctgtagtagttttagggagtcaacgaattattcaagaccccttcaaagaaccaaatatgtactgtctttaaggctgagtcctgggtctggttcattgatagagatccatccctcaaagtatgctaaggaatcttcccggattccctagagttgcagatctgctaaagcatctcaatagtgtcgtctaagtaattgaaaatacagagatcctttcaaatagttcgtattattacaaggctctataaacgataggttctcagtggcaccaagtaattgtgttttatctatagttttacccattatgaccgtattttcaaaatgattttatatatttcataattgttaccttgaagcctattttgccagcacctggatatttttaagaatttaaacattatggatgttatcgttaaagttcccttaaaacatttccccagcccatttttctccctctaaggcaattactgccctgaaactgatgtgcttacttcctgtctgttttcattcttatactccatgtttccataagtagtacataataatgtttcatatttttaaaataatttacagaaactgtgtatgtttcattacctcttagcactcagcattggttttgtggcttacattgattaatttagatttactatactaattttaattctttatgtggtttttttacttctttacaattttatgacttctcttggtctaaaatttctaggttgaacacgtccagtttttaatagggcaaggcaaagagaaataagcatcacttataaatttgttatagaactaactttattgacatatttccttctgtaaaaagtataagataatttaagacatttaaactgaacctgatgagtcaattataatatatcaatatttgggatcaaattttactcttaggtacaattaatttactctttcagggcacaatataaaaaaattgtagccaccacttactgagtatatactatagtgatatgttccgttcaccttctgtttgatgccactcgtctgtaccacaaccttgcaaagtatcttcagattgattttatagatgaggaattagaggcttagagattaattcatccagttcatatccagtgcacagtttaatcctgcactttttctgctgagtaatattgcttgttctaaatggcactcttgagtcaatgtgttcacctcgcttaggagagcagcttatttattgttataaatatgcttatctgaaagtaaatttatttttgcaatgccccatccgtagtcattgaaagatataaataataaggtgatatggcatttttgagttttgatatagtctgctaaaagggacttagtcgtcttatagtttcttgttagtaggattggatcagcaattatttactgtttaagttttcaaacatgtttcttgccctcaagtcctataaccaaatttaaatggcatttgttttggtaatcaataactctttatcataatttatatttacagtgttgattctgttgaacaggtatagacagtaatgtttacattctacttgattaagttaatgtgtaattgtttttataaatttataattatttcatttgtggaaatttgagttgctttcgagttttctagtgtagtttattgatagtatatgaaattgctagcaaatcaatgactttaacaaatttttgttgttaatcctttttttccccttcgtctgtaggtactacccgtcttctatctggtaagtttggctctcaggccattaaaagaaattgttttcactgtgggatatacaatccatattcctgggagataatattgtcttcttgtttttaaaaaaatgtatcctgcaatttatttttaaactttttagtatggaaaactttaaacgtcactcaaatagggaaaatagtacagtgaatcctcatatactcgctcggattcagcaattttcaactcatggatacccacttcacccacactccctggattatttggaagataatcccagacatcgtatcatttccttcataaacatttcactaagtaacctttataaaaacataaccatgtagcatacctaaaaaaatccagtaattccttaatatcagcaaatatttagtcaatatccaaacttccctgattatcttataattttttaattgatacataatgttttatatatttatgaggtacatgtgatattttgttacatgcatggactgtgtgattctcaagttggtatttggggtattcatcaccttgagtattatttttgtgtgttggaaacattttaggtcctttcttctagtgactatgaaaaatatatcacacattattgctaactatactcaccctactctgctattgaatattagaatgtaatccttctatctaattgtatgtttatacccatcggccaaagtctcttcatcctccctcctactcacacacttttctcagcctctggtatctaacattcttctctctacctccatgagaacttttttaggtctcacatgtgagtaagagcatgtgatatttgtcttttttgcttggcttatttcatttaatataatggcctctagttccattcatgttgctgcaaatgacataactttattctttttatggctgaatgtatttcattctatatatgctagatttgttttctttcttttcttttttttatttttattttttttttgagacaggttctcgtcctgtcacccaggctggtatgcggtggtgtgatcgtagctcactgcagtctcgaactcctgggttcaagcgatccttccacttcagcctcccaagtagctggtactacaggtgtgtgccacgacacccggctaagtttttgaaatttattttttgtagagacaggattttcctatgttgcccaggctggtttcaaactcctggccgtaagcgatttttccggcctcccaaaacgttgcgattataagtgtgagccactgcacctggccccacattttctttatccatttgtacattgatggacacttaagatgattccatatctttgctattgtgaatagtgcttcaataaatatgtgaatgcacatatctttttgatatattggttttattttcctttggataaatacccagtagtgggattgctggatcctaagatagttatatttttttatgttttcaggaacctccatattgttttccacagtggttgtactaatttacattctcaccaacagtatataagatttcccttttcttcacgtcctcaccagcgtctgttattttttgtctaaaaatggccattctaactgaggttaagaactgatagctcattgtggagcttgatttgcatttccatgatgattagtgatgagcagtttttcatatacctgctgagaaatgtctgttcatgtcttttgcccactttttagtgtgattatttgtttttcgctagtaagttgagttcgttgtatattctggatattagtacctttacagatgaatagtttatagatattttcttccatttagcaggttgtctcttcactctgttgattgtttcctttgctgtacacaagctttttagtttaatatagtcctatttatctatttttgtttttattgtctatgcttttgaggttttagccattaaacctttgcctagactaatgtcctgtagcatcttcctgatgttttcttctagtatttttatagttgtggatcttatgtttaagtttttaatcatctcgatttgatttttgtacatggtgaggggcagaggtccagtttcattcttctgtattttcccagcactatttattgaagaaggtatccattttccaatgtatgttcttggcacctttgtaaaaaaatcagttagctataaatatgtggatttatttctgggttctctattctgttccattattctgtgtgcctgtttttataccaataccatgctgtttttggttactataaccttatattttgaagtcaggtagcgtgatgctgccagctttgtttttgctcgggttgtgttagctctttggactcttttggttccacaatcattttaggacttttttttttctatttctgtgaaaaatggcattgatatcttgataggggttgtactgaatctttagattgctttggcagtgtagtcattttaacaataatagctcttccagtccgtgagcatgggatgtctttccctttgtgccctcttcgatttcttttatctatgttttgtagttttccttgtaggggtctttcacctccttagttaaatctgttcctaggtattttatttatttttttagttattgtcaatggaattgccttcttgatttctttctcagtttgttcattattgtatagaaatgttattgatttttgtatgttgatcttgtttcctgcaactgtactgaatttatcagatctaagagtttttggtgaagtctttaaggatttttttttacatataaaatcgtatcattaaaaaagagggacaatttgacttcctctattccagtttggatgccttttatttctttcttttgcctggctgcaagttaataaatgaaaacttggttctctatgagccaaatgaaacttggttcttcaatgaaatggaaactagggcttacagcattatgttgaatagaagtggtgaaagtagacatccttctcttgatccagttcttagaagaaaggctttcagcttttcctcattcaacagaatattagctgtgggtttgtcatgtatgacctttatgatgttaatatgcttcttctatgcctagtttgttgagagttttattgatttctatgtgttgaatcatccttgcatccctggtcgaaatcccacttggtcttggcatactaattttttgatgtggtgttggatttggtttgctaatactttgctgagaatttttgtgtctatattcatcaagagtattggcctgtgattttgttgttcttgttgtgttcttgtctggttttggtatcagggtaatgctggccttatagaatgagttagggaaagtttcctcctcttcaattttttggaattgtttcaggagaattggtattagttctcttttgtatgtttggtagcatttggctttgaatccatccagtcctgggcttttctttgtcaggagactttttattacaattcagtcttactactcattattggtctgttcagattttctgtttcttcctgactcagtcttgatagggagcatgtctccaagaatttattcatttcctctaggttttccagtttgtcaatgtataggtgtttataatagtctctgatattttgtatttctgtggtatcagttgtaatgtctcttttttcatttctgattttatttggggcttctctctttttttcttggttagtctagcaagtactttatcagtttggtttatcttttcaaaaaaacaagttttcactttattgttttttagtctctattttgtttagctctgctctgatttttcttacttctttccttctgctaattttggggttggtttgttcttccttctctagttccttaagatgcattgttagattgtttatttgaaatctttctacttttttgatgtaatcatttattgctgtaaacttccctgttagcactgcttttgctatgtctgataagttttgctacactgttgccatttctattttttcaagaaattttttgtctaatcctgaatttctcccttgacctaatggtcattcagaagcatgttgtttaattttcatttatttgtacggtttccaaagttcctgttgttattaatttctagtttaattccattatggtttgagaagatacttgatacaattttgactttttcaaatttattgagacttgtttggtatcctaacatatgttctattctggagattgtttcatgtgccattgagaaaattctgtagctattgggtgaactcttctgttagtgtctgttaggtccatttggtctaatgtgcaatttaaatccaatgtttctttgtgaattttttgtccagatgagctaatgctgacagtgggatgttgaagttcttaacaattattgtattggagtctatccctttagattggacaatatttgctttatatgtttgggtactccaggattgggtgcatacatacttagaattgttatatcctcttgctgaattgatctctttgtcaattatataatgacctcctttgtctctttttactgttttttacctaaagtctgtttcatctgatataagtacagctactcctgtttgtttttggtttgtgttagcatggagtatctttttccatctctttactttcagtcacaatgtgttttcacagatgagatgaatttcttgaaagaaacgtatagttgggttgtgtttttgcatccattcagccagtatacatcttttaagaggaaagtttaatctgtttacattcagggttattgatatgtgaggaattattcctgtcatcttattaattgatttctggttgttttgttccttttgttctctcttattattgtgatgtagagtttttctttcataacattttagtcttttctcttctttgtgtgtttgctctaccagtggtttttaaaatttctgtgtgttttcatgattgtagatatcattctttctcttctgggtatagcactcccttaagcatttcttgtaagccatctcatggtgatgaattccatcatggtgattaattccatcagctttcttttgtctgggaaagacattgtttctccttcatttatgaaggataactttcctaatccttggttggtagtctttttctttcagcgctttgagtatatcatcccgttctctcctggcctgtaaggtttctgctgagaaatccattgttagtctgatgggtttcctttataagtgactagatgcttttcccttgctgtttttagaactctctctgtctttgacttttgacagtttgagtatagtttgtcatggagaaaacctttttttttttttggttttgagacagagtctcattctgtcactcagcctggagtacagtggcgcaatctcagctcactgcagcctctgcctcccaagttcaagcgattctcccacctcagcctcctgagtagtagctgggattacaggtgtgtgttaccacacccatctaatttttgtatttttaatagagacagggtttcaccatgttggccagtctggtctcgaactcctgacctcaggtgatccacctgcctcggcctcccaaagtgctgggattacaggcatgagccaccgcaccgggccagagaagacctttttaaattgtatctacttggtgatctctgagcctcctgtgtcaggatgtctacatttcttgttagacttgagaaattttcctctgttgttttagtaatagattttctaatcctttcactttctcttcaccttctgagactcctaaaatttgaatagttggccactttagggtgtcccatatgtcatgtaaactttgcccatttttttattcttttttccttattcttatctgactgtgttatctcaaaagacctgtcttcaagttctgagattctttcttctgcttgatctagcctattattgatgctttcaagtatattatgtatttaatatttcatcaagtatattatgtatttcatcaataaattatttccagaagttgtttggttcttttatatgtatctttttttgataaacatctcattaatatcctgaattgtttttctgatttctttgtatttttttaaaacaaattttaaagtttgtatctcacctccctgagcttttttaatatcacaactttgaattcttttcccagaattttgtaagtttacttttgattgggatctgttgctggagaattattgtgttcctttggtggtatcatattttcttgttttttcacgtttcctgcatcctgaagttgatatctgtgcatctgatgtgatatttgctgtttctaatttttcaaatttgcttttgtaggggaggacttttcctgaagatgtatttatggtgtcagttaggtggggcactttggctttaattctgggtgcatgcagtagtgtagtttctgtatgactttcagctgtaaatatcatcagtggtatctgtcatttcctcagtgctttaggatgcggttactagtggagatttgctagggaataggatgccatgtgggccaatgttcggacccaagtgttggcagtggtgggctgagtttgcctgtccttgggcccagggtgatgttgctggcaccagtgttagcaagcccaatcaggccagttattgggtctccaggtggctcacttgggtgccagaaatggcgggtgacctggttctcaggctacttggcagcaagtgggggcatgggtgatggcagtagtagtggtgggacaaccctgtgggacacaagcagtctgtgccagtgttggctgtgggtgcggtgattgggtggatcagtttccaggtctgcaggtggcttaccagctgtgatgttagtggcaggttgagtgggcctgacttcagacaccaggaagagtgctcagctgctattggtggtggactggctgagcatccgggtacctgatggcaggcttgtgtactgagagggtgacgctgggccagatggacttgtcctcaggcctccctgtggtgcatgtgagtgctggctgtggtaggaagaggtagagtattcctaggctactggtggaatgcttaggtgaggacagtgtggctgtgctgtggaccagctacttgggacagcagtgttgttttcagttgggagcagccacagagaggtggctggggcacatgcagtttgctcatgcctcagcccaaagcagccagcagcagccatagccgcatgcactggaatttgtcctcagggaaccagaaaatgcctggctgctcctctattgggggtgtcaggtcgctgccagtggctcctgctttggcttaggcaacagtggccacagagcaagatgcagtctgggaggggctgggctctcaaaatagtcttgtgctgtggctgcttaggactcagtggtttatagtactcagtgtgaacttactctctggagtaatgccatcacactgtctccaggcagcttcctatgttagatctagagcctacgagaatcaagggactcctgtagctaggattgtgggagtcttcagagggaatgtggactgctggggttctctcacttactcttttcctgcattagggagtctctccaggcttccaggcaatctcagccaaacaggctgccttgcttctgtctccttccttgctttggtgcatcctgtcacttgtttgttaaattctagtgttctctctttgatgatctcttcaaaatgtgattatgtaattcctgcttaggtttctctccatggaagaggagaagaccagaggcatctagtcagacatcttgaagccactccccatgatactgtcttaggaaaacaatcaacatgtagcattcatggataccaaagggaaaatgggtaaacacatttttttttttttagacggaatctcgctctgtcacccaggctggagtgcagtggcgtgatctcggctcactgcaagctctgcctcccgggttcacgccattctcctgcctcagcctcccaagtagctgggactataggcgcctgccaccacacccggctaattttttgtatttttcagtagagacggtgtttcaccgtgttatccaggatggtcttgatctcctggcctcgagatctgcctgcctcggcctcccaaagtgctgggattacaggcgtgagccaccgcacctggccaggtaaacacattttttttcttccaccttttattttaggtttgggaggtacaggtgaaggtttgttacatgggtaaattgtgtgtcattagggttgagtgtacataatatttcatcacccaggtagtgagcttagtacccaataggtagtttattgattctcaccctcctcccaccttccattctcaaataagccctggtggccattgttcccttctttgcatccatgtgtactcattgtttagttcccacttataggtgagaagatgcagtatttggttttctgttcctgcattaattcacttaggataatggtttccagctgcatccatattactgcaaaggacatgatttcattcctttctatgtttgtgtaatatcccgtggtgtatatataccacattttctttatccagttcaccactgatgtgcatctaggttgattccatgttattgtgaaaagtgctgatgaacatatgtgtgcatatgtctttatggtagaatgatttttgttggtttgggtatatacccaataatgagattgctaggtcacatggtggttctaagttctttgagaaatctccaaactgctttccacagaggctgaactaattacattcccaccagcaatgtataagtgttctctgttttccacaaccttaccaacatttgttattttttcactttttaataatagccattctgtctgctatgagatggtatctcattgtggttttgattgcatttctctaatgattagtgatgttgagcatttttttcatatgcttgttggcctcatgtatgtcttcttttgagaagtgtctgtttatgtcctttgcccattttttaagggttggtttgatttttgtttgttgatttgtttaagttccttagagattttgaatattagaactttgttagatgcatagtttgcaaatattttctccttttctgtaggttgtctgttttctctgttgatatatatttttttgccatgcagaagcactttagtttaattatgtcccacttgtcaatttttgtttttgttgcaattgcttttggagacctcatcatgaaatatttaccaacacctatgtcagaatggtatttcctaggttttcttctagagtttttatacttttaggttttaagtttaattctttaatccatattgagttgatttttgtatatggtgaaaggtaggggtccattttcaatcttctgcatatggctagccagttatagcatttattgaatagagaatccattccccattgcttgttattgtcgacttcattgaagatcagatggttgtaggggtgtggctttatatctgggttttctaacctcttccattggtctatgtgtctatttttgtaccagtaccatgctgttttggttactgtagccttgtaatatagtttgaaatcaggtagtgtgatgcttccagctttgttctttttacttacggttgttttggctatttgggttcttttttgattccatatgaattttagaatgtatattttttaattctctgaaagatatcattggtagtttgataggaatagcattggatctataaattgctttaggcagtatggccctttttaaaaattttgtattaattttttttttttttgagacagagtctcactctgtcactcaggctggagtgcagtggcatgatcttggttcactgcaacctccgtctcctgggttcaagtgattctcttgcctcagcctcccaagtagctacgattacaggtgcacaccaccacacccagctaatttttgtatttctagtagagatgaggtttcaccatgttggccaagctagtctcaaactcctgacctcaagtgatccacctgcctcagccttgcaaagtgctgggattacaggcatgagccaccatgcccgcagtatggcccttttaaaaatatttattcttcctatgcatgagcatggaatatttttccatttgtttgtattgtctctgtcttctttgttttgtatttctctatagagatcattcacctccctggttagctgtattcataggtattttatccttttgtggctattgtgaataggattgcattcttgatttggctgtcagcttgacattgttggtgtatagaaatgcttctgatttttgtaccccgaagctttactgatgttgtttaacagttctaaaagcttttgggcagactatggagtattctaggtttaaactcatatcatctgtgaagagagatagtttacttcctctcttcctatatggatgccttttatttccttgcctgattgctgtggctaggatttccagtaccatgttgaataggaatgataataatggacatccttgtcttgtactggttttcaaggtgaatgcttccagcttttgctcattcagtatgatgttggctgtgggtttttcctggcggctcttattattttgtggtatgttcctttgatgcctagtttgttgatgacttttaacatgaagggatgttgaatgttgtcaaaagccttttctacaacaattgagatgatcatgtggtttttttgtttgtagttctgtttatgtgatgaatcacatttattgatttggatatgttgagccaaccttgcatcccaggaataaagcctacttgatcgtggtaagttaggtatttgatgtgctgctggatttgatctgctagtattttgttgaggatttttgcatttactttcatcagggatgttggcctgaagttttctttttttgtcctgtctctttgccagattttggtatcagtgtgatgctggccttatagaatgaggagtccctcctccttgatttttggcatagtttcagtatgattggtaccggctcttgtttgtatgtttggtggaatttgtctgtgaatccatctggtacagggctctttctggttggtaggttttttaaattactgattcaatttaagaacttgttattggtctgttcaggtatttaatttcttcctggttcaatcttaggaggttgtatttttccaagaatttaccatttcttctacgttttctagtttatgtacatagaggtgttcaaaatagtctctgagggtgttttgtatttctgtggggttggtggtaatgtcccctttgtcatctgagattgtgtttatttggatgttctctctctttattaatctagctagttgtctatcaatcttatttattctttcaaaaaaccagctttggttttgttgatcttttgtatggatttttgcatctcaattttattcagttcagctctgattttggttattttttttcttctgctagcttttgggttggtttgctcttgttttttctacatcctctagaggtgatgttactttgttaatttgagatttttctaacattttgatgtaggtgtttaatgctacaaactttcctcttgacattgttctggctgtgtcccagacactctggtatgttgtatctttgttttcactagtttcaaagaatttcttgatttctgccttaattttcagaatgccaaaagtcattcaggattaggttgtttaatttccatgttattgtatagttttaagagatcttcctggtattgatttatattttatgctgtggcctaagagtatggttagtatgattttggttttttgaatttgtttaaaattgctttatggttgagcatgtggtcaatcttagagtatgtgctatgtgcagatgagaagaatgtatatcctgttgttcttgggtgtaatgttatgtagatgtctgttaagtccatttggtcaagtgtcaagtttaggtcatgaatatctttgttagttttctgccttgattatgtgtctaacattgtcaatggggtgttgaagtctcccactatattgtgtggttatttccatctcttcataggtctttaagaacttgtcttatgaatctggatgatccagtgttggatctgaaaagagtaataaaaacattatcattactatcattattatttattgtggttattttatattttgaatgaacttctaagctaaaagatttatcttgaaagattccaactgttggaattcactttgttttaaatagaaataaatgtgtttcaaatgaaagtctgatgatttaatgatcacaaaagtgatgagtttaataaatgagttttttctcacctgctcaatggcactcaatgaaggtttgaaatgcctttttttcctgaaattctttaagtattataccctttgattttctagaaaactttccttagtcggcattccagcttgtgttaaaaaataaagaggaagtccttccttcttaaactggacatatggcaacattttttgtgtgtgatttcatatttgtaggacataaacctgaaaattatattcattaaatttattatgtgaatgaggttactcttctttaaagataaattaactctactgcaagaaaattgtttcatcaattacactgcaatgtaagtaaaatgatacagatgatctttgaattttggaagtatttgatttttttttcctattctgctaaggaagaaagactgactaatgttacagaactttctaatttgccttgtaaatgaagcatgtgttgtgaattttaaatcttttcttccgttggctttgtataagtgtttcccaatttttttttgtggggggtggggggtgcgttaattcttgctctcttctcaccaaagacctttttagacatttttttttgatcatcctccaccacacatatactgtaaatcagtttatgtatcacatatatatctgcactctgtacttaaaaaaggaaaatttttttttaactttcatcaggtatcacccccattgagaatgcttgctttctgttggttttgtttttattgtttttaaagacaaaatcatatagaagaaagagcttaacctctggagtcaaaccagtcggatgttggtttgaatcctgtttttttcacttagtaattattcaacccaagtgattaagtgattaacttaatctctctgagactcagttttctcatttaagagatagagattgtgattcctatgtgaagtatttgaagcttaatgtgattagtgggtatgaaaactccaagcacagtcctaaaagttgaataaatattagcttaaggaagtcactgcatgcaatcactattattttcctaagctggatttctgataatttcatcactccctctggccacaccaaagaataagaacagtcttttattcaggtaatatttacatgttttctctgtggcaagtactgtactgattttttttaatgtattatttcatattcttctcacaacaatcttataatgtagcatttttatcccattttcagctaagataactgtggttttgcaaaatttgtaacttgcctttcacagagctagtaggcaataaatagaggccgatgactagtttctctattaccaggtttttttttttttttttttttttttggatgggggacagggtctcactctgtcacccaggctggtgtgcagtggtgcaatctcggctcacggcaacctctgtttcccaggctcaagtgatcttcccaggtactttaaaagatagaaagatgctcatcctagtgacagaccaagagacaatacaacccaaattggacaattaaggtgccgtgattccctacaagtattgctttattcccctctgttgccaaagtcctatactgagacattcataagtccctcatggggactaatagatcaatttaaagaataataaataagaagtcaggaaatattcagtgaaatatagaaaatattttttctgtatcccctaacaattgtgtacttatttatcctttaaacttgaatatggcatatattacagactagcccaaatctaaatgtactttcaagagtcttgactcttaagtagctatttgaagttaataagatgtggttacaggggtctttatgtcttattacatgcccctatacatgacaaacttaagtcccattataaagtgacatcagttatctgcctgttattcaggtttaagtcagataatataatcatataatctttctgtgatacgtttagtctggaaaaggaagtatgtgaatttcccttattaaaaaaattgaagaaatacagaggtacagaaaatccaacgatgatggcaagacacttaaagggtcctgtggatgtctctctgaggaagcagagttgaatctgcatttacaaaatggaaaatttaagggttactcaagcatactgtttttcaaatcatctacgaaaatctcttcccagggtgccttcacttgtccacaggccctttattctgttacattaagtatgatataagcaagaacaaaacctttccataactttttgttttcatagcacatgcattgcatttccactttgttagctctgcaagttagaccttttgaagtgtctgggtcatcccacatttcttcaaaaaagatgatgtgcatcctctaggtcactccagttcttggaggtaggtagatagaattctaagttgggttctttggcagtgaagatgataccctatatattaatgtagtatctgtctaatgtaaattttgtttgatgaatatcaggtattttattgaaaatatttcaaacagttaaaattatggcctgaatctggggctagaagtgagtttttctatggcaataaactgacttaccctttcttggtctcagttttcttatctggaaacaagatattaagtgcaatttaataaatatttgttaaacactttctactgtttgccatgtactgtgttaataatgagaggtgatcaaatgagataataggtggcaaactgctttgcaatgttttcaacactgcaatacagttctacatgatggggaaccttactaaaatactccttttgtgggggagaaaacctttttctaacattatgttattttcccacctaagagctcttcagtttaatcttaggaacattggaatcataattattatttcattcattatttcatactttcatttttcccaagttgtataaatcttaatgttgattcacctttggttttctgtagataccaagtgaattttgagatcataaacagttgcctttgaacctgaaagttttgtttctaatttgggagataatatgctcttattaatttactgagaagatacgtagaattttgtttttcatatttctgtgttttgccttggttttctgttaaaccatcagcctctacactttcttctagaactatgtatatgtgttgagcattgttctgggaatagccttttacttctgtcatctggatgttctagatcactctgaattttctgtcttgatttagtattcaaataaaaaataagatattgaaagtggtggaattagtgggaactggtgacagaaagggggaaacccaaaattttttaggagctgtgatttatttcatggatagtctctctaagttaatgatacaattctaggggatcagttaaataaacttctaaagtaaaatactgtaaaaacttacctgtggtagaaatagctgttttttaaatcacaattttcacatggcagtgcaattgtacagtgtctctattttgctgatttggagccaaatacactcattagtcacgttagattcagttactattctagtgtcatctgtcatttcctttgtagtaaagaccaatagagttgagtccaaggacactgggcagggttggtgggggtggtggtgggaggggggctgttggtgaggaaagagagaatgaggatggtgagagaaaagggcaaatgggtgcatttgagaagaaagattgtgtaagctataaaaatgatttgatgttgatcaacttatttgaccaattatttgctgttgttcagctcaaaatagtgctttgaatcttaaaagtgaatataatttttgaaatgaaatttaatctaccatagactgaacactaaaaagcatattctgtaggcaaagtaaatatagtttgccctccaatctcagatgataatagtacaggcatatttcctgtgatggagaaatgtctacatatctgttatatctactgtaaactaggtaaatgtccttcccattaaccacatatgttaatgttcaacttccttctgagactcaatttactcatctaaaaaatgaaagtgaactctaagatgctttctagctctaaaataacataattctgtcaccatatttgaatgctcaacgatcaaaacatttaaaatcgagcatgattgggttgaaacacttaagaagcctctcaaacctgtcaaaaaattttatttgagcattgtgatattctaaatatatttcttcctttttctttcgaagaaaacaggacaaataaaacatgcatttgtcaaaaatttgtgacataaggaagccatatacaaaatgcaattaatatctcctatttgtaactcacttcataaccagtatgtatgtcattgtgaaactataatgtaattttaattgctcatgtttctattaactgtgttaccatatcttttccccttcaaggatttcttgctggtactctattaattggtaccctaattctagtcattggactatggaaaatcagagtgagcagaaattctgatgatttttaaaaatttattcctagtttatttccagtaaaatttggtactgtatcagtagatgactctcttagctttatttaaattttggcgtgtctctgtattcatttttgtctgtaattactatcctggattaacagacttcatgtctgttttttctcaatatattcaaaggcgcatttcaaagcaaagtgacttgaagtctcattttgtgatctattaatccactgatttttttccactcagtgtaatttatgatagtatctagtgttgcacagaagcaaagaaatctaggaaaaatcaacctctaacatactgtgaaattgcctgtgattagggctttttctcacttatattaatagatgccagtccagctcaaaacagcacagtggttaaggcagcagacaaatgggggaaatatagtacctacctcatatgattataatcatatatcaaatgagttgccacctgtcaagtgcttagaacattgcttggcacatagtaagcactcagatattaaaacaacaacagcacacacacacatcagtattatttaaaatatctaatctgcattgaatatacataatgttaagtataaatgtcacgattggctctgatgtgtcctgtagacagatgatgatttaaatcgaccctcttctgttttgtagttttaactgttcagaaaactagttgtggaatttatacaaacttgagttatttctaagctgccctaatgcctgtccgtttttcccattaataagaaaactattaatttaatgctgttattaaattgtctgttttaattctttagatgatgtgacctatctcctttttaccctctacaatttttctacttaaattaagaatattacttaagcctattataagttaaagcatgtaaatattctttaactcactaaatgagtcagtcttgtagaaaaatatttgaccattaggtccaggggagtgattaataatttttacaggcatttgtttaatatcaacaaaatattctagctgtcatgatagcaaatatagtaagacataactttttctccagatatatcagaaacgttttaggaatgtgatttagagcctagcaaaaactcacagttagtactaagtcatctaaagtgagttggtatggaagcatcagcaaagctactctgaaaaaaaataaaaccaccaatcttacgtactttcttgtacttgttccaactttccttttgaaatactgttatcagtttatcaagttataaagtatcaatgtatagagtattatcaatttaccaaagctactgctttgagactccctggatcggtgggaatggagactgggcgggggagggcggagggcgggcgggggcagggcagcaagatgtgataagtttaccaggtgctgtctcttggctttcatcagtttctttacatactttggtaaggtgattggctgtgatacttgtatgtcctattaaggacataaagtactggaacatcgaaggagggaatacagtaatttctgcttatcctcggttggggggcagggtgtttcaagaacccccagtgaatgcttgaaacaacagatagtgcctaaccctatatatgctgtgttttttcctgtatgtacatacctatgagataaagtttaatttataaatgaggcacagtaagagattaacaccaacgaataatcaattagaacaatttattgtagcaaaagttatgtgaatggggtctctctctctctcaaaatatcttattgtattgtactcacctattttcagattgcagttgactgtgggtaactgaaaccacagataagcagactaatgtatttgttttgaattgtattttggggttttgcagtgaacttaattgcttattttctgaattagagggaaagtcatgcaaactcctaagaaagaatttgtcttttttatgtgcacataaaaaacactccacttgctttattttggaaacataagctgttgagggtaagagctagctttatatatgtttggctagcctcctgatttcatactgatttaattaaatatttgatcttaattaagacaggatatagttaatgtgcaagtgataatgtggtttcatttaatgattcttcatgtttgcctatcagaggattgatttatttcttttagaagagttaggtctgtatgataaattttagtttagggatggaagtgtaagcagatgcctgacttcgttttttgattgaaatgacagttacataattcaattcaatagtttttttcttctctactattcagctcttataatgcacatgagagcaacaaagtactcaatgttgtgtttgaccatttaagtgtgactggtggtacctcagaaataagactttctggtaaattataaaaggtatatatggtttaataaaattacatttctgtatcttgcaaaatatccattaatacccttggctagggggttcttcatgacttttaaaggataatagaggcttaagtctctgtcactagagttgtttttttctttgttgaatgactaatacattgaatctctcattactatgacatatcgtcagttctggacttggtagcagtaatgcttatcatctcatcctacattttgaactcagtttattgtaacgattagatgctataatgccacaaatattcggggggaaagggatgatacattaggacttttaaagagaatgccttcattatgataatttgcatcatgagatggttgacctaccttgtatttctccttttgcttggtggcttttagagttttcaatgtttaagaaaaattataatatgtgctaagatatccttttataggtcatgtttatagatcttaaaagacatctcatatctttatacaaaattatcacacaaaaataacttggtgtaaatgtatctgtaaaactttctgagtgtcttcatctcttaatcttctcttccacatgtagtagtattcaggggtttttatttatttttatatttttttaacatctcccacacttaggaattcattgacttttaatctgaaggtaccttaattcattctagcttagccactgttcaactcgagaaactaaaaactccacgtcacattttagttgttgctgtagctgataaaccccacctgtagaatcttgtccatattctattactcattattttttttgttttgcaccccaaattaactgattctttttggtgatttatcacatagtaactaaaaatttatatttatcactagtaaataaaatcattttgattttaacttttttttttttttttttttaattttcagggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggtatcatgtagtatgtgaaatttattcttaaacgtgactactttatttctaaataagaaattccctacctgcttcctacaagcagttcagaatgccatgccttggttgtcctagtgtgaataattttcagctactttaaaattatattgtactttctcaagcatgtcatatcctttcctattagagtatctatattacttgttactgatttacctgaaggcaatctgattaatttctaggtttttaccatattcttgtcatcttgccaattacattttaagtgttagactagactaagatgtactagttgtatagaatataactagatttattatggcaatgtttattttgtcattttgcttcatctgttttgttgttgaagtactttaaatttcatacgttcatggcatttcactgtaaagactttaatgtgtatttcttaaaataaaactttttttcctccttaa

SEQ ID NO: 1603 - DNA, 39495 bp, Homo sapiens; identical to SEQ ID NO: 1602

SEQ ID NO: 1604 - DNA, 33470 bp, Homo sapiens
ttagaaggaaaagagattttgcgttatattttttaaatgaagcaatacaatcattttttatgtatatatctagttgaggagaaaaaattacagattttttcccccttactccaagataatctaaacagattttactctggatggcttaattataacataatccatgaagttatagccagggggttaaataagaagttgatgacaaacttggtttctctaacaagtatgcaagaaaactcaagtgccacaatgaacacccataaactgctgtcaggaggcaaagtccctatgaggtaataataaacccacgaggttaaggcaaaaccctacggttgtttctgcaaacaaatgtccaggaaactcaagtttgtgatgaaagaacagtcttgaattcaacttcagcagaacctttccctccctgggctccaaagcactatgtcacctacctctccactcaaatgccccattaagtaccatcctgttggagcttcctaacgcccctgctccctggtttcatttggaaccaactgagagacacaagtccctcttcgttgatcagggtcagttgaaagatgtagctgtcggcctggtagccaggtgggcttgctaatcctgcacctctaccttaagcttacccagcgtgaggccaggttagaaagtcacaggccttggcagcaggcagagagcctttactgtcatagtgaagagcttgccaaggacaggactgattcttcctccagcctcacctatcggggcagtcattgttccgctgtcaggaggagaggggccagaagggtcacactgaagaaatgtgacatgagggtggaggttcctgtccagcattcttcactctctatttaaccgaggctgactcattgcagttggcactaattttccattgccacagccctctccagccaggagggcctggagtacctgaggtgctgtttgccgggttcccttggtcctcagactgctcccttcagagaaagcacagaaagccttctctgtcccaaggagccccccttcccctcccccactccagctctgcatctggacacactgtcagccatcagatcctgaccaggtgctcagcctctttagggatatgtcacaatttgccgtgcccggtggctctgggcagcctttggacatgtagtggttgtgtcttggaatacaagagttgtgcctgaatctgggactctctgtgaccctgggaaaatcacatcagctctctgaaccccaattgtctctgatctataaaatgaagacagtatctacttcataggattgatttgatggacatatgtataagcagtgccagggacaactagtaggtggtcattggagtgtggctacagttattatacagttacacatggattccttgattccccattaagccctggtggatgaatgaggaaaatgcagcagggggtccatcctagaaaacccaacccactccagataatcgcgccagcctcacacctgagaagctgcttctacgacctgctgaggacataatgataaacacacacaagaggctactgtgtcccaggcacttgtcttaactcatttaacttttctaacaaccctaaacctagggttctcattttccagatgagaaaactgaggcatgtaaggttaagtaacttgcctgagggtcgccgattagcatcagagccggcatttcaaatagacaggccagctctagaggccagggtgtttggacagcctccaaattgtcaccctagccttcagggcaaggctgcacacacggcctctagtctcctacccctcttcctggcaggaggctggctctgacaggaggttgtttgtgccacaatttaaggaccaagctattctgggaagcccagaacagtctttcctttattattcatctcaattaaccattgtgttggtctggacttgggggtgcaggcattcccatctccctttcaaaaaagtttctaaaaaatgcagagcagcctttattcttgttttcccaggtaaatgtggtcctatgtacttgcagagtaagaatttaaaaaaataaacctgagaggtagtttagtggaatagggagtacagaggcctggaagatgagggagctgggtttaagccccatcaaccggcatcaactagccatgctaccttgggcaaaataaccgtagctaacacttagtgaccacttactgttgtgcgttctcatgttatcctgacagtaacacttatagggtaggtctgtcagaattttctgtccacaagcaacagaagcttacactgagaatttattggagggctttgagacagctcatgtaatggaaagctcttaagaactaggtttagaaggtgcagagaccagggcaacttcagggatccaggtagcaggaaggaatcggtagcctctttggtatggccactatggtggtagacactgtctaccttgtttgctgagtcttctggctttcttccactcttcctgctcttggacatcagactccaggttcttcagcctttggaatctaggacttgcaccagtgggttggttgccaggggctcttgggcctttggccacagactgaaggctggctgcactgtcagcttccccagttttgaggtttttgaactcaggctgagccactactggcttctctctaacccagcttgcagacggcctattgtgcgacttcgccttctaactgtgggagccagttctccctaataacctccctttcatatatacatatatcctactaattctgtccctctggagaaccctaatacatgaattataactctaagtttcagttctggccatagcattatgtcacaccaacaccagcatcaatattttaggttgcctaattaatgtatctgtaaacctatagccagcttgggtggggctattgagagtcagcaccagcactgatcatatataggatcagcctactggggttggccacgttgtatgtagctgcgaatagcaaggaggggaacagcaacatccctagggaaaccgatcacagaaaggcagctcactaccccacagtaaaaagaaccttgagtttcccagttcagtcccctgctgggtgcatgctacccccctcctctcccagaggctctggacctacacagctgctgaaaaagagaaaatgtccttacctacaatgaaccatcacaggcacccacctagaaattaaggtactgtggtcatttatcttatcccagaataacaggagtgtgtataaacaggaagctttagtttagataaataagattatccattacaaaaattttatattgaataacctgtaagtaatttgaaaaagagacttctggctagttttcacttatgtccaagtcagtgggggtaaatgcattgtgattcactgtaggttttagactcttacagccttaacaaccttgtaaatccataactagcatcttcctatctggcagaccctttacaaatgcattatctcaagcctcacaacaattctttgaggtagacatagaaagtgaaagttcagaaagggtttaaaaaaaaaaaaaaaaaaaaacttgtccagagacatagccaattagtggaagagggtttgaacccaggttcctaactacaaaatccacgggtttaactgctgctctcctgaaatgaaatatctacaagaagtagcaggcattgagaaacagatgggaagatagtgttttgatatgattttctgtttacaggaaggcctaactacgtcctgttcacctcatgctattgggtaactttccagtaaaaaacaattgcactttgttttcttttccaaaaagaggcagaaactgatttcttcaaagtaaaaaggcaccagggacccattctagactttccaaagctaggcacatattaaagagagtatacaaaataggcagagaagtagacttgctgacctgaggagctgagtgggaagcatggacttgccaacttacctaagtgaccttgagcgatccagctaactttgcatagtttcctcttgtgtaaagtgaggtgcaagtacagatgaaaatgtatataaaacatagagcttagaatcctgtaccagaaagctgccctcatcacaatgaatgtcagtcagtactagctccagccagctgctcagcccatcaagaatccctcagggggatctgttagcattagttcagatctgttggcagcaacagaaactaatgcgagctagtagactttgaacactgctaaagaacttaccaagagaactcagatgtataaaagtggttaattctgtcaagaggcccaaagtcttgggcaggctcttattttttcaggacacacataagacatgggggctaactgcaaggacacaagaaaaatatacccataccttgaagcccccagtacattcaagaccaagtttggcaaatagattagcatctttcaggaaataccatgagctccacttatctactcatcaggtgttccttgcacccctagctcatccccccaaggggacaatccaatgggcttatcaccacccaatactgaacactatgacagttcctgtaaatccagatgagtggagggcacagggtattggctctcgagcagagagccagtaggcatgactggtgttcgattcctaactcccctgctccctggtttcatttggaaccaactgagacagacacatgaatccctcttcgttgatcagggtcagttggaggatgtagctgtcggcctggtagccaggtgggcttgctaatcctgcacctctaccttaagcttacccagcgtgaggccaggttagaaagtcacaggccttggcagcaggcagagagcctttactgtcatagtgaagagcttgccaaggacaggactgattcttcctccagcctcacctatcggggcagtcattgttccgctgtcaggaggagaggggccagaagggtcacattgaagaaatgtgacatgagggtggaggttcctgtccagcactcttacactctctatttaacctaggctgactcactgcagttggcactaattttctattgccacagccctctccagccaggagggcctggagtacctggggtgctgtttgcctagtactataaatgtctttacattacagtattgcctttgggtccaggcactcaaccttgtctatggcatgagtcacagcaactttttgcagaaagcaaccccaaagtttaaggccatttatatgacccttgttgatttggacagcttaacagccccatctccccatttagtggcactcagattttgctttagaggactaccttcttcccagtgtagtctggccaaaaagtgggtacatgacacaagatagcagtaagccaatctcatcctagaatctcaatcctgagagaggcttccaaaactgtcgactcctggctttctggagtgtggctgaattccccacccccccgcccccaaaaaagttcccagaaattcattttctgcttaaattcatcaaaattgtttctcattccttagaactcacatgaaatgagcttctttgctcagccggtggctgtgggcatggtcagtacttcctcaggccaaaaaaaaaaaaaaaaacctattgatgtaaggaaagacactgagctaacagagaacacagagcaccaaggtaatgctaagttttgataagcaagtttctattttcctatgttcagggaacggcatcaacagaagaaagctggcactgctcaggatgtcttctttcagttgctaccattaagcatactgcatatccttttcggccataaccacattcacccacttgttatatttcattttcagaaaagcatcattcattgcactcggtttgtccaacagagtataatcaagggttttttttcaacattaatcaagaaattcctccatctgcaaaagtcagcctatgccattaaatacagccaagatcataaaatacaaatgtcattaggtctactgaatcttgagattcattcactagaatacacagggaaaaggaaaaagtttgcccttgtgaaaggtgtgtatcattttttagaagagcttctgaaagcctcaaacatctgtgagtgtgctaagagccgttacaaaggtattttatacaatctatgctgagtcagctaggagttagcaggaggctggatgcagatggtaaaacatacccctgcagatctgttgttattaaggatgacctttggaagtctcaaactgtaaccacaaagggtgtccccactgcattcatactatatacacacatacctgaactgcctttctaccagtaacatttaaaataagcacacttaatactgccagtcacatgtagtagagtgttcactctgtaactgtgtgtggcaaagccaagatatcctaccattccaataaaaaaaaggcaaggaaatagctttaacacaccattgatgtatgctattacacttttccagtggaagataacaaagcccatataaaatttaaagacagaggaaaaactcgattttcagccacttgtacctctctaagttttcatgccctgctatctggaacacttccccacttccctgccagaagtcctctagctctgcattaaggatcttgttgtccctgactgacacccacatatggaacatttggcatgcctccatggcaacacgggatccctgaagtttatgaaagcgttccatgtgagagaggatgctcatatactcctgccccaccctccaaagatgtactaatgatgctaactgactacatccaaggagccagaggaaaaataatctgagggctgcagagaacccactcaagctgtcactgcaaagctggtcttcccaagagcaaaggaggaagcatgcaatctagttcaagtcacacctacttcactcttagacttcttccttcaagtggggcttccctgcaaacaggactggtcttcaaagtctcccagagcccctctatcttagccaggttgctcaagctaattttattctttcccaacaggatccatttggaaaatatcaagcctttagaatgtggcagcaagagaaagcggactacgcaggaacggggagtttgggagaagctctcctggtgttgacttagggatgaaggctccaggctgctgccagaaatggagtcaccagcagaagaactgttttctctgataaggatgtcccaccattttcaagctgttcgttaaagttacacaggtccttcttgcagcagtagtacgttagctcattttccctcaagcgggttgtgacgtcgttgaaattgcaatgctcaaacttccaacacttgttatacacttgtaaccctgtggggagacacacacaagggtaagaaagtaagtgggaagagttctgtatctgcttttgaatcctcaattctatttcgtatgtatcctgtgcaagtagagacttctaggcaagatgctcatcccaggtgggttgtaaaggagaacaattaagtaaataatgatacacctctaaatagagcttttacagaaaaccaaggtctcatcagagccagtatagttatgggggtgggacggaggaggaacaggcatttatactgttaagagggaaatttggtaatatctgccaagattttaaacacatgccccctttgatccagcaattccacttttagaatttacgctatgaagttacttggggattttttccttttcttttcttttttttttttagagagataaggtctcactttcttgcccggtcatctggtcttgaactcctgggctcaagtggtcctcctgcttcagcctcccaaagtgatagaattataggggtgagccaccatgcccagccaaagctatgtataagatatatgctcaagaatggtcagaaaaaaacctgaaaaacccagtccattaatttttaaaaagtgttaaagaaattacaatagaattccttacaatgcaagttccatgcagataagaaatgacgtgggccttcaagtgctaacatggaaggagcttgatttaaaaaaaaaaaaataaaggtggggggggggcagaaaaataggtaaactggactccatcaaaatttaaaacttttgtgcttcaaaggacattatcaaaaaataaaaagataactcacagaaagggagaaaatgtttgcaaatcacatgtaaaccaccaggtgcggtggctcacacctgtaatcccaacactttgggaggctgagatgggagaattgtttgaggcgggaagtttcagaccagcctggtcaacatggcaagaccccctctctatttcttttttaaagtcatatgtaagagcatagtatccaggatatagaaaacattcttaaactctacaataaaaagactaacccaattaaaatatggacaatgaggccagtgtgatggctcacacctgtaatcccagcactttaggaggctgaagtgagaggattgcctgcggccagcctgggcaacatagtgatatcccaactctacaaaaataaaaaataaaaaaattagccaggcagggtgttgcgcctttagtcttagctacttgggaggctgaggcaggaggatcacttggactcaggactttaaggctgcagtgagctatgattgtactgctgcattccagcctaggcaacaaagcaagaccttgcctctttaaaaaaaaatgggcaaaggatttgaataaacatttctccaaagaagattctcaaatggccaataagtacatgaaaagatgcttgatatcattagtcattaggaacatgcaaatgaaaatcacagtgagataccactttatactcactaggatggctaagatcaagaaaatggtaaatagcaaatgttgcaaggaagtggaaaaaattggaaccctcaaacattgctggtgggaatgtaaaatggtgtagatactctggacaaatttggcatttctgcaaaaagttaaagatagagttatccatttgactgagcaattccactcacaagtgtatatacttctgccattctctggaaggattcccaagtaatttaatactgttatcatcatggaagaatacacttcgtttatgtttctattgagtttttcaaatttgccacatggataatttttaaaatatttgaaacttcattttaaaaatcattagattattcagtaatacaggaaaagtttctataagaacatgctatcatggtctcatttttggaaaaatagccttgggcacacaggaaaataaaggccagatgtatacactccaagtatcttatcgtagtttgaattgaaaactacgttcacacacaagtttccacatgaatgttcatggcaccatgattcaaaattgctaaaaagtggaaacaacccatatgtccattactggtgaatggataaacaaaatgtgatatatccacacaatagaatactatgtggccacaacagaatgaagtactgatacatgccacagcatgagtgaaccttggaaacattatgtttagtgaaaaaaaagctagtcgcaaagtgccacaatactgtatgattccttgcatatgaagtgcccaggagagccaaatctatgaagacagaaagtacatcagtcactgctggggcatgcaggagggaggaatgaggactgactgctaacaggtttcttttcaaggtgacagaaagatcctggaattagacagttgcgataagtcatacaaccttgtaaatatactaagagccactgaattatacactttaaaatgtaaacgttctggtctgtgaattatatctcaataaaaaccctagatgcagaacagtgtatagaatgtgacccatttgtggaaataaagcacatatacattgaggtaagtgcatttatttttctctggaaggattcccaagtaatttaatagtgttatcatcatggaagaatacacttcgtttatgtttctattgagtttttttaatttgccacatggatgatttatttttaaaatatttgaaacttcattttaaaaatcattagattattcagtaatactggaaaagtttctacaaaaaacacgccatcatggtcccatttttggaaaaatagccttgggcacacaggaaaataaaggccagaagtatatactccaagtatcttatcacagtttttttaatattcagaaaaagcatgttaggtgaaaaatgtattagttgagagagtggtattatggtagattttcttctccaaaaataactgagtgcctgtgtgctagatactggggtataagaaggtatttgtccttgccctgaaagtggtttcttatcttctgtgctggaaagaaaaaaacgcagatgcatacttccttatttcaggcttgtagctaatttacccaattccatgcagagcttggaacacaacacttctcagtttataactgcaggcataactgtcctgtcctcctcctctgaggggatgggtatctggattggaatttaatgaagtttagtcaagtggcagagtccacatagagtattccagaaatggctctagttgctgaagtcttaactaaataactggaagcttctaatattgtactagaggctgctggtgattcagacaagttactgctttgtaacagtaattacgcattggaacttgaaaagctttaaagctatcagaattttaattagggaagcctagaagcttggggagaacagacagtaatttatgaataattgctaccaattaatcatttactatgtgtcgtgcagcgtaccaaagtgctttacttgaattatcatattcaaacaacagccttaacgatggtaataatctcaccaaagccagccttggaattatccacataaaagtggcttatatcagaatccctggagtgttacaggttttctcctcctcactctttttgaagacttcggctcaagtctatctaaagtcaacagtcttcagctgtcctaggcacccttaaatgtggcccttgttcagaacgtcattacagcagtgaccacttgacactgtcatcagaggctccttcaagactaagtacatttaaccttgcttacacttccatggtttatactgctaggatgccagtaaatattggttgaattagcagccaacctgtctctcttctagacttactttgtatagcaccatcatatctgtctctgtgcaaacgtcatagcgtgtagttacacaaacttacatggaatagcctagtacacactcaggctatgtggtatgtcctattgctcttaggctacaaacctgtacagcaagttactatactgaatactgtaggcaactgtaatgcagtggtaaatatttgtgtatctgaccatatctaaacatagaaaaatacagtaaaaatatgacacaaaagattttaaaaatggtacacctgtacagggcacttactgtgaatggagcttgtgagattggaagtcagtgaatgagtggtgggcgaatgtgaaggcctaggacattgctgtacactactgtagatgttttaaatattgtacatttagtccacactaagcttattttaaaaaatcaaccctagtttactgccactttactttagaaattttttaattgtaaatgtttttacctttgtaataaaacagggtaaaacacaaacatgttatacagtggcacaaaaatattttctttctattcttattttataagcttttttatttaaaaaaatttttaaaaacttttcttgtttttgttaaaaatgaagacacaagcacacacattagcctagtcctacatagggtctggatcatcagtatcactgttttccacctcttcatcttgtcccactggaaggtcttaggggtaagaatactcatggggctgtcctgtcctaggagagcaatgccttcttctggaatacctcctgaaggacctgcctgctgaggctgtttttttttttttttttcttttgtagagacagagtcttgttctgtcacccaggctagagtacaatggcacgaccttggctcactgcaacctctgcctcctgggttcaagcaattcttctgcctcagcctcccgagaggctgttttatagttaatttttttagtaagtagaaggactacatgctaacatgataaaaaatatagtaaatacacaaaccagtaacacatttattataaaatattatatactgtatataattatcaaaatatcaagtattatatattgtgttatattttagttttgtaataaactaccaaactgtcatccacagtagctatactggtttgcattcccactaggaatgaatcaaagttcccactgctgctgggcgtggtagctcacgcctgtaatcccagcactttgggaggccgaggcaggcagatcacttgaggccaggagtttgagatgagcctgggcaaaatagtgaaaccccgtctctactaaaaatacaaaaattagctgggcatggtggcttatgcctgtaatcccaattactcaggaggctgaggcatgagaatcacttgaaccctggaggcagaggttgcagtgagccaagattgcaccactgccctctagcctaggtgacagagcaagaccttgtctcaaaaaagaaaaaaaaaaccagaaaaacaaagttcccattgttccacatcctcaccagcatctggagttgtcagagttttggagtttggccattttaataggtgtgtctcatttttgtttacattaaccatttataagaaattttgggatttaagagctggaaaaagatcttggctttgacctcctttcctctcctccctacctctgctgtccaacacatacatttcataaatgaaaaacagaggtggagagagctagctggtggcaggacagaagtcagagctctaattgctgctgtaatattcattcaacacatagtaattgcccttatcgtctcatttggaaactatacttagtttaattatacttagtagtgaggagtccaagagacacagttgatcaagctaaagagccaagtcttctgtgctcgtacataatgaccatgttctcgctaggggccttactacgcttcctacattaacagtgaatgaatatggtcttccagtgggggcagagggactggtgccctacagaatcaagagctctgaatggaaggtttggagttttagctgcaatccagctaaactatatcaaatttatcaaatccagctaaatatatcaaaattatcagatgcccctgtttttttagacagggtaactataatttgtctttagttattgagggatttctcctttctggggaagttaatcatctttatctcaggtttttctgaacatgtgggtgtcccaaggcttttctgagtttacctgacatgttcaccatttcttgatgttgacactggggggagctggtgtagaaggtctaagagtacaaataaccttgtggagtgtttttattattaatctcttagaaatctaagcctgagggttttaccttggacactaagaacattctgaaactgccattcctcgctggcatcatttgcacacatcgattctatccagaaccacaccccagcaagaacagagggcatgtctttgctggtttctttcctctgtctaccacttcctaaactctattttaacagggtgatggaggtgaatattctgtagtctaacaaatttggaaaatgcagactggacaggacttgtgcatgttagcattgcccatccccaaattcatgagcaccttgctctgaggctaccgagccctggcacctgctgttgcccctcccaggcacacccttcccttcttagccctcttacctcctacgtgtcctttgagctcagcttgagtctcctcaggactctgaatataccagataccccatggaatgagacagaggcatatataatgacatttaggacagccaaacaggcctttgtcataattttaattgtatgtgtcctttctttatctttgcatccctagctcctaaccctctgctgggcacacagtaggttctccaaggtctgggaggcagcacagggctgctgtaaaagagcacaagctttggaatcagatggacttccatgttcaattcctgagtcggttacttaaccataatttcttgcttaatctgaacctccatttccacatttatcaaatggaaataaaagatcacccttagaagtgcaaaacattaaatttaaaatgtatgaagaaagtgcttagcccaatacacacctgacgctaataaatggtagctattacttgatgcaagcctaatgaggattacagtggcacaatttttttcccaggcacttattaccccattacatttaggagacagacaggggaggctcttaccagctttggtaatgagacacgcatcaaaatcagatgaacaattgacggctgttttgcagtcagcagttgggttaggacagttgtagcactgcaggctatgacctagaatcaggaagaaagtcaggatctcttaaagcagcactgacttgtcccctggcagcccaccatctccattaatatgggcccaaagtcagcaacttgtggtatacttccactcccgcacaaatgtatagcagttatatctttccaaattcaaactacagttccagcaacattttttggaccctgatgcaagcacaaaggaaatatccacatttgaatatccatctaactgtgcaattgagaagcttcctcctaacctgcaactggaaggagattagtctgcaatgtaatgatgtgttaagaagaaattaccgagaaacaaacagaattctataagtgtcttccaagcaatgaatatgcccaattaaatcacatcctcgtgggttgatgatcaatgtctggcaatacctatctgcgtgaaaatacattttcaaaatgaaatatgtaaaatgtcatcacagattagtattaatagatgaacatctgcaattgatttgatgcgagggaacactaattttgaaccccaattaagcaaatggttatccccctaaaaagaattctattcccctcattagtagatgtgtattattatgctggactcaataattatgttatgaattttgtcaataaaaaaatctgtgaaaattttgtttcttattattgaggtaagtctcataatacccttgattttgcctcttggtctgcaaagcttaaaatatttactatctgggccaggcgcagtggctcacgcctgtaatcccagcacttagggaagccgaggagggtggatcacctgaggtcaggagtttgacaccagcctggccaacatagcgaaaccccatctctactaaaaataaaaaaattagccaggcatggtggtgcacacctataatcccagctacttgggaggctgaggcaggagaatcgcttgaacccaggaggcagaggttgcagtgagccacaattgcaccactgcactccagcttgggtgacagagcaaaactctgtttaaaaaaaaaaaaaaattgctatctggtcctgtacagaaaaagtttggtaacctctgggacagggtatcattactgaactactcccttctaagggactgaccgaatgccaggagtacacactgtcaaagacaagacaacagctgtgcactttaaacccatgggcataggacagctgggtaccagcagacacaacgtgagggtcatcttacatcagaagcaaattgcctccagttccctagtttgaaaaacaattattgctcccagtcaattcttaagactcatccttgctagctgtcagtttttgctgggttatttttccttctccatttttgtaacaacagtgacaacaaaaagatgagttacagtccacacgtgtgatggggagagactgaggaagcaagagttggaaggaaatcttcctggtttgtatggatacccccttttccatcatcagagataaactatcttcatgccatatgacttctaccatgtaatcagtatttggaagtacctacctctgtgaaaagacattttcaaagatgaaacacgtaaaatctcacaaaagaatgtcatggttaaaccaagtgtgggttttagagcccaacagctgacttctagttctaaggctgaaggctaggtttatcaccatggaaatagatttttcagtggaaagtccagtggaagcaaggtgggtcctcactttctgagcacacacaggaacccagttctctagagcatctgaaatggccatgtctgccctcacaggtgtgaaatcctacccaatagaggatcctctgacttgtgaaggttacagattaatgccttgaaatattagttttaaaaaacaacaacaaactaggccaggtgtggcggctcacacctacaatcccagcactttgggaggccgaggtgggtggatcacttgtagccaggagtttgagaccaccctggccaacatggtgaaacctcgcctctacaaaatatacaaagattagccgggcatggtggtacatgcctgtaatcccagctattcaggaggctaaggcatgagaatcatttgagcttgggaggtggagggtgcagtgagccaagcttgcaccactgcactccagcctgggagacagagcgagaccatgtctaaaaaataaataaaataaaataaaataaaaaccaacctcctccccaacttttttgcagatgacaagacagatgtctggagaggtgatgtgactcacacaaggacacctggctacaaagcagcagagctggcggcagccctggggcctgtgggcagggccccatccaccaggctttgtttgttctcccccactgtcagcctgtggctgtcatgcccgtgtgagagggaagccacaaggagaaggcgcaaagatgcaatttttctttggtcccttccttgtgccagacatgtattcacacgcatgaaatgaaaagagtctaagatgaagggtgttgttcttgagactggccatgtttgagggccattttaaaaggttacctgtagacatggatttttgtggtggctagatcccgggctcatttggcctcttaagaaagctttagaaggaaaggctaaaacccatggttggaacgtctgtgggcaaaaatattcatggcaaacatgttcattcagtgttcaaatatatgtgcatctatgtgctaagctcttcataggattgttaagagaactaggctcaattatcttcatccccaccttgcaagagaaaactaagactaagatgttaactaaattgttcaaagccacacagctactaagtgaccgagctgagctcaaactcaggctgtcagttctaaaatccaagcttggttaaccatgatgttcttctaattgacctgagtgggaagagaaggaaactctagattatggtggaaactgaggtcaaaaacaagcaacagggccaggtgcaatggctcacgcctgtaatcccaacactttggcaggctgaggtaggtggatcatttgaggtcaggaattccagaccagcctggccaacatggtgaaagcccgcctctactaaaaatacaaaaattaaaaagtaaataaaaaaaaatacaaaaattagccaggcatagtggcatgctcctgtaatcccagctactcagaagactgaggcaggagaatcgctggaacctgggacacggaggttgcagtgagccgagatcgcgccactgcgctccagcctgggcgacagagtgagactccatccccctgaaaaaaacaaacaaaaaaaaacaagcaataggtcagtggacaatggtttgatattttagccactaagccagggtagacgaggtttcccctgggccataagaggcagagctcagaggaaagttcccctgcagggtcctgagacccttttgggcagcagcaaagaaggcctctcatctgtgggcatgtgagcttcacatctcaattctctgagaaagggctgaagtgcaccccaagacttgtcacagagaagctgatggtcccaagcttgctccataaacaaatgcagactgctggaagtaggatgtcactgggctattaaaattctagaaaatattccaacttaagcagcagagacagaaaaaaagaaggaaccaagaaaaatgaataaataaaaaataattatagaaaaaatatagtgttttaacacaggtgaaccacattacagtgcaccctggctagaatcacggaaggtggggaagaaggggtgccatgacttctctttctgctcagaaagggagaacatattaaagtgtgtcctggcgccaagttactactttgccttcatttcctcagctgtaatatgggaggtaacagtaccgacctcccggaatggctggacggatttaaatgagacaggctctggcacagtccccagtaaacaataaacagtgaatatatggttgctgttaatattctaagacatgctacagtggtgtggaaatctttttttaaattgctcactgtattgccactttcttttctgctccccccaccaaccatatttataaaaaacaaaaaaccagcagtggccaagatattataccaacatgacacaggcagacaaccacacttgatctttacaatgaagcatgtgtgtttccactgttatagaagttgactcagaagcacacaatttcctccagcaaccaggggaggggtggctgaggagagggggtggcccagtgacagatggcctggagcaggagggaagagcagggactctgttgccagactgtgtgttcacattcccgtgtaccacttctgtgtgttatttgacaagttattaattttggggaggcctcaatcttgttgcttgtaaaacaaggataaaaataccaccaactccatcaggttggcatgaggattaaataagcaaatacacgtaaaatgcttagagtagtgactggcacataaatgcttcagggttagttagctgctgctgctgtcactatgaccatcatcatcattaaaacacaggaggagcctcagagcagaaggactgagctcagatggctctaagcagagtggaccccaaagggacttgcacagcactctaagaatggtatccattggtgtccccaagcagcttatggtgacaggagtgaaacttcagccgccgattgttgacccacccctgccaaaagccacgctgtaactcaggacgggctgtaactcaggacgatgccccactgaggacaaggtcataacataggaaggagctgtcatacaaccccagacctgtaacactggaaggcaaaagaaccaaagccaggcctggaggagcagctggggctgaaactgaggcttaagaagggagttcatggccaaggcagcctagatccatgtcctgagactggagcactcacctgaatggcagaagacagccaggacgagcagcagcccgaacaggacagaccctccttggattcccattgtgattgtccacagaacctggaaggaagggacaggaaggaatgtcaggaacgaacaaatgactgctggttgtctcaaaaaccaagggctggaaggccaagaaggcttctgagaggaacatttacagggggagtcaaggcacactgaatccctgggccatgccccagctctgacccacagcaccatatacccttgagtaggctcagtccctataagccccagtgtgtactaccacactgtgggaataacactatcttccccatcagggtcagtgagtcaaatgacaatatgagcaaattgactcatatagccactgtggttcccactctactggccccaccccaagctgctggctgaaagagagggccacttctcggagccacagcactaagtgaatcagaccaaaggggtgactctggaaggcaccagcatgcattcagcagtggaacagggagcaatggcttagcatacctggaagctctggctcctcactgtaagaagtataatggggacacttgcttgctctctttggggacatgaagagaggtattgagcaactttgtaagtttccattacgtgaatgcctagatgtgtagtgatagcatcaggtgagaagaaggaaagcctgaaatgcctccaaccctactttacccagtaaagaagccaaagcttagggaggttttgaacttgcctaagtacaaagcatccatagcagaactaagaaatctcccaactccaatcctacatccctgaacccatcctgaaataaggaggtggcagtgcctgtaaaccagggtactccatattctattctccagagccccacaggcccggacagacagatgggttcttggaagggtgagtcatctaccctccctaagtcagaaatgcagagttccctggggaactgacaatcctgacaatcattcctgtcccttccttctcacacatcttgaaggtcatctgctacttaggaatttgctgacgcaggccagtggaggactgagaagttccaggaaaagggcagggtctgacattgtccaaaaaagaaaacaatcagtgagtcaagcctggagatgggggtggtggagatgagaaagaggtggttttatgatatgtgaggaaccaggaagaaagacaattgtcatctggcctttccttacaaattgagggctccccaccacccgctgggctctgaaacctacagcctgctacgggacaccatcccccatgtggaccttcccaggagacctgggctccagcacatgccagcggcttgcttggttccccattttcaggggtttctgagtaggaagggtgatttatagactcaggttagacagggctccagtatacaaggaactgctacaagtgagcagggagaggaaggtattggtctgaggtccccgaacagagagctccagacacttcctaaaagttaagcatagcatgatcggagcctgggtattatagtgagaccctgtctctacaaaaataaaaacattaaaaaaaaattagactggtgtggtggcacataactgtagtcccagctacttgggaggctgaggtgggaggatcgcttgagcccaggaggtaaaggctacagtgagctgtgactgtgccactgcactccagcctgggtgacacagcaaggtcctctctccaaacaaacaaacaaaaacccaatgtagctacaatgtcaggcatccccacggaaggaggaaggaaggaatctcctgactcgggttaggcactggaaaggtgtcaggctggcaggagctgccggttcaggacacttcccttggaatggtccttgacataaatcacactgccacaacacacagggcccctgatggggagctgttctttgaagtaccttagaaagaagtggcctgctaagaaagcaggaagaacacaatgaaagggttcagagcacaggcattccagtccaatctggaggcctctgaacaaggccagatagttctggctctgtcacctctttgctatgtgttaacctctgatcacgctttggctagtaagcatggagatagttacatgtactgcatagcacaatgcctggccaaagatggcactcaaaaagctgtggccactgttagtgctactcaggagtaatgaggttacttgaggaagaaattgtgtggggagggagtgttggggggtgaacggtgggaaggcagacagagggtgatgtgaggtgaggaagccagagaaacaccctgggttgaatgagcaggggagacctcaggcatcaaacctaaggaagccctcagttttctgggatggttggggagtgtcaagtcttagcctcagttccacatgactggctggttgttgctatagctgatcccatgacatgctgcaggggaagccaagacagcagagaaaggaagtagctatgtgtagatgccaaggtcgggctgttccatcaaaataagaccaggcctttatgaaccactgccaaaatatgaatttccaagagcaaaacgttcatatggagtatgtgtatgtgtatggggggcggaggagggcgggaggcagaaaaagaaacagctgattgttttaaagctattttataaatgccctacaatgtagatggtaactaacactaagcaagatcatttatggctttttatttttcttcctgatcctttactttttgccatcctttccccaaatattctataattaaccaagtattacttttacaatcagaaacatcaggaaaattcacacatgacaatgttccttttctagtagtcatagatcatctatcttttggtaaaactactccctagactaaaacaccctccattttaaggaaaaaaaaaaaaaaaaaagaagatgcccataagttaagtgtagataagatggtaaatgaaccaaaagtgttgccattccacccaaaccaagtacttaaatgcaagatacactcagaaagcatcaacactcaactcctttccaaacatttcaggattcattaataacggtgggtttgtccctaacgactgttctaataatactgctattgttctgaatgatttttaatcattctaaagaatgcacaactgaaaaatccctcaaagaagatatgtaggaacaagtcttcccccatgatgaaggaacggcaggctttcctgggtggtgcgtaagttgactctaaagtcatttccgtaatgggagctccaagtaggcctttcatcacaggaataagaaatagtcaagggcatacaaacattctttaaaatagcaaaaatttagtgatacacacatccaacaataaggaaatgagtatactatggtacacttccatggtggggaaccgcatagccaggaaaagtaatgggcgtggaaggctactcacaatgaattaagatctgccaagcaaatggaaagcaaaaaaagcaggggttgcaatcctagtctctgataaaagactttaaaccaacaaagatcaaaagagataaagaagggcattacataatggtaaggagatcaatgcaacaagaagagctaactatcctaaatatatatgcacccaacacaggagcacctagacgcataaagcaagttcttagagacctacaaagagacttagatttccacacaataatagtgggagactttaacaccccactgtcaatattagacagatcaaaagacaggaaattaacaaggatatccaggacttgaactcagctctggaccaagtggacctaacagacatctacagaactctccatcccaaatcaacagaatatacattcttcttagcaccgcatggtaattattctaaaattgaccacataattggaagtaaaacactcctcagcaaatgtaaaagaacagaaatcacaacaaactgtctctcagaacacagtgcaatcaaattagaactcaggattaagaaacccactcaaaaccgcacaactacatggaaactgaacaacctgctcctgaattactgggtaaataacgaaatgaaggcagacataaagatgttctttgaaaccaatgagaacaaagacacgacgtaccagaatctctgagacacatttaaagcagtgtgtagagggaaatttatagcactaaatgcccacaagagaaagcaggaaagatctaaaattgacaccctaacatcacaattaaaagaactagagaagcaagagcaaacaaattcaaaagctaacagacgacaagaaataactaagatcagagcagatgtgaaggagatagagatacaaaagacccttcaaaaaatcaatgaatccaggagctggttttttgaaaagatcaacagaatagactgttagccagactaataaagaaggaaagagagaagaatcaaatagacgcaataaaaaatgataaaggggatatcactaccaatcccacagaaatacaaactaccatcagagaatactgtaaacacttctacgcaaataaactagaaaatctagaagaaatggataaattcctgggcacatacaccctcccaagactaaaccaggaagaagtcgaatctctgaacagaccaataacaggttctgaaattaaggcaataattaatagcctaccaaccaaaaaaagtccaggaccagatggattaatagctgaattctaccagaggtacaaagaggagctggtaccattccttctgaaactattccaatcaatagaaaaagagggaatcctccctaactcattttatgaggccagcatcatcttgacaccgaaacctggcagagacacaacaacaacaaaattttaggccaatatccctgatgaacatctatgtgaaaatcctcaataaaatactggcaaactgaatccagcagcacatcaaaaagctcattcaccacaatcaagtcggcttcatccctgggatgcaaggctggttcaacatatgcaaatcaataaacataatccatcacataaacagaaccaacgacaaaaaccacatgattatctcaatagacacagaaaacgccttcaacaaaattcaacagcgcttcatgctaaaaactctcaataaactagatattgatggaatgtatctcaaaataataagagctatttatgacaaacccacagccaatatcatactgaatgggcaaaaactggaagcattccccttgaaaactggcacaagacaaggatgccctctctcaccattcctattcaacacagtattggaagttctggccagggcaattaggcaacagaaagaaataaagggtattcaattggaaaaaaggaagtcaaattgtctgtttgcagatgacatgactgtgtatttagaaaatcccatcgtctcagcacaaaatctccttcagctgataagcaacttcagcaaagtctcaggatacaaaatcaatgtgcaaaaatcacaagcattcctatacaccaataacagacaaacagagagccaaatcatgagtgaactcccattcacaattgctataaaaagaataaaatacctaggaatctaactcacaagggatgtgaaggacctcttcagggagaactacaaaccactgctcaaggaaataaaagaggacataaacaaatggaagaaaattccatgttcatggataggaagaatcaatatcatgaaaatggccacactgcccaaagtagtttatagattcaatgctattcccatcaagctaccactgactttcttcacagaattggaaaaaactactttaaatttcatatggaaccaaaaaagagcccacatagccaagacaatcctaagccaaaagaacaaagctggaggcatcacgctacctgacttcaaactatactacaaggctacagtaaccaaaacagcatggtactggtaccgaaacagatatatagaccaatggaacagaacaaaggcctcagaaataacaccacacatctacaaccatctgatctttgacaaacctgacaaaaacaagctacagggaaaggattccctatttaataaatggttctgagaaaactggctagccatatgtagaaagctgaaactggatcctttccttacaccttacacaaaagttaacttaagatggattaaagacttaaatgtaagacctaaaaccataaaaaccctagaagaaaacctaggcaataccattcaggacataggcatggacaaagacttcatgactaaaacaccaaaagcaatggcaacaaaagccaaaatagacaaatgggatctaattaaactaaagagcttctgcacagcaaaagaaactgtcagcagagtgaaaaggcaacctaaagaatgggagaaaatgtttgcaatctatccatctgacaaagggctaatatccagaatctacaaataaacaaatttacaagaaaaaacaaacaatttcatcaaaaagtgggtgaaggatataaacagacacttctcaaaagaagacatttatgcagccaacaaacttatgaaaaaatgctcaccatcactggtcattagagaaatgcaaatcaaaaccacaatgagataccatctcacaccagttagaatggcgatcattaaaaagtcaggaaacaacagatgctggagaggatgtggagaaacaggaatgcttttacactgttggtgggagtgtaaattagttcaaccattgtggaagacggtatggtgactcctcaaggatctagaacatctgacccagcaatcccattactgggtatatatccaaaggattataaatcattctactataaagacacatgcacacgtatgcttattgcagcactgttcacaatagcaaattcttggaaccaacccaaatacccatcaatgatagactggataaagaaaatgtggcacatatacaccatggaatactatgagttatagttctttgcaggaaaaaggatgagttcatgtcctttgcagggacatggatgaaactggaaaccatcattctcagcaaagtaacacaagaagagaaaaccaaacaccacatgttctcacttgtcagtgggagttaaacaatgagaacacatggacacagggaggggaacatcagacaccagggcctgtcgggagttggggggtgggggagggatagcattaggagaaatacctaatgtaaacgacaagttgatgggtgcagcacaccaacatagcacatgtatacctatgtaacaaacctgcacattgtgcacatgtaccccagaacgtaaagtataatttttaaaaaagaacttaaaccccgtatctccgagaaaaaaaaaaaatacaggcacttcttatcaagttcctgaaaatgttttagatagcaaatgttctgggtatttgggtagaaaatgtaatgagtctatttccactattttaagtaggaaaacgtgttactgttcatccaaaaccccaaccggccccccaaatatcaattaaatatatatatacacccacacacatttgacccttgaacaacacaggtttgaactgcaggggtccatttatatgcaattttttttctgaaaatatattggaaaatattttggagatttgcaattgaaaaaactgttagataaactgcatagcctagaaatattttttaaaattaagaaaaatttaggtatgtcatgaatgtataaaatgtatatagatactagtctattttatcactacccaaaaacatacacaaatctattataaagttaaaatgtgtcagccaggcatggtggatcttgcctgtaatttcagcactttgaggggccgaggtgggtggattgcttgagccaagagtttgagacgagactggcaaaaccccatctctacaaaaaaaaaaatagccaggtgtggtggcgtgtgcctgtagttccaactactcaggaggctgaggtggaaggattgcttgagcctgggaggttgaggctgcagtgggccaagacacaccactgcactcccacctgggcgacagagtaagaccctgtctcaaaaaaataaattattaaaacttacacacacaaacacagaccagacatggcaccaaagtaaagagaaatgtaaacaaatgtaaagatgcagtattaaatcatactgcataaaatcaactatagtatatactgttaataatgccatagccacctcctgttgctattgcagtgagctcaagtgttgcaaggatctacttatcagcagggatatgattagtatcatgtgatgctaattatctgtgagctgtttgcctctttaagaaattgcacatcacagtaaaaggtgatctcttgcagttcttgagtattttctttatcgtgttaagcgcaatagtgtaaaacttgaatgacacatgagacccttacagggtgccacaagtgatgctggccacgctcccaagaagcagaaaaaagtcatgatgttaccaaaaaacagttgaactacttgatatgtactacagattgaggtctgcagttgtggccgcctgccatttcagacaagtaattcatcttgtaaacagacgacataaactgatggtatcaataactatagtacagaactgtaatggattttctcttccttacgattttctaagtaacattttcttttctctagcttactttatcataagaatacagtaggcaatacatataacacaccaaatgtgtgttaatcaactgtttatgttatcggtaaagtttctggtcaacagtaggctattagtaattaagttttgggggagtcaaaagttaaacttgaatcttcaaccgtgtaggtggtcagtgtccctaaccctgcattgttttagggtcaactgtatataaacatatataatatatattacatatatacgtaaaaacacacatatacatacattatatatacacacacaaatacacatatatatgcacatatatatatgcaatccaaagaaattgaacataaaacatttaacacatcaaataattatttaataacatttaaggaattcactcatcagtatacttactactgtgaagtaggtctcaactcctacaccaactggtgctaaagactaggacgaaaataaaagagggtcataacagtggttctcaaactttagggagcatcagaatcacctggagggctcttaagtagatgattagactccagccctagaggttttaattcaggtgggctagtgtaaggctcaagaatgtgcattttgagccagcactcaggtgctgcgtttctgctggttcagggatcacactaagaaccactgggttagagggtgacctggcataagggccaggttactttagattgggttggaaatgtttcttccaacagggttataaaagaagctgttagttcttaaatatttaggagccgcttctacttttaagggcccatatgattatgacattgaatgcaagccattaggcaagaccttgtgatatggtttggttgtgttcccacccaaatctcattttgaattgtaactcccataattcccacgtgttgtgggagggacctggtgggagataattgaatcactggggacggtttcccccatactgttcttgtggtagtgaataagtcacacaagagctgatggttttataaggggtttcccctttcacttggctctcatatttctgtcttgtctgctgccagtaagacgtgcctttcaccctctgccatgattgtgaggcatccctagccacgtggaactgtgagtccattaaacctctatttctttacaaattacccagtcttcggtatgtctttatcagcagcatgaaaatggactaatacacctccaaaatctcatgttgaattttaatccccagtgtcggaggagggacctggtgggaggtgactggattatggggtggtttctaacagttcagcaccatccccctagtgctgtcttgtggcagagcttaggaaatctggttgtttgaaagtgtgtagcacttccccctttgctgtcttcctcctgctcccgccaagtaaggcattcttgcttccccttctccaccatgattctaagtttcctaaggccttcccagaagcagaagcctatacagcccaaagaactgcgagccaattaaacctcttttctttataaattacccagtctcaggtacttctttatagcagtgtgagaatggactaatacaccttgttcctgtgttaacttccatttggtgagcaaatatcaagggccagttgctaagatagatgctcttgacatagtaactggagttaatcctcacaataataccataaggtaaactgaacctttgcctccaattacagggggaggaaacaagattgaggaagagaactaatttatgcaactaacttatgtggtaggtagaataatgcctctcttccccaaaaatgtccgtatcctaactccaggaacctgtgaaaacaggagaccttgcatggcaagtgactttgtagatgagattaaggagattattttggattattcaatgggcccaatgtaatcccaggggtcattgaaagaggaagaaggtagcagagtctgtcaaagactcatgaccgacaacagaaaaagaggcaagaaatttgaagaatgagatgaagacacgaagggttccctaagccaaggcacacaggcggcctttagaagctaagaatggtcctcaactgacactcagcaaagaaacagaacctcagtcctccagtcacaaggactatattctaccaggaacctgaatgagcacagaaacagactctcccctagagcctccagagcagcacagagccctgccaccttgattacagccctgtgagacctgtgtcagacttctgatttacagaatggaaagattaataaacttgtggcatttgaaacagctaaatttgtggtggtttcagcagcagtagaaaattattataaggccgagtgtggtggctcatgcctataatcccagcactttgggaggctgaggcgggtggatcacttgaggccaggagttccagaccagcctggccaacatggtgaaaccctgtctctactaaaaaaaatacaaaaattagccagatgtggtggcactcacctgtaatcccagctacttgagaggctgagacacgagaatcgcttgcacccaggaggtggaggttgcagtgagccaagactgtgccactgcactccagcttgggcaacagagagagactgtctcaaaattaaaaaaaaaaattattaaaattattatagcaacctctgaactggaaactggtagaacagcatttaaacccaggtctaagctctgagtgaacgaaccatagttaaactctagtggggagacgggagacttcttataaattcagcttctgaaatacattagttaagctgaggtcattagagaagagagttgacatcagtggtgtttccacaagattcacagttgcccatgagtatggttactcctcctaggagcctgaggccttacagactgaagaattttaaggctagaagtgtcctcaaaataaaacccaatgtttttattttataggaaattagtggaggcccagtgggatgaaattacctgtcccaaggcaacatgttagtcgcaaaaccaccctggatggatcttgtttctattcgccaggggctggcaactcacaagatacctagtgtcagcaatgtcagagaactagagcttttgaaccccaggtctgcgtgtcaccttggagacatacacaatacctgctctagccatgcctgttgaagcgcccagacaaacatccatcactcagttcacggaacaaattacatcagcaggaagagacaaagagaaaacaaccatcataacggaaaaggctttccaatccagccaaggttctcatgccaggaataaccactccaaaactctttgtgtgatatacatataaattctagggtacatgtgcaggatgtgcagatttgtttcataggtaaacgtgtaccatggtggtttgctgcacctatcaacccatcacctaggtattaagcccagcatgcattagctgtttttcctaatgctctatccccacccaccccacctgccgacaggcgccagtgtgtgttgttcccctccctgtgtccaagtgttctcattggtcagctcccacttattaggccagaactctttggaccaaacaaatctgcagcttcccctacaagggcctttcctgcagtttgttccggaatgccaatccctaactctccaaagagtcctatctccgcactcacggcccctcccgtgttaagtacacatgcaaaaccaaggtttagtgaatatgtttcctaagatataggacataagtaaaaagaagtctttgcctttagaaagcctcaagcacttctgggcttggcaatgtctgtggcggtttggctgaggttcttaaagaggtggcccagaattttccatgctctacttttcaagagcttctaccagcagctgtcaaagatgaatgccattaggcaccccactctctcaccctaagatccattttatttaggcttttatctcctaagccactcagctaatgggatgtttttcttacagctaagttcagcaaacagtttctagtttccactgtgaaaatacagaggccacaagttttaggactgtttggcttgtaggggaggcagcctccctttctgcctctccttcataaactgccacgtaaatagccacattttggcaaacgttgccatctccctcaacattcggggctctgtgccttcttcagggaactgggagtaaaccgccaggagtggagaacttgaacaactgctcagggatcgcagggtacctgaaataattagcagccgccgcgtttgtgctgagcgctttccgtcaatcatctcaaccaccctgtgaagtgaagcctattgttttacccatcaagtgctgttaaatacttccagaaatgaccagtgaagagcctgggtatcactaaacggccataaaaggcacactgcttaatgttggttttttttgtttgttctttgtgggttttgttcgtttttgaggcggagtctcgctcttattgcccaggcagtagggcaatggcgcgatctcggctcaccgctacctcagcctcccgggttaatgttgttttttgaaaagtcagcagtcagactctaagaagggtgcggcccgagccgacccaagaaaacaaaacatcacgttgtacttaaaacgtccgtttcggccgggcgcggtggctcacacctgtaatcccaacactttgggaggcggaggcgggcggatcacgaggtcaggaattcaagatcagcctgaccaacatgggaaaaccccgtttctactaaaaatacaaaatttagccaggcatggtggcgcatgcctgtaatcccagctactcaggaggctgtggcaggagaatcgcttgaacccggtacacggaggttgcggtgaacccagatcgcgccactgcactccagcctgggcaacagcgaaactccatctcaaaaaaaaaaaaaagtccgtttcgcccgacacctgcttttcaaaattacacatttagaccgcgaggggagagaggaactgccgtgaccacggagggctggcctttcccccggcgcagtttctctggaccgctagagcttcccttgagacgaaagcgatggcaggggcccgggtgcgaggctgcccccgagggaatggggggcgcgacgggggtaacggggctgcttctgggagagggcgcgctccccgtttctccttcctcgtagataaaatgaagccagcgttcggctaggacaccgggccgcggtgacgggttggaagggccaggcctcgggaggctcgcccggcaggggtcgagtggaaagcgaggacgggggtagcccccacagaccctccgcccgggcccagactgccgccgccacctcggctcggctcacccaaaccccagcaggccttcgggccttcttacctggcggcgcccaagatcctcttccagcctcgagccgcttctgcgctcagcccccgcattctttcgctccagcccgcaaggctccgccccccggcccc

SEQ ID NO: 1605 - DNA, 19718 bp, Homo sapiens
ttagaaggaaaagagattttgcgttatattttttaaatgaagcaatacaatcattttttatgtatatatctagttgaggagaaaaaattacagattttttcccccttactccaagataatctaaacagattttactctggatggcttaattataacataatccatgaagttatagccagggggttaaataagaagttgatgacaaacttggtttctctaacaagtatgcaagaaaactcaagtgccacaatgaacacccataaactgctgtcaggaggcaaagtccctatgaggtaataataaacccacgaggttaaggcaaaaccctacggttgtttctgcaaacaaatgtccaggaaactcaagtttgtgatgaaagaacagtcttgaattcaacttcagcagaacctttccctccctgggctccaaagcactatgtcacctacctctccactcaaatgccccattaagtaccatcctgttggagcttcctaacgcccctgctccctggtttcatttggaaccaactgagagacacaagtccctcttcgttgatcagggtcagttgaaagatgtagctgtcggcctggtagccaggtgggcttgctaatcctgcacctctaccttaagcttacccagcgtgaggccaggttagaaagtcacaggccttggcagcaggcagagagcctttactgtcatagtgaagagcttgccaaggacaggactgattcttcctccagcctcacctatcggggcagtcattgttccgctgtcaggaggagaggggccagaagggtcacactgaagaaatgtgacatgagggtggaggttcctgtccagcattcttcactctctatttaaccgaggctgactcattgcagttggcactaattttccattgccacagccctctccagccaggagggcctggagtacctgaggtgctgtttgccgggttcccttggtcctcagactgctcccttcagagaaagcacagaaagccttctctgtcccaaggagccccccttcccctcccccactccagctctgcatctggacacactgtcagccatcagatcctgaccaggtgctcagcctctttagggatatgtcacaatttgccgtgcccggtggctctgggcagcctttggacatgtagtggttgtgtcttggaatacaagagttgtgcctgaatctgggactctctgtgaccctgggaaaatcacatcagctctctgaaccccaattgtctctgatctataaaatgaagacagtatctacttcataggattgatttgatggacatatgtataagcagtgccagggacaactagtaggtggtcattggagtgtggctacagttattatacagttacacatggattccttgattccccattaagccctggtggatgaatgaggaaaatgcagcagggggtccatcctagaaaacccaacccactccagataatcgcgccagcctcacacctgagaagctgcttctacgacctgctgaggacataatgataaacacacacaagaggctactgtgtcccaggcacttgtcttaactcatttaacttttctaacaaccctaaacctagggttctcattttccagatgagaaaactgaggcatgtaaggttaagtaacttgcctgagggtcgccgattagcatcagagccggcatttcaaatagacaggccagctctagaggccagggtgtttggacagcctccaaattgtcaccctagccttcagggcaaggctgcacacacggcctctagtctcctacccctcttcctggcaggaggctggctctgacaggaggttgtttgtgccacaatttaaggaccaagctattctgggaagcccagaacagtctttcctttattattcatctcaattaaccattgtgttggtctggacttgggggtgcaggcattcccatctccctttcaaaaaagtttctaaaaaatgcagagcagcctttattcttgttttcccaggtaaatgtggtcctatgtacttgcagagtaagaatttaaaaaaataaacctgagaggtagtttagtggaatagggagtacagaggcctggaagatgagggagctgggtttaagccccatcaaccggcatcaactagccatgctaccttgggcaaaataaccgtagctaacacttagtgaccacttactgttgtgcgttctcatgttatcctgacagtaacacttatagggtaggtctgtcagaattttctgtccacaagcaacagaagcttacactgagaatttattggagggctttgagacagctcatgtaatggaaagctcttaagaactaggtttagaaggtgcagagaccagggcaacttcagggatccaggtagcaggaaggaatcggtagcctctttggtatggccactatggtggtagacactgtctaccttgtttgctgagtcttctggctttcttccactcttcctgctcttggacatcagactccaggttcttcagcctttggaatctaggacttgcaccagtgggttggttgccaggggctcttgggcctttggccacagactgaaggctggctgcactgtcagcttccccagttttgaggtttttgaactcaggctgagccactactggcttctctctaacccagcttgcagacggcctattgtgcgacttcgccttctaactgtgggagccagttctccctaataacctccctttcatatatacatatatcctactaattctgtccctctggagaaccctaatacatgaattataactctaagtttcagttctggccatagcattatgtcacaccaacaccagcatcaatattttaggttgcctaattaatgtatctgtaaacctatagccagcttgggtggggctattgagagtcagcaccagcactgatcatatataggatcagcctactggggttggccacgttgtatgtagctgcgaatagcaaggaggggaacagcaacatccctagggaaaccgatcacagaaaggcagctcactaccccacagtaaaaagaaccttgagtttcccagttcagtcccctgctgggtgcatgctacccccctcctctcccagaggctctggacctacacagctgctgaaaaagagaaaatgtccttacctacaatgaaccatcacaggcacccacctagaaattaaggtactgtggtcatttatcttatcccagaataacaggagtgtgtataaacaggaagctttagtttagataaataagattatccattacaaaaattttatattgaataacctgtaagtaatttgaaaaagagacttctggctagttttcacttatgtccaagtcagtgggggtaaatgcattgtgattcactgtaggttttagactcttacagccttaacaaccttgtaaatccataactagcatcttcctatctggcagaccctttacaaatgcattatctcaagcctcacaacaattctttgaggtagacatagaaagtgaaagttcagaaagggtttaaaaaaaaaaaaaaaaaaaaacttgtccagagacatagccaattagtggaagagggtttgaacccaggttcctaactacaaaatccacgggtttaactgctgctctcctgaaatgaaatatctacaagaagtagcaggcattgagaaacagatgggaagatagtgttttgatatgattttctgtttacaggaaggcctaactacgtcctgttcacctcatgctattgggtaactttccagtaaaaaacaattgcactttgttttcttttccaaaaagaggcagaaactgatttcttcaaagtaaaaaggcaccagggacccattctagactttccaaagctaggcacatattaaagagagtatacaaaataggcagagaagtagacttgctgacctgaggagctgagtgggaagcatggacttgccaacttacctaagtgaccttgagcgatccagctaactttgcatagtttcctcttgtgtaaagtgaggtgcaagtacagatgaaaatgtatataaaacatagagcttagaatcctgtaccagaaagctgccctcatcacaatgaatgtcagtcagtactagctccagccagctgctcagcccatcaagaatccctcagggggatctgttagcattagttcagatctgttggcagcaacagaaactaatgcgagctagtagactttgaacactgctaaagaacttaccaagagaactcagatgtataaaagtggttaattctgtcaagaggcccaaagtcttgggcaggctcttattttttcaggacacacataagacatgggggctaactgcaaggacacaagaaaaatatacccataccttgaagcccccagtacattcaagaccaagtttggcaaatagattagcatctttcaggaaataccatgagctccacttatctactcatcaggtgttccttgcacccctagctcatccccccaaggggacaatccaatgggcttatcaccacccaatactgaacactatgacagttcctgtaaatccagatgagtggagggcacagggtattggctctcgagcagagagccagtaggcatgactggtgttcgattcctaactcccctgctccctggtttcatttggaaccaactgagacagacacatgaatccctcttcgttgatcagggtcagttggaggatgtagctgtcggcctggtagccaggtgggcttgctaatcctgcacctctaccttaagcttacccagcgtgaggccaggttagaaagtcacaggccttggcagcaggcagagagcctttactgtcatagtgaagagcttgccaaggacaggactgattcttcctccagcctcacctatcggggcagtcattgttccgctgtcaggaggagaggggccagaagggtcacattgaagaaatgtgacatgagggtggaggttcctgtccagcactcttacactctctatttaacctaggctgactcactgcagttggcactaattttctattgccacagccctctccagccaggagggcctggagtacctggggtgctgtttgcctagtactataaatgtctttacattacagtattgcctttgggtccaggcactcaaccttgtctatggcatgagtcacagcaactttttgcagaaagcaaccccaaagtttaaggccatttatatgacccttgttgatttggacagcttaacagccccatctccccatttagtggcactcagattttgctttagaggactaccttcttcccagtgtagtctggccaaaaagtgggtacatgacacaagatagcagtaagccaatctcatcctagaatctcaatcctgagagaggcttccaaaactgtcgactcctggctttctggagtgtggctgaattccccacccccccgcccccaaaaaagttcccagaaattcattttctgcttaaattcatcaaaattgtttctcattccttagaactcacatgaaatgagcttctttgctcagccggtggctgtgggcatggtcagtacttcctcaggccaaaaaaaaaaaaaaaaacctattgatgtaaggaaagacactgagctaacagagaacacagagcaccaaggtaatgctaagttttgataagcaagtttctattttcctatgttcagggaacggcatcaacagaagaaagctggcactgctcaggatgtcttctttcagttgctaccattaagcatactgcatatccttttcggccataaccacattcacccacttgttatatttcattttcagaaaagcatcattcattgcactcggtttgtccaacagagtataatcaagggttttttttcaacattaatcaagaaattcctccatctgcaaaagtcagcctatgccattaaatacagccaagatcataaaatacaaatgtcattaggtctactgaatcttgagattcattcactagaatacacagggaaaaggaaaaagtttgcccttgtgaaaggtgtgtatcattttttagaagagcttctgaaagcctcaaacatctgtgagtgtgctaagagccgttacaaaggtattttatacaatctatgctgagtcagctaggagttagcaggaggctggatgcagatggtaaaacatacccctgcagatctgttgttattaaggatgacctttggaagtctcaaactgtaaccacaaagggtgtccccactgcattcatactatatacacacatacctgaactgcctttctaccagtaacatttaaaataagcacacttaatactgccagtcacatgtagtagagtgttcactctgtaactgtgtgtggcaaagccaagatatcctaccattccaataaaaaaaaggcaaggaaatagctttaacacaccattgatgtatgctattacacttttccagtggaagataacaaagcccatataaaatttaaagacagaggaaaaactcgattttcagccacttgtacctctctaagttttcatgccctgctatctggaacacttccccacttccctgccagaagtcctctagctctgcattaaggatcttgttgtccctgactgacacccacatatggaacatttggcatgcctccatggcaacacgggatccctgaagtttatgaaagcgttccatgtgagagaggatgctcatatactcctgccccaccctccaaagatgtactaatgatgctaactgactacatccaaggagccagaggaaaaataatctgagggctgcagagaacccactcaagctgtcactgcaaagctggtcttcccaagagcaaaggaggaagcatgcaatctagttcaagtcacacctacttcactcttagacttcttccttcaagtggggcttccctgcaaacaggactggtcttcaaagtctcccagagcccctctatcttagccaggttgctcaagctaattttattctttcccaacaggatccatttggaaaatatcaagcctttagaatgtggcagcaagagaaagcggactacgcaggaacggggagtttgggagaagctctcctggtgttgacttagggatgaaggctccaggctgctgccagaaatggagtcaccagcagaagaactgttttctctgataaggatgtcccaccattttcaagctgttcgttaaagttacacaggtccttcttgcagcagtagtacgttagctcattttccctcaagcgggttgtgacgtcgttgaaattgcaatgctcaaacttccaacacttgttatacacttgtaaccctgtggggagacacacacaagggtaagaaagtaagtgggaagagttctgtatctgcttttgaatcctcaattctatttcgtatgtatcctgtgcaagtagagacttctaggcaagatgctcatcccaggtgggttgtaaaggagaacaattaagtaaataatgatacacctctaaatagagcttttacagaaaaccaaggtctcatcagagccagtatagttatgggggtgggacggaggaggaacaggcatttatactgttaagagggaaatttggtaatatctgccaagattttaaacacatgccccctttgatccagcaattccacttttagaatttacgctatgaagttacttggggattttttccttttcttttcttttttttttttagagagataaggtctcactttcttgcccggtcatctggtcttgaactcctgggctcaagtggtcctcctgcttcagcctcccaaagtgatagaattataggggtgagccaccatgcccagccaaagctatgtataagatatatgctcaagaatggtcagaaaaaaacctgaaaaacccagtccattaatttttaaaaagtgttaaagaaattacaatagaattccttacaatgcaagttccatgcagataagaaatgacgtgggccttcaagtgctaacatggaaggagcttgatttaaaaaaaaaaaaataaaggtggggggggggcagaaaaataggtaaactggactccatcaaaatttaaaacttttgtgcttcaaaggacattatcaaaaaataaaaagataactcacagaaagggagaaaatgtttgcaaatcacatgtaaaccaccaggtgcggtggctcacacctgtaatcccaacactttgggaggctgagatgggagaattgtttgaggcgggaagtttcagaccagcctggtcaacatggcaagaccccctctctatttcttttttaaagtcatatgtaagagcatagtatccaggatatagaaaacattcttaaactctacaataaaaagactaacccaattaaaatatggacaatgaggccagtgtgatggctcacacctgtaatcccagcactttaggaggctgaagtgagaggattgcctgcggccagcctgggcaacatagtgatatcccaactctacaaaaataaaaaataaaaaaattagccaggcagggtgttgcgcctttagtcttagctacttgggaggctgaggcaggaggatcacttggactcaggactttaaggctgcagtgagctatgattgtactgctgcattccagcctaggcaacaaagcaagaccttgcctctttaaaaaaaaatgggcaaaggatttgaataaacatttctccaaagaagattctcaaatggccaataagtacatgaaaagatgcttgatatcattagtcattaggaacatgcaaatgaaaatcacagtgagataccactttatactcactaggatggctaagatcaagaaaatggtaaatagcaaatgttgcaaggaagtggaaaaaattggaaccctcaaacattgctggtgggaatgtaaaatggtgtagatactctggacaaatttggcatttctgcaaaaagttaaagatagagttatccatttgactgagcaattccactcacaagtgtatatacttctgccattctctggaaggattcccaagtaatttaatactgttatcatcatggaagaatacacttcgtttatgtttctattgagtttttcaaatttgccacatggataatttttaaaatatttgaaacttcattttaaaaatcattagattattcagtaatacaggaaaagtttctataagaacatgctatcatggtctcatttttggaaaaatagccttgggcacacaggaaaataaaggccagatgtatacactccaagtatcttatcgtagtttgaattgaaaactacgttcacacacaagtttccacatgaatgttcatggcaccatgattcaaaattgctaaaaagtggaaacaacccatatgtccattactggtgaatggataaacaaaatgtgatatatccacacaatagaatactatgtggccacaacagaatgaagtactgatacatgccacagcatgagtgaaccttggaaacattatgtttagtgaaaaaaaagctagtcgcaaagtgccacaatactgtatgattccttgcatatgaagtgcccaggagagccaaatctatgaagacagaaagtacatcagtcactgctggggcatgcaggagggaggaatgaggactgactgctaacaggtttcttttcaaggtgacagaaagatcctggaattagacagttgcgataagtcatacaaccttgtaaatatactaagagccactgaattatacactttaaaatgtaaacgttctggtctgtgaattatatctcaataaaaaccctagatgcagaacagtgtatagaatgtgacccatttgtggaaataaagcacatatacattgaggtaagtgcatttatttttctctggaaggattcccaagtaatttaatagtgttatcatcatggaagaatacacttcgtttatgtttctattgagtttttttaatttgccacatggatgatttatttttaaaatatttgaaacttcattttaaaaatcattagattattcagtaatactggaaaagtttctacaaaaaacacgccatcatggtcccatttttggaaaaatagccttgggcacacaggaaaataaaggccagaagtatatactccaagtatcttatcacagtttttttaatattcagaaaaagcatgttaggtgaaaaatgtattagttgagagagtggtattatggtagattttcttctccaaaaataactgagtgcctgtgtgctagatactggggtataagaaggtatttgtccttgccctgaaagtggtttcttatcttctgtgctggaaagaaaaaaacgcagatgcatacttccttatttcaggcttgtagctaatttacccaattccatgcagagcttggaacacaacacttctcagtttataactgcaggcataactgtcctgtcctcctcctctgaggggatgggtatctggattggaatttaatgaagtttagtcaagtggcagagtccacatagagtattccagaaatggctctagttgctgaagtcttaactaaataactggaagcttctaatattgtactagaggctgctggtgattcagacaagttactgctttgtaacagtaattacgcattggaacttgaaaagctttaaagctatcagaattttaattagggaagcctagaagcttggggagaacagacagtaatttatgaataattgctaccaattaatcatttactatgtgtcgtgcagcgtaccaaagtgctttacttgaattatcatattcaaacaacagccttaacgatggtaataatctcaccaaagccagccttggaattatccacataaaagtggcttatatcagaatccctggagtgttacaggttttctcctcctcactctttttgaagacttcggctcaagtctatctaaagtcaacagtcttcagctgtcctaggcacccttaaatgtggcccttgttcagaacgtcattacagcagtgaccacttgacactgtcatcagaggctccttcaagactaagtacatttaaccttgcttacacttccatggtttatactgctaggatgccagtaaatattggttgaattagcagccaacctgtctctcttctagacttactttgtatagcaccatcatatctgtctctgtgcaaacgtcatagcgtgtagttacacaaacttacatggaatagcctagtacacactcaggctatgtggtatgtcctattgctcttaggctacaaacctgtacagcaagttactatactgaatactgtaggcaactgtaatgcagtggtaaatatttgtgtatctgaccatatctaaacatagaaaaatacagtaaaaatatgacacaaaagattttaaaaatggtacacctgtacagggcacttactgtgaatggagcttgtgagattggaagtcagtgaatgagtggtgggcgaatgtgaaggcctaggacattgctgtacactactgtagatgttttaaatattgtacatttagtccacactaagcttattttaaaaaatcaaccctagtttactgccactttactttagaaattttttaattgtaaatgtttttacctttgtaataaaacagggtaaaacacaaacatgttatacagtggcacaaaaatattttctttctattcttattttataagcttttttatttaaaaaaatttttaaaaacttttcttgtttttgttaaaaatgaagacacaagcacacacattagcctagtcctacatagggtctggatcatcagtatcactgttttccacctcttcatcttgtcccactggaaggtcttaggggtaagaatactcatggggctgtcctgtcctaggagagcaatgccttcttctggaatacctcctgaaggacctgcctgctgaggctgtttttttttttttttttcttttgtagagacagagtcttgttctgtcacccaggctagagtacaatggcacgaccttggctcactgcaacctctgcctcctgggttcaagcaattcttctgcctcagcctcccgagaggctgttttatagttaatttttttagtaagtagaaggactacatgctaacatgataaaaaatatagtaaatacacaaaccagtaacacatttattataaaatattatatactgtatataattatcaaaatatcaagtattatatattgtgttatattttagttttgtaataaactaccaaactgtcatccacagtagctatactggtttgcattcccactaggaatgaatcaaagttcccactgctgctgggcgtggtagctcacgcctgtaatcccagcactttgggaggccgaggcaggcagatcacttgaggccaggagtttgagatgagcctgggcaaaatagtgaaaccccgtctctactaaaaatacaaaaattagctgggcatggtggcttatgcctgtaatcccaattactcaggaggctgaggcatgagaatcacttgaaccctggaggcagaggttgcagtgagccaagattgcaccactgccctctagcctaggtgacagagcaagaccttgtctcaaaaaagaaaaaaaaaaccagaaaaacaaagttcccattgttccacatcctcaccagcatctggagttgtcagagttttggagtttggccattttaataggtgtgtctcatttttgtttacattaaccatttataagaaattttgggatttaagagctggaaaaagatcttggctttgacctcctttcctctcctccctacctctgctgtccaacacatacatttcataaatgaaaaacagaggtggagagagctagctggtggcaggacagaagtcagagctctaattgctgctgtaatattcattcaacacatagtaattgcccttatcgtctcatttggaaactatacttagtttaattatacttagtagtgaggagtccaagagacacagttgatcaagctaaagagccaagtcttctgtgctcgtacataatgaccatgttctcgctaggggccttactacgcttcctacattaacagtgaatgaatatggtcttccagtgggggcagagggactggtgccctacagaatcaagagctctgaatggaaggtttggagttttagctgcaatccagctaaactatatcaaatttatcaaatccagctaaatatatcaaaattatcagatgcccctgtttttttagacagggtaactataatttgtctttagttattgagggatttctcctttctggggaagttaatcatctttatctcaggtttttctgaacatgtgggtgtcccaaggcttttctgagtttacctgacatgttcaccatttcttgatgttgacactggggggagctggtgtagaaggtctaagagtacaaataaccttgtggagtgtttttattattaatctcttagaaatctaagcctgagggttttaccttggacactaagaacattctgaaactgccattcctcgctggcatcatttgcacacatcgattctatccagaaccacaccccagcaagaacagagggcatgtctttgctggtttctttcctctgtctaccacttcctaaactctattttaacagggtgatggaggtgaatattctgtagtctaacaaatttggaaaatgcagactggacaggacttgtgcatgttagcattgcccatccccaaattcatgagcaccttgctctgaggctaccgagccctggcacctgctgttgcccctcccaggcacacccttcccttcttagccctcttacctcctacgtgtcctttgagctcagcttgagtctcctcaggactctgaatataccagataccccatggaatgagacagaggcatatataatgacatttaggacagccaaacaggcctttgtcataattttaattgtatgtgtcctttctttatctttgcatccctagctcctaaccctctgctgggcacacagtaggttctccaaggtctgggaggcagcacagggctgctgtaaaagagcacaagctttggaatcagatggacttccatgttcaattcctgagtcggttacttaaccataatttcttgcttaatctgaacctccatttccacatttatcaaatggaaataaaagatcacccttagaagtgcaaaacattaaatttaaaatgtatgaagaaagtgcttagcccaatacacacctgacgctaataaatggtagctattacttgatgcaagcctaatgaggattacagtggcacaatttttttcccaggcacttattaccccattacatttaggagacagacaggggaggctcttaccagctttggtaatgagacacgcatcaaaatcagatgaacaattgacggctgttttgcagtcagcagttgggttaggacagttgtagcactgcaggctatgacctagaatcaggaagaaagtcaggatctcttaaagcagcactgacttgtcccctggcagcccaccatctccattaatatgggcccaaagtcagcaacttgtggtatacttccactcccgcacaaatgtatagcagttatatctttccaaattcaaactacagttccagcaacattttttggaccctgatgcaagcacaaaggaaatatccacatttgaatatccatctaactgtgcaattgagaagcttcctcctaacctgcaactggaaggagattagtctgcaatgtaatgatgtgttaagaagaaattaccgagaaacaaacagaattctataagtgtcttccaagcaatgaatatgcccaattaaatcacatcctcgtgggttgatgatcaatgtctggcaatacctatctgcgtgaaaatacattttcaaaatgaaatatgtaaaatgtcatcacagattagtattaatagatgaacatctgcaattgatttgatgcgagggaacactaattttgaaccccaattaagcaaatggttatccccctaaaaagaattctattcccctcattagtagatgtgtattattatgctggactcaataattatgttatgaattttgtcaataaaaaaatctgtgaaaattttgtttcttattattgaggtaagtctcataatacccttgattttgcctcttggtctgcaaagcttaaaatatttactatctgggccaggcgcagtggctcacgcctgtaatcccagcacttagggaagccgaggagggtggatcacctgaggtcaggagtttgacaccagcctggccaacatagcgaaaccccatctctactaaaaataaaaaaattagccaggcatggtggtgcacacctataatcccagctacttgggaggctgaggcaggagaatcgcttgaacccaggaggcagaggttgcagtgagccacaattgcaccactgcactccagcttgggtgacagagcaaaactctgtttaaaaaaaaaaaaaaattgctatctggtcctgtacagaaaaagtttggtaacctctgggacagggtatcattactgaactactcccttctaagggactgaccgaatgccaggagtacacactgtcaaagacaagacaacagctgtgcactttaaacccatgggcataggacagctgggtaccagcagacacaacgtgagggtcatcttacatcagaagcaaattgcctccagttccctagtttgaaaaacaattattgctcccagtcaattcttaagactcatccttgctagctgtcagtttttgctgggttatttttccttctccatttttgtaacaacagtgacaacaaaaagatgagttacagtccacacgtgtgatggggagagactgaggaagcaagagttggaaggaaatcttcctggtttgtatggatacccccttttccatcatcagagataaactatcttcatgccatatgacttctaccatgtaatcagtatttggaagtacctacctctgtgaaaagacattttcaaagatgaaacacgtaaaatctcacaaaagaatgtcatggttaaaccaagtgtgggttttagagcccaacagctgacttctagttctaaggctgaaggctaggtttatcaccatggaaatagatttttcagtggaaagtccagtggaagcaaggtgggtcctcactttctgagcacacacaggaacccagttctctagagcatctgaaatggccatgtctgccctcacaggtgtgaaatcctacccaatagaggatcctctgacttgtgaaggttacagattaatgccttgaaatattagttttaaaaaacaacaacaaactaggccaggtgtggcggctcacacctacaatcccagcactttgggaggccgaggtgggtggatcacttgtagccaggagtttgagaccaccctggccaacatggtgaaacctcgcctctacaaaatatacaaagattagccgggcatggtggtacatgcctgtaatcccagctattcaggaggctaaggcatgagaatcatttgagcttgggaggtggagggtgcagtgagccaagcttgcaccactgcactccagcctgggagacagagcgagaccatgtctaaaaaataaataaaataaaataaaataaaaaccaacctcctccccaacttttttgcagatgacaagacagatgtctggagaggtgatgtgactcacacaaggacacctggctacaaagcagcagagctggcggcagccctggggcctgtgggcagggccccatccaccaggctttgtttgttctcccccactgtcagcctgtggctgtcatgcccgtgtgagagggaagccacaaggagaaggcgcaaagatgcaatttttctttggtcccttccttgtgccagacatgtattcacacgcatgaaatgaaaagagtctaagatgaagggtgttgttcttgagactggccatgtttgagggccattttaaaaggttacctgtagacatggatttttgtggtggctagatcccgggctcatttggcctcttaagaaagctttagaaggaaaggctaaaacccatggttggaacgtctgtgggcaaaaatattcatggcaaacatgttcattcagtgttcaaatatatgtgcatctatgtgctaagctcttcataggattgttaagagaactaggctcaattatcttcatccccaccttgcaagagaaaactaagactaagatgttaactaaattgttcaaagccacacagctactaagtgaccgagctgagctcaaactcaggctgtcagttctaaaatccaagcttggttaaccatgatgttcttctaattgacctgagtgggaagagaaggaaactctagattatggtggaaactgaggtcaaaaacaagcaacagggccaggtgcaatggctcacgcctgtaatcccaacactttggcaggctgaggtaggtggatcatttgaggtcaggaattccagaccagcctggccaacatggtgaaagcccgcctctactaaaaatacaaaaattaaaaagtaaataaaaaaaaatacaaaaattagccaggcatagtggcatgctcctgtaatcccagctactcagaagactgaggcaggagaatcgctggaacctgggacacggaggttgcagtgagccgagatcgcgccactgcgctccagcctgggcgacagagtgagactccatccccctgaaaaaaacaaacaaaaaaaaacaagcaataggtcagtggacaatggtttgatattttagccactaagccagggtagacgaggtttcccctgggccataagaggcagagctcagaggaaagttcccctgcagggtcctgagacccttttgggcagcagcaaagaaggcctctcatctgtgggcatgtgagcttcacatctcaattctctgagaaagggctgaagtgcaccccaagacttgtcacagagaagctgatggtcccaagcttgctccataaacaaatgcagactgctggaagtaggatgtcactgggctattaaaattctagaaaatattccaacttaagcagcagagacagaaaaaaagaaggaaccaagaaaaatgaataaataaaaaataattatagaaaaaatatagtgttttaacacaggtgaaccacattacagtgcaccctggctagaatcacggaaggtggggaagaaggggtgccatgacttctctttctgctcagaaagggagaacatattaaagtgtgtcctggcgccaagttactactttgccttcatttcctcagctgtaatatgggaggtaacagtaccgacctcccggaatggctggacggatttaaatgagacaggctctggcacagtccccagtaaacaataaacagtgaatatatggttgctgttaatattctaagacatgctacagtggtgtggaaatctttttttaaattgctcactgtattgccactttcttttctgctccccccaccaaccatatttataaaaaacaaaaaaccagcagtggccaagatattataccaacatgacacaggcagacaaccacacttgatctttacaatgaagcatgtgtgtttccactgttatagaagttgactcagaagcacacaatttcctccagcaaccaggggaggggtggctgaggagagggggtggcccagtgacagatggcctggagcaggagggaagagcagggactctgttgccagactgtgtgttcacattcccgtgtaccacttctgtgtgttatttgacaagttattaattttggggaggcctcaatcttgttgcttgtaaaacaaggataaaaataccaccaactccatcaggttggcatgaggattaaataagcaaatacacgtaaaatgcttagagtagtgactggcacataaatgcttcagggttagttagctgctgctgctgtcactatgaccatcatcatcattaaaacacaggaggagcctcagagcagaaggactgagctcagatggctctaagcagagtggaccccaaagggacttgcacagcactctaagaatggtatccattggtgtccccaagcagcttatggtgacaggagtgaaacttcagccgccgattgttgacccacccctgccaaaagccacgctgtaactcaggacgggctgtaactcaggacgatgccccactgaggacaaggtcataacataggaaggagctgtcatacaaccccagacctgtaacactggaaggcaaaagaaccaaagccaggcctggaggagcagctggggctgaaactgaggcttaagaagggagttcatggccaaggcagcctagatccatgtcctgagactggagcactcacctgaatggcagaagacagccaggacgagcagcagcccgaacaggacagaccctccttggattcccattgtgattgtccacagaacctggaaggaagggacaggaaggaatgtcaggaacgaacaaatgactgctggttgtctcaaaaaccaagggctggaaggccaagaaggcttctgagaggaacatttacagggggagtcaaggcacactgaatccctgggccatgccccagctctgacccacagcaccatatacccttgagtaggctcagtccctataagccccagtgtgtactaccacactgtgggaataacactatcttccccatcagggtcagtgagtcaaat

SEQ ID NO: 1606 - DNA, 19718 bp, Homo sapiens; identical to SEQ ID NO: 1605

SEQ ID NO: 1607 - DNA, 19718 bp, Homo sapiens; identical to SEQ ID NO: 1605

SEQ ID NO: 1608 - DNA, 19943 bp, Homo sapiens
ttagaaggaaaagagattttgcgttatattttttaaatgaagcaatacaatcattttttatgtatatatctagttgaggagaaaaaattacagattttttcccccttactccaagataatctaaacagattttactctggatggcttaattataacataatccatgaagttatagccagggggttaaataagaagttgatgacaaacttggtttctctaacaagtatgcaagaaaactcaagtgccacaatgaacacccataaactgctgtcaggaggcaaagtccctatgaggtaataataaacccacgaggttaaggcaaaaccctacggttgtttctgcaaacaaatgtccaggaaactcaagtttgtgatgaaagaacagtcttgaattcaacttcagcagaacctttccctccctgggctccaaagcactatgtcacctacctctccactcaaatgccccattaagtaccatcctgttggagcttcctaacgcccctgctccctggtttcatttggaaccaactgagagacacaagtccctcttcgttgatcagggtcagttgaaagatgtagctgtcggcctggtagccaggtgggcttgctaatcctgcacctctaccttaagcttacccagcgtgaggccaggttagaaagtcacaggccttggcagcaggcagagagcctttactgtcatagtgaagagcttgccaaggacaggactgattcttcctccagcctcacctatcggggcagtcattgttccgctgtcaggaggagaggggccagaagggtcacactgaagaaatgtgacatgagggtggaggttcctgtccagcattcttcactctctatttaaccgaggctgactcattgcagttggcactaattttccattgccacagccctctccagccaggagggcctggagtacctgaggtgctgtttgccgggttcccttggtcctcagactgctcccttcagagaaagcacagaaagccttctctgtcccaaggagccccccttcccctcccccactccagctctgcatctggacacactgtcagccatcagatcctgaccaggtgctcagcctctttagggatatgtcacaatttgccgtgcccggtggctctgggcagcctttggacatgtagtggttgtgtcttggaatacaagagttgtgcctgaatctgggactctctgtgaccctgggaaaatcacatcagctctctgaaccccaattgtctctgatctataaaatgaagacagtatctacttcataggattgatttgatggacatatgtataagcagtgccagggacaactagtaggtggtcattggagtgtggctacagttattatacagttacacatggattccttgattccccattaagccctggtggatgaatgaggaaaatgcagcagggggtccatcctagaaaacccaacccactccagataatcgcgccagcctcacacctgagaagctgcttctacgacctgctgaggacataatgataaacacacacaagaggctactgtgtcccaggcacttgtcttaactcatttaacttttctaacaaccctaaacctagggttctcattttccagatgagaaaactgaggcatgtaaggttaagtaacttgcctgagggtcgccgattagcatcagagccggcatttcaaatagacaggccagctctagaggccagggtgtttggacagcctccaaattgtcaccctagccttcagggcaaggctgcacacacggcctctagtctcctacccctcttcctggcaggaggctggctctgacaggaggttgtttgtgccacaatttaaggaccaagctattctgggaagcccagaacagtctttcctttattattcatctcaattaaccattgtgttggtctggacttgggggtgcaggcattcccatctccctttcaaaaaagtttctaaaaaatgcagagcagcctttattcttgttttcccaggtaaatgtggtcctatgtacttgcagagtaagaatttaaaaaaataaacctgagaggtagtttagtggaatagggagtacagaggcctggaagatgagggagctgggtttaagccccatcaaccggcatcaactagccatgctaccttgggcaaaataaccgtagctaacacttagtgaccacttactgttgtgcgttctcatgttatcctgacagtaacacttatagggtaggtctgtcagaattttctgtccacaagcaacagaagcttacactgagaatttattggagggctttgagacagctcatgtaatggaaagctcttaagaactaggtttagaaggtgcagagaccagggcaacttcagggatccaggtagcaggaaggaatcggtagcctctttggtatggccactatggtggtagacactgtctaccttgtttgctgagtcttctggctttcttccactcttcctgctcttggacatcagactccaggttcttcagcctttggaatctaggacttgcaccagtgggttggttgccaggggctcttgggcctttggccacagactgaaggctggctgcactgtcagcttccccagttttgaggtttttgaactcaggctgagccactactggcttctctctaacccagcttgcagacggcctattgtgcgacttcgccttctaactgtgggagccagttctccctaataacctccctttcatatatacatatatcctactaattctgtccctctggagaaccctaatacatgaattataactctaagtttcagttctggccatagcattatgtcacaccaacaccagcatcaatattttaggttgcctaattaatgtatctgtaaacctatagccagcttgggtggggctattgagagtcagcaccagcactgatcatatataggatcagcctactggggttggccacgttgtatgtagctgcgaatagcaaggaggggaacagcaacatccctagggaaaccgatcacagaaaggcagctcactaccccacagtaaaaagaaccttgagtttcccagttcagtcccctgctgggtgcatgctacccccctcctctcccagaggctctggacctacacagctgctgaaaaagagaaaatgtccttacctacaatgaaccatcacaggcacccacctagaaattaaggtactgtggtcatttatcttatcccagaataacaggagtgtgtataaacaggaagctttagtttagataaataagattatccattacaaaaattttatattgaataacctgtaagtaatttgaaaaagagacttctggctagttttcacttatgtccaagtcagtgggggtaaatgcattgtgattcactgtaggttttagactcttacagccttaacaaccttgtaaatccataactagcatcttcctatctggcagaccctttacaaatgcattatctcaagcctcacaacaattctttgaggtagacatagaaagtgaaagttcagaaagggtttaaaaaaaaaaaaaaaaaaaaacttgtccagagacatagccaattagtggaagagggtttgaacccaggttcctaactacaaaatccacgggtttaactgctgctctcctgaaatgaaatatctacaagaagtagcaggcattgagaaacagatgggaagatagtgttttgatatgattttctgtttacaggaaggcctaactacgtcctgttcacctcatgctattgggtaactttccagtaaaaaacaattgcactttgttttcttttccaaaaagaggcagaaactgatttcttcaaagtaaaaaggcaccagggacccattctagactttccaaagctaggcacatattaaagagagtatacaaaataggcagagaagtagacttgctgacctgaggagctgagtgggaagcatggacttgccaacttacctaagtgaccttgagcgatccagctaactttgcatagtttcctcttgtgtaaagtgaggtgcaagtacagatgaaaatgtatataaaacatagagcttagaatcctgtaccagaaagctgccctcatcacaatgaatgtcagtcagtactagctccagccagctgctcagcccatcaagaatccctcagggggatctgttagcattagttcagatctgttggcagcaacagaaactaatgcgagctagtagactttgaacactgctaaagaacttaccaagagaactcagatgtataaaagtggttaattctgtcaagaggcccaaagtcttgggcaggctcttattttttcaggacacacataagacatgggggctaactgcaaggacacaagaaaaatatacccataccttgaagcccccagtacattcaagaccaagtttggcaaatagattagcatctttcaggaaataccatgagctccacttatctactcatcaggtgttccttgcacccctagctcatccccccaaggggacaatccaatgggcttatcaccacccaatactgaacactatgacagttcctgtaaatccagatgagtggagggcacagggtattggctctcgagcagagagccagtaggcatgactggtgttcgattcctaactcccctgctccctggtttcatttggaaccaactgagacagacacatgaatccctcttcgttgatcagggtcagttggaggatgtagctgtcggcctggtagccaggtgggcttgctaatcctgcacctctaccttaagcttacccagcgtgaggccaggttagaaagtcacaggccttggcagcaggcagagagcctttactgtcatagtgaagagcttgccaaggacaggactgattcttcctccagcctcacctatcggggcagtcattgttccgctgtcaggaggagaggggccagaagggtcacattgaagaaatgtgacatgagggtggaggttcctgtccagcactcttacactctctatttaacctaggctgactcactgcagttggcactaattttctattgccacagccctctccagccaggagggcctggagtacctggggtgctgtttgcctagtactataaatgtctttacattacagtattgcctttgggtccaggcactcaaccttgtctatggcatgagtcacagcaactttttgcagaaagcaaccccaaagtttaaggccatttatatgacccttgttgatttggacagcttaacagccccatctccccatttagtggcactcagattttgctttagaggactaccttcttcccagtgtagtctggccaaaaagtgggtacatgacacaagatagcagtaagccaatctcatcctagaatctcaatcctgagagaggcttccaaaactgtcgactcctggctttctggagtgtggctgaattccccacccccccgcccccaaaaaagttcccagaaattcattttctgcttaaattcatcaaaattgtttctcattccttagaactcacatgaaatgagcttctttgctcagccggtggctgtgggcatggtcagtacttcctcaggccaaaaaaaaaaaaaaaaacctattgatgtaaggaaagacactgagctaacagagaacacagagcaccaaggtaatgctaagttttgataagcaagtttctattttcctatgttcagggaacggcatcaacagaagaaagctggcactgctcaggatgtcttctttcagttgctaccattaagcatactgcatatccttttcggccataaccacattcacccacttgttatatttcattttcagaaaagcatcattcattgcactcggtttgtccaacagagtataatcaagggttttttttcaacattaatcaagaaattcctccatctgcaaaagtcagcctatgccattaaatacagccaagatcataaaatacaaatgtcattaggtctactgaatcttgagattcattcactagaatacacagggaaaaggaaaaagtttgcccttgtgaaaggtgtgtatcattttttagaagagcttctgaaagcctcaaacatctgtgagtgtgctaagagccgttacaaaggtattttatacaatctatgctgagtcagctaggagttagcaggaggctggatgcagatggtaaaacatacccctgcagatctgttgttattaaggatgacctttggaagtctcaaactgtaaccacaaagggtgtccccactgcattcatactatatacacacatacctgaactgcctttctaccagtaacatttaaaataagcacacttaatactgccagtcacatgtagtagagtgttcactctgtaactgtgtgtggcaaagccaagatatcctaccattccaataaaaaaaaggcaaggaaatagctttaacacaccattgatgtatgctattacacttttccagtggaagataacaaagcccatataaaatttaaagacagaggaaaaactcgattttcagccacttgtacctctctaagttttcatgccctgctatctggaacacttccccacttccctgccagaagtcctctagctctgcattaaggatcttgttgtccctgactgacacccacatatggaacatttggcatgcctccatggcaacacgggatccctgaagtttatgaaagcgttccatgtgagagaggatgctcatatactcctgccccaccctccaaagatgtactaatgatgctaactgactacatccaaggagccagaggaaaaataatctgagggctgcagagaacccactcaagctgtcactgcaaagctggtcttcccaagagcaaaggaggaagcatgcaatctagttcaagtcacacctacttcactcttagacttcttccttcaagtggggcttccctgcaaacaggactggtcttcaaagtctcccagagcccctctatcttagccaggttgctcaagctaattttattctttcccaacaggatccatttggaaaatatcaagcctttagaatgtggcagcaagagaaagcggactacgcaggaacggggagtttgggagaagctctcctggtgttgacttagggatgaaggctccaggctgctgccagaaatggagtcaccagcagaagaactgttttctctgataaggatgtcccaccattttcaagctgttcgttaaagttacacaggtccttcttgcagcagtagtacgttagctcattttccctcaagcgggttgtgacgtcgttgaaattgcaatgctcaaacttccaacacttgttatacacttgtaaccctgtggggagacacacacaagggtaagaaagtaagtgggaagagttctgtatctgcttttgaatcctcaattctatttcgtatgtatcctgtgcaagtagagacttctaggcaagatgctcatcccaggtgggttgtaaaggagaacaattaagtaaataatgatacacctctaaatagagcttttacagaaaaccaaggtctcatcagagccagtatagttatgggggtgggacggaggaggaacaggcatttatactgttaagagggaaatttggtaatatctgccaagattttaaacacatgccccctttgatccagcaattccacttttagaatttacgctatgaagttacttggggattttttccttttcttttcttttttttttttagagagataaggtctcactttcttgcccggtcatctggtcttgaactcctgggctcaagtggtcctcctgcttcagcctcccaaagtgatagaattataggggtgagccaccatgcccagccaaagctatgtataagatatatgctcaagaatggtcagaaaaaaacctgaaaaacccagtccattaatttttaaaaagtgttaaagaaattacaatagaattccttacaatgcaagttccatgcagataagaaatgacgtgggccttcaagtgctaacatggaaggagcttgatttaaaaaaaaaaaaataaaggtggggggggggcagaaaaataggtaaactggactccatcaaaatttaaaacttttgtgcttcaaaggacattatcaaaaaataaaaagataactcacagaaagggagaaaatgtttgcaaatcacatgtaaaccaccaggtgcggtggctcacacctgtaatcccaacactttgggaggctgagatgggagaattgtttgaggcgggaagtttcagaccagcctggtcaacatggcaagaccccctctctatttcttttttaaagtcatatgtaagagcatagtatccaggatatagaaaacattcttaaactctacaataaaaagactaacccaattaaaatatggacaatgaggccagtgtgatggctcacacctgtaatcccagcactttaggaggctgaagtgagaggattgcctgcggccagcctgggcaacatagtgatatcccaactctacaaaaataaaaaataaaaaaattagccaggcagggtgttgcgcctttagtcttagctacttgggaggctgaggcaggaggatcacttggactcaggactttaaggctgcagtgagctatgattgtactgctgcattccagcctaggcaacaaagcaagaccttgcctctttaaaaaaaaatgggcaaaggatttgaataaacatttctccaaagaagattctcaaatggccaataagtacatgaaaagatgcttgatatcattagtcattaggaacatgcaaatgaaaatcacagtgagataccactttatactcactaggatggctaagatcaagaaaatggtaaatagcaaatgttgcaaggaagtggaaaaaattggaaccctcaaacattgctggtgggaatgtaaaatggtgtagatactctggacaaatttggcatttctgcaaaaagttaaagatagagttatccatttgactgagcaattccactcacaagtgtatatacttctgccattctctggaaggattcccaagtaatttaatactgttatcatcatggaagaatacacttcgtttatgtttctattgagtttttcaaatttgccacatggataatttttaaaatatttgaaacttcattttaaaaatcattagattattcagtaatacaggaaaagtttctataagaacatgctatcatggtctcatttttggaaaaatagccttgggcacacaggaaaataaaggccagatgtatacactccaagtatcttatcgtagtttgaattgaaaactacgttcacacacaagtttccacatgaatgttcatggcaccatgattcaaaattgctaaaaagtggaaacaacccatatgtccattactggtgaatggataaacaaaatgtgatatatccacacaatagaatactatgtggccacaacagaatgaagtactgatacatgccacagcatgagtgaaccttggaaacattatgtttagtgaaaaaaaagctagtcgcaaagtgccacaatactgtatgattccttgcatatgaagtgcccaggagagccaaatctatgaagacagaaagtacatcagtcactgctggggcatgcaggagggaggaatgaggactgactgctaacaggtttcttttcaaggtgacagaaagatcctggaattagacagttgcgataagtcatacaaccttgtaaatatactaagagccactgaattatacactttaaaatgtaaacgttctggtctgtgaattatatctcaataaaaaccctagatgcagaacagtgtatagaatgtgacccatttgtggaaataaagcacatatacattgaggtaagtgcatttatttttctctggaaggattcccaagtaatttaatagtgttatcatcatggaagaatacacttcgtttatgtttctattgagtttttttaatttgccacatggatgatttatttttaaaatatttgaaacttcattttaaaaatcattagattattcagtaatactggaaaagtttctacaaaaaacacgccatcatggtcccatttttggaaaaatagccttgggcacacaggaaaataaaggccagaagtatatactccaagtatcttatcacagtttttttaatattcagaaaaagcatgttaggtgaaaaatgtattagttgagagagtggtattatggtagattttcttctccaaaaataactgagtgcctgtgtgctagatactggggtataagaaggtatttgtccttgccctgaaagtggtttcttatcttctgtgctggaaagaaaaaaacgcagatgcatacttccttatttcaggcttgtagctaatttacccaattccatgcagagcttggaacacaacacttctcagtttataactgcaggcataactgtcctgtcctcctcctctgaggggatgggtatctggattggaatttaatgaagtttagtcaagtggcagagtccacatagagtattccagaaatggctctagttgctgaagtcttaactaaataactggaagcttctaatattgtactagaggctgctggtgattcagacaagttactgctttgtaacagtaattacgcattggaacttgaaaagctttaaagctatcagaattttaattagggaagcctagaagcttggggagaacagacagtaatttatgaataattgctaccaattaatcatttactatgtgtcgtgcagcgtaccaaagtgctttacttgaattatcatattcaaacaacagccttaacgatggtaataatctcaccaaagccagccttggaattatccacataaaagtggcttatatcagaatccctggagtgttacaggttttctcctcctcactctttttgaagacttcggctcaagtctatctaaagtcaacagtcttcagctgtcctaggcacccttaaatgtggcccttgttcagaacgtcattacagcagtgaccacttgacactgtcatcagaggctccttcaagactaagtacatttaaccttgcttacacttccatggtttatactgctaggatgccagtaaatattggttgaattagcagccaacctgtctctcttctagacttactttgtatagcaccatcatatctgtctctgtgcaaacgtcatagcgtgtagttacacaaacttacatggaatagcctagtacacactcaggctatgtggtatgtcctattgctcttaggctacaaacctgtacagcaagttactatactgaatactgtaggcaactgtaatgcagtggtaaatatttgtgtatctgaccatatctaaacatagaaaaatacagtaaaaatatgacacaaaagattttaaaaatggtacacctgtacagggcacttactgtgaatggagcttgtgagattggaagtcagtgaatgagtggtgggcgaatgtgaaggcctaggacattgctgtacactactgtagatgttttaaatattgtacatttagtccacactaagcttattttaaaaaatcaaccctagtttactgccactttactttagaaattttttaattgtaaatgtttttacctttgtaataaaacagggtaaaacacaaacatgttatacagtggcacaaaaatattttctttctattcttattttataagcttttttatttaaaaaaatttttaaaaacttttcttgtttttgttaaaaatgaagacacaagcacacacattagcctagtcctacatagggtctggatcatcagtatcactgttttccacctcttcatcttgtcccactggaaggtcttaggggtaagaatactcatggggctgtcctgtcctaggagagcaatgccttcttctggaatacctcctgaaggacctgcctgctgaggctgtttttttttttttttttcttttgtagagacagagtcttgttctgtcacccaggctagagtacaatggcacgaccttggctcactgcaacctctgcctcctgggttcaagcaattcttctgcctcagcctcccgagaggctgttttatagttaatttttttagtaagtagaaggactacatgctaacatgataaaaaatatagtaaatacacaaaccagtaacacatttattataaaatattatatactgtatataattatcaaaatatcaagtattatatattgtgttatattttagttttgtaataaactaccaaactgtcatccacagtagctatactggtttgcattcccactaggaatgaatcaaagttcccactgctgctgggcgtggtagctcacgcctgtaatcccagcactttgggaggccgaggcaggcagatcacttgaggccaggagtttgagatgagcctgggcaaaatagtgaaaccccgtctctactaaaaatacaaaaattagctgggcatggtggcttatgcctgtaatcccaattactcaggaggctgaggcatgagaatcacttgaaccctggaggcagaggttgcagtgagccaagattgcaccactgccctctagcctaggtgacagagcaagaccttgtctcaaaaaagaaaaaaaaaaccagaaaaacaaagttcccattgttccacatcctcaccagcatctggagttgtcagagttttggagtttggccattttaataggtgtgtctcatttttgtttacattaaccatttataagaaattttgggatttaagagctggaaaaagatcttggctttgacctcctttcctctcctccctacctctgctgtccaacacatacatttcataaatgaaaaacagaggtggagagagctagctggtggcaggacagaagtcagagctctaattgctgctgtaatattcattcaacacatagtaattgcccttatcgtctcatttggaaactatacttagtttaattatacttagtagtgaggagtccaagagacacagttgatcaagctaaagagccaagtcttctgtgctcgtacataatgaccatgttctcgctaggggccttactacgcttcctacattaacagtgaatgaatatggtcttccagtgggggcagagggactggtgccctacagaatcaagagctctgaatggaaggtttggagttttagctgcaatccagctaaactatatcaaatttatcaaatccagctaaatatatcaaaattatcagatgcccctgtttttttagacagggtaactataatttgtctttagttattgagggatttctcctttctggggaagttaatcatctttatctcaggtttttctgaacatgtgggtgtcccaaggcttttctgagtttacctgacatgttcaccatttcttgatgttgacactggggggagctggtgtagaaggtctaagagtacaaataaccttgtggagtgtttttattattaatctcttagaaatctaagcctgagggttttaccttggacactaagaacattctgaaactgccattcctcgctggcatcatttgcacacatcgattctatccagaaccacaccccagcaagaacagagggcatgtctttgctggtttctttcctctgtctaccacttcctaaactctattttaacagggtgatggaggtgaatattctgtagtctaacaaatttggaaaatgcagactggacaggacttgtgcatgttagcattgcccatccccaaattcatgagcaccttgctctgaggctaccgagccctggcacctgctgttgcccctcccaggcacacccttcccttcttagccctcttacctcctacgtgtcctttgagctcagcttgagtctcctcaggactctgaatataccagataccccatggaatgagacagaggcatatataatgacatttaggacagccaaacaggcctttgtcataattttaattgtatgtgtcctttctttatctttgcatccctagctcctaaccctctgctgggcacacagtaggttctccaaggtctgggaggcagcacagggctgctgtaaaagagcacaagctttggaatcagatggacttccatgttcaattcctgagtcggttacttaaccataatttcttgcttaatctgaacctccatttccacatttatcaaatggaaataaaagatcacccttagaagtgcaaaacattaaatttaaaatgtatgaagaaagtgcttagcccaatacacacctgacgctaataaatggtagctattacttgatgcaagcctaatgaggattacagtggcacaatttttttcccaggcacttattaccccattacatttaggagacagacaggggaggctcttaccagctttggtaatgagacacgcatcaaaatcagatgaacaattgacggctgttttgcagtcagcagttgggttaggacagttgtagcactgcaggctatgacctagaatcaggaagaaagtcaggatctcttaaagcagcactgacttgtcccctggcagcccaccatctccattaatatgggcccaaagtcagcaacttgtggtatacttccactcccgcacaaatgtatagcagttatatctttccaaattcaaactacagttccagcaacattttttggaccctgatgcaagcacaaaggaaatatccacatttgaatatccatctaactgtgcaattgagaagcttcctcctaacctgcaactggaaggagattagtctgcaatgtaatgatgtgttaagaagaaattaccgagaaacaaacagaattctataagtgtcttccaagcaatgaatatgcccaattaaatcacatcctcgtgggttgatgatcaatgtctggcaatacctatctgcgtgaaaatacattttcaaaatgaaatatgtaaaatgtcatcacagattagtattaatagatgaacatctgcaattgatttgatgcgagggaacactaattttgaaccccaattaagcaaatggttatccccctaaaaagaattctattcccctcattagtagatgtgtattattatgctggactcaataattatgttatgaattttgtcaataaaaaaatctgtgaaaattttgtttcttattattgaggtaagtctcataatacccttgattttgcctcttggtctgcaaagcttaaaatatttactatctgggccaggcgcagtggctcacgcctgtaatcccagcacttagggaagccgaggagggtggatcacctgaggtcaggagtttgacaccagcctggccaacatagcgaaaccccatctctactaaaaataaaaaaattagccaggcatggtggtgcacacctataatcccagctacttgggaggctgaggcaggagaatcgcttgaacccaggaggcagaggttgcagtgagccacaattgcaccactgcactccagcttgggtgacagagcaaaactctgtttaaaaaaaaaaaaaaattgctatctggtcctgtacagaaaaagtttggtaacctctgggacagggtatcattactgaactactcccttctaagggactgaccgaatgccaggagtacacactgtcaaagacaagacaacagctgtgcactttaaacccatgggcataggacagctgggtaccagcagacacaacgtgagggtcatcttacatcagaagcaaattgcctccagttccctagtttgaaaaacaattattgctcccagtcaattcttaagactcatccttgctagctgtcagtttttgctgggttatttttccttctccatttttgtaacaacagtgacaacaaaaagatgagttacagtccacacgtgtgatggggagagactgaggaagcaagagttggaaggaaatcttcctggtttgtatggatacccccttttccatcatcagagataaactatcttcatgccatatgacttctaccatgtaatcagtatttggaagtacctacctctgtgaaaagacattttcaaagatgaaacacgtaaaatctcacaaaagaatgtcatggttaaaccaagtgtgggttttagagcccaacagctgacttctagttctaaggctgaaggctaggtttatcaccatggaaatagatttttcagtggaaagtccagtggaagcaaggtgggtcctcactttctgagcacacacaggaacccagttctctagagcatctgaaatggccatgtctgccctcacaggtgtgaaatcctacccaatagaggatcctctgacttgtgaaggttacagattaatgccttgaaatattagttttaaaaaacaacaacaaactaggccaggtgtggcggctcacacctacaatcccagcactttgggaggccgaggtgggtggatcacttgtagccaggagtttgagaccaccctggccaacatggtgaaacctcgcctctacaaaatatacaaagattagccgggcatggtggtacatgcctgtaatcccagctattcaggaggctaaggcatgagaatcatttgagcttgggaggtggagggtgcagtgagccaagcttgcaccactgcactccagcctgggagacagagcgagaccatgtctaaaaaataaataaaataaaataaaataaaaaccaacctcctccccaacttttttgcagatgacaagacagatgtctggagaggtgatgtgactcacacaaggacacctggctacaaagcagcagagctggcggcagccctggggcctgtgggcagggccccatccaccaggctttgtttgttctcccccactgtcagcctgtggctgtcatgcccgtgtgagagggaagccacaaggagaaggcgcaaagatgcaatttttctttggtcccttccttgtgccagacatgtattcacacgcatgaaatgaaaagagtctaagatgaagggtgttgttcttgagactggccatgtttgagggccattttaaaaggttacctgtagacatggatttttgtggtggctagatcccgggctcatttggcctcttaagaaagctttagaaggaaaggctaaaacccatggttggaacgtctgtgggcaaaaatattcatggcaaacatgttcattcagtgttcaaatatatgtgcatctatgtgctaagctcttcataggattgttaagagaactaggctcaattatcttcatccccaccttgcaagagaaaactaagactaagatgttaactaaattgttcaaagccacacagctactaagtgaccgagctgagctcaaactcaggctgtcagttctaaaatccaagcttggttaaccatgatgttcttctaattgacctgagtgggaagagaaggaaactctagattatggtggaaactgaggtcaaaaacaagcaacagggccaggtgcaatggctcacgcctgtaatcccaacactttggcaggctgaggtaggtggatcatttgaggtcaggaattccagaccagcctggccaacatggtgaaagcccgcctctactaaaaatacaaaaattaaaaagtaaataaaaaaaaatacaaaaattagccaggcatagtggcatgctcctgtaatcccagctactcagaagactgaggcaggagaatcgctggaacctgggacacggaggttgcagtgagccgagatcgcgccactgcgctccagcctgggcgacagagtgagactccatccccctgaaaaaaacaaacaaaaaaaaacaagcaataggtcagtggacaatggtttgatattttagccactaagccagggtagacgaggtttcccctgggccataagaggcagagctcagaggaaagttcccctgcagggtcctgagacccttttgggcagcagcaaagaaggcctctcatctgtgggcatgtgagcttcacatctcaattctctgagaaagggctgaagtgcaccccaagacttgtcacagagaagctgatggtcccaagcttgctccataaacaaatgcagactgctggaagtaggatgtcactgggctattaaaattctagaaaatattccaacttaagcagcagagacagaaaaaaagaaggaaccaagaaaaatgaataaataaaaaataattatagaaaaaatatagtgttttaacacaggtgaaccacattacagtgcaccctggctagaatcacggaaggtggggaagaaggggtgccatgacttctctttctgctcagaaagggagaacatattaaagtgtgtcctggcgccaagttactactttgccttcatttcctcagctgtaatatgggaggtaacagtaccgacctcccggaatggctggacggatttaaatgagacaggctctggcacagtccccagtaaacaataaacagtgaatatatggttgctgttaatattctaagacatgctacagtggtgtggaaatctttttttaaattgctcactgtattgccactttcttttctgctccccccaccaaccatatttataaaaaacaaaaaaccagcagtggccaagatattataccaacatgacacaggcagacaaccacacttgatctttacaatgaagcatgtgtgtttccactgttatagaagttgactcagaagcacacaatttcctccagcaaccaggggaggggtggctgaggagagggggtggcccagtgacagatggcctggagcaggagggaagagcagggactctgttgccagactgtgtgttcacattcccgtgtaccacttctgtgtgttatttgacaagttattaattttggggaggcctcaatcttgttgcttgtaaaacaaggataaaaataccaccaactccatcaggttggcatgaggattaaataagcaaatacacgtaaaatgcttagagtagtgactggcacataaatgcttcagggttagttagctgctgctgctgtcactatgaccatcatcatcattaaaacacaggaggagcctcagagcagaaggactgagctcagatggctctaagcagagtggaccccaaagggacttgcacagcactctaagaatggtatccattggtgtccccaagcagcttatggtgacaggagtgaaacttcagccgccgattgttgacccacccctgccaaaagccacgctgtaactcaggacgggctgtaactcaggacgatgccccactgaggacaaggtcataacataggaaggagctgtcatacaaccccagacctgtaacactggaaggcaaaagaaccaaagccaggcctggaggagcagctggggctgaaactgaggcttaagaagggagttcatggccaaggcagcctagatccatgtcctgagactggagcactcacctgaatggcagaagacagccaggacgagcagcagcccgaacaggacagaccctccttggattcccattgtgattgtccacagaacctggaaggaagggacaggaaggaatgtcaggaacgaacaaatgactgctggttgtctcaaaaaccaagggctggaaggccaagaaggcttctgagaggaacatttacagggggagtcaaggcacactgaatccctgggccatgccccagctctgacccacagcaccatatacccttgagtaggctcagtccctataagccccagtgtgtactaccacactgtgggaataacactatcttccccatcagggtcagtgagtcaaatgacaatatgagcaaattgactcatatagccactgtggttcccactctactggccccaccccaagctgctggctgaaagagagggccacttctcggagccacagcactaagtgaatcagaccaaaggggtgactctggaaggcaccagcatgcattcagcagtggaacagggagcaatggcttagcatacctggaagctctggctcctcactgtaagaagtataat

SEQ ID NO: 1609 - DNA, 33470 bp, Homo sapiens; identical to SEQ ID NO: 1604

SEQ ID NO: 1610 - DNA, 33470 bp, Homo sapiens; identical to SEQ ID NO: 1604

SEQ ID NO: 1611 - DNA, 33470 bp, Homo sapiens; identical to SEQ ID NO: 1604

SEQ ID NO: 1612 - DNA, 4250 bp, Homo sapiens
tccactcacagcctgaagcatacccggcaggggctgtccccaggcccaacaagcaaagggcccagtagcgagggccactggagcccatctccggggggctgggcaggaagtagggtggggtttggggtagggatctggtaccctgggactgctgcaactcaaactaaccaacccactgggagaagatgcctgggggtccaggagtcctccaagctctgcctgccaccatcttcctcctcttcctgctgtctgctgtctacctgggtatgtggccaaagggcaggaactggcgggaggtgggggaagctgtggaggctgcagagagggcacaggcagagggaagggggctcagggaaaggggaagaggaggcagaggataggggacccagggaagatgcctatagaaatcgtatctgtgccaagatgggccaaggtggggctggagggagcccagcgaaggagaaggggcgtccacagtctcacacagggaggcaggagcaagagtcacctcccccacctcctgttccccacaggccaaaataaggaactaaagttgctcttgactgagcaccagggctgggggcaggaaggggacttaggggtagcagcattcagcgtctgtcaaggggagaaaaagctttctctgccttaaacctcaggtgcctctctctgttgggagtcccttctcagcactgggggaatgggtgtctcatggactccccctcacctgctcaaggacagctggcaggggctgtggccacgctaacccaggagttcagagaaaaaggttccccacccaaggggacactgggagcaaggattggagttcacgtctgagtcttaagcccgtgacgatgagggtgctcggcccctctccccatctcttcctccttctctcttcctcacctccctcctccacctacctccagaagaggggactggccatgtgggaggcctggctgagagctggggcttcccagaggagcccggattggacactgcagccagcctgagccgcctcgtctcactcagagacacccccagtctccaccccgctctgagccccttcaatcaccagcagcccagcccaaggactgaactcacccctgacccctaggttgacacatacaacttacagagaatgagggccaggcacagggtcacaggccagggcaggccacagactggctcctcagcccaggcagggagaggccagggagccaagagtttgaacccagtgccactcctgactgcctggtgatgctggcaacccgcctgccctcccagagcctcagccatccctcctgtaaaatggggctaaggagagaacctacttctagggttctgtgaatgattacacaagaaaaagcgccaggtgctgggcctggctgaggctggggtgcaaaaatggaccgggaaggctgcgggaggaggggacgcctgcactgcttctggaaggagctgtctggacagcggtcctccagtgcctggaacaaacatccaaaatccagagagttcacagggccagagtacaaagtgcgtatgcgggagggggacaagagatggcgctgcagaggtgagaagggcctcccaggggtcttaccatcccagggagtctcattctcctctcccaggatatcctcacccaccccaaccaggtatgtcctctctccttcccaggggcttcttcactttcccgcatcccccctctccccaggatgtatcagcccctgtcaggggctctctctctccctccccacccaggagagtcctcaccctcttcccaggagtgctggaactgcaggggccagggctggggaaatgtgtcaccatccccagtccctgacccacccaccctgtctctccacaggccctgggtgccaggccctgtggatgcacaaggtcccagcatcattgatggtgagcctgggggaagacgcccacttccaatgcccgcacaatagcagcaacaacgccaacgtcacctggtggcgcgtcctccatggcaactacacgtggccccctgagttcttgggcccgggcgaggaccccaatggtacgctgatcatccagaatgtgaacaagagccatgggggcatatacgtgtgccgggtccaggagggcaacgagtcataccagcagtcctgcggcacctacctccgcgtgcgccgtgagtggcccagccctggcccctactcccactgtcccgctggggacactcggtttatctttgaagtggggatagagccagtaccttcaatgtgggtttcaaaccggcttggacagagggacggacattctcctctgcagagtggggtctctggggggtctggggccttgcaggaggtgggcggggccaggaggctagggagggcaagaggggccagggctctgagccatactacctccttgcagagccgccccccaggcccttcctggacatgggggagggcaccaagaaccgaatcatcacagccgaggggatcatcctcctgttctgcgcggtggtgcctgggacgctgctgctgttcagggtgagccccctcggacctctgagtcagccgggcgagggcctgggccgagggacccccaatacccaggtagccctctagagcctgaggttccccatccaaaacttgggagaatgaaagcacccaccatataggggctgtgggagttaaatgaatgaatataaagaagggacttgaactggcgctgagcccagggggtgtcttcaatttagtttccccttctgggctgtcctcacgtccacctccccccaagaagagtctcattcttctccctaagagtgtcctcactcccctcctgccctcacccaggagtgtggttaccctccaggtgtagccaagaccagggaaggtggggcctggtcctcccagaatctctgatctgtaccagcctctccttaggcactacagaaagtgtgactgttattgttattattcatggagaatagtaagggagtggagactcaagaagacgctagcttgggaggccgaggcaagaggatcacttgaggccacaagtttgagaccagcctgggcaacacagcaagaccctatctctacacacacaaagtcttaaaaaaaaattagccaggcatggtggcacacacctatagtcccagctactcaggaggctgaggtgggaggattgcttgagcccaggagttcaaggctgcagtgaaatatgatgttgccacagcacttcagcctgggcaactgagggagaagaaagagagagagagagaaagagagagagagagagagagagagagagagggcgagagggagggagggaaggaagggaagggaagggaaggaaggaaggaaggaaggaaggaaggaaggaaggaaggaaggagaacactggttgtagactcagagagaactgttacataaccagtatgtggccttggggacatctcttaccctttctggaaaagtacttcctggcatccaggagggtctgaaagatattcacctccccctgctcactgaggcacccaccccacccacccctacagaaacgatggcagaacgagaagctcgggttggatgccggggatgaatatgaagatgaaaacctttatgaagtgagtgaagggtggggatggggtaggggcagttgtgttaggggtgggggtgttccctctgggggtggctgggggcagggaccccaggtgtcagggtgctgatgttcgctgcctcatttccatcccagggcctgaacctggacgactgctccatgtatgaggacatctcccggggcctccagggcacctaccaggatgtgggcagcctcaacataggagatgtccagctggagaagccgtgacacccctactcctgccaggctgcccccgcctgctgtgcacccagctccagtgtctcagctcacttccctgggacattctcctttcagcccttctgggggcttccttagtcatattcccccagtggggggtgggagggtaacctcactcttctccaggccaggcctccttggactcccctgggggtgtcccactcttcttccctctaaactgccccacctcctaacctaatccccccgccccgctgcctttcccaggctcccctcaccccagcgggtaatgagcccttaatcgctgcctctaggggagctgattgtagcagcctcgttagtgtcaccccctcctccctgatctgtcagggccacttagtgataataaattcttcccaactgca

SEQ ID NO: 1613 - DNA, 4250 bp, Homo sapiens; identical to SEQ ID NO: 1612

SEQ ID NO: 1614 - DNA, 3607 bp, Homo sapiens
tgtggtttctcaggacacaccgtttattccacgggggaaggcactggaggccagggcctccctggggtgggagtggttgcgggagaggaatgatgttcctgtggctcttctggggcccagttgggtccatggcccttcccaagctctgctgggaggccctcggctccgagtccatttgcgggctctggaccagtctctgcctcccccatcccatgtgtggggacggatcacctcatagcacccccagaaggctgggtcccgtccatccccagagaactccctccaagttgctgccctgttgtccttctactccaggccctttggcaagagctggggaccaggggctggagacaaatggcagctctggtgggccagcttcagaggccagctggggggtccaggaaaggggttgggccatgagccaggcagctccgaagcagtcactgaggccagggagcctgcacccaggtcatggggcgacctggctctcactcctggcctgggtgctcacctacagaccacttcacttcccctgtccgcagcgtcactatgtcctcataggtggctgtctggtcaatgtccaggccctggagacattaagtggaactcaggccgggaccacaccccaaccacaccagcagatagtggccactgaccccgaggactcagagctgctgggcctgcccctctccttacctcgtaggtgtgatcttcctccatgccagccttgctgtcatcctgggggcggagagggatggagatcagagtgttagtgtcccccagccccatcccctgctgggccaggctggggagggccagggagaggggtgaggggtcaggagtgaggtgcattctgcaagaacagctgaatgaaggaaggaaggaaggaatgattgaattggtgagccagtggggacaggctggaccaagaaggccacaacgagagctggggagatggagaccctgcatatgcctggcctatgcggtggcctcctctgcggtcccccaaggcttcccccgtcccctgatcaccttgtccagcagcaggaagataggcacgatgatgaagaggatgatcagcagcgtctggatcatgatgataccatccttcagcgtgttcctctgcttcagctgtgccaaggtgctgaatcctgcggggacaggggtggggttgtgagcctgggccacagtccaccttttaggcctacaagggcagctccctcaggtcccagtggctctcctgagtgctctagggccatgaccatcaccacaagaggcaggccgggctagggtggggcggacagctacaggagcgtcccagccacctggcacacacccatgactcgcagctctgtgccgcagccctggtagacctccgaggtgttgttgcacttctgctgacagaagtagatgccattgtcctcaaaccggatgccttggatggtgagggtggcgagagattcgttctgggactcttccatgcggcccttttccagcttcagctgctggggattctcgtccatctcctgcttccagagccagctcacattgccggaggcgctgttcatgtagcagtgcattttcaccgtgaagccccgtttcctggctatgaaacgtgggctctgccagatccgcgaacaagcactacctgtgggtgccaaggccaggctcagcattccgcttggcatcttcctgagtgccagccccagcagcaggcccctgccctggctggcacagactccctgggcttagtccttgcttctcagggtgtgggacaggcaggaggctgaggttggagttgggaagcagagccacgtgagaggctgagccacatgagaagccacggccaagctctcagactccacctcttcccgactgccccacctccccttcgattttcctttggaagagccctgggaccttgccattccttcctatgcccattacaacagcctgacccaggccacacccccaggacctggaggcccacaggcctggcccctcctttcactgggctgccctgcacaggcttgaaatcctcagtctcccccgttcctccagggataaaggccaaattcctagtctgtcaactgagaccttcctcagtcgaccccctccctgcatgacttccctctatcatccccctcttccctcctgcagggactgggtccacttcttgttccagaaccctctttccagcttcgactgccttgttcttagtgagcactgcccgggaatccctgagcccctcacatagtgaccctgcactggagggctcacccgagactcagccagattcccagctagacaggcccgggcctgagtcctagaggaacccccaggctcccttgctatgacccagagtttagcccagcccttcagtggccaaggctggagggcatgtgtctgatgaggatgacagtgggctgggggtggggctcagaggagatcctaaggaggcctggggatgggaatcctggatggggagatcaggcaagggtgggaaggcggaccgcccccaggacagggaccatagtcggacacaggacatagtcgcacacaacttgccctcagaagcggcaggcgaggctactgacctttgggattccggtaccggtcctccgatctggctgctggtactggctcagctgctgggtgggaggaagtgggcggggccagtcagggcctcctctggcctgggctgccccacccctgcatgccctctatgttcccggagctacttcctccttccatgacagcagcttcaagacccctcggtcctccctgcccccagtacttgggagacagatatggggtgggggtaccggaagccctgcccccagccccctttctgcctttgaccctcatggtggctttgagcaggcatctgaatgagacaggagggacagggaaatctcagtattttgagaggccaagacaggaggatcgcttgggtccaggagtttgagaccagcctgggcaacatagggacaccctgtctctctttttttttttttttttaaagagagacaggaagaaagtcacagcccggaggatctttcacctcccagaggaggggaccacatttggatcttgcatcttccagggtccggttgggacagcctctcccctcccgacccccaggcaccgccctcagcctctcttcctcctgagcctagttcttccacggtcctggttgctaactctggtttgctcctcatgcccagctcagcctgatgctctccaggcaggagaggaactggggccacaggctcctgagcccatcaccacgtgcagctgacacccacagacccaggccccagggccatgagagggagacaggcggtaaagagtgagagacagaggaggagggtggagcaagcaggaggcagagccgcagggcccagacagctggagatgagagcaaaccccacaggcctcgtcgtgggttctgtacctgagagcagcagcagcaacgccaccatccagtggctgggcacaggagacaacgccagcctggccatggtcaccgctctgtccccgaccccaaacccgtgacaacgtccgaggctccttggaggaaaacgtgtaactgcaccggctgcag

SEQ ID NO: 1615 - DNA, 3607 bp, Homo sapiens; identical to SEQ ID NO: 1614

SEQ ID NO: 1616 - DNA, 3607 bp, Homo sapiens; identical to SEQ ID NO: 1614

SEQ ID NO: 1617 - DNA, 20103 bp, Homo sapiens
gagcgagcgcgcaacggcggcgacggcggcgaccccaccgcgcatcctgccaggcctccggcgcccagcgccccacgcgcccccgcgcccccgcgcccccgcgcccctttcttcgcgcccccgcccctcggcccgccaggcccccttgccggccacccgccaggccccgcgccggcccgcccgccgcccaggaccggcccgcgccccgcaggccgcccgccgcccgcgccgccatgggagtggagggctgcaccaagtgcatcaagtacctgctcttcgtcttcaatttcgtcttctgggtaagggctgcgccgggggccggggcgggagggggcaggcacacactccacgttgggcaggtcccgcggcagcgtgctaggccccgcgggcgcagcgcgggccgcgaagttgtggggccacctgtgggctccaggagcggggtggggggtcgcccggggccaccgcgccccccgacattggggctgagggctgcgagccgagtttcggggcctctgtgctcgggggcccacctctgcggccgggccggggcttctgggggccgccgggcagttcccgctgtggtggtgatgggtgcggtggtcgcgggtcgggacccgagtacccggccgcccctcagctaaggaggggcctgcgcgggtccctggccgcggattccggactgctgcttcgcggggacgaggggggggctcgcgggcgggactcctggcgccccgcccccatgagctcatcaagagccgccgcccctggatggtggggcgggggcgcacactttgccggaggttgggggcgatccgcctcactctttccccagcccagctcactctccaatctgcggtcaccacccgagaccttcctgggggtcgcgcctaaaaggagcgcagactcccgccgggatggcccagaagctggggtgcgcgcaccctggccgtccctgcctgggagccgatctccctctcctcacccagacacgttccagcggaggcctcctcccagaagggctctggaggcctcgcaggagtggggatcccgcggttctgagttggcacaaggaagagagtggcaccaggggcctggagtggatggcagggtccgggagtggggccgctgctttgcaagaggggcccccacgctgggcatctttgggtgccagcgtgggtggaggagggtcttttgctgagaatggctttctcctgaccgcagtctttgctgctgggaagtgactgatgggctttcgccttttgtttccatttcctgtcggtgttagaattggggagggggtggaaatcccttcttggcctggaaggactggagtgggtgtccatggccgcggcctccccgtggccacgcccctgggcatagactgcaagcccctccccgtgccccccaggctgtcacccccttctcgtggaagactcggctgatgtcccagtggaccgagtgtttctcaagttgaggcagggagggcaaactttttaaatggcccctggagccagtgtgtgggaccagagacatctgtttcccatctggacggctgaggatcccagtgcggatgattatttggagggggaaggacggaggctgaactgaactctcagctgggagatgagtggggcagtcacatcccaccttccccaagccgggctgttctgcacagcctgcttgggacgctggtgggagtcactgtggccttcggcactgccctggcagtgggggcagctaggccatttgggaggggctcgccttccccaggcccggccctgggacctcagccgttgcttagtggtggcctgcttcagcccaggcatgtgggagaggcaccagacacaggatgtccctctgccagcccctgaagccccgtcccctgacgaggcgagtgtggacctgggggtgggggctgagggagactgtggacctgggggtgggggctgagggagggtgtggacctgggggcaggggccgagggagggtgtaggcctgggggtagtaggggctgagggagagtgtggacctgggagtaggggctgagggagggtgtaggcctgggggtgggggctgagggagagtgtggacctgggggtaggggctgagggagagtgtggacctgggggtgggggttgagggagggtgtggacctgggggcaggggctgagggagagtgtggacctaggggcagaggctgaaggggagtcacgggaggggacttctccggaggtggatttttgctctctggacggtgtgtcagcactgggtgagcccctcctgcctgcccaggctgagaggtctccctggcagccccctgggagtgtcgccagggcgggcctggaagtttcccaggcagctggggtggagacctgacacatcccaagggtgcttgttattaaggctcaaggaaatgtctctgaggcctcaccgctcctctccccagggcctgctccctgcaaagcattgagaactgagtccgtccacagtcactgtggacccacccatccactggggctcagtggtagccagcaatgccaggctgggtgaggtggggttggtgggcaccaccctggtggacccccctccaccctggtgtcgcagggtgtgtggctgagagcacagtgccatgggcttgggcctccttggtggagtccccaacacactgctctggtcctgggcctcggccttccccgtctgcagtgggggcccacagtgagcctacctcctggtggtgttggtggatttgctgacatgcctgagtgttgacagggggcttggtgcaggaagggctcagggcgtgggtgttggccaggggtccaaagggacctctgcctcagagagcccagcccagacaggcaggatgtgcagtggggaaggggctgcgggaaccctgcagggtccagaaggacacagtgcagtcctgtgggctctggggaggctggtggggaggaggttgacaatggatatctgggtggggcacttgttagaagttccattttagagaggaaagaggccttgcctgtgggagaaggcagctggggtagcctgacctctttcccaggaaggagcccacacacacacgcacaggcactcacacacacgaatgtgcacacacacacactcccaccttcacacacactcacactcttgctgtctcccttcccaagccaaggtgcgagggggaaggtctgggcagcatgcacctgcgccctgaccgctttgggggccagtgagaactgggctccctgggtgcgcggcgggcccaagcagggaggacattgcagatgccctggccaagcagcgtggaaatcctgtcccttgggtgggtctcggagcctccatcagaggcggctggcacctgagacccacctgctgccaggagcagggcaggagagtttgtgtcccgggacagggaactggcctgtgggagccttgccttcctcatctgtgtaatggatataagagtcttctcctcgggggctggccagggagtccagaagaggtgtcaccagtccccgcagggagaagagcggtgtcccccgcctgggactggctgctcccccaagctaatgcagctggtagccacctcccagtggcagggcagccaaacccggccgggaaagagactgattagaagcctcgctcacgggtatttctcgcttccagacagcacatgactgtcatttggcacgtctttcgccgtccttccgggagaggggctgcaaccctggcaggcgctgtgggggagggggctaggacatcctgtgcctggtttcaccaagtgggtgtgtggactttccctggctcccccaggctgtctggctgcacagctttggggaaacggccactgggtcaagcgggccgagaagaggaagtctgtggtttgtctctgctacagactggccccagtgaggctgtccagcagtgcagggcacagagcaaaagcagggaggtatgggcctacttccccggtcgcccctgtggctggctgtggctctgccgggtgctgacaagtcactcgccctccctgcggtcaccagggtgcatgcccgaaagccctccattctttcctgggtttgagggtccttctcctgcacccaccccagcgcccagttcagctcaactttcagaaatctggttcacccccaatccctttctcataactgcttccaagcccagacaaggagacagaccccaaaagatccctacccctatttccgcacctgaaatcgcaccacgggaagagctttgctcatagagtcaataaggcttagagtccaggcgcctgtgcgagggagcaggtcatcacccttgtacccaccgtggttttagacaggaccctgaggttggggtggggctggggctggagaggagccaggtgccctgccccttgcttgggccccgtgtccctgtgatccaggctgggcgtgctatgggtgctgggtgatattccagccctgcaggtgtccgccttgttcccagcacccctctgggcaagaagaaccaggctctcccagaaatgggcttcagtgatctccacttccaagtcgtccccacctgccttgtaggacacagtggtacctggtatgctgggcagccttccaggaacctctggacttactcagtgtcccccagccctacacaccattctttgtgtttctgggcccaaactaagccccccaacctgggctgcagagcaagtgctgaatcatgagagacccttgagggtcctccaggtaggcccccagtgctggaggagtcccctcaggcagggggccacgcccaagggtgtggaaggtcagctggcagccggatctcacttttggggctgtaggcttcctgcactggccgccaatgccatggccgtgggatggccaggataaggcatctgccccccacccccaccccccgcacaaggtctttgagggctgcgggctcaaggagttggcggtagggctgggggaccaggggcacagagcttgtaagcgcctctctccaggatgtgggtggcccagcaggggagctttgagagtccaggtgtgagattccaaatgctaggggcctgagaggagggagccaccagcttggccagagcctggtggatcacgcccccaccacgccttgcccttctctctggtcatgtgctctcccaccacgtttggaaagttactgcttccctcttcctcagcccctcgggctcccagttatggaagtggcgtgattcagagaaggtaaaggatgggagggagagggctgggtgatgggggaccccgcagggcgccctgtgctgttacatggagctccaggatcagggcaggtgggcagcctggggtcctcacttctctccccagccaggccaggtccctcacagccctgccaggagcatgatatccgctgcggtgcagaactaatctcaaagctcaaacccaggtaacagtgtaggtaaaacagatgacagggcatgagactcaccccaggacaggcgaaggacccaggccgatgggggcccagaacagtcctgatcctggagctccttcccgagtgggaccccaggggtttccgaggggcttagagtagggcttagaggcttagagtagggctagggacttcctggcttccctgcctcgggaacagctggtcctggaaggggcttggtcctcggggcactggtgcccaccacccctgatgcctgggagacaccagcatcctctgagcatgtgtgcgtcctcctggtcccgagggaagtgactcctcacatcccccagctggcggggccagagggccagcatcctcgcctgacacctatttttagatgctgagacaggcggcttcctcggggccaggggccctgtgagtggagcttccgcttcctggcctaggagagaattcctgctcctcttccctccatgctgccttttcgcccctggaggccacaacggggtcagaggggcagctgctcaccacctaggagggcctgagagggccctacgtcacccagggaggagtctggccccgtccccaacctccacacccaggcctggcactgccccttcttggtgggcagagagtgaggggttggcctgcagggacccaggctggaggggccgttcacctccggcccccagcgtcccttcctggaagcaccttggtgagcccctcccctccttcacccagtatctccaggggtacttcctcctttccttcctgcctcagggcctcactgtcctcctggggagggtgtctcaggccccagcacctcccagtggctgagccgaatgggcacttcccggtgtgtttcccatatgtgcagtccctaggtgtcggtgagcaggcacagagcccgcagcgtggccctgcctggtggaccccctccccaagagcatcaagggagggcctggactagagacacacagatgcccagcctgtacgtaaaggcgggtgagctgatgtaccatcgtcctcgtcccccactggggtgcctgggcaggacttggggtgaccacttggcccgtctgggtgggggtaaggtatgggtggggcgaccagatccctgccctttcctgcagctgtgggggtgtgtgtgctggcctggagagctcccacccgaagttctggctcctggctgtccggggcctgcgggggcagcgagcagctggcatgggtaggggagctgacctaggcctgcccgggcagcgcctgctgccttttgctccctttcagctgcttcttggaaacagcggacaggctgggcaggaacccagtgtgcttggcagccccccttttaaagtcgattctgttatttattaattcccaggaaggagaaagaaagaaacaatccttcatagagtacaaacactgcttttagtagccttgcaaggagccctccaggaaccccacaggttacctgggctccatcctgagagccaccctccatccccaatccccagcagagcatcttgtggggtggggcggcttgtggggcggggcgccttgggaggcggggtgtctcgggaagcggggcgtctcgggaggtggggtggcttgtggggtggggcatttcctggggtggggcgtctcgtggggtgggacagcttggggggtggggcatctcgggaggcggggcgtcttgtggggtagggcggcttgtggggtggggcatcttgtggggtagggcggcttgtggggtggggcatcttgtggggtgggacggcttgtggggtggggcatctcgggaggtggggcatctctggggcccggccacttgggaggcggggcatcctgggggcggggcatctcagagggcgcctccggaggctggagtatcttgggaggtgggagcaggtggcagagaggcttcccacaggtgagctttgagcagggaggtgcctgtatggatggctctgtggggagaggggtgacaggagttccagattccggcacttatgaaacctcacagtgatggagagccgagtgctgctgtgcaggctaagttgtgtgcatgtcagcttctgcacttttatttccttgtttgtagacaaggcagagagaagctgagatgggcctgaggtcgccttggtgaaaggcactcagcagccagggccttgggctgccctccctcatcaccgtgaaagcgggactctcttttaactgacatcgggctccatagttactccagtcctaactttgatggatcctaaaagtgcacttctaaggacgcggcttcggtgtttcccatgccgctgcttgcccctgggaagcgttggctctgcctcggaagaagttagcgccaagatggcagcctggggtctttggggcccagaagaaacactggccccggggagttcagtcatcagggacttaggatgtgggggcttttcaaacagctttatttagacgtgattgacacacagtaaatacagatgtttaagggtacaacttggtaagttttgacaaatttatacccccgtgaaaccatcaccaactccccaggtgcccctggggcccttgggatctctgcttcctgcccctcctccccgtcccagggcaaccacgggccgtcgctgtgggtgcacacagcatgcatttcttcaacaagcggactcagaaggcacttgcacatcgttgctgttctgcctctttgcttcagcatgattacccagaggcgcacccgtgccgtggcctgcccgtcgtctatgcacccgtgctgtggcgtgcccgtcgtctgtgtggcatgcctgtctgtgcacccgtgctgtggcgtgcccgtcgtctgtgtggcatgcctgtctgtgcacccgtgctgtggcgtgcccgtcgtctgtgcacccgtgctgtggtgtgcccgtcgtctgtgcacccgtgccgtggcgtgcccgtcgtctgtgcacccgtgctgtggtgtgcccttcgtctgttccttttattgccgggcagggttgcacccacatgtgcaagccagcgacggaccccaggttcacccgttcaccggtcagtgggcatatgggttgtttcagtttggggcatttacaagaaacgtgctagaacatttgtgtacaagtcttgtgtgaacctaagttcatttctcttgggtaaatacctgtgcgtggagcagctgggtcatgtggtgaatgtgggtttcactgcttaagcagcagttttacataactgccaaactgttattcaaggtggctggaccgttttacagcccccgttgtatgcgtcccagttgcctcccccagcagcatgtggtgtggttggtctttttcgtggcagccagtccactgggtgcgctcggcatgtggctgcagcttgacctgggtttcctggtccctggcaaggtggagcatctcttcatgtgcttttttgctgtgtgtggatcttgcggggaagggtctgttcctgttttttgcccatctttcaaagattgggttgccagttttcttgctgttgagtttggaaagctctgcatacgttcagggcacaggtcctttaccaggctctgccccaggtctttcggagagcaggtgtctttcgcattcctgactctggggaacctctagccctgccacatggggtttgttatggggcaggggcacctgtgcctttcccaccacggggcttggggatttggtgctgccattgccctccctcgtaggtggccctaggggggtccctccgcctccgtttcctcatccagaaaccggcagtgaccatcaccaccattgttgtcacctagctccagctcaaggtccctgctgaaggtcggagagcttggcatggccccgtttgtccatgctagggctgggaagaccaaggctcaggtgaggcctctgcccagtgcctggcactccttcttgccccatttttccacccagggtggctcccgactacttctggtagcctcggggacagttgaggtggacaggctggcgtcacccccatttccggctgtccctcccaccccctcctggcccagctgttctgccctattaaaagtcacatgggccctcgggtccttcctggtgttggcccaggctctttcaggccctgcaggccaggaccagccttccctgcaaccctcggcagaggcctggggccggggcttgtctaggggcagcctccccatacggccctggagtctgaacagaagccccttcccagagcacagcaagaagctgcaacgtggcctgaagtcccaccattagcaggtttggggtttaggctgagctttgccatcactacctttctgttaggacggtatgcccattagatgggatcatcccctcagcgcccaggctagaggaggggtggtccctgcccagccagggagggctgggggtggatgggcctctacagagcagcttccgagccaggcacggttccatgatcagctctgttttatagagggggacactgaggaaccgggagcctggggaccttccagtggccccacagctcctgtggctgagtcagggtttgtcaccaggcctctgtggggatgaggctcccccatccacctgccccactctgtcctggaacagctctcaaaacggtctctggaccacagtttcaaaagaaaataagcaatgttttcaaaggccctggaggaagccagagttaccacggcaactctcggcctcgccacctcctcccgccaggctgcatctggagccagctcaggagggcagcagggtgaggacagccaggctctctggggccaccccccagcccccacccttcctgcctctcctgcactgtccacggccctccctgtgctcccacgggtataatgggcacagaagaaccaggagctgtctgcccctgcaggattctggaagccaggggcccctggcctccctggggccttgtcatgtgaggggcacacgtggggtcccagctgccacatggcttccagcgctgcccgcaggtgtatgttgggcccttggtgactctaatgcaccttccactcggcacagaagagcttcagtctggggcctgggcgggggaagtaggctgccatcctcgctaaaccaaagtgtgaaaattgagttgaaactcccataggagggcaggaggcacagctcctcagaagaaggtctgagaaaccacagcccaggttgttgtttcgggtgtgtggagaaggtgctctggcagtcctgctacagggggaccatcaacagcccctttggggtgagagccccgtggctgctggcaccagcagcccctatgaggcttattttatttttgagacagggtcttgctctgtcaccgaggctggagtgcagtggcacaatcataactcactgtagcctcaacctcctgagctcaagcgatcctcctgcctcagcctccaaaggtgctgggattacaggcgcttgctaccacgcccagccccctctggccttattgtttgccaggcccagctcaggtcccggaggaggggagacaggagtgtgagggaaagggggaagaggtatagagcccccagctcctccacccacccgaaccctcaccgaggccctagaccctagaccggcctgaccggggggtcctcaggccggggacttgggtgcaggccatggtgctggggcctgaagctcacgctctgctgagcacagccccctgcccaaccccaccctggggccctgcttccctggccagggccattggaacaggagtggggctgtccaggtggtgttcttgggtccagccctcagtttctcttctgcagttgaccggcagccctgcatctgtggtggggtcggcgcctggtgctggtgaggcaaggcctcagctgctgggacaggacctgcctggcacccagctggtggcagagccaagcattccgactcagctctgggagcagctgccttctgggctggcattctccgccaggggggttgtgccctcgtggccccccccgggtgcctcctcacctggctgatttcatctcctgtccccctgcctcctcctccaggaagcccccagggcctggccctccttgagagtggcatggaggaggaagaagactcgcccaggcccatgggagtcggatggtggccgcacttgtggggccctgaccccataggcttcttcagcacgccctggcctgggtgatccctgcctgagggctgtgcacggctcatctgccagaccagattttaggggattcttgtactgtcctcctggagcagcagggggtaaagcctgacccacccagactgtccagcaacaagggcctcctgctgtgggccagggaccctggaactgaccaattgtgtcctagggacgcagagtccccaggctgctagagggctgtggggccctgtttcatgcctgaagcaggaagaaaccccaggagaggtctgaaggggacccagcccccaccctgtctagcagggaggagcctctgcaagaggccgaggggtgctgaagtggaggaggatagaggcagcaggactcagggtcactggtcatttatggggatcacacggctgcagtgtgccctgcatggtgctaggcaccagggacagcagaggacaagcctgtgtcctctcccaccaccagagggctgggcactgcccctagggagagagggggccttggtgtgtgcagaggggggcctggggcacgtgcctggcctggtcagatgatcagagtgggctgggctgggcctggtctggggcccagtctcaagggcagaccccacctggctagagttgattgtgtgcacaccggatgacccggcgttgaaggcctctcctctctgtgagcctcatccccacctgccagactcccagcacagcctgcttcctgccccagctgctgagcgacagcgctgggccggcttctgcgcgccccttcccccagcccatcttggaaaccacagcagcgtccttcctcccaagtcccttcccagggctgacatcccacagcagggatgtatcccacaaaccccgcaggccctggtgcctacagcttggcctggtaacatcaaatcctaccctctcctcctggcagcaaagatggggtgcccccaccccagagttctcagcacccccagacagaagcagtcccccagcgacctcagaactcttggggcgctgccacacccttgcaggagggggcagtgttcctgggatgctcaggtcctggtatcacctctggccagatacggaaggtgaaactacagggcatccaattcaccttgaacttcagataaacaccagattatttttttgtatgtcccgtgcaatatttgggacacacttaccctaaagaagtattctgttttcatctgagaggcagatttaaccggcgtcccgtgtcttcctggcagtcctgccctggagtcacactccacaggtgcagggcagggccaggctccaagtagatggcggccaaagcacccgccccatgctcctgactcccggggctcttcagggcattgcgaaaaccagcagcagagctgacacctggtccctgctcgggagccagcaaggcaggaggctgcttaggccttgcgtgtggggtgggcgcactccctgctgcagtgctcttcgtacatgtgacactgttcccgctctttcccagctggctggaggcgtgatcctgggtgtggccctgtggctccgccatgacccgcagaccaccaacctcctgtatctggagctgggagacaagcccgcgcccaacaccttctatgtaggtgagtgcacatgtggccgcagacgcattcagggagggcttctaggaggaggcaggtcctagccttttggatggggacatggagggtgaaagacagtcgggcatggcgtgtccgggcagggaggcggccctggaaagggctctgggcacaagggttgagatggaggtgggcctgtggcctgctggcccttctggtctgagccagggcagggggtggcagctaggcctgggcagggactgtgtggagaccttgcttattttaagtgtggggttatttcgggggaggctccctgagaagggtggggctggatgcctgggccacacagagcagccgaggcagctggcgctgtggagcccgggagggagggagggatggagctcaagggatggaacccagtgaggggtggagacggggcaggggaggggtggagaggggtggagacgccccagaggcggtgtgactcagctgcccctgcaggcagctgcaccttgctgccttattaggctgcgtgtgggggactgggctgccctccctgcccccaggagcaggagcaggagtgatggaggaggaggaggggaggggcaaggccaggaggaggaggagggccatctcactgtgcagagagcagcacccttcctcctggtgcccctggcagggctggtgctggtggggctctgggagcatttgttgagatgcttctggccttgaaaggaggcccctgggatggctctgttgccctcacaggctgaggggtgggtgaggtgggcagcctgtgtgtccccagtcctcagggcttccctcagccggcaggtgcccccaggcctggagctgcagggccaggccccctgccagttacggaggctgcttggcttggttgctgaaccagggccccaggaggccgaaatagccccacacctgcgccgtcccacctctttgtccagtcaccccagggccaggtgagggccctggccacacagcgtgcccgttccttcttccccatgccccgctcatgggtcagagggccggtgctggggtccagatggtgtcaacagggatggtccctgtcctccccagagacagaagcctgtggcccacggagggtttctgggcccagccgatcctagggagggtcccatggccctgcccataggttcctggcctctctcggggccgtggtgccctcacaggtggtgtcaggaaggacgggaaaggctgcttgtcccaggggctcatgtggagaccaccccctgcacgcagctggggcgctcctgcctgtgtcctcagaagcactcggcttagctttgcccatgtgcctgggctgtgggtggcagagcccggccagcatcctccgatctccaagggtgcatctctactggaggcccctcctgggcctcttgctccccgcttcccagatcattaggatatttggggtccagaagggcctcccagccatcctgggccttgtcctccggggccaccagtccagccagtgacaaccacagcatccccggcctggaacgaggctgcccccagcacgttcctcgtactcctgtccagggacaggaggggctgcccctgccaccgagtccccttctccaggacctggggcctgtgggtgtgaggcaggtgttcttggaaggggtcactctccaggcacccggcggccaaggcttgtggctggagcagctcccgctgtggggtcggcgtcgggccccgtgtggccggagaggagctgaagggtcacttagcttcgggctggggcgaggacaggggacaccccagagaggtatgccaggcctccttcctgcgccccactctcggcagaagcagaggtcacaggctgtgctgaggccccatggtgctgcccccatgatgccagggtgaggctggcgttggaagcaggtgtctgacctgcatggtgtcaccgtggccacatcagagctccagccccagagccgcccaccctcggtccttggctgtggtttccctgggctggaggagcctgccgttgtgttggccacacgaccacaggacctgccacccccgacgtgggctctgcctgggcccccactggacagggaccccttggagctcctctggccaccaagtcctcgcccattccagaatcggccttctggagcctcttgctgtccctgatgcgggctgggccttgccaagggctttttttcctgcgccgggaacagggtggatttgctgggctcactcccctcagagacgctgcgggtgcggtgggttaggcccaagggcgttaagagaggaggctggggtggggctggggcctggcagggggtctggcagccctgggcctcccacctcctgtcaggaccaaaaaaggcaacgcgcctctcctgacctgtaccccggagtgaacccaaccttgcaacccaggagtgtcagggcctgaggggagggagacctggctcctgggtgccgtgcccgtaaggaggtggccacctgcagggcattcctggcagaggcttcatctggccaggtaggaggctgggtggccgagccccaaatctgggtgtgttctctgcctggcggtgggtcctgccccaggcaccttctcctctgggctggctgggcagggacaatgggcctggctgcgaggagggggcctgggctgccttctgcattgcctcggtgacgggagatggcccctgcctgctgagggataggggagtgggcaggcagtgagagacactgacagctgtcccgcgggtacagggccctgtctgggtggccaggcccatgtctcgggcccacagtgcgccccccacccttggacggcgccttctccctccccaggtgcatgctgcccagccagggagcgtgggggagttcgggagggctggcctacacgccctggtccagctgtcccaggtggggtgctgggcttcagccctcagcccagggcctaggaatccaacttgatcctccccacacagcagccaggttcaaatgcaggtcccgtaacggaagtgctgctgtgcagcccagattggggggcaggagccagcagggcccccccaccctcttctcgcaccacactggggaggcagcattggttccagttccggttcctgggctgccctctcaaccccggcctacagtggggcccaccctgtgccttctgatgccactcccaccccacgccaagtcccagaggctttgggagcgggtgaaggcggtgggtggcgggtggcaggtgcaggcggtgggtggtgggtgtggcaggtggcgggccccaccgcaggtgtcatccctgcgaagcacctgtcgccagcactcagagcgctcatgaggtgcccagtccccatgtggcctccttagtctccgtcctgtgtcatggaagaggtaactgaggcacagaaaactcaccaggccaggctgggatgtgaggtcccttgctgctcatccctggcagtcagcaaccctacatcttcccagctgggcggcccgtggtgggttcggcacccaggaccctccggggtcttgggctgtggcgagtgtgtaggcacccacctggtgtctctctccccgcaaggcatctacatcctcatcgctgtgggcgctgtcatgatgttcgttggcttcctgggctgctacggggccatccaggaatcccagtgcctgctggggacggtaaggcagggaggcgggcctgtgcctgggccggggaggggctgggggctgcgtctggccctgaggagggggcagagctggtgctcagggcggagcctagaattctgggggaggtggctcctgtgccctgcttttcccgtttggtttttaaattaaatcccaccgtgcttggtctccatcgtggccagttcctacgtgaccgcttttctttgtcaaaaaatagccacaaatataacagggagcaagcctcagctctgaggccagcctcggcgtcccgggcacaccgccccctgtgggaagcccaggcctggctgtgccatccagggcctggccagtccaggaagagggagcctatgcccgtgtctccagtgggggaaactgaggcagatcccatggctcccccttccgtggggagcaggaacaagggggtggggaagatcagtcaggggtcatgctgctgcacacgcctccctgggggctgcagacatcctggactcaccagcctgtgaccccaaaccacacgccccgccccatccaccccgtcctgtggagcctggtgccgcgtggggacatcctgggctttgacggctcctccctgcgctgagttttagcctctgtgccccagggctccacacaagccgctcactcctggtcaggtcgtgggctggtggctcccactagcccctcacagacacgcctgctgggcacctgggtgtgtgtccttgggccccgcctacagcctgccctctttcctccctctggccactgcccggctccagttcttcacctgcctggtcatcctgtttgcctgtgaggtggccgccggcatctggggctttgtcaacaaggaccaggtgagcctgggtgtgcagggacagggtggggtgggtgacgggggcaccctcctctcctgtcgcgggtgggggttgggctgactcatggcttgtgggagctctttgggctcttcctgggtcccacttgccaggaggatctccaggggctttatggaggaggcagcattggggctgagcaccaggccagcctcccgtgtcccagcactcccggggcagctgagagtgcagagtccttgtcctctggggtctagcctcgaagccaccctgcccagggagagcctgggaaaagtgcgtccgcctggggcggggcggggtgggggcaaggagggggaggttccccctgtgcatgtgaccgcacccctcccccagatcgccaaggatgtgaagcagttctatgaccaggccctacagcaggccgtggtggatgatgacgccaacaacgccaaggctgtggtgaagaccttccacgagacggtgcggccccggggggcgagggcggggagcagggccccgggaacccggcggggtgtgtctcgtcctggatgaatcctgcctacgcccagacctcaggagcaggaggtgcccttgggacctccaggacccctggtctcaactggtcctcgggtgggaacctagtgggccagggtggcccagggtgcggaaagctctgagcagcgcagctgaggaggaagaaggctggcccctggatgcattctgcagtggggagcgctgcgtacccctggccacctccccatgggttccctagagccaccgtccccctgggcacatccagggctgaccttgcacccctgctctctgcagcttgactgctgtggctccagcacactgactgctttgaccacctcagtgctcaagaacaatttgtgtccctcgggcagcaacatcatcagcaacctcttcaaggtgcgcgaggccggtggggccgcgcctgaccccccgcatgtcccgcccctgggtggggtcctaggggtgggcaggtcacacggcagccccacagggagcgaccacactgggtggcatggcccctgtcagggctgctctgctgggagggttggggtgggaccgcatctggcccacgaggaaggcaggcgccctgtgctgcgcattccgggtgaagaaggtggaggctctggggggtgggaactcacctgcacccccagctccacgtgtgcactcgtgggtgtggacgcccctgacagcctgtagctggcagggcctgcaggccatatagtgccctgtggaagtttcctgctgaggcctcagtggaagtcgtcatcagtgatgctttaggggtctagtgacaccaatgaccgtgatctcagtggaaaagggcacagtgtgtcccaggcatttcgcgtttatgttaaaacgggtggaagatagcaagccggcagaggccgggccgctgcacccgcctgttccgaggtgggtagggggtggggggctgttcccaggattcccctctacgctttctgtggtgaccacggattactgcgtgacaacgggaagccgggagccgaggcccggtccctgaccacgcgtgcctggccacccctgcaggaggactgccaccagaagatcgatgacctcttctccgggaagctgtacctcatcggcattgctgccatcgtggtcgctgtgatcatggtgagcgggcgggggcggagggcctgctctctgggctgccccttccgcggggccttgtgctgactgcgccccccaccaccctcctgcagatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgctaccaggcctgtgcagtccctcag

SEQ ID NO: 1618 - DNA, 23792 bp, Homo sapiens
tcggatgctgtttacccattaaagaggatgctacaaatgtttattcattaaagccactcataacagcatagtacaaccctatttaaaaaagaaagacatattttacatgtatgtgtagaaaataatcaggaagaatgtacaccatattaacaggagattattcctaaggtgaagaattatgagtggttcttatttccttatctacttaagttttttctctccaatgggcaggcattgcttgtaccataccttaagcaaggaagtgcatgtttgggacagcagtttgggctctcagcctccttaagagagtcaggtctgcctcatccctgtatctgctagttgagcagaggccagggctgtgtgaggggctctccaacaattgtctttacaaagtataaaaagtcatcagtgatcccaggaacatgtttgtatctcaaattcagagattcaagagggccttagtttaacctcactgatgctcaaattctatttgtaaaggggtagcctgtcctctttcatgggcccctctgcaatgcaagggctgggagagcaattccgcctccacataggggtttcacagagattttctttagagatagagggattcattttccagggttaagctcaccacttcattttattttaggtctatacaattttaggcttgattataaaaaaaaaaagtctgatattgtttacattatagaactctgccaaaggcagttctcttctttaattcattacctcctcgaggctctgggcacagtatcccaggtatcaagaagtacttgttcccttgccgttggagactcaagcacctcaccctgagacaggggcctcggaaagaaagacctgaatggtgtggaggaaagagccctgagctgggagacaaggtccctccagctactgctccaaccctgacttgctgtgtgcctttgatcaagctgtctctgggctttagcctccccctttgtaaaacgggcggggaagaggttgagatggcatgggtgcctccagctctctcagcatgattctgagaactctgcgggtagctctggcctgcccctttccacgccctaccgcgatgtgcgcacaacagtattgtgacccttgtggtgtactgtagattttacctagttttgtttcccgtcaaacacataaagaaaaagtaatctttcccaccccgcccccactaaaataataatcatgagaatgaatacacagggaggaagactggaaaaaatgaaagggaaggacttgctccctcaaaaggaaggatctcagtttgaagtaatgtagtggctgttgcacagggttagacgtatctcgccgaaaggctgggcttgtctcccgatttgaccacaggcctgaaagagaggaaagcgaccatcattgtagccagaaccccgccagtgcagcatccatccagccacgtccagcctcccaatcccccagcctttgaaaggtctgagaacctgttcctggggcaccagcatgggactgggtgaatgacgtcagcacagcacccgtgctaaatgccttacttgcaccatctcatgtaatcctcacagcagccttaagggtgggcactgagattgagaagttaaacttgcccaaggtcacacatctaggaggtggctgagccaggatctaaaccgagttagtctagcttcctggagcccctgtcaaggtctccacagaggtgtgagagtgagactgataaccaaagtcattagctgacctgattctcagccccggaggatgacagggagagaggaggatgtgagcaaatcaccaccatcagccaaatgatgttacgctaaaaacgtgttaattcagcaccaggctagcaccttgtaaacatgctaattcatcatgagcgtcatgtctgcactctcagccctctaaaacctctctgttgaagctgagcggcccaccatcatcactgagtatattaactcgggtgttggaatttcccaggtgtgtttaatctgtatagctttgtattttaaggcagaactttattctcagttattcatctcaaaatgagagttttcagaaaagatcgagaaaagggatggtccttctgcaaaagttccaaagtgcaccctgaataataaaaatgctaaaaactggccgggtgcggtagctcacgcctataatcccagcactttgggaggccaaggcgggcggatcacgaggtcaggagatcgagaccatcctggctaacacggtgaaaccccgtctctactaaaaatacaaaaaattagccgggtgttgtggcgggtgcctgtagtcccagctacttgggaggttgaggcaggagaatggcgtgaacccgggaggcggagcttgcagtgagccgagatcgcaccactgcactcaagcctgggcgacatagcgagactccgtctcaaaaaaaaaaaaaaaaaaaaagaaaagaaaagaaaagaaaagctaaaaacttccccccccactttttttttttttttttgtgagatggaatcttgctctgttacccaggctggagtgcagtggtacgatctcagctcactgcaacctccgcctcccacgttcaagcgattctcctgcctcagcctcctgagtagcccggattataggcatgcaccacaatacccggctcattttcaaagtctttatccccttggtatatcacctgtaacatatgcattggaaatccattgcatttccattgctaaaaacaacaatgtgtaaagtcctgaacttggattccctcagaaaaatgtaaaggagtataaaatgcaaactccaggtataaaatgtaaaatatttcatctactgaaaagaactggtgtacacagtcggttatccttaacacttcagcctgcagccatggggaaggtgtctgagctttggatggaagttgcagctcccgggcagtatgaccttggacaaatcactaaatgttctaagcctcagtttccttatctgtaaaatgcaggtaatcatgactactttaaaagttgtcataaaacttaaaattaaaaaaaatctataaagcaagtaacgtgcgttgtaggctttcatcaaatggttattactattgataatctgagtttaatgtgcctttgccactttactaatccctgagccatgagatggcacaaagttgctgtgaggattaagagagatggggagtattacccctatcacagtgcctgactagagcaggcacttgttagatgctaccacagggatgcctcagccaacgggtggagagaggtttttaacagagagggagagagagagagagtgtgtgtgtgtgtgtgtgtgtgtgtgtgatcatgggctgaaactggatgaggcagtcacttgagctgccagatagccaattgtccctgcatctcgttccccttttttctactccagtccttggcagcaaaccaaggtcctacatgacacagagaagttagcaaccaaagccattattattttggttcagctgataaaagattggctctccctcaaaaaactagaccagccaagtaggaaaaaaaattgttttcttaagaaaacaacaaaacccagatggaataatcagaataaagaggaggtcaggtcctacgaggagctaggataaattgggggaatccctcaggttttttttttttttttttggaagtgccaggtcaaataagatggagatttactggagtcacactgctgttggcacccgcctaacccgggcctcctttttctcaaagacacaggccagatgccagccttggcctctctttgctcaggaactggctgactccctgccccaggatttcacggccatgacctctctctgggaaaagttcccactatttgctgctggggaaaccaggaccccaccccagggctggccaaggtgagcaggctgagttcaaaagagactcaccggggacatttgcaaacacgtcttcggttccctggataaggaaaaagaagggaaaaagtgagtgcccctatccatcaatagtccccaaagacagtgtattttttgttgttgctgttgttgttgctgctgttttttggttttacaaaaaatcatttcagaacgatcatgggctgaaattggatgaggcaaatagggaattgcctctacgaattctccttcctttcccctatttctttgaggattataactcttgagagccgggtaagggcttcttatccatccttcgtctcaagcatcaattaaaaaaaattgcaactacagacgcgggcgaaagcggggagcctgcagacctgatccggcacctctcttgcatgggacccaaagcagggtgggcggttcgccgaagagggccaaggacgaacctcaaactgatggtggttttgactaaccctcctgggcacttgactcggccacagcggccccctcccggcgggcgtttgtcatgtgtccagacatgtgcgcgcgcgctgcgggcttcgtcgacggaacacacccgctgcagcggctctgggaacgcggctttgtctcccaaaacctctccgagagcgcaaggagcgggaagggctttctcgcattctatctcccagaaagaagtgcctgtacctgcggggcagctcgggagtcccagaaaactcaaccccaagctcccccctcgcaaggtccgcctggagctagcagagccaagggcaggagcggggccgactccttcccgccgcgattcctcgggacttactgtggttgcagtaaagggtgataaccagtgacaggagaaggaccccacaagtcccggccaagggcgcccagatgtagatatcacaggcgaagtccagccccctcgtgtgcactgacgacaccaaagacgccgacatttaggagagggcccgggacctcccaaccgccccaccgtcccgggaacgtctctccgcctcagatctcggtttcccaccacttggacagcccttgactctacctacagtatcagggctgtccctggcatgggctctccccgcggtgcgtgccgcccccgccccgggcccccgcacgcctcacctgcgccccccgccgctggccggcacgcctctgggcgcagggacaggggctgcgacgcgatggtgggcgccggtgttggtggtcgcggcgctggcgtcgtggtgggcttcgctgcaagagcaacagagcgtggttgggggccaggctggggttatggaggcgccccagccccggcctcgcgcacctttccccacggggacgcctccccccggttttcctgggagaagggatagcagaggagacaggatggggaccccgggatgcgcgcggacccctgtgctcgggcctcggctcagcccagcgcacccggcgcccagagccggagcgcaggagccagctcccctgcacctggcctctctcccgggctgaaccagcaaccctggagcgcgggttgattgctgtccgcattttacccacgagcaaacggaggcgcagataatttaagtcatttgcccagaatcacacaagaatccgaactcgagtccagatcggccggacgtaaaaagccatccccagtccctactcagcctcgcgttagcctcagtttgctgtgtctgtgaaatgggaacagtatctaagtcgcttccaggtgcgctaagaggcttgaaagcagggcccaggtgtggaaaacaggttgaggtgaaccccaagccccacgcggagaggtgccgcaacccggcgcgcggacctggcaggaagaccggcacgaagtggctgaagtacatgatggagttgctcagggccgagcagaaatagtagccctcgttctctcggcggaagtcgctcagggtgaggacgaaggtgtcccccaacctcttgcccgagaaccgctgggtgtccagcccctcggccgccttgggcttgttttgggagaggtataggaggaaggtgggactggcggcggcgccgcgcggctggaagagccacgagcagcccgacgtcgggttggacagcagcacctggcacttcagctccactgtctcgcccaggttccaggtccgatccagcggcgacacccggaactggctcggcctggcggcgtctgcaggcggcaagcagcgaggctgagcccgcagtcccgcgccccccgccccccgcccgccccatcccctgccttcccgggcgtctcaaactcacggagcagcaaggccagcggcaggagcaaggcggtcactggtaaggccatgacgcgctccccaggacgctgcttggctcgaagctcgggcgcgaggggaggcgcgcgggagccggtggggcgccgaggggggaaagttgcgcccttcggccggcccggagcctgatttcgcatttggaggatgtgatgtcacccgaagcccccgccgaggagagtcaccctccttttcgcggttgtcgccttccagcccggcgaggaggctggggcccgtgaatagggccgtcgaggcagcctggccaggcaactgggggcagctgaaaactgcgggtttggggatgaggaaaagggcttggaaatagtccttggaaatggttgtcttgtgagagtgacagagtgggtgaagggagaccaaagatttcaagaagtgagggcgagagtaggcagcaaaggaggggagtgtcccttcctttgccttcactaaaggcgtctcttgtactgtcaccttgggactttttattggcaaaatgggcactgagggctgaaaaggaagaggaactagcgacctgcccgcttctgaggaactcgctagagcagccccagttttcaccgaggaaggaccctctcccttcccccaggagatttccatgagagcggcagcagccgaagctttgggtgtcggtgtcagtgcgctgctgacctcattcttccggcctttcatccagcggctaaactcaccacacagcctcatctcttcttggagccattgcaacagccttcaattcacaccagtctctctcctgatcagtcctccagccacgttgttataaaaattattattctcacaaaggggatctgacagcgtcactgctgcagcctcccatggcctgcattgctggatggaaattcaacccccagcttggttgaccagcccttgggtgctggctcctcccagcctccgcacagccccctgccctgcctttcccatacacctgcagctgcagcttcacaggcttgaagtcattcaacccctgcgctctgtgctttcacgcccttgcacttgcggtccctcggcctggaatgctggtctgtttaagccctggaggcagctcctgtgctgtctcatttggacctcatttctttcacccccagctctgggtgctctgcagggaggtgtgggtgatgtgggtgaatgcttgggtagaggcggttttctcttttctgtccctaacacatgtgtgtccccttcctttttgtttctttaaaaaataaaataaaataaaaaagactggagtctcgctgttttgctcaggctggccttgggactcctgagctccagtgatcctcccaccccagccccctgagtagctgggactacaggctcatctttcctttttgactgttgctgtcctgaaaccttccagctccagtggcatgccctcttcccatttcttcagggtttctgagtctttccactttgaatcccatagtggctgcacctcacattgctactgcttgatcctagagacaagacacctggcattctgtgttccatgtgtctgccccacccattagttctgctgggcgaggaccatgccgagacttcatgatgtgtcctccatccccagaaacacagcatgggctgagctgtgcttgttgaactgcattctccttgtccttgtgaagtacaaacttaagtgttggatgggttctttgtcgttgttgctatttttttttttgagatggggtctggctgtgttgcccaggctggagtgcagtgtggcaccacctcggctcactgcagcctctacctcccaggctcaagtgatccttccacctcagcctcccaagtagctgggaccacaggagcacaccaccatgcccagctaattttttgtatttttggtagagatggggtttcaccatgttgcccaggctggtctccaatgcccgaggtcaggcgctttgccccgccttggcctccaaagtgttgagattacaggtgtgagccaccatatcagggcctggatgggcttttttttttttttttaattattttgatttcagtacctccttccagctccctcaaagcatccaagatgcttattctagcatggaacatgtaacattttatattcagaaatttttaaaaatgtcttttaagtgacaacagtgcaatatattcttgtacgaaaacaaacacaaagttccctgtctcaactctcctcactgtcacctgctccccacagaaaaccactgttacagttgaatgtgtcccttagatattatctgtacataaacagatgtttatacatcatcttagacacatgggattgtatgagataaatatttttttgcaacctatcttgtttcacagtagaaggagagcgttcagcagatgaagatccaccccattcttataaatgggtgcattatatatgggtgttccataatttaattctgctgttagtggacatttaggcgatttctcattattgcaacactagcaaggctgtggtagatataatgtatctgtatcactgagggcttgcaccagtacctgcagctttttcaaatgggagatgagggagttggggaagaaaacacctttacaatgatggttataactggcctatcgatgtatgcatgtgtgtgtgtgtgtgcatggtatgagggtccctcgctgtgtagacacagtgctgtccctcaactcacatgaatgagggagacaaggaagcaatcaagtccagacaggccaccaacacatcaattcttgctgtagatggtagtttgccattttgctcagcaccaccagcactgtatcaggagtgtcaaatggccctgctggccaaaggctacaatcaacagggtggtaaggaagatggctagacacgaaactgcacttgcccagtggtggaagcactgagggggccagagtcaacctccacctatttggatcttgagaatcaggcccctgagtgtgatgatggccagatttgggggtgtactgctttaaaatagactagttccatcttagtctcacggaaatcagcttgggggccttctagccctgcagctcagaaaagtgtcagccagtggggtggcagcccctttgtacagagcaccatgggggttggggtggggaggataaggcaacatgtcaaacccatcaaggaggctttgtgaccccagtgatattttttgcagaacgtggtggattttcgatgtgaccacaatgacatccgccttgcagtggcagaacagatgcaattgcacaagttctggagaaactttctgtagaccaggtgtgcagagggctgggttgggcctgtccatcactgccaggtaagttcccaaaccccacactgtagcactgacttgggatggcatgaagaaatgtgaatgactgcactcctttaagcaagccccttatttaaaaaaatatccagaagtagatagagtaagatagtaaccagtttctatgctgatttaaactggtccatggaaatggaaaactttaatgtagattaaagacatattcaaaatgcaaaaccgggcagagcagtggtaggaaatccatcagggttctgtgccactgctcctaagacatgaactgcagggacaacttggaatcatggctgggaaattgcctgctgtgtccccatcgccaattcaggtctatggagatgttactgttcttggaaggagttagcttgtccagggctagaaactctagagttatcagggcttgttttatcttaattggaaataccaatcaatttggcctcacttctgtcacctttcttttcctccaccccgagttccccaagttcatctagctgctgtccttctttcctggacttttgcaatggcctcttaactggccaaccccatttctgctctggtcccttctagagaaaatctcatcatgccaaccccctgcttcaacctgaaaggacttcctggtgtccctagtagaatgtcggggatccctaatgttgcctgtgaggccctgcacacttggtttcatagtctctgtcctcttgtctgtcaccttcttcactcctcctaggttccgcatctctcatttctcaagcggaccctagtcctttccacttcagagccattaaacatgctattccctcagccaagaatgttctcacctctgctctctgcttaccaaactcctctcccttaagacccagctcaagcatctccttcctgtggggtttagctccttccccctcccactcccagacagtacagaccacatccttctcttctctgtgtcacccggaccttgggtatctgcagactggagcacaatggtttgtttgcctgtccagcttgacaaccaaacccttggtcccttgaggaaggagccttgtccctctcatgtttacaccagggtgccaaacagagggcttggcacacacttgagtggcacacactcaagaaattcttgctcagtaaaagctaaaggaaggtagaagtagggtacagcagaccagaggaggcttagatagttcattccaagtaagagtggtcaggaaaggcttcacatatagttgggtttgaagataaaggaagaattaggagagaggttgtttagaatgaggcatttgatatgtctgatcaagatcagctgataccatgctttaacatatagcaatggtatagttaaaaacaaaagaagaggaggaaggggagaaggcagatgtactcaaaagcaagataaacgtcttcaaggatgtagttgcaggacaatggctggaatcaggggctggcttgctgggatctgttcttagcaaaccattcttgggcctgggtcttgagggtctgttcttagtgtagaggcaccaagagtttgactccttcagctaacagagtttcacagtgctttgcctatagaggaaggctggagccaggctctctgcttgaaacagggatttggatctgattttctcttgattgaaagagagcccacagccacccatgtaaggcctagttctgactgtgggccctggaaagtcagaggctactttaaaaaactcaggaaaagagagagtaaagagaggaagagattttcaaaaatttctattcaagataaccctgcacacacactcgaaattcaaagtatacataaaaaagactcaacaagtggaatgtgaattcacttccaaaaagaggcaaattattgaacaatttgaaaaatgtttaaaacaaagagaacaacaaatgtagaaaatgcagaaattaaagaagaacagttgaagatgataaatactgagcatactggaaatgaacactctacatattaaacaaggatatactctaggttggacatagttgaagggataattaatgaattggaagctagcattgagaaattcatagagaatgcaacacagggagatgaagacagaagcagtttgaaaaagctgttgagatgtatattagcatggtgaagtgtttaataggatttcagaaaggggagaacaaagggaatgtggagaagaaatatgggaagaaagcatggctgaaaatttttcacaattaaagacaaacattctcagatcaaaaatactcttagtgccaagtataaaaacatatacatctttgcacatatcaaggtgaattataaacatcaagagtaaagagaagagggcatcccaggaagctaggatgtttgaaatataattgggagaatccttgttgcagtttggattgggcagagagggtaagaagctgaactgtaatggggaaaaatatacacattttggttacaccttgcattgactctctgtcatcccctcccttggtgctgacacatgcttactgtaaaactgatccaatgatcccatagagttgatgtttgtggtttctttgaataaacatataaattgatccttgccttcttaaaacctgagaaagttacatttgtcttatctgagttcctttctagggaaaccaactatcaggcctcccagatggtagcaatgagctgaaactcaccagatcacttattatgaacaataagacgtcagactcttcacctggtatgatggcctaactaacctcctgtttcctgttgtccaactccttttccttactcctcccaacttcctgttttcccacacatgattacatgtcttccctgctatataaaccccttaattttagtcaggtcagagggatggatttgagactgatctcctatctccttggctgcagcacctgactaaattcttcttccttggcaatacttgttgtctcagtgattggctttctgtgaggtgagcagaaggacctagatggatcccccggtgtttcggtaacaaaattgttttggatctttaatctcagtaacactgaaacagaagcgttctgaatgcaactggagagccaggatttgagttcagaagaggggtcagggctggggatgtagccttgggaaggaggtgataagttgtgagagtgggtgtcattgcaaagggaggtggtgtggaaagaacatacagaagagtatatggaaccttcagggaaggctcgtattgaagagcaggaaataaaacattggcaaggaatccaggtagtgcaggaaattcagaatggggcttgagaaggtggaagaacttcacaggggaggtttgggctataagagaagcacagagaggacatcaaagcctgtggcaggtagagattgtaagctcatgtctgcccctgacccacatgaggatgtcccacatgtttgccattggtggatgataagatgaggaggactcacaggagaaaggccaacaagggagggtaggggcagcatggggacttgtggagggcaatgtcagatgaagtgatgttgacttctgaacttcattcattattcactcatttaaatatttctgctattcacttttttaaaaaaaagttttgaaaacattttaacatagaacaatatgtcaaataatataaaatgcccactctttataagtgttagcattttgtcgcatttccttcacatgaacattacagataaaactgtaccctcccaagtaccaccccacccgccttctcatgaaaagctaaatttggagttttgttcattaattatgacagaaagatggtaagttttttaatttttaatctgttaacctttcctatggagctgagagagaaggatgccgaatgtccaatgagtgtggatttgtctatttctccttttaattcagttcatattttgtctcctatattttgaagctttgttattaggtgcatacacatttagaattgtgccttctggatgaattcactcttttatcattatgaaatgttcgtctttacctctgcctctggtaatactttgttgtgaagtctaccttttattcataaggaacagagctttctttcttttttttttttttgagatggagtttccctcttgttgctcaggttggagtgcaatggcacgatgttggctcaccgcaacctccacctcccaggttcaagctattctcctgcctcagcctcccgagtagctgggattacaggcatgcaccaccacgtccggctaattttgtatttttagtagagacagggtttctccatgttggtcaggctggtctcgaactcccaacctcaggtgatccacctgcctcagcctcccaaagtgctgggattacaggcatgagccactgtgcccggccagaaacacaactttcttatgcttcccgtttgcataatgtatcttttcctttttcttttttttttttgaggcagagtctagctctgttgcccaggctgcagtgcagtggtgcgatctcatctcactgcaacctttgcctccagggttcaagcaattctcctgtctcagcctcctgagtagctaggactacaggtgcacggcaccatgcccagctaatttttatatttttagtagagatggggtttcactatgttggccaggctggttttgaactcctgacctcaggcaatctgcccacctggccttccaaagtgctgggattacaggcatgaaccactgtgcccagcctgcataatgtatctttttctatccatttactttcaacttccccttctctgttttgaaatgtttactagatatgtatacatgtatatgtgtatatatatctataaatgctatataattttattttctgagagtttcaaaatacagaaatgtcatcatattgtgtgtctttgagctatgttgatacatatagatttattttaaatgctgtgtggtgtattatcctgtgaatgtgccacagtttcatgttcagtggttcttgaaccagagtgttcatctctctggaagtatatggaggctgtccttggggatacacataattttaaggaaattgttttccagattctcaactcccattggttctcttctcataaaatggacctgcccaagaacaagtccctgtgtttaggctttgtgctcgttctcctttctggcctattctttcatgattattttatttcccactttaaaactgaaaggcaaacttcccgccctcctgttccttactatgctccagaggtgggcacgtaatcctctgggccaccaataaaaagacaaatccaaacatttttcatgtaatttccatccgttagaaattgccaaagaatgcatttctcctgagcagagtccccagtatccaggtagagtcatctgggggccgggcacggtggctcacgcttgtaatcccagcactttggaaggccgaggtgggcggatcacgaagtcaggagatcgagaccatcctggctaacacggtgaaaccccatctctaccaaaaatacaaaaaattagccgggcacggtggcgggcgcctgtagtcccagcgactcgggaggctgcggcaggagaatggcttgaacccgggaagtggagcttccagtgagccaagatcacaccactgcactccagcctgggcgacagagcgagactctgtctcaaaaaaaaaagaaagaaaagagtcatctgggagggatgcaggaggcagagtgcctcacagcaggctttggggcctcatccctctactcagctctctatcatcgagctagaattcagaggtgagacagtcattatgaggatgcatattaacgtgttcattatgattacaaaaggaatcagaattcttttttttttttttaacagaaattaagtctgagttgttaattggtttgacattgaagaccagctttgccaatgaggttaatggcagtattttaactttccttgaatctagtgagctaaatctttagctccaaggttttgatgagaatcaagtttagcgctaaagaaacagcttagaaaaagaaagaaaagaaaacacttttaacaagtttaaaatctatgataagataaaagcattttggccaggtgcggtggctcatgcctgtaatcccagcactctgggaggccgcagtgggtggatcacaaggtcaggagtttgagactagcctggccaacatggtgaaaccccgtctctactaaaaatacaaagaaaatttagtcgggcatggtggcaagcgcctgtaatcccagctactcaggaggctgaggcaggagaattgcttgaacccaggaggtggaggtagcagtgagccgagatcacaccactgcactccagcctgggcgacagaaaaaaaaaaaaagaaagaaaaaaaaagataaaaacattatatcacaatattgtttgtattggaatttgtcttgaaattaaattaaaaatatttctaataccccaacactttccaagttaatcaatttcagcaatcgtttttaagtgaaagaagaatgatgtcattgatggctacttggtaggcttcggtaaaacctagtttagggcttccaaaacccaagaaagtgaataaatctaaaaatggtaacaaacccatgtgcaggtcagtggttcccaagtgtttgctttcaacaaaattggaagaaggccttctagatttggcaactatcacaggttgaattgtgtccccccaagtatatttgttgaagtcttatactctagcatctcagaatgtgaccttatttggagacaaggtccttacagaggtaatcaagttcaaatgaggccaataggatgggtcctaatccaatataactggtgtccttgtggaaaggggcaatcaggacacacacacagagaacatcatctgaaaacaaggcagagatggggtgatgtttctacaagtcaaggaatgccaaagattgccagcaactgactagaagctaggtgagaagcatggaacaaattccttctgtagccctcagaaggaacacacccagctgacaccttgatcctgaacttctagcttctagaactgtgaggcaataaatttcttttgttgaagccacctagtttgtggtactttgttaaaacagccctggcaaactaatacagcaactaatagatcattaaaattaatttttgatgatagataacattgtctccctccctccctgcctccctcccttccttccttccttccctccttcccgctctctttctctctctctttttccctttctccctttctctctctctctctctttctcccttggagaaagggtcttgcactttcgcccaggctggagtgcagtggagtcactgcagcctcaacctcctgggctcaaacagtcctcccacctcagcctcccaagtagctgggactatgggtgcacaccatcatacctggctaaatttttgtagagatgggggttcaccatgttgcccaggctggtcttgaactcctggactcaaggaatccatccatccaccttggcctccaaaatgctgggattacagacgtgagccactgcacctggttcatgcttttgtctttttgaaaaaaaaaggaaaaagttaaaagatttagtgattctgctgtaacaaagccaactatttatttatggagacaaaatttctcagtacttacattgtatgacaaacaaaagcaaaacaaaattaatactgaactctgtctcattctagcaatcaataaataaaataaatcctgttattttatgggttcattaattaattggaccacaaaattcatttgtggggggtccatttcattaagagctgaattttcccccaaaattatgttttaaaaagctttttttgagataattgtagattgacatgcacatacaagaaagggtacagagaattccatacccttcacccagtttcccctaacaaaggttacttttatatttatttatttatttttagagacagagcattcttctgttgcccaggctggagtgcagtggtgtgatctgggcccactgcaacctccgcctcctggattcaagtgagtctcttgcttcagcctccctagtagctgggattacaggcacccgccatcatgtctggctaatttttgtatttttagtagagacaggatttcaccatgttagccaggctggtctcaaactcctgaactctagtaatctgcctgcctcggcctcccaaagtgctgggattacaggtgtgagccaccatgcctggccaaaggttacttttaatgttcattaattttgaagacttgcagtttatttatgctataaaggacaattgtgcactattaatagtcgcaatgatgacataatctaagacttttaatatttagaaacttatggttgcaggaaattaaaaattcatctcatgtgcttttttggcagagaagtatgaaatattgatcaatataaggtccttaagcatatgcacctattaaacttttatggaggaagtagaatagaattcataagtccatttgtttttactctttatttttttgagacagagtctcactctgccgcccaggctggaccgcagtggcacaatctccactcactgcaacctctgcctccttggttcaagtgattctcgtgtctcagccacctgagtagctgggattgctactcaggtgtgcaccaccacacccgactaatttttgtatttttagtagagatgggatttcacccctttggccaggttggtcttgaactcttggcctcaagtgatctgcctgccttggcttcccaaaatgctgggattacaggtgtgaaccatcgcgcctggcctagaattcataagtttaaggagaaaaaggagtgatgaaaaatttccaaaagttaagaactttttcttgtattttaaaaatgagtgacggttgaaacaaaattgatatattatttatgtgctattagaaataattaaaaagaataaggttttcttttttaaaaatcaacatttactttggaaattatgtcctttatagtgatgaaaaatgtttgatgtcaagttaaaagtgagtaaagaagtacattcattttataacagcatttttcacagtagctaaaatgtggtagcaacccaagtgtttattactggatgaatagataaacaaaatgtggactcaggcatctctcttctgggctcatacccaaaggaaatgaaatcaccacctcaccaaggtatctgtactcctgtgtttattgtagcattattcataataaccaagatatggagacaacctagacaaccatcaatggacgaatggtttaagaaattgtggtacggatatatacaagggaattcagccttaaaaaaggaggagatagcatttgccataacctagacgggcctggaggacattatgctaaatgaaagaagccagacacagaaaaaaaatattgcacgatcttacctgtatgtggaatcttttatttatttattttcttagacggagtctcactctgttgcccacgctggagtgcagtggcgcaattttggctcaccgcaacctctgcctcctgggttcaagtaattctcctgcctcagcctcctgagtagctgggactacaggcacctgccaccacacctggctaattgtatttttagtagatatggggttttgccatgttggccaggctggtctcaaactcctgacctcagatgatccacctgccttggcctcccaaagtgctgggattacaggtgtgagctaccatgcctggcctgtggaatcttttaaaaaggtcaaatatatagagaataaaacagtggttatcaagattggagtaggagagaggaaatgggcagatgtaggcctaaggatacgaagtagcaaacatataggatgaacaagtcaaataaagtacaatatgaagactacaattaataatagcatattattccaggatttttgctagatgagcatagttgcttttgctacaggaggaaataaatgggtaactaagtgagatgatgcataagtcaatttgtttcactatagtatccattctactaaatatgtgtgtcttataccatgatgttgtatataccttatatatacacaataaaatttatttaaacaaacaaaatgtggtatatacatagagtggaatattattcagccttaaaaaggaagttctgacacatgccacaatatggatgaatcttgaggatattatgctaagtgaattaagccagtcacaaaaaaccaaatactgtatgattctatgtatttgaggtatttaaagtagtcaaaataatagagacagaaagtagaatggtggttgggacaggctggggagagggaggagtgggagttatgtttaacggttatagagttttagtttttctagatgaaaagagttagagagaaggatggtggtgaaggttgcacaacaatgtgcatgaacttaataccactgaactgtacacttaaatgttaaaatggtaagattgttatgtgtattttgccacaataaattagtattattattttttttagagacagagtctagctctgtcaaccaggttgagtgcattggtgtgataacagctcactgcagcctccaactcttgagcccccaactcctggcctcaagcagtcctcctgcctcagcctcccaaagtgctgagattacaggggtgagccattcactgttccttgctaaatcttttttttttttttttttttttttttgagacagagtctcgctctgtcacccaggctggagtgcagtggtgcgatctcagctcgctgcaagctccacctcctgggcttaaatgattttcctacttcagcttcctgagtagctgggattacaggcacacgccaccatgcctggctaatttttgtatttgtagtagagacagagttttgccatgttggccagactggtctcgaactcctgacctcaagtgatccacctgcctaagccttcctaagtgttgggattacaggcatgagccaccacacctggcctaaatttttttttttaatgagtgaaggagtccatagtctttcatactttggggtgatacaagaaaaggaaaaaggtttaatgacaactgccactttcatttattcattcctttgttgatgtacttttgggctgggttttgctgttataagctaaactacaatggacatccttgtacacattccctagagtccaagtacaagattttctctagggtgttttcctggaaaaggaatgacttgaggagtatggcaaccttgtgagaaatgactgattcgaaagatgtgtcccatagcttttgatacatttttctccgaagtcatggttccagtccacactcacaccagctgtggaggagttttcatttacccacgagctttgttatttctggttttgtcagtcttttcaattctgccaatctcatagggtgtgatggtatctcgttgtttaaacctgacttctcttgttaaggttgagaccgagcatctggccccatgtttgctggctattcagctttcctcttctgcagactgcccgtttgtccactgctctgtttcagtaacttccatataccaagaactctctgccttccataactcacatcacttaaaatacgaatttttttgatgcttagagaacctgatttccttccaaccaattgtgctctcctaattccaacaaccaaatgaagcttcaactcttctttttgttcagagccctcctgagtcctgtcctactcacagtaaaggctgtggcaaaataaataaataagtaaataaaggggaaaaatacactgcatccaaaaaaggctcgtttctttttctttctttctctctctctctttctttttctttttctcttgttgtgacaattgtcacaacaaaatgtgtatgtgacaatttgttatcttaaaacagtttacccaaaatagaaaccttacaaagccagtggaaacttttctttttgcataagttggttaattcttttgagtgctggcctgggatccatgaaataacctcaactcgaccataaaacttttcactcccacgttatgcaaacggtgatgaccttgttggtggcaagccccccgtgtgactttccgaggggatctgagtggtgcaaggtggaggacgcagtgatggaaacattgcgagagggaaggcgtctgtttccacccacttaccctcagagcatgagggctgggcgaaggctctgactcctgtagggggtgacccatttctaggactatagaaggagaggtgtggacctggaaaaaggaaggaaagaccacggcaaggaaagtcaagaagtgggagaagtcaagggctctctcctcccttcctccttgtccttggcctgcagcaactcctctttctctttttgtggggacagactgaagaggatttcttagtatggtttgtaccttcccagtagagcaggaaaaagaggaacgagctgctccctccacacctcagacgctgaggtcaactgccctttgggcggggcacgttggctcacgcatctaatcccagcactttgggaggccgtgaggggagcatcacttgagcccaggagttggagaccggcctgggccacatagtgaggccccatcctccggcttgcaccactcaaattccctcgtaaagtcacacggggagcttgcccccagcaaggtcgtcagtttgcaaaacatgggagtgaaaagctttatggtggagtgtaggttatttcatggatcccaggccagcacccaaaagaattaaccatcttgtgcaaaaagaaaattttccactacttttttaaagtttctattttgggtaaatcgtttcaagataacaaattggagagagacctagagagaaatgagcctttttaagatgcagtttattttgccccatgatgtttttgtttttgtttttgccagagcctttactgtgagtaggacaggactcaggaggcctctgaacaaaaagaagcgttgaagcttcatttggttgttggaattgggagagcacaattggttggaaggaaatcaggttctctcaaaaaataaaataaaataaaataaaaaaaaaagccagcgtgctggcgcgggtccatggtccaagctacttgggaggctgaggtggggggatcgcttgagcccggaagtcgaggctgtagtgagccgtgattgcaccactgcactccagcctgggcgatagaacaagaccctgtctcttaaaacaaacaagaaacaaaacaaaacaaacaacaaaaaaattcatttgggaatgtttctgcgcgtgcccataagcagagccatgctataggatctcccctgtgccccaacaatcagcttcttacttggagggtagagaacggtgcttccccacgctgctgtgcaatggataggagctatgtgaagctggcgtatgggtggggtttgcaggcttcgtccggcttcatcgccggctgctgacccggcaccaattcctgttctgcaggtctcaccgcagaggggcacgccagccatgaggacagatgagggaacacgtgatgccacgatgggggtgccaggatgaggtgggtgcggtcgcggacaggcgcacgaggagcccagcggagcgccacccggagcaggcgcggaggagggctggggagggccaccaaggcgacgagagccggtgtgcctgaatcagcctaaaggagacggaggaggagtgtggtgggcgcaggggcagggagctgggggaagggcggggggctagcccaggctgaaggcaggcaggagcagggccgcgatgtcagacaagaaacggcagcagtgtgtttgggaacctagcaccaaccgcaccggtggagacagggtctgctgtagaggaggtggggccgggtcccagctaagtaaggcggtggatcttgcagcccttccatcctcagccgctcattctgcgcaaatctcggggccagccttggtggagccgtaaagcgtccaccagaacctggatccctccgccacctttcccatgaattcacctttctgtacacagcaagcgcctgagcggagacggccgacacgtttcccactgttaccccaggaaaccgcggctcctgagggggtcagggcctgggcagggggcagagctcagcgcgccgtactgaggcagaaacggggtccagagagggtggggtgggggtacagggaagggtcgcccgaaggtccctggcgcagggaggacagaggagggatctagaattcgtaggggagaagagaactcagaaaagatccggcccagcgcatttattttacagag

SEQ ID NO: 1619 - DNA, 7110 bp, Homo sapiens
tcggatgctgtttacccattaaagaggatgctacaaatgtttattcattaaagccactcataacagcatagtacaaccctatttaaaaaagaaagacatattttacatgtatgtgtagaaaataatcaggaagaatgtacaccatattaacaggagattattcctaaggtgaagaattatgagtggttcttatttccttatctacttaagttttttctctccaatgggcaggcattgcttgtaccataccttaagcaaggaagtgcatgtttgggacagcagtttgggctctcagcctccttaagagagtcaggtctgcctcatccctgtatctgctagttgagcagaggccagggctgtgtgaggggctctccaacaattgtctttacaaagtataaaaagtcatcagtgatcccaggaacatgtttgtatctcaaattcagagattcaagagggccttagtttaacctcactgatgctcaaattctatttgtaaaggggtagcctgtcctctttcatgggcccctctgcaatgcaagggctgggagagcaattccgcctccacataggggtttcacagagattttctttagagatagagggattcattttccagggttaagctcaccacttcattttattttaggtctatacaattttaggcttgattataaaaaaaaaaagtctgatattgtttacattatagaactctgccaaaggcagttctcttctttaattcattacctcctcgaggctctgggcacagtatcccaggtatcaagaagtacttgttcccttgccgttggagactcaagcacctcaccctgagacaggggcctcggaaagaaagacctgaatggtgtggaggaaagagccctgagctgggagacaaggtccctccagctactgctccaaccctgacttgctgtgtgcctttgatcaagctgtctctgggctttagcctccccctttgtaaaacgggcggggaagaggttgagatggcatgggtgcctccagctctctcagcatgattctgagaactctgcgggtagctctggcctgcccctttccacgccctaccgcgatgtgcgcacaacagtattgtgacccttgtggtgtactgtagattttacctagttttgtttcccgtcaaacacataaagaaaaagtaatctttcccaccccgcccccactaaaataataatcatgagaatgaatacacagggaggaagactggaaaaaatgaaagggaaggacttgctccctcaaaaggaaggatctcagtttgaagtaatgtagtggctgttgcacagggttagacgtatctcgccgaaaggctgggcttgtctcccgatttgaccacaggcctgaaagagaggaaagcgaccatcattgtagccagaaccccgccagtgcagcatccatccagccacgtccagcctcccaatcccccagcctttgaaaggtctgagaacctgttcctggggcaccagcatgggactgggtgaatgacgtcagcacagcacccgtgctaaatgccttacttgcaccatctcatgtaatcctcacagcagccttaagggtgggcactgagattgagaagttaaacttgcccaaggtcacacatctaggaggtggctgagccaggatctaaaccgagttagtctagcttcctggagcccctgtcaaggtctccacagaggtgtgagagtgagactgataaccaaagtcattagctgacctgattctcagccccggaggatgacagggagagaggaggatgtgagcaaatcaccaccatcagccaaatgatgttacgctaaaaacgtgttaattcagcaccaggctagcaccttgtaaacatgctaattcatcatgagcgtcatgtctgcactctcagccctctaaaacctctctgttgaagctgagcggcccaccatcatcactgagtatattaactcgggtgttggaatttcccaggtgtgtttaatctgtatagctttgtattttaaggcagaactttattctcagttattcatctcaaaatgagagttttcagaaaagatcgagaaaagggatggtccttctgcaaaagttccaaagtgcaccctgaataataaaaatgctaaaaactggccgggtgcggtagctcacgcctataatcccagcactttgggaggccaaggcgggcggatcacgaggtcaggagatcgagaccatcctggctaacacggtgaaaccccgtctctactaaaaatacaaaaaattagccgggtgttgtggcgggtgcctgtagtcccagctacttgggaggttgaggcaggagaatggcgtgaacccgggaggcggagcttgcagtgagccgagatcgcaccactgcactcaagcctgggcgacatagcgagactccgtctcaaaaaaaaaaaaaaaaaaaaagaaaagaaaagaaaagaaaagctaaaaacttccccccccactttttttttttttttttgtgagatggaatcttgctctgttacccaggctggagtgcagtggtacgatctcagctcactgcaacctccgcctcccacgttcaagcgattctcctgcctcagcctcctgagtagcccggattataggcatgcaccacaatacccggctcattttcaaagtctttatccccttggtatatcacctgtaacatatgcattggaaatccattgcatttccattgctaaaaacaacaatgtgtaaagtcctgaacttggattccctcagaaaaatgtaaaggagtataaaatgcaaactccaggtataaaatgtaaaatatttcatctactgaaaagaactggtgtacacagtcggttatccttaacacttcagcctgcagccatggggaaggtgtctgagctttggatggaagttgcagctcccgggcagtatgaccttggacaaatcactaaatgttctaagcctcagtttccttatctgtaaaatgcaggtaatcatgactactttaaaagttgtcataaaacttaaaattaaaaaaaatctataaagcaagtaacgtgcgttgtaggctttcatcaaatggttattactattgataatctgagtttaatgtgcctttgccactttactaatccctgagccatgagatggcacaaagttgctgtgaggattaagagagatggggagtattacccctatcacagtgcctgactagagcaggcacttgttagatgctaccacagggatgcctcagccaacgggtggagagaggtttttaacagagagggagagagagagagagtgtgtgtgtgtgtgtgtgtgtgtgtgtgatcatgggctgaaactggatgaggcagtcacttgagctgccagatagccaattgtccctgcatctcgttccccttttttctactccagtccttggcagcaaaccaaggtcctacatgacacagagaagttagcaaccaaagccattattattttggttcagctgataaaagattggctctccctcaaaaaactagaccagccaagtaggaaaaaaaattgttttcttaagaaaacaacaaaacccagatggaataatcagaataaagaggaggtcaggtcctacgaggagctaggataaattgggggaatccctcaggttttttttttttttttttggaagtgccaggtcaaataagatggagatttactggagtcacactgctgttggcacccgcctaacccgggcctcctttttctcaaagacacaggccagatgccagccttggcctctctttgctcaggaactggctgactccctgccccaggatttcacggccatgacctctctctgggaaaagttcccactatttgctgctggggaaaccaggaccccaccccagggctggccaaggtgagcaggctgagttcaaaagagactcaccggggacatttgcaaacacgtcttcggttccctggataaggaaaaagaagggaaaaagtgagtgcccctatccatcaatagtccccaaagacagtgtattttttgttgttgctgttgttgttgctgctgttttttggttttacaaaaaatcatttcagaacgatcatgggctgaaattggatgaggcaaatagggaattgcctctacgaattctccttcctttcccctatttctttgaggattataactcttgagagccgggtaagggcttcttatccatccttcgtctcaagcatcaattaaaaaaaattgcaactacagacgcgggcgaaagcggggagcctgcagacctgatccggcacctctcttgcatgggacccaaagcagggtgggcggttcgccgaagagggccaaggacgaacctcaaactgatggtggttttgactaaccctcctgggcacttgactcggccacagcggccccctcccggcgggcgtttgtcatgtgtccagacatgtgcgcgcgcgctgcgggcttcgtcgacggaacacacccgctgcagcggctctgggaacgcggctttgtctcccaaaacctctccgagagcgcaaggagcgggaagggctttctcgcattctatctcccagaaagaagtgcctgtacctgcggggcagctcgggagtcccagaaaactcaaccccaagctcccccctcgcaaggtccgcctggagctagcagagccaagggcaggagcggggccgactccttcccgccgcgattcctcgggacttactgtggttgcagtaaagggtgataaccagtgacaggagaaggaccccacaagtcccggccaagggcgcccagatgtagatatcacaggcgaagtccagccccctcgtgtgcactgacgacaccaaagacgccgacatttaggagagggcccgggacctcccaaccgccccaccgtcccgggaacgtctctccgcctcagatctcggtttcccaccacttggacagcccttgactctacctacagtatcagggctgtccctggcatgggctctccccgcggtgcgtgccgcccccgccccgggcccccgcacgcctcacctgcgccccccgccgctggccggcacgcctctgggcgcagggacaggggctgcgacgcgatggtgggcgccggtgttggtggtcgcggcgctggcgtcgtggtgggcttcgctgcaagagcaacagagcgtggttgggggccaggctggggttatggaggcgccccagccccggcctcgcgcacctttccccacggggacgcctccccccggttttcctgggagaagggatagcagaggagacaggatggggaccccgggatgcgcgcggacccctgtgctcgggcctcggctcagcccagcgcacccggcgcccagagccggagcgcaggagccagctcccctgcacctggcctctctcccgggctgaaccagcaaccctggagcgcgggttgattgctgtccgcattttacccacgagcaaacggaggcgcagataatttaagtcatttgcccagaatcacacaagaatccgaactcgagtccagatcggccggacgtaaaaagccatccccagtccctactcagcctcgcgttagcctcagtttgctgtgtctgtgaaatgggaacagtatctaagtcgcttccaggtgcgctaagaggcttgaaagcagggcccaggtgtggaaaacaggttgaggtgaaccccaagccccacgcggagaggtgccgcaacccggcgcgcggacctggcaggaagaccggcacgaagtggctgaagtacatgatggagttgctcagggccgagcagaaatagtagccctcgttctctcggcggaagtcgctcagggtgaggacgaaggtgtcccccaacctcttgcccgagaaccgctgggtgtccagcccctcggccgccttgggcttgttttgggagaggtataggaggaaggtgggactggcggcggcgccgcgcggctggaagagccacgagcagcccgacgtcgggttggacagcagcacctggcacttcagctccactgtctcgcccaggttccaggtccgatccagcggcgacacccggaactggctcggcctggcggcgtctgcaggcggcaagcagcgaggctgagcccgcagtcccgcgccccccgccccccgcccgccccatcccctgccttcccgggcgtctcaaactcacggagcagcaaggccagcggcaggagcaaggcggtcactggtaaggccatgacgcgctccccaggacgctgcttggctcgaagctcgggcgcgaggggaggcgcgcgggagccggtggggcgccgaggggggaaagttgcgcccttcggccggcccggagcctgatttcgcatttggaggatgtgatgtcacccgaagcccccgccgaggagagtcaccctccttttcgcggttgtcgccttccagcccggcgaggaggctggggcccgtgaatagggccgtcgaggcagcctggccaggcaactgggggcagctgaaaactgcgggtttggggatgaggaaaagggcttggaaatagtccttggaaatggttgtcttgtgagagtgacagagtgggtgaagggagaccaaagatttcaagaagtgagggcgagagtaggcagcaaaggaggggagtgtcccttcctttgccttcactaaaggcgtctcttgtactgtcaccttgggactttttattggcaaaatgggcactgagggctgaaaaggaagaggaactagcgacctgcccgcttctgaggaactcgctagagcagccccagttttcaccgaggaaggaccctctcccttcccccaggagatttccatgagagcggcagcagccgaagctttgggtgtcggtgtcagtgcgctgctgacctcattcttccggcctttcatccagcggctaaactcaccacacagcctcatctcttcttggagccattgcaacagccttcaattcacaccagtctctctcctgatcagtcctccagccacgttgttataaaaattattattctcacaaaggggatctgacagcgtcactgctgcagcctcccatggcctgcattgctggatggaaattcaacccccagcttggttgaccagcccttgggtgct

SEQ ID NO: 1620 - DNA, 7110 bp, Homo sapiens; identical to SEQ ID NO: 1619

SEQ ID NO: 1621 - DNA, 7110 bp, Homo sapiens; identical to SEQ ID NO: 1619

SEQ ID NO: 1622 - DNA, 14158 bp, Homo sapiens
cctccgggcccgggtcggcgcgcccagcctgccagccgcgctgctgctgctcctcctgctgtgggaccgctgaccgcgcggctgctccgctctccccgctccaagcgccgatctgggcacccgccaccagcatggacgctcgccgcgtgccggtgagggctgggcgggcgaacccgaggggcgggcgcggtgggtgctggacgcaggcgggcgcgggccgaccctctccaactccgcagcctagcgctgccttaactggtggcctgcctaggcgttgcccgcttgggcaagcccctgattttgtgcacctgggataactgagggccatggggacgttcctgcgtggcgtgcgcacccgaagtgcgggcggcgtggagacttgagtcgtttgcaggatggctagcagcgctggaaagccctaggcacgtgcgtccgccaaaggccggacagcggccgggagcgctggccggtcccgattttgcctgccaggcagagccagcctgcctgccccctgggaggttgtcccgcagcggcccagccctttcccgcacacaactcggagccagtgcgtggctcgccgcgtctatacccgcgctcagtgggtggcccttgggcgcgcaccccgcccggcaagagacgcgtccgcttctaaccgctgagggccagcgcgtctgaggtttaaggtcttgcgaaccggtctcctagaacttgggctgcgcacgcagtgtgaagcgaccgtagtcccgggcggtggttaagtgcatttaaagggcttggtgggtcaaagcgttcgccgaccatttgctcgtttcctacttcctccaccccaacccccaaccccccaccccccaccccccagccttactcttagctgcaggacgttgctctgagtggaacgttactttttgctctaacggaagccagaacgtagggtcgggctcctggagagggtagaagagtgggggttgggtgaaacggaagacaatgacatgtttaaaataaatatcaggggttagggaccctcgcgggggtgggtgcgatggggcgtggtttcagagctgagtcgccgccccggtggagctgggcattggctttccggatgaagaaaaccatgtgtagctggtcttggaacctgacatgcctgagttcaaatctgagccaccatgggacttgagtaatccatttcgctttcctgagcctcagtttcctcattggctaagtgagaataacgatagcacctttgttgcaaagaattaaacctgacgtgaaagtgtacttaacatagtgcctggcacgaaaaacgcctactataaatggtattagttattacttacctgccaaagaagttcatctccgtcttgactatttgccttgctgcttttttgtggcttttcctccaaagatacgtttgcctggtaaataactcttggcttgtgctgacttgttaaagctcagcctgtatttctcggacagcttccaatagaatgccgcctttgaggctgtctggggcctctgactgcttgcaggtagattgatgagtaaagggtggtaattcctgcagtaatgcgatgaacactgctgcttaagaagatggcagacttgagttctccttcctgcccctgtgatcttgcagtctattacaccttcctggggccttgaatatcctcatctggaaaatgggatctgagatccttttcagctcccaacattcattgtgtcccaggctggagtgcagtggcacagtcacggctcactgcagcctaccgggctcaagcagtcttcccacctcagcctcccaagtaactgggattacatgtacgcaccgccacatccggctgatttttgtgtttttagtagagacggggtttcaccatattccccacgctggtctcgaactcgtgggctcaagtgatcctcccaccttggcttcccaaagcgctgagattacaggtgtgagccacccccctacacatacacctaacctttatatttagtagctctaccttttacacgttgtcctgccttgttaagagggcaaaagacaaaaacttcctaagatgattgaacggagtttacttaggggtatagggatgttgggagtgccatcatcatgaaaataactttatctgcaagagactgaaatgcgtaatgttaggccaagaaggagggcaagaatgttctggtcacctgacatcttacatcttagcatattttgtagaatctataccagagcttgccctttcaaagttttcagtgtaaggaatcacttctgctattccatggccccatttaaggaataaaaacacaggacctaatgcaacacttaggaaatctcgttaaatattaagaaatgacaaaccactatcctttttttatacaagatagatgccaattacattttctgagagcagtgccaggctgttcagtatttatgaatgaatgaagcatttctatgtaagtaatttgcactttataaaaggacttttaaaaacttaagtcttgtatagcaaagggacagcaacaagaactgaatgacagcctcaagtaatagagtgctaaaatggaatccggtatcccacctgcatttggagtgctatttgatctttaacttggctccttgtaccatttgttgaagcgtttgatgtatttgctttgtaaggacttctgtggaaatcacgatagccctcttgattggaaaggggcctgcttggaagcctgccatcttgaagtagaggtcctgcccagtttttgtagtttgtgaaattagcatcacagtacatagcccaaagcttacataaaaatacctcattagcttgattttggctgagggagaaaaatctttctccccttttgtacttttgaaatttccttttagaagtacagtttaatttttttaaaaaaacaggttggattttaggagtttagcattaaaatctcctgtggggctcagtataatgctaagagctaaagattaggggctcataaaggtgggttgagaggtagctctacagatgtttgaataaattgataaatgtctttacaattttcctgcaaagggatcccttcttagaatttgacctggttttggccgggcgcggtggctcacgcctgtaatcccagcactttgggaggccgaggcaggcagatcacgaggtcaggagattgagaccattctggctaacacggtgaaaccccgtctctactaaaaatacaaaaaattaaccgggcgtggtggcgggcgcctgtaatcccagctactctggaggctgaggcaggagaatggcgtgaatccatgaggcggagcttgcagtgagccgagatcgcgccactgcactccagcctgggcgacacagcgagactccgtctcaaaaaaaaaaaaaaaaagaatttgacctggttttaaagatttttgggtccagatacagtagctaatgcctgtaatccaagccctttgggaggctccggtgggaggatcacttgagcccaggagtttgagaccaacctgggcaacatagcaagaccccatctctaaaaagaaataaaataagttagctgggcatggtggcacatgcatgtagtcctgtctactcaggaggctgaggcaggaggcttgcttgagctcaggagttccaggttgtagtaagctatgatctcagcactgcactttagcctggaagacagagcgagatcctgcttcttacaaaaaaaagaaagaaaaaattttttgtagcagttaacaaacttccttttctatgtagggtatgataaatggacatatctactctgtgctgtttgaacctactaaactaaaaaaaaatgatgtctttagttaaataaagtaagcatcacgcttaataggattgctatttccatttgcagcagaaagatctcagagtaaagaagaacttaaagaaattcagatatgtgaagttgatttccatggaaacctcgtcatcctctgatgacagttgtgacagctttgcttctgataattttgcaaacacggtaagtgctgcctgagaataaacagaattgagtctgcagtgctcaaaatgccccagatgctttgtgcgtgattaaaactgcttgctttttgcctacatttctatacagccgttatgaaaatacagtatgcactataatttcatttcactttttgctgtggttctaggtagtaattgttggaggtagattagctacttattctatccttttgaaatgtcgcctaacctaacatgcatgatgatttgccataacaactcagaaatcatttgtaaacctctgaaccatttttctttgtaacaaaagctgttctcttgtagtgcacttgtaaatgtgatttgctctctgcacggtttatggaaaattggttcttgaaaaagaaaaaaaatgcacaaccgcatttatttatttattttacagaaacctaaattcaggtcagatatcagtgaagaactggcaaatgttttttatgaggactctgataatgaatctttctgcggcttttcagaaagtgaggtgcaagatgtattagaccattgtggatttttacagaaaccaaggccagatgtcactaacgaactggccggtatttttcatgccgactctgacgatgaatcattttgcggtttctcagagagtgagatacaagatggaatggtgagttcgagaatttcaccagtttcaagaagtaagatacatttagaggcatgacatatttttagaaatttttttcttgtgattttgattttagtcatgccagcagactttgttgaccttttaaaaatttttagtgttttcttcatgtcttaaagcagtgtttactaatgtagtcggacttacaaatcatgaacattttgtaggctctgaaaatttggaaactggtaagataaaattggccaatctccagattttcgtttccacaaaaatccagcctaatcaggaagcacactagttctaaatattatctacatttgcatttaagttcaagtgcccagcctagtgcctgtcatagagcagacctttgataaatgttggtctcatagtagatctgtggctgcatcttgaaaacctgtgataacttacgtgcaggagctccattgcagataatgacattgagggcccttcctgctgctacttttgctccttggttggcttttcctatgcacgctaccttcctttaactgccgctgccactgttgtgctgtgcctcggtcccactcttctgagcatactgcttaattctgcacacattttcctgttccaaagactttcttgacaaaggaagcagtgcattcactgataatcaagtgcatgctcttcaactcactggtctgacatggatccactgcctgaggttcatggtttgagtaacattgatagaagtggcagtgcctggccaaggagtgttttggtccaaatcagtgcatactggagtttgttgcagggggtccagtctgcagatctggatgcgacacaaacattgtcaatagcctgaataatttctgggcagtgtttcagttctttgaagatactgtcatgattaataaaatgccaattcattataattgttaggaactcatgaaaggtttttgttgttttgtactctctcaatccatggacactaaaagtacaaaaagctgtttgtgggcatgtaagacttttgagacagggtcttgcactgtcaaccaggctggagtgcactggtgtgatcatggctcactgcagcctccacctcctgggcttaagcgattctccctcagcctacccagtagctgagactacaggcgtgtaccaccatgcctgggaacttttaaaaattttttatagagatgtgggctcactttgttgctcaggctggtctcgaactcctaggcccaagcaatcctcccgtctcggcctccaaaagtgctgggattacagccaagagccaccttgctggccttgataaatattttaatgttaaaactgagtctttatgggtgaaattctgggatttatgggtgatttttttcttctctctctctttttttttaacctgcaaccattaccatagtcaattttggaataactttatgaccccaaaaaatgactctgtacccattaacagtcactccctattctttcccaacacccccagctcctggcaaccatcagtctgctttctgtcgtcatagattagcccgttgtggatatttcataaaaattgaatcatgatatgtggtcttttgtgactggcttctttcacttaggataatgatgtcaaggtttatttatgttgtggcatgtgttagttcttcattttattgcagaatattctgttgtgtgaatcagccacatttgatttacccattcatcagttgatggataagtgggttgtttgcacttttttggctattatgaataatgctactgtgaacattcatgtacaagtttttgtgtagtttttgtgtatactcttaggtatatacataggaatagaattgtgggtcatgtagtaactgtttaaccttttgagaaatagacaaagtggctacaccagtttacattcctaccagcagtgtgtgagggttacagtttctccaaatttttgctaatacttttttttattttccttttgctttttttttttttttttgagacagagtctcactctgtcacccaggctggcgtacagtggcataattttggctcaccacaacctccgcctcctgggttcaagcgattcttgtgtctcagcatctgagtagctgggactacaggcatgtgccaccacacctggctaattttttatatttttagtagagacggggttttgccatcttggccagactggtctcgaactcctgacctcaggtgatctgcccatctcagcctcccaaagagctgggattacagatgtgagccaccatacccagccttcttttgctttttagctctactatgaagtggtgtctcactatgttttgtgtttttttttatttttatttttcggagacggagtcttgctctgtagcccaggctggagtgcagtggtgtggtctcagtgatctctgctcactgcaacctccgcttcctgggttcaagcgattctcttgcctcagcctcccaagtagctgggattacaggcgtgtgccactgtgcctggctaatttttgtatttttagtagaaacgggatttcaccatgttggccagactggtgtcaaactcctgacgtcaggtgatccgcctgccccggccttccaaagtgctgggattataggcatgagctaccgcacccagccttgcattgtgattttgatttacattaccctatggctaatttggataaatttttaatgatgaaaacctatattacttttggaatctggaaatattttcattttgaacttctaaaagtagattagagaagtacctagagaagtcaaatgtatagacagaaaataggatgatggttgccaggggcggagggaaagagggaatgaggaattactgtttaatgggtatggatggagttttagttggagaagatgaaaacattctggagatggatggtggtgatggctgcacaacaatgtgcatgtatttaatgccattgacttgtatacttagaaatggttaaaatgataaatcttatgtatattatattatatattttttaaagtagagaattgagatctgttaatataatttaatattgccataaacattgaagccatatttataggggaacacatttttttccctttttttttttttcaagacagggtctggctctgtaacccagccctggcatacagtggcacgaacacggctcactgagcctctgccccctgggctcaagccatccacccacctcagccttccaagtagctgggaccacaggcatgcgccaccatgcccagctaatttttgtatttttttttgcagagacggggtttcaccatgttgcccaggctggtctcgaactcctaggctcaagtgattcacccgcctcagcctcccaaagtgctgggattacagatgtgagccactgcacccagccaggagaacacatttgttcttgtcagaattcttttaaaatacataaagatctgtttctaaagaaatgaaaagcaggtggtaggaattttaacattttaaaaaaaggctcagaaccacaggcctagggactatgaaaatagcttataacagtgtggtccagatgggctacatggaattaaactgcactctgttgatgtactctttgtggttcctgattttgttacccagaggtatcaatgttcagttaaaattcatttcatacaagtgtctcattgaaaagggactttgtagttatactgatgcagcttgtctgctgatcaagtcctaatgactcaattgttgtgattagaggctgcagtcagttcgggaaggctgtaggacccgcagccagtgcaggcactctggacctctcagggtggcgatgaagtttccagcgcggagtaccaggggagcaaccaacaaaaaagcagagtcccgccagccctcagagaattctgtgactgattccaactccgattcagaagatgaaagtggaatgaattttttggagaaaagggctttaaatataaagcaaaacaaagcaatggtaggtatctgactttgtgttagaattaatttttcctctctaagcgactcattacttaaatctgttccatcacgcaaaagttatttttttctgttacatgaataaaaagttatttttgtttacctgtgaagtcttcaatgtgtgcctcaaaatgtgtttctttccctgaactactttttttaaatctgttaaaggcctggttaagtgtataggggaaatcagaaactctgaatgtgtcagcttactatcaaatataaaaccatgagatgtacttgagtattttccagaagttagttgctcattttcgacagttattctaagccaatgatatcagtttaatttcctccctttttagcttgcaaaactcatgtctgaattagaaagcttccctggctcgttccgtggaagacatcccctcccaggctccgactcagtaagtaccagttcttgtttatatacagtagtgttttgggcacacctaaggtcgatctgtgttgtatttaaaaatctaatttctttatttgtgtggccttctagacaaacgaaggggacctagaggaaaccccctgacagatctctggatgatcctccttgaatcctgggcagtttggtctctccttgctgtgctcctgtggcactaaactccttttgattggttctttctttccttcccagctagactaagcccctcatgggcaggtaatgaagattgaaaacttttttctgttctccagtgtgagcacattcctcctacatggtagatgtgcaatagatgtttttaaaattggagaatgaaaataaaagaagaaaatcacaatttcttatcaagttgtagcttggtatcatacacaattgcattctgaggaattaaggtggtacaacttagggagatttggtgtgtctgctgtgatagaaaagatttctttttcctggctttccctgaggaaaggaaagatggaaagagggaagccatacagatatccctctattttgcagtgtagaaactgaatgtgtttctacagggtcaagagacatcagagaaaatttttttttttagaacagaagatcatttcttacatcttcattaagtaaaagaataaatagctcatctctcaagttgaaagaaactgggcttggtattacaaaagcaaaattaagatggccatataggttttaggctcattttgccatgcattatgcaaaggacaaagaaaaagaaaaaatagagctctctttacttaaaacatccttaaggagaagctatgaattccccaaagtactacttctctttattatggaataaatggattcccttatacgtgctttgtttagcaatcaaggagaccgcgaaggcgtacattcccgggtgttgcttccaggagaaaccctgaacggagagctcgtcctcttaccaggtcaaggtcccggatcctcgggtcccttgacgctctacccatggaggaggaggaggaagaggataagtacatgttggtgagaaagaggaagaccgtggatggctacatgaatgtgagttctccgcattggtacttgctcttctgattctcatcttcggtaggcctggcatcatacacagcacaggtacacgcacatccttaacaccaggcgatccatagtaaatgttttcctctaaccattcagaactgtaaacgtcacataagcttacttggtaattttattagcaggcgagaattgggttttcttcatctcttcttaattgtaggcatcgtttccaaaatgtccagttaggctacagtaagcgtatggcctgttcccctaccataagctctaggagagatttccaggttgaagtttgtgtgaagaaattacaagtcaagtatctgagattcaaagctggggagagccagttttgaatctctgtgtttcatatttgaatctgttttttcagttttgaatctctttcagtttttcagttttgaagttctgtgttttgtattccttgtaatgcaggaagatgacctgcccagaagccgtcgctccagatcatccgtgacccttccgcatataattcgcccagtggaagaaattacagaggaggagttggagaacgtctgcagcaattctcgagagaagatatataaccgttcactggtgagagcctctaaattacacctgagaatgtaaacatctgtgagaggaagagagcttctgtccctaagcgttgcccaggttctaaagggcctagcatgtgaaatctgtacctatatgtttttttcacacaaggaaggaaaagttttacagtatccctgggatttagccctctttcacagtggaattatctgcttagtaagtctgtagtcatggtaaatcttttctcctaatttagaaatcaattcattcaacatatatttactgcatatctattatgtgtgtatacatagctaggtgctggagtgtggtggtacaccaaagataaaagtggatttgggtaggttattttttaataagaccttttcttaaagggaaagcggttttaccacaccaggctaatttttatatttttagtggagatggggttttgccatattgcccaggctggtcttgaactccttggctcaagcgatccactctcctcagtctcccggaatgctggggttacaggtgtgagccactgcacctggttgagttatttttcataccctggcatatacatgtgtatgtagagattcatagacaaaatgtaagcctatactacgaagagggacattctgtaaatatgccatttcctctgttgaaaaacagtggttttttttgttttttttcttaatggcttatttgtagggctctacttgtcatcaatgccgtcagaagactattgataccaaaacaaactgcagaaacccagactgctggggcgttcgaggccagttctgtggcccctgccttcgaaaccgttatggtgaagaggtcagggatgctctgctggatccggtaggtgcctgccaggggttggtcctgtgggcttgaaggtcagccacaaactgtgatgaggccagaaaaaggcattggtgaaggggtggagccctttctgttatggggtgctcttctttttttttaagatggagtctcattctgtcgccaggctgcagtgcagtggcgcgatctcagctcactgcaacctcctcctcctgggttcaagcgattctcctgcctcagcctcccaagtagctgggactacaggcacgcgccaccacacctagctaatttttgtatttttagtagagacggggtttcaccacattggccaggatggtgtggtggtacaagatctcttgacctcgtgatccacccgcctcggcctcctgaagtgctgggattacaggtgtgagccaccacgcccggcccagggtgctcttaattcagaacacaaatgaattcagagggatggtgctgcataggcatgagccgcttctacgatactcgggtctgaactgtccctgggaagttgctgctccatttatccctggtagctgcttgtaacttccactcctggaaggaagcattaggcattaggaaacattaggcatgactaatgcctattaatcatataaatttttaaccataaagaaggggttaaatgtaatgtagataagttggtgggggaggtaaggtttaacttaattgtgccgtttgacaatcctccttcagaactggcattgcccgccttgtcgaggaatctgcaactgcagtttctgccggcagcgagatggacggtgtgcgactggggtccttgtgtatttagccaaatatcatggctttgggaatgtgcatgcctacttgaaaaggtagtgggtgtttttttttcccttccacatctgaattttatattcatttatgtcttaatgagaagatgatagatgtcagaagagtggttatctctggcggggtggagactgactggaacggggcacactggaagggatgggaacattttctgtcttcacttaggtggtggtaacccgggtgggtgggtgtgtatgaaaaagtcaggtaatatacttgaagatgcgcacacttgaccatagtgatgttataactcaataaaaatggttttaaaaatgaattaggctttcaaaagagaattctttggttgaaaactatgtcctgacacatttccttttgtttttcacagcctgaaacaggaatttgaaatgcaagcataatatctggaaaatttgctgcctgccttctacttctcaaatctttcttgtaaaagtttccaattttttcactgaaacctgagttaaaaatcttgatgatcagcctgtttcataagaaactccaatcaagttaatcttagcagacatgtgtttctggagcatcacagaaggtatattgctagttacactttgccctcctgcagtttcttctctgctcccaacccccatctcacagcatccccctctatttccaatgctcctctccaaccgcttagtttctgaatttcttttaaattacagttttatgaaagcatattttatttacttggtgttgaaatagccctcataaaacctaagcacttggaaacacaataatagtattaactaactagatctattgaatttcagagaagagccttctaacttgtttacacaaaaacgagtatgatttagcattcatactagttgaaatttttaatagaatcaaggcacaaaagtcttaaaaccatgtggaaaaattaggtaattattgcagattgatgtctctcaatcccatgtattgcgcttatgttacaagttgttgtcacagttgagacttaatttctcctaatttcttctgcccgaagggtaagtggtgcgtccagcttacacaatcataattcaaaggttggtgggcaatgtaatacttaattaaaataatgatggaagagctatctggagattatgagtaagctgatttgaattttcagtataaaactttagtataattgtagtttgcaaagtttatttcagttcacatgtaaggtattgcaaataaattcttggacaattttgtatggaaacttgatattaaaaactagtctgtggttctttgcagtttcttgtaaatttataaaccaggcacaaggttcaagtttagattttaagcacttttataacaatgataagtgcctttttggagatgtaacttttagcagtttgttaacctgacatctctgccagtctagtttctgggcaggtttcctgtgtcagtattccccctcctctttgcattaatcaaggtatttggtagaggtggaatctaagtgtttgtatgtccaatttacttgcatatgtaaaccattgctgtgccattcaatgtttgatgcataattggaccttgaatcgataagtgtaaatacagcttttgatctgtaatgcttttatacaaaagtttattttaataataaaatgtttgttctaacttgtctgcttttttaaaaataatcttactgtacttaattctaattttttcctcatatttaaataaaaggccatttccaccttttc

SEQ ID NO: 1623 - DNA, 14158 bp, Homo sapiens; identical to SEQ ID NO: 1622

SEQ ID NO: 1624 - DNA, 2108 bp, Homo sapiens
tcccaatcccggggcggccgggcgggggtgggcagggggcgtgaggccgcccctgcgtcccgggggccccccgaaaacgcgctccgggtgcccggtccctccgctgcgccctgccgccgtcctcccgggggtctcgggcggccgcggccgtgtccttcgcgtcccggcggcgcggcgggaggggccggcgtgacgcagcggttgctacgggccgcccttataaataaccgggctcaggagaaactttagcgagtcagagccgcgcacgggactgggaaggggacccacccgagggtccagccaccagccccctcactaatagcggccaccccggcagcggcggcagcagcagcagcgacgcagcggcgacagctcagagcagggaggccgcgccacctgcgggccggccggagcgggcagccccaggccccctccccgggcacccgcgttcatgcaacgcctggtggcctgggacccagcatgtctccccctgccgccgccgccgcctgcctttaaatccatggaagtggccaacttctactacgaggcggactgcttggctgctgcgtacggcggcaaggcggcccccgcggcgccccccgcggccagacccgggccgcgcccccccgccggcgagctgggcagcatcggcgaccacgagcgcgccatcgacttcagcccgtacctggagccgctgggcgcgccgcaggccccggcgcccgccacggccacggacaccttcgaggcggctccgcccgcgcccgcccccgcgcccgcctcctccgggcagcaccacgacttcctctccgacctcttctccgacgactacgggggcaagaactgcaagaagccggccgagtacggctacgtgagcctggggcgcctgggggccgccaagggcgcgctgcaccccggctgcttcgcgcccctgcacccaccgcccccgccgccgccgccgcccgccgagctcaaggcggagccgggcttcgagcccgcggactgcaagcggaaggaggaggccggggcgccgggcggcggcgcaggcatggcggcgggcttcccgtacgcgctgcgcgcttacctcggctaccaggcggtgccgagcggcagcagcgggagcctctccacgtcctcctcgtccagcccgcccggcacgccgagccccgctgacgccaaggcgcccccgaccgcctgctacgcgggggccgcgccggcgccctcgcaggtcaagagcaaggccaagaagaccgtggacaagcacagcgacgagtacaagatccggcgcgagcgcaacaacatcgccgtgcgcaagagccgcgacaaggccaagatgcgcaacctggagacgcagcacaaggtcctggagctcacggccgagaacgagcggctgcagaagaaggtggagcagctgtcgcgcgagctcagcaccctgcggaacttgttcaagcagctgcccgagcccctgctcgcctcctccggccactgctagcgcggcccccgcgcgcgtccccctgccggccggggctgagactccggggagcgcccgcgcccgcgccctcgcccccgcccccggcggcgccggcaaaactttggcactggggcacttggcagcgcggggagcccgtcggtaattttaatattttattatatatatatatctatatttttgtccaaaccaaccgcacatgcagatggggctcccgcccgtggtgttatttaaagaagaaacgtctatgtgtacagatgaatgataaactctctgcttctccctctgcccctctccaggcgccggcgggcgggccggtttcgaagttgatgcaatcggtttaaacatggctgaacgcgtgtgtacacgggactgacgcaacccacgtgtaactgtcagccgggccctgagtaatcgcttaaagatgttcctacgggcttgttgctgttgatgttttgttttgttttgttttttggtctttttttgtattataaaaaataatctatttctatgagaaaagaggcgtctgtatattttgggaatcttttccgtttcaagcattaagaacacttttaataaacttttttttgagaatggttacaaagccttttgggggcagtaa

SEQ ID NO: 1625 - DNA, 189263 bp, Homo sapiens
gcggcggcggcggcggcggcggcggcagcggcggcggcggcggcggcgcgggggttgagtcgtggtggtgcggacgcgctcgtgctcgggaactatcggattaaacttgaatcgagtgaaattacacaaaggagcgccgcggaggaggcggcccggggacccggacaccctgaaactcaccagagacccgttcgcccccggccaactccgtgcccgtggattcagccccctggccgcagctgccgagccaactccggagcccgctctgcgttttgttttcccctcggcactaggcagcggaggagcccgaccgacccggtgagcgcgagagttcgcccggcgcccccgggaggggcggcggcggcggcggcggcaggaaatcgctccgggccggggccggggccgcgctaggagttgggagcgaggagttgggcgtgtgcggggcgaggggcgaggggcgagggcgggagggggccggggccagcgcaggagcgcagcgccgcccgcgtagtgtcgccggcgtcgccgcccgcggggcccgaacccgcgccccgagcgccgcccggcgccccaacttttgcctgcgtccgccgggccggcggcggcgggggcgcgcggtgcggccgagggtcacttcctcgcatgtaaatggctttttgttgtgctgccggcgtggggggggggtacgggggacaggagggagcgtgtctgcgcgcgggggagcgcgagcgcgtttcctcccgccggcgccgagcacgagttgccggctccattcgagagaaaaaggaaggaggaaaagttgggctccaactcaagtgcgagcgggcgatgggcgcgcgggcgcggggcggctgagcagcggcggcggcggctcggggacggcggcgacccccgcctcccgcccccgccccccgctccggaccgaccacgccgcgctcgccgggagctgcggccgcaccggcgcgaacaaagtgcgttcctcccggcgcggcggcgccagcccgcgcggggaccgccaccgagcgaggtgggtcggcggcggggaaagtgcgcggggcgccgcgtggggcgggggcagcgcgaacacgcggcgcgggaggcgtcccgagctcagccagtgccggtcgcgggcgcggagttgcgagcccggagttgggggctcctggggctccccggcggctcccaagtgcgctaggaggagaagaaagggagcggggccggggcgagcgccgggaggcgcggcgaggaggggaccccaccttgtcgagctggccgggccgccggcggcggcagctgcataatagcgactttaaccttccaacgcaactcggctcccccgccccccaacccgccgggggtcagcgccggtggggggtggtcaccaggtggcccccgaggtgacccgggtgcgctctgccctcgcagagagccgcggcttggagcgtgaacggccgaggtggctggaggccaagcggtcagcggggagaggaaaggagggcggtgggggacgcgttgtttgtttggttcgcaccggggattgggctcgctgggggcgcggggctcgggcgggggcgcgggcaccggctgggctgcggtgcggggcgggcgcggcggcgcggggctgtcgaggtcgcggggggggggggcgggggcggcggcggcggcggctcccgggcgggggtgggggcgctggtcgggaggctctggggaaggagccgccggccccgagcagccatcattaccgagccgcctttctccggatggctctgcctcgaggagcccggagccgtgggagcgcaccccaaactcccggccggccgcccgctttgtgagcgcccccgtgaagcgagcggcgcggagagtgctcctgctatgggtcggactcttttcctggaggtcacttttagagactgctcacgccttggtttaaactagtttttttccccctcttctgaacagacaatggacaaaagaaaagtagcaacccacatggagagagtttccttttgaattgctagaattagatacactatccagcgctccacttgctaagtatactttttagtttcccattgtatattatctagcaatcgatttaaataacttatcttaaaaagtgtcccttttgggggcttaatttctggaatacattacatgtcttaatttatttttaaaggattttgtgaggccctgattttttattttctaaaaattttaatttaagccgtctttgcagtgggcgatacctttctaaggggttaagtgttatttcaccccagttctctctcggtaagggagggagtactcagtatacgtagtaatcgaagaggaaacaaaatacgtgtctttatttcttcactgatcttgtctgacgatgacaaaaaatatcttagtgactgtgaccttagcagcatggctacctgatttatcccagttataattatatttagattgcagtaatgtctaagtacaaggtaattcctatttcagaaataacttgagcagtgattttacgaagttgaatccttctcccagcccccagagtacatctgtcgcgcagtgtttttgtcttgctgttgcacaacagaagccctccagtctttaccctaaaatggcagctttcatttgactgaggcccattcattgacaatgataataaagaggctgaaagctagatgcttggggcatggagtaggacttggtttgcctttctaggtgataagtaggagacattttatgtcttccagtttgctcaggaaaagtttattttccctgaaaaatctgtcttgtagaaaaaagttatagtaaaataatttggaaatgggtaaaggcttgagcagcaaattttagaagctaaattttcttattttgcccaatagtggaaatatggcattctcttttttggtaatctgctgataaaaggacataatggatttttgtcaggcttgtaacaggtgaatttcctcatgctggtactcaagaattgggattgttttctagcactgtgggtttttttctctttatattttctaattttttctcctgttcgagtcactaaattgaaccatgatgaattgtatcctgggtctatgctttcgcgattgaaatgagttttcagataagaaatgaattataattttaaaagactggtatatgaattttaaattattatattcatttaatcaatggccttatttttaaattagtttttttaaaaagttactttcttttatatgtcttaacatggaaggcacaatacaggaatggtagagtggttgtaccggtgatgtttaaaaacccaaatattattttcctctttcaaggaaagaaataactttttttcccaagttgaaaatatggaagtcaaatttataacaacgtattcagtaacttagttttaaaatagtacttttatagattcaccagtatttggtctagtttttaatcagttcaacttacaggaacatttcctaaacttttttcataatgagccttctttctaggttagccttacttttattgagttaaaatgaataccatgaagagtacctttataatacagtaacatcaaggaaatgttacaaccgtttttcatacagatgcgaagtcaataatatgttatagtttttaagcagttaggtcaaaataacagaaatattttgttatgagaaaatacactgtaaatgcttctgtgtgcctgctgtgtaacccataaaagccatgtaagtgccaagttagtgtagttctttcaaacctaagattacagcattgtattccatatgcttgaaaaagtttgcttgccacacagtcaccatgcctttagttaactttgattcagcaaaccttggcaagccttccatggttaaaacaataaaaggcagtactttcctttagggagtgtaccatctaatagagagcagttctataggtaagcaaatattcacatttgacttttaagataaacttataagtaatagttatctttcatctttcattaactaaatacaaccttttgggtttgatagcagacaccatggccatcttagaaacatcgaatataaatgtggcattgcaagaataaaaatgtttagtcaggtctgagcaaatggctcttaaaacttcaactttgtaagacagtgattctttttcagtaaatgatttctacatgtaaaaagtaagcacatagtcacatagctaaaatcaccaaaaaggatggagaaggaacatcttaggtgatattaagatgatgtcagcaatatattggctctgtgggaccctttcaattgtcttgttcactcatgtgggcatatttgtgtatcttaaaaaaatctgttcttttcatgcgattggaaattcagaatttagcatttttctagacaggtttccaaaaccattatggtttcattagttcaggagatactattttcccctttctctataaaactttattatttagtctttaaaaaaattgttgacattcaaaggtgactaatgttaaaatataaaagaaattgagatcaataatcgcttggtttttctacaaaaaatacaaagatggaatgatttatttcaatttgggtatcactcaggttgcagtgatggcagaggtccatagctgattatggtggttgttaagagctaggaaggtaatttaaaacatcatgactatgtgtccatattttacttttgtcaatagattaaaaattgtaaatgaaatcacatctgcatgataaaaagaagaaatagaaacaggaagttgtaatgatgttgtcaaataaaaattcattttatccttattagagaatgattggatatttagagtgtgaggaccttagagagctagttgaactttctcattttacagattaagaaactaaagtccagagagattaattaaatgaactgcctctgactggccacccactgttgcagagcttatctcagttacagttgtgttcctggtgcctagcatcgtgccagtgcaggaggggtgctggtcttgtctttgttggctctggaagagtacagctcttgctcatgttctgactcaaaggtacctttaggctttagaatcctacagcataggacaacataactcttaaagatgttcctaaaccaacaataatttgcttctgtttttggaggttttttttttttaactatgattatccatttaggaaaaatgcagagataattatttcaagatttgacaactgttttcactttagatgcatgtattgatcaccatagctagattcctgttgcattttaactaatgttaggtgactgactgcaaacatgattgttttttcagagaaggatttttttggggtttctgttctgcttttactttgaaaattagaaatgtctttttaaaagtaaaaaataacgtaggtatttatgaagaaacttaacttgtcagtaaaggctggttcactctcaggcttgtttacctatgctaatgtggaatctaaggcactttttaaagtgaccctttgagccttgcttcctctgtgcatgtcaggattggctttcacggccacagaatctggactgtgattagtcttcctgtttcatctgtggttttgctcattgattcggctgtttgttgggtacctgctacctgaaagatgcaatgctatgaattgtcaatatagtgatgacatgagaagacatggtaaactcacacaaaaactagagctactgtaaggtcataggtgtgatgcagtcggtgccaggaggagtgagagcttaggacttggggattccgtcagttgggtggggtattaccccttaggaagtggctttagcattaccatctgaatgatggtagaagaaggggtgagggcacttcaggcagtgcccctcacctgcagggaggctgtgtgtttgaggcattcaactgcaagatgagactcgaggcaggcagtatccaacttggtcagggctttcaggatatcaaatttgggatttttgaaaaaagcagtaggaaccactgatgagtgttaagcagcctttgacacgagcagagtagtgttttgaagaagattgaattggtgggtgcagagaggacaataggttgtagacaatatcctgcctgcttttgttgtggtctgtgggatggggaaatcacaatgatttggactagattggtggtggccatggggatggagagaaatggacagatttgagagatatttaacagtttcaacgaataggacttggggatagatgcgctctcaagagggagatctcagggcatataggtttctagcatgttccctgcttggctggttggctactgatcctattcacagaggcaagaatcagatctgctgaagatttgagaaggaagctcatgagttcttgtagcatatgactgaggtagctgataatggaccatgatgacattgttttatcctttgcattgctagtggcattccagaactttaaaaaaagtaatctgctagctttaaccaaaagatattggacgtggggagttcatcaaggaatgtgaatgggttcagtgaaatgggagaggggagggaagccttacttgctgaatacatagcactttgcttgttacttgcctgatacatagcactttgtaggagtttgctcattccaggttgagcgtagaatcctgtggtaaccagaccttggcacattttgttcttctgtatgtccccttacggaggctgctttctgttgctagtcacatattagggcaaggtctttgggttcccggcacgtgggtggcaggtcccccatgttctcggggctgcagtctccctcggagagagttgtattttagaagttggttgtagtcatacagaagcaaggaaggagtgaatacattatttaaataaatgtggagaagaataccaatgtttatcagaatacttacctggtttttagtggagtatgtataaaccagtttaataagtaaattaccttcaaagttactttgttcagttattatgaaaagtagattgtaaagcatggttgccggtggcagatgagcgatgctgttacacccagaaaagcttctgaattgctgactttaatattatataagaaaaattatgaaaatacaggacagtaattttggagcttttttagggaagtgtttgtatttttgtgtttgccagctaatatgggtgattgccagccaatatgggtgatagaactttttgttatagatcaaattttgttcttgtgtgcataaagataaccttcctgggactcagtgtctttaattaggggtctgtttcaaagatacttttattgtcattgtgtgttcctcatgggcctttctggtggccattgtgactcagtcaagtcttctgggttccttcctgtcttgtgttgtttgtagggacatgcttcatgtgaaagtttaccttcacctgcaatagttttgagtgattatttgaataagcttaaattcaggagaagtaatgtttccacgtgtggaatggcaggaaaacttggtgcactaacttcagcttcagatgggcttgtgccaactactctgtggcaatttatatctaatactatttcttcaacttgccagtttttcttaaaaaaaaaaaaaaaaaactctttaaaatacattctgtcattaggtccagccagcagtgtattcttagggtgtaagagatcatttctaagaggtgtagacatcgaatggaaaggcgcatgcaggcccctgtggatgtggctttaatggaagaatagaggggatgcttctttggggcctgccttctctcctggcatctgcagtggctgaggaggcagcagaggtcatgtggtggatttgagttttccaccatgtatttcatcaggatgaggttgggcaaatagccatctgctgctgagcagggaccgcgtgcgacctgggtttccacacccaccctttgtgtagggaaaggtgtgcaattagacacatgtgttaggttggacacatcacctcctttccctagtatcctcagtgtaaaacagtcagatttctataccatatttgcagtatgtctaaaaaagggtacatggcaccttactagttaattttctttctagttctgcagcaagtttggggaactactttaactttttagaggccactgtgtcctcttttcatcattttgaaagaaaccacaaacattttatttgttatccatttttgttttgtttcgttttcgagatggggtctcacaatactgtccaggctggattctaattcctgagctcaaaggcttttcctgcctcagcctcccaagtagctgggattactggcatgcaccactgtgccctgttatatcaacattttagaaatctgtctgttgatatttaaaacataattagcaaatgtgcatattatttcaacacacctaaaaactattaaacatctttaacataatactaagcagtcatagtgagaagtccctcgaagaattataagcatgcctttagtttccaaggcagtgcttgctagcatactaagtgaataataaaatcagtttgagcacaggaatatgataaaaaaaaaataccccagttggtgaagtattttgaagtgtatgagcctagcaattatttatggttagaactggcactatattgaaattgttgagcccatatccttaaataattttttaaaagtctctgttaaagtgttttatgttcttgtatacttggccttgtttgtgcttgaaattttgctttcattaatctcaagtgtaccgatcttgcaagaaaaatcatacatattcatcttgagaatttcaaaatcttgattaacagtgtaccccaccctgaagtatatgttgggccaatcaagtaaaatagtgcagaaataataaaacaatattaaaaataacagtaataaccataatgaccggctgttatttccagttgggtagttactcagctgagtgttgtcatggatcatttcatttcctcatcagagcaactctaggtaataggtagaactattatccccattttacagatgaggagactaaaagggatgagaagttaaattacccagggccatacatttctagcacgtggtggaggaggaatttgaatccagatgagctagactccacaatctgtgtacataagcatggtgctgctgttgccacgtagaccagctctggagcttgcattgttgccgtcttaatagacaaaggtgtgttaaaaatacccatgccatgctgtgatgctacctattgctgtgtcttaccagcccaggctatttttttctgtacttcctctgttggtgcctgctgtagttgtggggccatatgtcatgggatgtcttcgtacctaaaacgaccaggtccttgcctttcacacttaaggcccttctgctcacatggagatgaggagaagagttgttcttgtggaggttgccttctgaggcggctgagaatttgagttttgatgtcggacagatacgggtgtgaatcataaaaatggacataatacattctcctaactgcccagggttatggtgaaggttaagtgaggcactccagctaacatacttggtatagcatatggcatattcattgagtggttactatttttattagttcagtttaatcatggaacttatcaaatcatatgtattgcttttacttttgttttaaaaagtccctcaaaccataatcctacagatgactggacaagaatgagtggcctaaaatggtgactggctacacaattttcatttttcttcaggagaagacatttgaaaataacatctttatgtcctttgtccatcagtgcaaccagatgttatttgcctaattctcttgttgattatatagagttgattcagatatcccaggtactaaaagtgacaggtttgagggagtgcttatctcttgtcctgaagatgttcatctcctaccagagttatggctgtccttctagtgaaacagtcatttcttctttgtcccaaatctgcaattctccaaacatggtgggtgatgttatcctagatgatcagtggtgtaggcatgtttgatcagctctgggatattacggttttctgatttagaccagaggtcacagggtgttctcaaaatctataggagctccagatcctcaaatctcagaagctttgattcctcagtcccttcctcccaagttctctttaccatgtaaagaggagacaagatggtatctgaaatgggagtaggcttgggttggggtcagggatgtgagtagcaactagaacataagaaggttcttaggagagggaaggctctggggtagcctacttagaatctcactgctacccagattggcagggaaatggaagagatggagtatagacaattttcattttattctattctatttctttacttgaaaatgacttggaataacaaaataagtgagtcaaaaagtaaataactggtaacgtgtggatttatgggagatccttgtactattctaactttactgcaagtttgcaaatgtatcaatatcaaaagttttaaaagaacagtagctccaaggggttgatgtcagtagctaacatttatggagcataaagtttgtgtcagttagcattttgctaagctatttacatgaactatttctgctgaatcctaaagtaggattagtcaaaatgctgaggtaggaataataattgctattttacaggtgaagaggttgtttaataaatttgtctaagatcatagtttttaatgagtagtgttgggactcaaagcaggacaggctcatttaacagcctgtagcattaactgctctgcagaaattgctttggatagtcccatcaaaataacctaggtcttagaaggataggaacaacaaacatcatgatcttacacacctgcactttctagcaccagctcctggagaaaaatcgagaggctgaatggtgtctgttaacagattatagtcagtgaggcctctttcctcagatgttgtatcttatcaatggcagacattttcaacctgaaagacacatgctcattacaagacttagtagtgctctaaccctgttttcacttatcagtccaagacgtagccgacatcaaagtattcagcttattacagaattgacttcctcaaagtttctctcagtgtttatccaagatgtaattcacttagcatctttatctcgctgcacaggactagagttgccttcgaaaaaactcaggataccacttggctatagatcacagtacttgttcctcgtatttgcgttaacttgtgtgaatatgcagcctccgtgagatatttgcatactgcttctgtgaacacacaggacaacagactgtcttccgcagtcatacactcagtcatattctcaaataggtatacagttcaaatgtataaatcagtagtcttacatgttacagagtgggtggatgttcctttgccaggggattaaaaaaaaaaaaatcccaagtcttaatactgctttctcccacacgaatagtctatgatggtgtatttttggattttgtacatgtttatagtttttttcttttcacaattttgaataaactgttgactagcttgagtatggtaagcctctacttaaaatgtaaattttgctatttttggtgcatttaatattttaatatttgtcttgattgtgttaattttcagagctgtgtttatcaccagatttagtatgttaacttttcaatgttcccacttattaaaaaaaataaaaaaaataaacatctgggctggtgtatgaagcaaacctccagttttatagggaactttgtggctactctggggtgctgagagccttccatttagctgctaaaggccagcaggataaggaaaactgtcttatatgctgtcaaatacattaataaggacacaattcaaggacataagtaatttccccacactgtggagcacacaggtggtgatactgctgtagctgaattgctggctggcagtcagtgccactgccatagcaccacaattttcatttttgttgttgttttactgttgtctcggtatggtgaatggttgggctatgggagtggcacagaaacccaggccgtacctagcagaatggttgacagtcgccgactccctgtcattttctgcagctcagtattttcaggtcagggagctgcccatgtcatttgcatctttctttctttctttctttttgacggagtcctgctctgtctcacaggctggagtgcagtggcgtgatctcggctcactgcccacctccacctcctgggttcaagcaattcttgtgcctcagcctcctgagtagctgggattacaggtgtgtgccaccactcctggctaatttttatatttttagtagagatggggtttcgccatgttggccaggctggtctcgaactcctcacctcagctgatccacctcggcctcccacagtgctgggattacaggtgtctgtgcccagctgacattattctttatggatcactaccataataatatcaacaataatagtgtctttatttggcaaacctgtaacatgactctttacttctttataacactgcttcagcctgctattgatctagtgagtgatttgacttgtttcacctaatactaggcgagaggtaagaaaaacgagtctttttattcaaggcattaaagcattaattcatatatttatacagtttacttgtgcatcttttactctcctgatacactacttcgtgtaaggaacccccatcctccttttctcactgttttgagacaggtgcttagaaggtgcttgtccattatcctccaggcagaaaaagtaaagtcgtagttggtacttgagttgcatggggaggaggaaatgattgtctctgagcctgggcttctgcctcagtcctgcagctaatgttcttacccactcctcccttccacctcaccaggattaagaaggtacagagttgttttgcggaaataatgcatccattggtctttaaggaagattagaatagtgagctggaccgaggtaactttcttacctgttttctccaagaaactcgtaaagtgtgtttgttttagattattttaaagaccctgtggaatttgtaaaaagtttatctggtaagcttagaatgcctgaaaaaatagatatttattgggagttagaattagacagtcgcttagggtgcttgttaaaaatgcagattcctcaactccacacgagatttattgaattaaatctccctgggtcatctagaatctgaatttttatcaaggtgcttctgatgtactctgaaacttacgaagcaatgtggttagaccaatatgttatgcaatgaatgtactttggaaatacgaaaaatttagaaaatggcaaggaatatgcttgtccatcattcatattataagaattgcaaaaattcttacagtgtattttggaatattgcaagttatgttattctcttgcatgtaactgaatgaatgtggctgctgtttgacacactaattactataaaggtgaagatggatgactgattaagcgtttgaaaccatagtctttaaaggtggtgctaaaagggtagaagatagattgctttgtatttatttgttaaattttattttcatttctaccactgagtaattaaaagcttgttttgtatatagttctggtttaaatggtacatgtctgccaaactaatacatttgttaagctacagtaactattttggggcaaccatttcaagccagtgttatttccacgggcatataatacatttaaaatgagaatcatcttaaaaggtaatttagtgagtgggttagtgctttcttggaggacttgttagcataatttcgtgtaagacaggatgcttatatgaaaggcataaaggaagcacataaggcagcttttttcctggcccttcccccattcccctcccttttggatagaggccatactgaccacccctcttcctgacacttcaggttatcctggaccttggccgaaggcgtcattagggtcctgagctttcccttccatgctgcctcagttgcttattctttttcttcctaccccctcaatatagcctgttctcaggggtttgatcctggcatcctctgggtctagttcaggcccacagcaaccttatttgctactaactcctacgtctgtattcttatttctcgtatctcccccaaactcctatccttaatgttcccaatctgtttaaaccgaagtcatcataacaactccttcttcctgcaaaagcatgaaacaaaagtgtgaaacttcaagcccagccctttctcttgaacttaggctctgcactgcaagtctgcgctggtggtgtcaggtcctggcaacccagctgatgggctgctccagactccacttcctgtgtcctggcctgttggcatctttgttccctccactatgttgtgccctccgcgacacccccttggcggtcagagcgcagtcccaggcctgctaggtcattatggtcactgtcaacttgcacggttggggagagtacagcaaagacccatgttagggggaccctttccttgcttccttcctgctcccctgtggaacaagtccctgtctgtctgctgcaccctttagaccttgccaccccattgctcctgccgctcagccttccttggggcacctgcagagagagggtcccccctccagctctgctcctctggcagggcttgtggggtgccttccacaggcaagacctctgttgctgctgagccccaacagtttagtgtccaggctccctgtcttgggcagggcaaggttgccctgtgcctgtggcctgtccttccctggcctcctcagctatcgagcccctgctcagccctctcccagctggattagaatgtgggtgggaagaggaggtgagttattctggcctccccaaacccattaccacattcctgacatctgattggaacacattttcccatggtagctttattatggttaggcactggcgggacaccgtgggttagcctagtgcttttgtaggttaacacaacaatgtcaatagtataatgttatatccgagggaaagtgatccaactagcagctgaaggccttttggggaggagctgctttctcctgtgagcccccatggggaactgtcctgtagagtgtcatgccagcaccatggaaccatttggtggcacaagcatcagagcagtcacctgccttgccagtgggccctcaggtgggtttcagaaagctgggtctatccagactcataagcgtgaacttttacataaagaaccatgactgtggcaattctaagaaggactttaatgaatgcaaaggcatggccactaaagacaaggaaggaattcaataatgttttcagattgacatctctaaagagcgaatggcaatttcggtgtgaggcttataacagaatctttttggcttttggaaatgtagatgtgcctggtgaaaaatgttattaacttttttcaaagataaataagaaccatgagcaggcagatctttagtctgttgctactaacttgtcggtataactttaatgtttgtgaaggtgtgcagatgtgagattatggctttgctaagctctgtgggagatactaaaaatgttacttctagctaggtagagcaggttaacacacttatgaccctgtggaacaggatagcacagtctgtaattaagtgctaagaaggcgtgatgtgttgtagtcattgtatagtggagaaagaaatcagaaagcgtgacttgccctctcctttgataagttagaggaactgagtgataatgtgaaaaaaatcacggagaggctgtcagccaagggtcctggcagggagcaggtggccagcccagaacatcctgcaaggaccagggcaagagccctttgtctctggtgtcctcctgggagggcagctttgcaggagctatggcccccagggagagcaacacagccactgccaccccctgttgccctccccacctcaaccttcaattcaaggaccagtcttctgggactcagggaagatcagttagcctgccctgagggagaggggcagcaggttggatagatagggagaggttgagcagtggtgaaattggaagcttagactgagtgagattctgacttatattacgtgatggaaatggagttgaaaggttagtttggcagcatgtgatggattgcggttgaagagagactagaggcaaaaagtcagaggctgttgaaatagcccaaccaggaggtggtagagctttggctaggcggggaaaatggactgagagaggaaaagacacagccatggacattcagggtggggggaagagggactaggagcctggcatggagcggagaatagcttagaaagcctcctttcgagagaagtaaggttgacatttggaacttagatttgatccaaaatagaaaacatttgagcagggagaggtgtaaaaagatcaccttagaaaggtttagaaataaagctactccattgataaaggtctgcaacttacagttcaagaaaataggtatctaacatttaaaaacaagttttaaaataaacttcttataaaaatgattttggaacatataatttgacattgtttttataaatatccttataacattgggtacagtcagaataataggacagaatttgatattagtattatactttcagaatcaaaatagcacagtgataatagcacaagagggctacagaaatgcaggtactagaaattgaagtttatcatcttagcatacttgacctttcttttggaggtgtgtgttgtagcgttgggaagcattgtctcatgtttgatgctttagcaactctaatacttgtgtatgggtctactaaaaaggcgcatcagcatgttctgtgagagaatacaacagagaagcaattgcagtctgaaagaaaagcagtcaaggatataagcaggtaatgtgtggaaagcaaacttaattgtcaataaacacaaaaatttccaaattatggaataatttaaaaatgcaaattaaattaaaatgatatacttctcctcattaaattagccaagacttaaaaatattctttatgctgctagaatatggtgagacctgcacactcactgttgcctgaagtttcataagtataaacttctttttttgtgaagaaagtagagactgtgtgtataaagatctttacaaatggccattcctgtggtatcagtcatctatcccaaggaaaaatctaaaatccagtcaactgttataagccacagcatttctttttgacattgaaaaattgagaatggtgaaatttatgctgtagtcatgttagaatatcatgcaggcactgaaaatcatgtttttgaaaaatgtgaagcttgaaagagtacaaaagaacatactaactgtatcatgattagttttatacaaattaaatttttactttttaattttttaaatatttctatgaccaggtgtctacaacaatacaaattaaattataaacataagaaaagactaggggaaatacatcaatttaaaaaattattagtttcagggattggcagtttcacttaattaaaagctacaattccacagttaaacagatgtggtttgaatctgcctgaccgcttaactgtgtgaccttggatagtgacttactagttctatgtgacttactaactccatgaccacaggccaattacttaattgatctaagacgcagtttcttcagctgtgacatgggagcagtaacagtacttactagttcacaggcttatgtggattaatgcaacagtgcatctaaaatgctccagcagtgcttgttgcatcattagcacacaactaatgttaattatttggattgcaggtagtttttttttttttaattcagtctttctactttttaaatattctaaattttatactgcaaggattgtaaaactcaagaaactctctgatactgtatatggaaggaaggactctgacagtttttcagtaattttgtggtatagacaggaaaatctttttttaggtaccataattttccataattttaaccagcgatatatctgaaacaatactttcaaattttgcatgttttttttttttcttttctagattgcttggcagttttggctttttttaatctcaaagaaattttgttttacagtaagttacgtttaattggaacctcccccactttttttttaaagtttcctgaaatcaaggaacataagaataatttttaaaaattttctgtaggtgagatctgaatttgattaatattaactgcacatttagctctcagatttcagaccgatttagtgttagcttctgtgcatctcacctaattgttaaaatatgtgagcatgattttgatatttgggaggtggaagagaagcctcttgagacttttgaactaaagttaaacagtttattctgtcttggagttagttggtgtaggttagtaggaagactttaacatctggagctctttcaccttggaattgtatctttctcatggaagaaacacatttgagctgcagacagcctggaaaagctttcaggctatattttcttcacaggagggcaatagctttgcacttataataaaatagcttcaaagtttttgtctccttgacattatgttacctttaatttaccctcaaacattattatatcttctatagcaaacagaggaggataagaaaaggaaaaacagagacaaattgttaacattatccccaaaataataaatgggttgttggtaacataagacttgaaaaccatagaatccagaatatatgcaacttcattttattactgtattgcattaaatttaagatggtgtcagttgtaagatgtattctatttctgatacattgaaatgccaaaaaaaagtcgtggaattgatgaaatctagtagttaaataaaaaaccacaaaaacctcagtttgcagtcacctgtatttttcaatttggtgtatggaacaaaaaggacactcacctgaatgcatctgaaattggaacttaaatctctaatctttagcaaaaatatgtcccagctatgtatatcactttaatcacacgtggtgccacctctgatcttgctccttatgttgtgcacagcacgtagagtacagcataggtggactcatgagttaggtgtttgaacatgaccctcctcagctactggaccaaatgtaaacagtggtcaactttttatagtgttaatctgtcagactgctgtcaacacactgggtaccataaaacagtgtcaccaagactgttccacaggagtgatgccaaaaatctattaaaactcacagtaaaacaagaaatgtactgctaaccacttacagcctgacttgacaattatcaagtatttgagtatacattctaagcttcactaggccagtgcttaccttgtacataagcaaaagtaggaaaatgaatggttcctgtttgtcagaagtttaaaatcaaattactcagcaatacaaagcagggaaggaccccctttacctttctgtatcgaggataatttgagaggatttttgcgtcagttagggtgaggccaatacaggaagaatatagggtaggtggaccaattataatgatgtcagagaatcctcctccaccagccataggaaagaataatttcatataaaatgatagcaatttaaagatttctcaaatatataattagaggttggaggaggtaatatggcataaaggttagaggcaagggctctagagttagactgcctgggttcaaagcttagttgcagtactctctgcctttgggatcttgggcagataacctgttcctgttttcttgcttataaataaggtagctgatagtcccttcctcaatgcctggcatattttataccaaacattcattgaattgaactatagttaatattgttaaggcttgctttgtttcttagtaaagagaacatggaaatgagcagtgtaaagatttgcagagccttgatgtctagtggtatgacttgacttttcttctcttctctttctctttttcttttctttttgaggtagggtcttggtctgtcacccaggctggagtgcagtggcacagtcacagttcactgcaacctctgcctcctgggctcaagtcatcctcccacctcagcctccagagtagctgggactacaggcacataccaccatgcctggctagtttgtatatttggagagatggggtttcaccatgtggctcaggtgatcctcccaaagaggtgggactacaggtgtgggccactgccctggctgactctggagctttcaaataaacatggtacataacacatttcttggtgttatagtgaacagtatgcaacttgagagcaattagatattagcatatttaaataaaagattgtgaaagtatgattgtggcaactacctatagaacattttgctggtggtatcttggtcagagttttctagattttcccatgtgtcatgtggttaaatatgtagtggttttaacatggcagtgtggatttaagatgaagtgtaggagctgtgctttgtatgagatgacaagggcatatctattttgttccatagatttatttgtctgaggtgatataacccaatatcttaatgtcaccaacaaattatgtgatcatccagaagaactgaaatgatttcaaacattgatgatttaactgttttgtttctaatcacctagagggagccagcgtaatgtgataggtcttattttattacatttcacttaaaaaaaaatttttttttttttaaagcctggggtagcctgttctggagccagctctgtctgtcccattgctatggaatatactgtagctcctctatttccttccctagagcctctcagtactcttggatgaggtgggagaagctgtagaaaattataataaatagggcaagaccttaaggagtttctagtccatctccatttctaccccatgctcccagacttcacgtgtcatccgtcacattctgctctcacctgcataacaggttagatggcattgttttttcttgtttattgtttgataacttgatattatttcttttttttttttctttttcgagatagagttttgcttttgttgcccaggctggtgtgcaatggcgtgatttcagctcaccacaaccctccctggttcaagcaattctcctgcctcagcctcccgagtagctgggattacaggcatgcaccaccatgcctggctaattttgtatttttagtagggagggggtttctccatgttggtttggctgctaggctgctctcgaactcccgacctcaggtgatctgccctcctcggcctcccaaagtgctgggattataggtgtgagccaccgtgcctggcaacttgagattctttctatggaaatattttaaattccaaacaaccaaattttagaagatcattatgaatgaaactagatactaaattagtacttggtgattgcttgccttaggctctttctaaccatattggctgcttttcaccttcacaaaatgttagaagcttaccatcttagagtaattataactgctgatgattgttctggagtaggtgtatgttacttaacaggttgtggagcttgccagttgatgctatgttgagagtgtgctgacctcacaagaactaagatttcatatatatctcagtccaaactagaagataaagacaatattaagccccaaggcatcagcaccacggaagattactacatttggcctaacacaatgagacgatgccatgatgttaggtgactgaatagttggtagcaactattacgttgctcattttaggcagcaacctaaaagtcctgcctggttgggtgccggctggtgcccatttagccagtcacatggtctgtcaacatgcagctttctaatgccaggtctgctgttggcagccattggaggcagtataacctaacagttaagagtgggtcctgcagttagaacctggttctaatttagactcctcactgtaccatagtattttgggaaagcgacttaagttctgaagagggcccagtgccggacacacacactgtaagtgcaatgaggacgatgatggcagtgagacgtcaggggtacagctttggcaggttgtcactgcctcagagcacggtgcttctcacaagtggcacgctgctcacagagcacaggctgctcatttgaattctgtctcaggttttgagctgagtgaggttgtgataacgttatgtttgagttggaaagtgaatacaagatacatgctgacttatacttgatgcaattcagaatctgttatgtgaaagtaacaggtagcaacaatctgaccaactcagcagactgtaggtacaatttttaaaaaaagattcacaactgatacatcttcgtgagcagcagcaacagtttagtcactgtttccaagagagagctgtgtgtaaaatgttcacaggttatgtagtactgagtgtgcagtaaatggtcatcatggtagaagagatcccggctcagatcaccagtcttttcagtcacatggattcattcatttgtggaaagtcttataatcagtatctttatttgcggactgtcccttttgtttcccaaaataagtgtaagtccttaaggttaggtggattatttttgcctctgtttttctagctagttatacttggatggttggttaggacagatgggatctgctagttttaatggaaaggggattccttacctgaagattaattgtggcctctccacttacacagtcattagagtgtggattactttattgtatcatagttctttcttttatgtaactgtctaccttatataatgggaatatttcctgatattcttttcttggacacctttttatcagacaattacaatttttaaagagtgaattttatttggaaaggtaggtttgggtaaggaaaaaacactgttggtttgaaaggtatctggtttagtaacagttccatgtgaacttatgaaatatttttaaccttcctggagatcttgaaaagtttatcctgcactttttttggggagaggcagccatcatcattttggcttgtttaatttttctgtagggcacatgtgtcttgatgtagggttgttttctgcacccagtgccaatccttaagttctggtgttgtgctctgcagagtcatgaggagtggaggctgtgcctccctgcagtggtgttttctggaggtattatagaacaaaatagagaaaaaacatggactttaaaagtagtgggacctataatcaaataccagctcctccactcactagctttgtgatttgggaagactcacttaattgctttcagtttcctcatttacaaaatataggcagataatattcaggcatagttgtgaggattatatgggggcaggtggtgtgtgggtgggtgagagggtgtatgatgcaaagcccctagcgcagtgctctttccacagggagcacttactaaatgttaattactttttcttctactttaatactaattttctaaatgtggtgggtatataatctggaaaatataggatattcttattttagatgttctttcttgttagactaggtatcccccctactttttactttggtgtaaatatagttattgtattcatatcacatgttgtgtcttatagctcttgttttggttttctctgactgtcctttccgactttacagaacaactggaatctatgtagtcccttaagtaaataaagcttttaatgctaagactgtcaagcaataagcctgtgagaaggtggagactgtgatcttggttgtaaacttaaaaacgaaatctcttacaccagtcttttccctgttacagctttctagttgctggtgaataaaatgcaaaagtgacaaagaatttgcatatattcttagggaccaatagcttcgttttcatagtgaatcttattatcttttgctgtgtaacaaactacactgaaacttggtggcttaaaagagaagccatctatttagcacatacttttgtgggttggcagtttggattggtttcagctggactcacccctgcatctctggtcagctggtggctgatagttagctggggccatatgtttgcatgtgagagagagtgagcgagagagcgccacatattccagcagattggcccaggcttgttgacatggtggcagaaaagaaggccgctctggtgctcaagcacttttcatatctgtttgcctgaagtttgctattgtctctctggccaaagcaagttacatggccaggcagtgtagaagggaatacttcagggaggcccaacatatttggccaccactgcgaccatcttctacagagaatgtacgtcactctctctttctcctcctccttcctttttcttattgtggtaaaatacacatcttaactatttttaagtgtacagttcagtgatactaaatgcatattcataatgttacgcatccatcaccagcatccatctccataactcttgtaaaactgaaattttatacacatttcacttccccacatgtgcatatctcttaattcttctgtagaatgcctttgaccagtgattggtcatatagcaccagaatgaaaggcctggggaagaacatgttaaaattcatcgctttctcttcctcttattggtcaaggtagggttatggataggaaatgagagaagaaaacaaaacaaaaacagaagactacttgtgctttcattttccactctccccccaccacccaactgaaaaaccaaattcgtgatacttcagtaactggaaccatgaaacgctcccattttgtttagccacattataaaattaatgttacatttctgtctgtgagtacaagctgatccatgatcttgtcccacccctttatggaaggactgtcccgccaacaaacagccctcccatcctgggatcatgttggcagctgctttggattttaattgactaaactggccaccttccctctattgagccagctaccaagcctggtctgttattctgctgcatctctgaaacagctcataaactcctacctctccctgagcgaagtcagatataacttcactctgccaagtgaatcttgatttaaccatgcctcagttcctggatccacaatgtaaaactttctcttaatctttcaaggccctctgcttgcaccccctctttcatccagttcttttgttcctctccagtgttgcccagctccacttgtgccattctctgacttatgccatcttagggcttttttcccctgatgcttcccctgcccctttaaaaaaacactcctgttgttaaacctactcatagaaaaatttctcccttgtttgagtttcctcagtactcatgtcatatattttgtcttactcttcccaagttattggctatagaatttatcgttttgtgtttattaatccaaaaaagtattcatgtatatctgtgggctgggcaccatgatgagtgttggggatgcaggggcgaacacagttataccatgtgcccaaggctggtggacagtgggccaaatgaccacacaaacctgtgtaagtacaactgtaataattgcttgaaaaaaaggagcagtgatgtcatggagtgggtaacagaggcatttaacttagttcagaagatgtagaaagactcacctgaggaaggcaagcttgggctggggtcttcttgcccaaaggttctgcggctacactgggagagcttggtctgtaccccaagagcaatgggaaggagttactctggttgcaccatgtgcatagattggaaggcctggaaggggaagaccattgcatagtccaggtgagaggtggtagtgatttgatctagtgtggtgtggtccggctgtaagcagaagtgggtgggtctgagaaagatttagcaggtaaaataaaaaagatttgatgatgagttgggtgtgggaaaccacaggggcagaatgtgtcctaggtgacacatggattactgctttgcctaaatggctgatattcatggggccacccctaacccatatggtgcctttgcaacttaacaagaggtaccctttctcttgagcacatggcttggctggtggaatactggctggaattttacactcacttgcttcctctagtcccttgtgtagtgaagggactgttcaatcacatgccttactccggcagcccctggccagtcaccaacatgtaggctttctagctttctttctcacctggttaggataggaatctcatctgcataggagctctgaatgtgatataaaatctgatccaattgagaggtgagctataaaggaatatataggaaggagagagtaaagggtagttgatggtataagagtcctgaaaggtagataagtgtggagtctaaaagtgagggaataggtctcggcctggaagagcatagttgtcctggaaacaaggaggcaggaggaatggatgggtacagatgttagtgaacttgcgcgtttggctttaggaactcccacagttagctatcagaggggctcctattttctctgcaaagtaggaaatgaaattacttgtttatgtcttgcttctttaaccaaagtataaattcactgaggacaaaaaggtatgaatgcataaacatgcttatttgttctttcacagtactcgtttgatacttaatgttggatttcattgaaaattggactcattgaaaaatcagacttgttacttagggttaaataagacattgcatctaaaaaatgactcacccagtttgtaaaaatattaaacactgtaaataggtgccatattaaattattgctaactacttcctgaatgttaccagtttaatttatgattagatatccataaataaatcttattgagtaaaaatggcagaatttgtgctaacagtttggtgcctgggctttagagaaatgcacaccacctgtactttgagatttaaaaataaagtataaagataatggtgatgcatgtagaagagaaacagggagaaaagtgaactacttggaataatagatttttatatcaactcctatgaattgattaacattatataatagaataagtcacatttatactgtgttttattgcttaccaggcattttaatacatgctggcacaaataatccatatagaaaaggtggcattttataaaagaagaaactttggatttccccaagcacatgcatatagtagatggatgaaacatccttgattctaggtcttaggacctcaaaggaaagtcaagagcctttcaccctgggcattctaaaaggatacattttttttttttaatggtcctgagctatgcagttccaaaggacatggagaatctaatggaaacacacagacccttttacaccatggtgattacattcattggatctgattgctgttgagtgatgtagcaagcttgctgattcatattttttttgtgtgaaattatttaaagtttgaatttgggttaggtagttgaacgattatgaattgcttaagttgataatgttcaggaagtagttaggaataatttcatatggcacatcttggtagtatttagcatttttacacagttgataaaatagcgagttttatgataccatgaaatatttttgtgcttgactagaattttgcatatagtttaataaaaataatttaaacaatatcctggaacaatgtctgaacagtgtaggtgatgaaagaacaaggggtaatactagactacttgttatataattacgtattatgaaacttctttttaatagaggattttgctctaattattgaatactcagaagtaggaattagagctgtagcatataaaaagacaaatttgagattatcacatttatcttcaaattataaggacaaaactatagtaatttatgatttggtgatttaagaagtttgaaacccctcagtggaaatattttgctatttaaaaaagttgacatgctggaagttagttttcatatatgaaaaaaggaagttattttaacattgcttagtaatctacaaagatctttttaaaatatatatatatttattatactttaagttctaggatacatgtgcacaacatgcaggtttgttacatatgtatacatgtgccatgttggtgtgccgcacccattaactcgtcatttacattaggtatatctcctaatgctattcctccctgctccccccaccccacgacaggccccggtgtgtgatgttccccttcctgtgtccaagtgttcccattgttcatttcccacctatgagtgagaacatgcagtaatctacaaagatcttttaaaataacatattaagttaacataaaatgacactattaagattctgtgtagaagctctgaatatgatataaaatctgataaatattagtaagaaacaccttttgatgctgtctggtatggtcttggaacttgcttattcatgcatccacagaggctgaaatatgcaaatattgacaaaactagatttattgatagtgatttcaattacagtagtgtgatcctctacatccagcagtctcccttgactggcagctcttctgtggaaaggaatttgcttgctttccctgagtgctcttctgtggtcctgctagatttggagattgtcatttactgtctgacctagttcacacacgtgttccctgtgaaccaacttagatgtctgtcttaatgtaactgatagctcatttacttactaatggattggataaataaaaagtttacaagttacccttgtataagaacctactttgagggattttaatagtaactgggaagaattgatgaccagaattgggtaactattaatagatgaccagcacttgtttacttttaatttatagcatcaagtccaatctgacacatcctatgtacatttaagtttttaaatagaaatttaaactgtatttgagggtaaaagaaatctttagttataatttattcatatctcaaaaaaagggaaactatttgagatgactgagattttaatttgctggactatatggtagccatttcactataagtatatggaagcatcacgttgtaccttaaatacaattttcaaaacccagttttatggcaaagcaggatgccaggtacatgcaagtttgaataaaatgccgtgtatgtctgtcaaagcattaagacctcaagtgtttattgtatgtggccagttaaagtgtgggtgagggttcctggaggaattagcttttgtgcaggatttaaagaatctactataaccagagagagcggtgataaaggtcgaagggtggtgcgtaaagcagccaagttttgtatttaggaaccaggaagaatttggtctaggagaaatagagaagacatgaagatgcccaaggagggctttttgaatgaatctgggattatttttacactgggaatggtgacagctgagctgtgctttaagtatgaggtattcgaaatcacacctggctttctccccaaccattctgcaagtcacccaggaatacaatcgccatttcatctctgactttctctcctgttgcaatcctctgtatccagaatgttggcaaagtctgtagattttatctcccctcattgcctctcacatcctgcctgcatttcagtgtctactgccttctcttctggactcctgcagagacttctcagtctctctggtgcctgcatcttatcggctcacacttctggacaaccagctttgcatttaacccttgaaaacagattgcttcccttcacctgggatgcaggcctcccctactgcctgcctacatttctaactgtaggatctgctcttctttaaatatagtccacaacaggcctacctggattattcgtgatccctaaacactcagtcgtttccctcttccatgcctcttgcttttgcttcgccctatttcaagtacgattttgtccactcaaactcagctttgcctgtcgaaattctgcttgttttcaggttctgtttcaaatactacctcttctgtaaagccatttctgactcttttcaaccgaatgcaacttccttaccttatattgtcctttcattctagttatatgggggcacatgtccctatgtacataggctgtgcagccagtaaacacacaagtgaggtgcagaggtaaataaggcagcatcttacgatgccctagtggctcgcctgtctctgtggagacgttgctggcccttcctttcctggggtgactcattgctctgtttctcctctctctgactgaggctctttccttttgcggaattcctaagattttattgcacttcattatctacgttcctgttttcttcttttacattataagctctttgaaggcagcctagggctattttagtattttcctattaaagggttaaggtctgatttctaaaataggtagcttcattgtaatgttacctaagcaataacccaggtgcatttgtgtagcttgtaatattttgataacttgataaaatggtggattcccttaaaaagggaatcttgtgtatgcttgactggaactcagctaagttagaggaaggtggagatgataaacagtgtaaaaatcaccaacgtttattcactttatttttgtattcctgtagcagccagcaaacagcttagaatagtaggtttacaggttttggttgaattgaaaattaataaaaactcttaggtaaaagttacttgcaactaaagtatgctgaatgagtgtcattgttgctttcttttttgcttttctgactagattgagttcatgaagaatttcttgtttacttttaatttatagcatcaagtccaatctgacacatcctatgtacatttaagtttttaaatagaaatttaaactgtatttgagggtaaaataaatctttagttataatttattcatatctcaaaaaagggaaactatttgagatgattgatattttaatttgctggactatatagtagccatttcactataactatatggaagcatcatgttgtactttaaatacaattttcaaaacccaatttaatcttcaatagcaatggtaatagaaaatgccatttaaagatagctattctcctacagagtttaaaatgtgtcttatagtaataatttgtataaatttatgtatacctgatttgttagtaatggagtatttaagattagagatcataaatatgggttgctgggaatacttttatttttttaaatttcagatttttattcccttagtattgcttataatacaaaaatccactccattttgggggagagaattctcccaatgtcacttttttttttttacaccttgtttagatgaaatgttctcttctgttcacaacagtgggaggaggcagtggggaagagggtattcaagaaagacattttagatttcaaaatacacgctcttagttgatcataattcttgtgcaaactttgaaatgaaaacttttttttttttttttggtcatactcatggtgatagtccaagtagctgtattcggtttggcaacacagaaggcactcatcctggaagcactagccagcccatagagggcagatgccatgcctgcaatgcacacagttatgtacggtgtcgattcactcaagacaccccatttagctttgtctctgactgtggaagatggacatctttccttcttcactgtaccatctgtatcaaagttggtaaattgcctttctaacgtgcaattgatttcaggattcaaaaactcagtgtcttttctgttgttaagaacccagattcatttttatctgctttccactgccccttgacattgttttccatacccaaatccttaatcttgaggtattttaaatgcaaatatttgtcatggatgactagcctgaaacctgttggatttaaaaatggtgcattttaaaagaagagaatacaatgtgtacctcagagagcagtgtgattgtttaagagggcaacaccaagacttcacttaggagcagctccagctgcaatggcgatgcatggctgtgatggccagctcctagtgtcctgcgtaaaaaagagctggaaaatgcatactatgtgcagacacctatctgcacaagatcacctaggcaggaagggatgcacaggaaactattgagtttgttagctttggaaagttacactaggcgatgaaagagggtaataaaacatatttttttaaattcctagtcttctttactgtttgtttttgtccttttttatatcataagttacttttacactaagtaaaatagaccagttgacatttggtgagcgtgaggctgtgataacctgtgttccctacatttctgctccatgtacaagtacctctaagatcttgtggacaaggagggctattaaaaggctgtgactgtccagctttaaagtgtaaacattgaataactttattttgtacttaaggacttttagtagtaggcttaattatagtcccacatcacaattttaaaggaaaaagtgataactcctggggaaagcatctctatggcctgcagaattccatttcttgtggaggagatgaggttataatggagtccagagtttcaaaccaaactgtagcagcctcatcagatacagcttggcggcctactgacttataatgagggtggcatgtaattagaaattgtccctgtcttttctgagtactgatgaaaaccatggctcagaggttaattcaaataataattaatattggtctctgtcagtacagggtggtaatgaaatctttcgttatttgatgactttgactttagatgttgagcgaggaatagaaatggtgttattcctcttgctaattgtggggcagctccaacaactgaacactgtggtaaagcatacgatttggaagatgtcaagtacaaaatttctttgtagcctataattgtctaccatagaagttataacatgacacagacatattagtgttattttattttctagagtgataattatttagagtgaggtattaggaaggcaattgatcctgccattgtagattgagacgcttttgttggtctcccatttttcctactgtatgtgatacatagtagccagaacaaaattacccattcaaccttaacagattgcatgtgcacattaatctgaaaacaaaaccaccaaatggctggttgattatagagagccttgactatccttttcaaccttgaaagtcattgattctgtaagttggtgcaccacatttgatgaacatcttccatatgcagaggtgggtgttccaaatgatgtagaagatacatagttggtttaagaaggttatttggaaatacataggtatctgttaacacagattaactgtagcttttaaagctgcaaatggcaactacagttgtttcattaaaataattttggtggaagggagatgtttaggcaggacagtttttaaaaaataattacagatgcttcattacataacttgctttaaaattattattattattttttgaaatgtttgttgactgaacttctacagcttaatcacggagggtggtgtttggtatcattctaagcaacatcatattttatagggaaaaataataggaaaaaagaagaatttttacaatgtttgaggactctgagatgcttcagatacccaaacagcagaacctttctaacatgtaaaagtagacacgagcagaatcggccctcctgcatcggatgcctcatcaggtccattaactcaggcctgccttgtttattcacattctcactggtgtttcccatgtcctgtattatttagcagcaaatcccaggtagtatagtattttattttaaaatacttcaagtagtatcactaaaagggaagctggccgggtgcagtggctcatgcctgtaatgccagcactttgggaggctgaggcgggcagatcacttgaggtcaggagttcgagaccagcctggccaacatggtgaaaccccatctctactaaaaatataaaaatggctgggtgcagtggctcacccctgtatcccagcactttgggaggctgagtggggaggatcacccgaggtcaggagttcgagaccagcctggctaatatggtgaaactccttctccactaaaaatacaaaaaagtagctgggtgtggtggtgtgtggctgtaatcccagctacctggggggctgagacaggagaatcgcttgaaccctggagggggagttacgctgagccgagattgcgccactgcactccagcctgggcaacagagtgaaactctgtctcaaaaaaaaaaaaaaaaaagaattctttccagattaaattgctatagagatttttgtggacattttgttttttgttgttgttgggacagagtctcactctgtcgcccaggctggactcagtggcgccatctccactcactgcaacctctgcctcctgggttcaagcgattctcctgcttcagcctcactagtagctgggattacaggcgtgcgccaccacgcttggctaatttttgtattttttagtagagacggggtttcgccatattggccaggctgttctcgactccttacctcgtgacccgcctgcgttggcctcccaaagtgctgggattacaggcgtgagccactgcgcccggccagaaatttttttttttaattgaaaggcagtactatatttgagaagggattcgtaagcatgctttcttagctagaatatagagggtgataggcaattgttggacagttaggatcagtatttgatttcaatactgattttaatttgattttagcagcaatcctagaattctgaaatgagaatgacagggtcaaaacattattttattcacaaaagcaacgttctctctagggtgtcagtgttaagattgtttggaggccagaggtttggaggaggtggtgggcgttcacgaggagctcttctagagctgttgctgcctggggtaaaccagcacagattccaggagaagccagggaaaacgcatcccactgggatctaagtgacctttcccacaagaccaggtcttgtcacttctcagcttaacatcttagatcggcttctcattgcctgcctgaatatgagccaggaatttcgatgtgatttttttccttctttttcttattttgcttctcctcccgctcccactcccaatccccgttttctttctttgtagaaagatagcagacataaataatcttcaataaaaaggcagttaagaaaaaaggcatgccttcattccaaaaccccagattcagactcccagggctgcttagggggagcgctggggcagagccaggcctcggcgggcggggtgggccgggctgggccgcgcttccgggatgggtcagcgcccggagcccgcgcgaggacatgaggacggcgagcgggccccccggggggcggggcatcccctgggccagacgcagggcggagcggggtcatcgctggcacgcggaaggccctcataaggccctcgctgccggcaccgtggcctcccacccactcggggcgctcgcttcacctcatgcccgcctcagtggctcggggccggagctgcggccacttcctgaccggaaggccgagccccacctggcctgacaacatggcggccgggagaaggcccccccccccccccccccccgccccgcacaccgccaggcctctggacgctgagactgggagcgaagtgggcaggagtcagcgaggccatctcgcgcccgtgcgcaccgctgtagggtcatctccagcgctggcacctggctcagccctcagccctcctggcccctgggcttctcgaaatggccacactgccccccacttcgcggcctggttccgccctttcttggcctcaggtgctgcacaggccacgccctctgttccgagcccttcttgccacctgccctccctcatggctcccgctcctcctcactctggtcgtctcgggaggccttctctggatggagacctggctaggtccccgtaacttgacctcagcagcctgttttgccttcgtagcccacagcccacttgtaattctgtgttccaggtctgcccaggggaaaaggggatggtaatgcctgttgctgacatagctctatcagaaaggtgctcagcggctgaatgaatgaatgaatgcggtggagcatgagggcgcaggcgccatagtggggaggggcaggagggaatattctgccggcagccacaagaataggaaagagaaatactctgtccgaatggtttgtttttttgtgttggtgggattgctcaatgcatggctcttcttgatcagtgagaaatgtgattggagaaagacattagagttttatagctgatgttaaaaaatgagagccgccacattgacactatttgcttccggagaccgatgagagtgaagaactaacagctttgggctaaactttggagtgcatttttattaataaggctagatgaaccatcgctggctttccagttgtatgtatccctcatagaatcagacaccaactcagggaggggcctttccagcacacagagggctctgcctttttttttttttttttttgggagtcttgctttgtcgcccaggctggagtgcagtggccgatctcacctcactgcaaactccgcctgctgggttcaaggaattctgcatcagcctccggagtagctgggattacaggcacctgccaccacgcccagctaatttttgtgttttagtagagacagattttcaccatgttggccaggctggtctcaaactcctgatctcaggggatccgcctgccttggcctcctaaaatgctgggattacaggcgtgagccaccgcgcccagccccttcctctttttggcttccacttggccaaaggagcttccctttggggccgcgtctgagtcatgttagccgctggttcaagggagccatctgaaactccttggagcagggtttctcctgtatatggcaatactctaccttagaaaaacaaaacaaaacaaaacaaaacgtcaagttacatggtataatggaaaaaaaccctaaacttgggctagaaaatataggccactattttgtttctaataccactatgtatatggacagaacagttaactgtccacgccctgtgtcttccttcgtgaaaggtggtgacactgtaccttcacagcctacttcataggactttggtgtaaaatgagacagcagatgttaaagtaccttccgagaccattgtttccagaaccttcatcacattgtggtattagaaaccttggagtcctccttgactctttcacaagctacattgaatttgttctcaaagcctctggctctgcctttaaagtatatgcagagtctgataccttttctctccacttctaccacccgggtccaagtggccttttttccttgccggtgttactgcagtagctcccctactgctctccctgctgttgcctgtgttgcctgcagtctttccaatgttagcagtcaaagtcatctctcagagccagagctggatcatgtccctcctctgctgaaagcagttcgtgattcatcctcttgaggcaaaacctcagccctcacagaagtaccctctgctccagcctcccccatccagaatctcatgggacaccacactttgtccttgctgtcctttagatgctcaggtgccagttcccctctcagtcttccacagttgctctgatctcctcagacactgtcagggcctcgtagggcctgctgggctgactcctcagttccttcccgatcatacataactatcttccctgtgaggcagtcccttaccacccaatttaaaattgcacctccttcctccaaccggtccctctgctgtgatttggtttttctctcttactttccttttagttatttacttatttattttgtttgactctctccacaaacaaagcttaattaagctgcatgaaggaatcgttgtccataatgtttactgatgcatctccagtgcctaggacagtgtttgacagatgataggtgcacaatacatatttgttgcttaaaattatatgggagctaatcattggagggaaaaatgtcttcggttctctgtagcacactttttggcatagtatagccgatgaaactttgtaagcaagatagcaaatattgttacactatagtggctttcagaaattgaagacagtgtttctctttgagacagtcctgattagcaaattacacatttttcccctcttgttacatctaccttaagcctttttttttttttttttcctggagtaatgcatgaatggtggtatgtcttccctcaggtcattgcatctgggtacgtaatgttcatttgtcccgtttactggtgatacgtactttgatcacttggtaaaggtgagttattccatttgaaaagaaaattattagaataacattagtttactgtcaagttggaattatagtgatttgcttccttgtaaatgaaagatagtgtatcattgtggtgttttccatttagttatacttgttggctgcagagtaaacactttggttattagacttagcaataactttgtgtagaacttttctgagggcacaaagttatttcacatttttcatttcagagtatttctagcactatgtattttgtttatctagagagaaagtaactgtgttcttgatataggtcaggccttgcagtggcacagtatgtgaccctagtttctttactgttactttccttttggtcatgctacaactcaggtggttatgtagttaaaccttatgggtgtaggggaagggcaggtggcatgagctgaaaagtgtaaggtaactacccctgaaagttgattgattgaaggttcattatacagtcatgtgccatataatgatgttttggtcagcgatgggccacatatacaacagtggtctcatgagattataatggagctgaaaaattccattgtccactgacaattgtagtcatcataatgtagagcaacacattacccatgggtttgtggtgatggtggtataaacaaacctactgtattgctggtcttataaaagtacaccatgtaaaattatgcacaatacataatatttgataatgacagtaaactgtgttactggttcttgtatttgctatactatactttttattgttattttggagtataccccttctaccatttttttttaaatttaactgtaaaacatcttcaggcaggtccttcaggggatattccagaaggcattgttatcataggagatgacagttccatgcctgtgatggcctccgaagaccttccagtcttcagagtggcacagaatgtggagatggaagacagtgatattgatgatcccaacctgtgtaggtctaggctaatgtgtatgtctgtcttagtttttaacaagaaagtttgaagttggtcgcggtagctcacacctgtaatcccagcactttgggaggctaaggtgggtggatcacctgaggtcaggagttggagaccagcctggccaacatggcaaaaccccatctctactaaaaaatacaaaaattagctgggtgtggtggcaggcgctaatctcagatactcgggaggctgaggcaggagaatctcttgaacccggtaggtggaggttgcagtgagccaagattgtgccattgcactccagcatgggagacagagtgagactccatctcaaaagaaaaaaaaaaagaaagtttgaaaagtaaaaaactaaactaaattaaacatttaaaaatatgaaaaagcttttggaataaagatataaagaaagaaaatacttttgtatggctgtacaatgtgttcgtcttttaagttgtaaaagtcaaaaggttaaagtctataaaataaaaaagttacagtaaacagataaatttattgaagaaagaaaaattaattttcataaattcattatagcctaggtgtacaatgtttataaagtctacagcagtgtgcagtaacatcctaggccttcatattcattcaccactcactcactcactcactcacccagagcaacttctagtttacaagctccattcatggtaagtgccctatgcaagtgtatcatttttaatcttttatattgtatttttgctgtaccttttctatgcttagataccattgtgttgcagttgcctacagtattctgtaacatgctgcacaggtttgcagcctaggagcaataggctgtatcatgttgcctaggtgtgtaggaggctgtaccatcttggtttgtgtaagtgcactctgtgatgtttgcacaaagataaaatcacttagcgacacatttctcagactgtgtcctcatcattaggtgacacatgactatgtttacaggtagcctcttgccttctaaactgacacttgagtgatgcatgacactatttggatatgggaaaggatttgtcacccacagggtaggaaactttggagattggcagacttccttttttgattcaagtaagtctaaattatgatttcagatgagtaggctgaaaatattttgtaaagttccagagcaggaatatgaaaaatttggacacttttcattttgaagttccacaattgttagatttagatagatagattgattttatgtctttaaaatatttgaaacgtgtgggggctcaaaggtttataaacttttttttcagaattttcttgaaatggatatcagtctcagactgacacattcttacattattattattgattaaatatgttaggggctagtttgtcttgccatgaattattaattggtcaaacctttgtactgggcactctgggagccctggggtaataaataaagccctggggtaataaaagtgtacaaagcacattctgcacctgccctcagggagctccagcactgggggaccctcctcattcggcaggcagtgaagctcagctccagtgagcgctgtgaaggagcagagagtccattgtgagatgagaaaatccggcaaccaacttctcatccccacaggtcttcctgcttacctgaaaggaaactgaggccttgtgagggttatcagctagcagaacttggatggacaccagatctgtttgacaaaggcaaaaaaatcataataaattatttttctaacatctggctgattgtaagtatgcttattccaaaatattcaagccataaaacatgcatgaagtaggaagtgaaagcccccacccctgataaattcaggtacattaattaatcttctaggtttttaatgggagaaaggttgcagagtgtgagcatattatagatacacaactccttttttcctgaaatactgtggctcatcttttcataccaacacacagagctctgatttttttcagcgaggtcaaatgactgtgtcctgttccatataacttcacttatctgtcctctttcaatggccggttgggtcatttcagtgtttcactattgaaaatggcacggctgtaaagatcatcagccttttatgtacctctctttgcacattgggataaattcctagacaggggtattacagggtcacagactatgttcattttaaatatggtaaatgttcctggattggccccagaaaggctgtatcagttcacattcctttcagtggtgtatgagttacttttttttgtgcactcaccaactgtggaccttactgtcttttgccaatttgataggtgcctttcttttattaccagtgaagtcaagtatcattccatgtgtgtttttggccttcttcgtttccttaaagcctgtcctctgcaccattgtgctgttgagcctccagcttctgtgatcgccttctgtgactgaatatcatctccgtgagcctgtgcacccttctccgttctggtagagagagagtaaaggctaagacggctgtctctgaaagcagtctcagggattattcccattgctgccgcttaccagcagtggctccttggcaggctacttaacctttgagccttcagtttcctttcctctaatgggggtaacaaggattaaatgaacgagtgcatctgaagccttagcacagggcctggcatgtgagtaaatgtccaggaaatgcttgccaccatcagcagcagcacctgtgtgggaaattactttcccttctcccttttctatgggagtcccttagagccctgctcagcagcctggatcctcatcagttctgggattccgttggcggctgctgcttttccaagtggacacttttctctttgtcattccatgtcaagggctgtgaagtgaggtcccggaccagcaacatcaacttaggcatggagcctgggcattttccttctggttggtcttatggattgaattgtgtcactctctcccacccaaactcatatgttgaagcccctaatccccaaggcaattgtatttggagatagggcctttagggaggtaattaagattacatgaggttataaagtggtcataaggtaggatcctgatctgacaggactagtggtcttaatacgaagaggaaaagagagagctggctctcccagttgacaaaaaagaggccatgtgtgcacacagtgagatggtggctgcctataagccaagagaagaggcctcagaatgaatcctgccttgccagcaccttcgtcttggacttccagtctccagaactgtgaaaaataagtttccgtttaagccacccaggctgtagagtttgttatggaactctggcagactgagattgttggagaaccacagtcctggtggttgagtgcctgcctcaggcattattgtttttaggccagtggtttgtgcatcaaaatgcttggtaaagcagactgccagggcttactccaagaatttcagatttaggattgacatgagaagtcacatttctaaccagttccccagcggtgctgatgctgccgatgctgccaatgctgccaatgctggtccatgttcggagaaccactggtttagatggtgtgtcggagaggcttcaggcaagcgctgggagacttgaggtagggatagtggctctcccgcccaactaggaagttgtttaaactcagagcctcagttgcattatctgtataagggtgataatatttattctgcttatttcatgggattattgaagtcagatgcatgaatgaaactttttaggtcctcctgctcttcatacaaagtagttgggttggggtcggggatgttgcattctttttgcaaaaagagaaggacaaatgaaatgctgaagtattctaatagtaaattataaagcaaaagtaaggtatttccttccttttcttcaccagatacggcctggtcatctgatttgctggctgcttggacattggtctttacccacttcttttctctgcaatccccacagcaacttctcttaaaagccaggcagtttagctaagaagcctttattacagtatctgtggctcctttttctggccctgccctgtcaaggatgcctgtggcttttttggtgattgagacagtggaaattactgagtttctagttctactccatgggtacgattgtggtcatgcttttcatatccagggtattgtagttgaaaggtctttttttggatttcttttgccatgcttaaaatgttttgtgttgtacaagttttaaatatataattactggcatattgtattttcaacaatgttatcaaccagtaataaggttgcaaatcatttagagctatggttttcacatgagaaccccaaagagctttggtttatgttggttagatctatggataattactacatttgaaattaaatctaagaagtataaaaatacttagtttatttaatatcaacataaatccagtacaagttaatataaatagcgtaacttttgttttttaaaacaaaagttgttgacaatgagtgagattccttcctatttttataaatctctttaatgcctggtttgagaaaacagctagattctcatagctacttctgcattcagtctgttacaatatgttatttcagttgaagaacatgaagaaaatctggtctcatgtggacatgtattaaaaagagaggaatttttgcatagccttctcagataatttgatattacatcaaaactctacaaggggtagcttcttaaaggttagtttcaatgtggaatctgaaattgtatgattgaaatttttgtgcttgagttcattaaactctattggtctatcttgcactttgaatggatcttttcaccattcatggttttataacattgttcattggtagtttggaaaatattggtttaatgagttacataaatctttcaaatgctggcatattttattttttttaaatttgtatttgttaatattaccacctatctaatcagaaagcctttaagtatcagaaaactgtcaaattcttggtggtagttacaggttttccaaaattcctattttattcgaatacttattttattttatcattggcaacaaaactgtcaattgttttcttggaagtaacaggcttattttgttcatttttgaaatgtttgccaaatactcaagtctgtataaccgtagtttttcagttgtttttttctcccctaggtaaaactggtggtctttgaaaaaagcctgcacctcagttatacctcagttatgcaatctgcttctcctctacctcgaatggaatggttactgacatttaaccactatctagaaggaatgtaggaatgatggcatagagaacacatctctgtatagacgggctactcagagccatttgggggaagcaagtactctgctggttaaatgcaaaaaacctaatatagttgacaatatgccagaaattatgtaaatgaatgttgtttccttcaacatagtgaccttggagacaggacaccacattcagtgataacgcgaatggttagaacgtttttagaatgccaccttatttggagttgcttcaagttatgactttaagtttactccatagattgtgtttggatgtactgttttaaagttgtaaggcctcaaatgcttgttaagttttcccaattatatctaaatatagttgactagtctgcgaagaccctgttgcatagtggagaaattgtggacacattttttagcaatttaggatatttatcacacaggacccagcaccatgcagagcaagcataattctcagagtcagacctgggtcctcacctccgctctgccactgactggctgggtggccttgaacaaagcatttgccttttcactatttctctgtgaggttaagtagttggcttaggtctcaagtcttttagccctcatgttcaatgattcagagattctagaggcatgacagcaggattcccttcattatctggggaggtagttcgtcgggggtttgctccacagccttcctgtccctttcagccagcctgtttctggcctaggaagacagcagacttcgtgtggttgtgattttttaaaggcagtgtttaattcttattacagcacaagagttcagaacttgggtaacagcatttgagtattgtagatcatcagctcctacagagataccctgtatgtttgaggttaaactgggagcaaggaaagttgggtgactagattaaggttggtgcaggatagcagggagaacaactgacatttgctgactgctgcatgcaaggcattttgttaaaagccacttgtgacagttgaatgaatcgcttccaagtagccttgtgagggaggtggtggaggtgatggaatgcaaattttcatagatgaggaagctgaagtttagagaactgctttaatttgcctgatgtaaagagagtgtttgagccagatctagttggctttttacaactggtttcccccaaatttctccttttttctgcatgccttcccagccattatattccatttttcatttttctctatgacttaagctgttctaaagtgttggagagatgtcacaattggacatcaataatctttgagaagtgctgattttataaactttaacatttataaacttaatttttaataaaggccaataaaaacttaaagaagagaaaatgctgatgttaagtcataggcctgtgttgaaatagatggcccagggctattagatatatgaaattgagggcagataagctttgggacaagcaaggacagaatgtgcaaatctggcattgaggtgtttacaatttgcctttccatattgagaacagaaattcaaattttggtggattatttgtttaaaagaactgttatcttttactccttcaacaagtgcattcatgtacctcctttatcctagtcacagcgataagccctggggataaagaggggcgggaacacctagcccagggcctctcagagccacagggctcccagctagcagcttgagttcctaaactctggatttcagatgtgtggaaatgcactgatggcaggttgttagggatggagatgtcttaaaggaatgttcggttatctctcctgaagggttttaaaaattgtggaagtcaagatcaaggatgaagatgaaatttcttgtggtttcttcatgagagatctcttctatctgtatagtccggaattctgagtagtatcccaaagtgtaccatcaagacagatgatagcagagagttgaatttttatatatattttatattgctaagcatattttttgttagggatttgaagtagttaagtcatcctcacagcatccctgggaatgacagttgacattaagctattttattgttggaaaaggaaattatggaggttacttctcactcatattttttcagcaaggaattgggaaatggaaagaatatattaagcatctgcattataggatgcccttgcagttacattctgaacccttgaattgttattttgatggaagggttacagttgtgtggcagagagcttatattgttggtgattagggagagattgtgtgctgccagacctgtttaggagtaaagggtagtgagagatttcactcttctgagaaatttgcttcagctgactcgcttgttttaggaccaacacactccaggcttatgggactggatctgggaggtacctgagccgttttcctggaggtggtgctggcaggcatcccagtgccaacttcacttcctttaggtggggagcagggggatttcctccaatgagaacaagcaaatgtgttctgagaagtgatggtttacaacagttggcatcagaagtacacaagtttactaccaaaaccagggaggagcagttactttccgattactaatagtttcctggtaaatatcccataaaatgtaattttgcatttaaaactgaaacttcactgaatcatttacataacatatatgtattcgatttatttatataattatgttttatcacttatctgtgcttcttgaaatttggaatatttttctttcaccagaagtgtggatttcagaagaagacagctatacttagcatatttccaattgtgaagctagtaaagttagcctcttagagtgaagggacttttgccattctcttcagctccctttccacttccccattctggagataaaccaagaatcagagaggttaagtaactggatcaaggccacgtagcctagtttaatattttgtgtatttaaaattttcataaaatatgaaaaaatgaaaaagaatgctttcgaaattaagataacaaagtttattttaacttttaggtttgggggtacaggttaaaacaggaaatgtgtgatcgtctgcactgagtgctaattatctacaaagtactgcgttaagtgcattatatcacacaatctaatttggcctgatgaattaaaggtaggtggtatcgtatgtatttgacaaatgagaaaagaaatttctttgtagtgcaggttcagttatagttcagaatcagtctcagaccttcagtgggcccagagtgttttgttggttctttttttaacacaagcacctcatgaccaccaccccctgcataactcgttgagccagttgtagccatcagagtggaagcacatccactgctgatttccttcagccatctgcacccaccttcctgtgtgtcccagggggttctgcctctcctatctcatctcttcagagagatttccttaatttccctctttgtatctttgccccttcttacttgtctctgtccctctgtgcctacttctattagtgtttaattgtatattttatgtagcaaatgcttacatagtgctttctaagtggcagacgttgtaaatgctttacaaatactaatgtacttatgctcctaatagctctctgaaataaatactattattatccccattttattttattatttatttatttattttgagacagggtctttctctgttgcccaggctgtggtgcagtggtatgatcatggctcattgcagcctcgacctccaaggctcaagggatcctcccacctcagcctccccagtagctgggactacaggcatttgccacccctgcccggctaatttttgtatttttagtagagacggggtttccccatgttgaccaggctggtcttgaactcctgatctcaagtgatcccccccaccttggcctcccaaagtgttgagattacaggcatgagccactgcacctggcccatagtaactactcttaacagagttaataacagagttagtcttaagagagttaatatccaacttgttgaatctgatgggcacttgtcttaccttccctctttctctgtagcatttgaactggttggttggtcacttccttcttctcttggtgtttgcccctaccttgttggctgactcctctgcctgccctctgagtgttgatattcttcaggattctgtccttgctcttttctcttgtcattctaaatatgcttttgggttgacctcatctgctgcaactttgtcttccttctgtttgtcaatgacttaaacggccatatctcagctcagcattctctcttgagctctctgctttcatattgtactgtctcctggagagctctgtgtgaatttttttctacacctctcttccataccaaataaataaatcctgcttctcttctgttccccacatttcagtgagtggtttttaccatctgctcagttacccaagccacaggcctcgttgtcatcccagactctccatccagaaacaagtctctctcttgagtatgtctgtctccttctttgtagcaccattgtctcttacctgaactcctgtgtgagctcttgaactggtcttccaggctccagtcttgtacctttctcttccagtctgtgctccacagtttagtaaaatgcacaactctcttaaaaagcgtagcttaaaaactgtggattatttgactctgttgatgggaaatttgccaggccatgttaccttggagggtctactctgaaagctggaacagatcattacacaaacaaggaattgtaaagctgaaaaggtgtcatcagtgtgcagttcttttgaatggtatagtattagcggagagatggaagatgctttaattccctaccccaacccaaaacccacccctcacttatgtgaataaagtcttaaggagcctatacaatcattgactcttccatgtttttgtggcaggaggaaggagtgttagtgatatactgagatgttaggtaatggctaattccacacctattttaaggcaccgtgtctggcattgggggtacaagtgagagacataaaaggcaaggtctttctttcttttttttgagacagtctcgctctgtcgcccaggctggagagcaatggcgcgatctcggctcactgcaacgagcaaggtctttcttgatgtgcccgcctagctggggacactgtgcacatttatagagttataatggggacattgaaatggtttatgatgaaagaaatattgaaatatagtctatatttacaggttgacctttaaacaggatatcattttttcaaagaaaaatatgaagaaatgaaaaagaattctttcaaaattaagataacaaagtttatttattttaacttgtaggtttgggggtacatgtgaaggtttgttacataggtaaacttatgttataggggtttgttgtacagattatttcatcacccaggaattaagcccagtacccaatagttatcttttctgttcctctccctcctcccaccctccaccctcaagtagaccccagtgtcaataacagaaaaattagatttattctacaagtgttatacatgattctgaaaggttaaaagctactaaataaccagtttgtatgtagccaataaaagttatttggatatggtgatctaagcaattttgagtacaaagtggtatttaagaacttttgccataagttatttcactgtcttaggatggcaggattttggggctgaggaaatttggcatttgaatgtgtagagctccagacaggtgcccagccaaagcacagagtgcttgtgactgtgcttttgaagtagaagagtgagatatgtggtctgtcagaacattttttgccaaacctttatttatattctttaggtttgtttaataggatagtgattttttcaaatgatttctgagtaattggcataaagtagggaatttgctatgtttagagatgcagcagatatgggggaggaaacttgaaaatgtgggtaggtatagtatgatgcaagtattatccctgatgaaacctaattatttagatttccttatctggatcataattttattatcagctgatttatagtagttaaactcattaagaccatatagatgggtgggtgcagcagtcttaggccttagtaaacactgtattttgaaactgagtaggtgcctggttctgtttgtaatctttgattaaaccaagcacaaaattcgaagcttcataggtaaacttaaattattttcatcattctcattatgcaaaacaaatgtcatgtctggtagtagcttgtcttctcactgcacttactttttcttatattacagtctctttgctaacttgacatgtacttattgatctgtgatcaaaatggacacaatgtagaaatttatgactacttaaagtgtgatcttttttcaaactgaaatatgaagtttacttacaagttagattgctgtcctaatatcaagagtcttgtacactcatatgtatgaagtacttaaaattagaattggttagtcaaatgatttttagggaaaatatgtgagccagaagcatgtcattacagtcaatgctcaatgatgtagaatagcatggtggtgcaaaaaaagtaataaaagaatttgttacaaaatgctttgtattgtagttttaaaaaaagcaaatgtaacttgtaagttaattactgatagtattataaaagatgtttcttgaagttagttttcccccagtacatgactctctggaggaaggaaacccagatgactgctggggaataaggagagaggccagtttggggttgaacctttgttgaagatgtaggaagatgttaagttaaatatacagagtttgtggataaaactttgtcttttatcatatgctaatatgaatgaagacatttaatttggctaaaagatggcatgtttcgctgtgtgatatttatagttttgattatggtggcattgtagaacctacttgcattaatgataaatgtaggtacagtagaccccctgccccaccccagtccaagtttttgctttccaaggtttcagtttcagtggtttcagttacctgcggtcaactttggtatagaaatattaaatggaggccgggcgtggtggctcacgcctgtaatcccagtactttgggaggccgaggcgggtggatcacgaggtcaggagatcaagaccatcctggctaacatggtgaaaccctgtctctactaaaaatacaaaaaattagccggtcatagtggcgggcgcctgtaatcccagctacttgggaggctgaggcaggagaatggcgtgaacccgggaggtggagctttcagttagctgagatcgcgccactgcactccagcctgggcgacagagcgagactctgtctcaaaaaaaaaaaaggaaatattaaatggaaaattccagaaataactcctaagtttttaattgtgtacccttctgagtagcatgatgaagtattgcattgacctgcactgtcccatccaggacataaattattcctctgtccagcatacccacactgtagatgctacctgcccattcagtcactttgtagccatcttgtggttatcaggtcaactgtggcagtgtcaacgtgcttgtgttccagtcacccttattttacttcagaatggccccagagtgcaagagtagtgatgctggtgatttggatatgccaaagataagcaggaaaatgcttcctttaaatgaaaaggtaaaagctcataaagaaaaaagtttgtgtattgagatatacatcttataaataaatcataagtattatttatggtaagaatgaatcttctatcagttaaattgtggggaaggaaaaacaaatttgtgctaattttgctgttgtatctcaaactgcaaaagttacagtcacagtgcctgataaatgcttagttaagatggaaaatacattaaatttgtgggtggaagacatggatagaaatgtgttccaactgacggcaatggggtttggtactgtgcatggttttgagtgtccactagaggtcttggtacgtatccccaggatgaagggggactactgcatagaaaaaatgtttcccaaatttgttataagttgaaatgactgtgaaatattggatatgcaactgttaactctgtatttcagccttaattccatctcctttgtcaaatataacttgatttgaaaccaaaatttagtgtcatagtcactgaataagttacatttgttttcttcattttttttcttcctgtaggtttacctttttgagattgggtgcagttttccaaaatactttttctaatactcttccaaagatctcaaccttcctttacagtttgaactcctgtttgtattgcttgcttccctaatggaaatctgaatttttataattcctgtgtatttcttttttgcattgccttaacaggcatgggtcttcgaaagccctggagctccctgtgtggcccctgccattggtatgctgtgatgctttgcctgtcctgtgctcaggtttattcatgatggataagactcccttcctatcacatgtgcactgttctagcaaagagaatagacaaattcttttcagttgtgatgttgcccagggttttgttttgtttttttccctttaaggaaaagaatgtcagtggtgtatatcagaaaagactgtttacaccctttctatcccttgcctttcaaaccaggcaggattcagtacacttttaaactcccccagaatatgaaaaaagatcccttttcagctttccagaaattttttaaaatgtagaagaatgtaggaaattgccaaatcagttagttaatcagtgacaactgcagtcagtacacgaagagcacgcttcttacaagagcagctagctgtttgctgctttctcagcccctctgcatgcttgcccttgcctcacctctgcatcctcctccagaggttcagtgtcagccttataggagctggtgattgccacggggtccccagacagagcatggccacagggcagctccttccttcccttccttctgttccaccctcactttttgtaggcttgacatcacctggagcttctgtgtgtcaagtcagtagcttgaaataagtctagaataagtgggaaaatctttcctaatggtgatttttttaaaatcaggctaataaacatggtgttactagcctttatacaccaccctgggctttacaaaacccaggatattttataatattaagcaagatacatactagcaatcagcaaattttgtaaaatatacattactcttccataagtctgcactgtaagcattcttgccaggtgggttgaaatacatttctgaaatttaatttttttcctatccaaaataaattacttaaaaagttttcatttacttatttctagacctgtctcttcatttgattttcttctctaccatattacaattaattaggataacattcaaaagatatgagacctggtgcagtggctcatacctgtaaccccagcactttaagaggctgaggcaggaggattccctgagcctaggagttcaagaccagtttgggcaacatagtgagactttgtttcccaggaaaaaaaaaaaattagctgggtgtggtggtacacaactatagtcccaactacttgggagcccgcactgggaggattacttgagcccaggagttgggagactgcagtgagctatgattgtgccactgcactccagcttgggtgacagagcgagaccctgtctcttaaaaaaaaaaaaaagatatgggatagatacacatattttatgtagctacatatgtgatctacacctaggtatggtatatatagatacatgtttgtcttcatttctcttttgccatacaatgttgagtacttcaggtgctattagaatgtgtgcccatctgttcctaggacatgttgtgtacatggaatgaagaccctgctggacatattttcttagtgtctgcactgcggcagcaggtcagctgtctccacgttagggtcaaggtgctggccaccttctcagtgggcttagcctttaggagttagcttcagagaggtatttgaattttgaattgcagggtgtaaaggacacaaattttcatgatccttgtgcttttgtggcataatttatgtatggggtaatatactccttttgaccactttggaaaaagctagtgctgtgggcatgcacttagtataagctgttagccaagtgctatttcattagttgccttgaaaggaaacgttagcctcaatactgcatgaaggaacaaaagaacagctttttttttttatcataaaggctactcagaatatccagagtcttcaaagttatgtagaaataactgaaagatttctgcaagaaacctgtgaaatagtatgttatgtaacatagcattagatattaatgttaactgcatttttttgacttgcacaaatgattggcaaacagatgggcatatctttaaaattaaaccatctttagatacccactccttgtaaactgttacagattaaatttgtcactaagggctgttcataattctttgaatgaagtcagtattgtttatttgtcagacacaaatgtcaagactactttctttaagtgacatatctttgtattgctttataatattctttgtaacatgtgccatttgttgttgatccattatattaactgagtggtcagtgtgctatcctgtaggaggagctcagagtctgagggcaggacttcccaaactttcacatgcacaggaatcacttggggcctttgttaataaaggcagattctggtgcaggaggtctgaggtgagcctgagagtctgcgtctcttaccagctcccgggggtgccaggggtcctgtctctcaggattccacttcacatggcaaggctccagtcgccagaaagagagggaggtgaacacataagaatagtagcgtgcttggcacttttgtagcttctgcccatgttgatgtggtggtactgctagcaagggctttgaaatcagcctgaagagggagggttgagggtcaggaagcttccgaagatgggtgataacaaaggaactgagatgaaaaagaggccagcctctacagtgaggggataaggaggccagggaagagaccatgggtgtgaaggcgaggaaggtatgagatagctgatggatggttggtaaactttgagtagtttgatatacctaatgggggtgtttgtgagtgcttcaggggatagagggaagggagttaagggagttgagaatggacaggtcaataaggatttgattattagtgccttcaagcatgctggagcatttggactggaacctgaaagctatgggaggtcctttaaggattttaatcagggagaggtatgatgtaatctgtgttttataagatcattcaatcagtagtgtgaaagcgttgagaccagaattaggagaactgattagatttctaattttttgtggttcactaaaccatgaaggtctgattacttcagagctagtgtaaacagggaggaggagttagacccataaatatctgggagagagcattagcaggttgggaaatgcactgaatatgtgggatgtactggggcgtttattcaaactgcaagctgcacgaggacagggccacatctgcttcgttcaacactgtatacacagtgtctgttaaccttgaatattttttaaatgaatgatgacaggaaggatctaggcttatttcccattgtttggctaggttgaagaggtggatggagatggtgttactgtcatagcgaatgctaacataaggcgtagcgttgccctatacgatgtcagtggttttccttattaaaaatgtgtctcttctgttaatatcagcaaaatgggaggtaacctagtaatatgaatggaggttaccagtacaatccttattactatttatggttttatttttaatatgatgcttggggacaaacagaccttagaaggacttcacatacttcttttttttctaaatctttttctgaattgtgtatagttgagaattattcctaacatactgaaaattatttatgaagaaataagaatatatgttgggagataatacagaaaggagacataggttgtaagtatagttaacataaaatatgatatatggaaaaaataacatatatttcatcccaaagggtagatatggacctttaaaagaatactaatctctgaaagaggagaaaatattttttatgaaagaggattgctgctatttaatatggtctttgtttaaacatgttacctctaagaagaaatacataggagtgctttccatgtaattttctgcagtgatggaaatgttcattataggcactgtcgagtaggtagccaccaaccacatgtggcttttgagcacttgaatgtggcttgtgcgactaaggaactgaattttaagttttatttagtttaagtagtttaaataacaacatgtggctggtggcttctggattacacagcaccgtcatagagtattggcaatgccctagcatactaatgaggaagaaaatgtggtcttggccaggaagaaaatgtggtcttggcccccttggccaacccagggggttcaggaagggcatcatttgacccatgaagcaaatacggaaaatactttgtggtgaactgataagctggtgttggtgacttggggggcacttcctgattctttatccaggttcttgtcagttggatagatgtctccttcatcagcaagcattggtcctgctagatgttcccaagtggctgttgggggctgggttgtgggtggggcagtgggaggagattcctgttaaccggattcaggatctagctgaaaggactttcactttgagtggaagctcagcagtgtgagccctttgtcttcggtctgtccacctaccagtgtgtggattctttgcctctcttgatatgttttgcagccttgatgattgagaggtgtctccatgggttatgatgagggtggtgatgtgctgtttttttagctgcaaaatgcttccttggaaattctgattcatgctccaccctcatccccagaatcattatcacagtgatgttctatacctcacgctctttggaggtggaagagagaaatttaaatagaacaactcaaaatcaaaccataagcagcaaaatagtcttcagtatccaataggcaaatgtcctatgatttcactcttgcccacgtgttggctgtttatcaaaaaagtttcccttggatgacattttacttacacaataggacaaatagtgtttgagctataggagatactttgcatgtgaaaggtgttacgtattcacctatctccttgctaggtttctagtccacacctgtgacgctaaaaggttctgcgtcactacaaaattaaaactcagctatacaaatgccattctactttgagaagagtgtagtaaataattgtttatattgttttggaaggtcagaaaatcactatatataaaataaatttaataagtaaaaatttaacatgtgttataattaagaaattttatatatacatatatttttcaaaatattaatattttcagtgacatttctttcatcttggtttcttgcgcacccgttgcttttatcattgattctgtctgtgcttggatctgcccgtttttcatttgactatttcccaataaaatttaccaatagctccaatttggtgttgatatatgcttgtttcctaaaagttatatatagtatgatttaaaaacatttttggaaaggaaattcacttctatttgctgatggcagcagcagttttagtgattctctgaataaaacagacttgatgcaggcctttaatattttgtcctcactagtaagctgctgtttcattcattcattcatttctttcatctttgggaactgtcactaaaatgttttgtagaagaagtttactcctctcagtctataaaaggatttttttcatctgttaaatgaggaggggtttggattagaaggtcttcagagtgcttcctaactctgaaatgtttgtaattggtttcacagtgtgcctctaatgttgatgattctgttagttgagtggtctcgttgtgacccctcctcacccccaaacacatgcatcttctgaactgtcctttagttcacatctcagaaaatgctggccaatagggcactgagtagaaacttgaattactatgtctccattatatgcataggtaccgtttgctacatattctcacatttagttagactattcctcatcagaagttaccgaggagtattttgtaaaatggcaacctatatttttaataacataagccctgaatcttagttcttatttaagagatgcatcatttacagatatataagctccatgaggacaagagggaattttgttttattcacagatctctctccagctcttagactagtgcctggatcatagtaggtgctcagtaaatacattttgaataaataattgtgatttgagagttaatttttatgtaacaccaaataaaacataaatgcaacttgaatgtttattacccaggtgataattatgagactttaaaaaatttcattgctaatttgttatttctgtttcttctttttaaatactttatgctgtccagtatggaagccacagccccatatgtccattttttcacttgaaatgtagctaataggaattgagatgtactgtaagtgtaaattacatactgggtttcaaagactcaataccaaaatacgtaaactagcttattcatttttttatattgattacctgttgaaatgacagtattatgcatttattggtttaaatagaaattggtaaaatggatttcactcttttggtctactattaaaatgtagctactagaaaactaaaaattacatgtaatagctcgcatttgtggcccattgaacagtgttcatctagacacagaaaatctagatattgagtgtagacgagagggaagctttcaaaatagggctttgaatgaatatcttttatagaaacacaaaattatacaatgcagctgcgacttgggaaagtgggcattcagatggtcttgatcaaatttaaaaaaaggaccaaaacaaattaattagattatctcaaatcagaaatatgaaatgcagctaccagatggattcctggcatagttgccagctgggtcttgaggtcagaaaaggggcaggaaggcgttggtggctgtcccagtgagcggtcactaatggcagactgcaaagccagtttttgaacttctctgcctggaccttacctgagcatggttgtagttgtgccgagcgacatgcttagttgataccatataatgctggcgtttttcaagcgtctgggagatggacacttagtagaagggcgtagggaacaggaagaggagcacagccaaggatcagtatgggtactctcaggcagggctgtttttccctactcatgcgcataggcaacttgtccctcttctgaatcttaagctgataaaaagttagcaccaacttcatcgccacttctccaagcttgatctgactctgcctctgcctctgagctcagtgggcttgcaagagaaggtcaccagtgggctaagccatccactccctctgggctcacttttacctggagctggcctggagccccatcgagtcagtagcatttcttcccataacagttggcggaccctggaggatgaagctgctccccaggacacatatgtagacgttactttccttaagctaatttgaaaggttattttggtaagtggttgggctgcatggctggtttaagctattatcaagtccattccagtatttatttctttgaaagttagaatgagccttgaataaatgatgactgactgcttagccttcttaggagtgtatttaagaatatttgttgcaactggcactggagatgtctacttctctttattttggattttaaaatagttgtatagtaaagcagcgtgttttcagtaaaatagctttcatgctcaccttattttcacccatctgacctctgtatttggagaaagtagatcagaaaattcatggcagttagcggcagagtgaagagacctttgactttagttgacagctgtcacctgaaaactacaggcctggagaccctctcaggtgttatgtctgtagttctgacagtgaacaggaatgttgtttacattttctgtaagcaaaattctccccttgttaggaatgtgttagaatacggcaggcagaaacagaatttttatgtgtcttactggtaagttctcaggagtgttggttagcccattgttcattcccatgctcttatggaagggtgtcagtagaatttatgactgagcctgtttttatcatcactttggaaattcttcaacaagatattgtttttttcaagtgagctagtatcacacaatgcttaatgtccttataaaagagaaaaaaatgagttaaattccaaagatgtttaagatttcagtcattttctctatatgaattaggtctttattaggccgttgatttaattagtgttcaacaaaaacactttcctgtttagattgtcaacgcattctttaaattagttattttaatctgacacaggatctgttaggaagagtttgaataagatgcagcatgttacatagtgtacacagtgcgctggaagcacgtagggtgcgaacacaagtgcctgccaacttgtctcccttcctgcttaggtcctgccttgtcccaaaaggacttaaggcaatggtgaggagagcatattttgaactttattctgtaaaaataattttcagttttggagaaagttgtatttctagttatgagaatagttggtgtccacaaagtatccactcaactagttttctctgagtggtcacgtgggattctggtccaccagagcccagcatgcctgcgggtgaataatgagcctggtgattgggctgctctgtgtcagtgcagactgggaccatggtaggctcagagccatgagtgaaattggtcgtcttggacaatgaaagcttttcttttagtttctttctgaatcttgtatatttctgccattaaacataatgaaattatgaatttattgtactgttctcaaggttgcttttcaacatcattatgaacactttcttgttagatgcctctgttgcagttacatagttgtatgtgggctgtaaatatctaatttgtatgaaatgaccgattttggtatttgtataatcctctagtcaatttaactaacttgagcttttcacagcccttggtgctgctgttgctcatctgattacaccgctcaggggaataaggttaagggcgggctgttggtaaccagagcatttccagggctttagttcagcagatgagctgcttggctatattcatacatctgcttgcctgctgtggcagctgctgctgcttcacgttgtgttcttttgttctgtttcatccaagaatggaacgctaggaagtgtagtgaatggattaatttaaggttaaggttagtgttttgcttgctttctaagtaaccgatcataatgatgcttctggtagaagctaatgagtttctcttaaagtgaactaaatttataaaatacagctcagcgagggagctagattcgtattgttgatggggaccaaattcagatgtacaaaatactggcagtttttatcattggatcctaattctttgttttcttccttcttctcccccaccccaaactcccttccaggacctatatccagactttgcctgacactgcagggtccaagagaattaaagaaatatggaatgacatgaagaagattagttaaggattataggctttgagggcaaacacctcagtgaagtgaagcacaggcaagctcctgagctgtggtttggaggagccgtgtgttggaagaagatggcagatccaggaatgatgagtctttttggcgaggatgggaatattttcagtgaaggtcttgaaggcctcggagaatgtggttacccggaaaatccagtaaatcctatgggtcagcaaatgccaatagaccaaggctttgcctctttacagccatcccttcatcatccttcaactaatcaaaatcaaacaaagctgacacattttgatcactataatcagtatgaacaacaaaagatgcatctgatggatcagccgaacagaatgatgagcaacacccctgggaacggactcgcgtctccgcactcgcagtatcacacccctcccgttcctcaggtgccccatggtggcagtggtggcggtcagatgggtgtctaccctggcatgcagaatgagaggcatgggcaatcctttgtggacagcagctccatgtggggccccagggctgttcaggtaccagaccagatacgagccccctaccagcagcagcagccacagccgcagccaccgcagccggctccgtcggggccccctgcacagggccaccctcagcacatgcagcagatgggcagctatatggcacgtggggatttttccatgcagcagcatggtcagccacagcagaggatgagccagttttcccaaggccaagagggcctcaatcagggaaatccttttattgccacctcaggacctggccacttgtcccacgtgccccagcagagtcccagcatggcaccttccttgcgtcactcggtgcagcagttccatcaccacccctctactgctctccatggagaatccgttgcccacagtcccagattctccccgaatcctccccaacaaggggctgttaggccgcaaacccttaactttagttctcggagccagacagtcccctctcctactataaacaactcagggcagtattctcgatatccttacagtaacctaaatcagggattagttaacaatacagggatgaatcaaaatttaggccttacaaataatactccaatgaatcagtccgtaccaagataccccaatgctgtaggattcccatcaaacagtggtcaaggactaatgcaccagcagcccatccaccccagtggctcacttaaccaaatgaacacacaaactatgcatccttcacagcctcagggaacttatgcctctccacctcccatgtcacccatgaaagcaatgagtaatccagcaggcactcctcctccacaagtcaggccgggaagtgctgggataccaatggaagttggcagttatccaaatatgccccatcctcagccatctcaccagccccctggtgccatgggaatcggacagaggaatatgggccccagaaacatgcagcagtctcgtccatttataggcatgtcctcggcaccaagggaattgactgggcacatgaggccaaatggttgtcctggtgttggccttggagacccacaagcaatccaggaacgactgatacctggccaacaacatcctggtcaacagccatcttttcagcagttgccaacctgtcctccactgcagcctcacccgggcttgcaccaccagtcttcacctccacaccctcatcaccagccttgggcacagctccacccatcaccccagaacaccccgcagaaagtgcctgtgcatcaggtaaggggacacagagcctacctctgcattgcagtgtgaaattcaacatggctaacttgtctgatcgaatttttctttaaactctatgaaaagctttttcattatgagtgccttaatttttatttgttattggcttatgcatttattttattcaggcatcaatctccctgtcccagggattgtgctagatgttaaggatatgtagataactaagactgggtccctgctgacaaggagctgggtcaccgctagcagggagatggacagaggactcagaatgctcacaagacaaacgcttttgtttccttctctcaattcttctttattctttctctttctttgtgtgtgtgtgttttaaaaatacactgacacttggtttctagcaaagatttatgcgtgtgtggtagtctcctccatctctccttttatattgtgatatttttcttgggaagctgcaaatcgtatacttctgtgatacttattttactaactgttgactttgttagtgtgagttttaattgcaaactgtagaaaatcacagtaaatgataattcacagaagatgtttggtctctaaaagatttggatacccagcactgaagtagggaatcttccttttttgtaagctgacgtttttgttatcattcagaatttataaaagaacagatttaagtttatcatattcacaaagacatctttccattataaattttgttgtttatgccctaggtctgtgaaagataaattaatgcctgtgtatacagattattcttagtgctattcaaaaatatatactgattatctaccagaattgcagctctgtttttggggtgcacagtagctgattttagagctataaagcatagtgcttgttttgatggacttattatcaattttggggaaataagacttgcatgtgaaaatacagaggagtgagagaccaggcatgattatgtgacaaatgtccagagagaggaaataacctgtagttgagagtgcttggaatttggctaggccttaccccggggaggtgaacccaggtcagcagttgagactgggggatggtttgctaaacaagggcacgggaagtcaagcttgctgcagggaataggttggaaagtatcagtcagggccagattgttgtgatcttggattcctttttaaggaatttggacttaaacggggagggagccagtgatattgattagacagtccacaggacagatggagaaggagaagatgaagtgtgaacctgttttctaggcctttgaggacagtttggaccagaaggatcaaagtgggagcagaaggcattgaagcagtgttgaaagtaaaagggtttagtcagtaaacaaagccactcagggcatctcagagcagcattttttttttttttttttttttttttagtggtgataattgtcttctatgctttttgtcagttcattaaaaaaaagaaaaaaaaagtattttaggccaggcacaatggctcatgcctgcaatcccagcactctgggaggccgaggcaggcagatcatctgagatcaggagttcaatgccaaactggccaacatggtgaaaccccgtctctattaaaaaatacaaaaaattagttgggcatggtggtgcatgcctgtagtcccagctgcttgggaggctgaggcaagagagtcgcttgaacctgggaggtggatgttgcagtgagctgagattgtgccacttcactccagcctgggcaacagagcgagactccatctaaaaaaaaaaaaatttttttttttttaattttagattcacgcaggcatttaatacagaggctctgaagcttcgtcctaagctgggctgagggagtggaggtcaggaagactcctgggaccacaggacaagtagtggcttcagggaagctgccctcagccggtgggcagggcagcttccctgaagaccttggtgatcctcatataaccacccttggtgattcttatataacctcagggcagaacgcctctcctcaaagcggaccaaaagtactgtctctgaggccagcagacctgggtggcttttaggacagaaatgaatgtgacttagtttttaggaattattattttcttattccctggaaagtttcttactaagcaagggatattttagagcagtggtttctcagacttctcattccgacatcctctgtcttcaccggagggtgagcacagtttggaagacaccctgtgattataatctgatccctggatgagaattgttgctctcctccagctttcctgggttttaagagtacagatgcctcagtgggcatttcagaggacatgtgtgagtctgtggcgtttgaatccttgaccagtggaggctccatgcctgctgtgtccggtgctagacttcaggagagcccacatgcattccctccttctttgaatgtgtcattataggcaaactcaggacctttacagggatgtaaactaggacatttgaggtattttcattctaagtacaattatgttttccattttgctcattgattatttgctttcttatttctgcttaactttgcatcctcttcagattttgaaacactcagttttgaacataaggctagggaggtgtgaagtctcaggcacagaacatagactttaaagttagaaagatatgtggaccccagctctattgcttattaacctggtgatcttaggcaaaggatttaacttctctttacctcagatttttcattagttaagcaggaaaaatagcacccagcacaaagggtgttagattaagtgggcttaacatataccgagtgcctagtataatgtccactccatggtatatatgttaattctcctctaattttagcttctgatctcctgaagtgcaaaccttgctacataattatgtcatttcccatgtagatacaatgtaaaattaactttatttatttattattttttgagatgaagtctcactctgttgccaggctggagtcagtggcgcaatcttggctcactgcaacctctgcctcccaggttcaagcgattctcctgcctcagcctcctgagtggctgggactacaggcgcgcaccaccgtgcctggctaatttttgtatttttagtggaaacgaggtttcaccaaaattaactttatttttaaggataggttaaatattatgtaatacagccttagttatgaaataactaaatttgatttgtgcaaatattatcccccttttagactgtgttgccacatgtgaggaggataataatatgggtaattcaaaatactatcctatacctttaaaatctctctctctgaatgattgacattctaccctaggaaatatttttatttaattatgttttgctttagagctactaaaattattttgcattttatatatgatggagtagtggctcaatactataccaggtatcagggaagataccagattaggttgaaatgtccatttaacttgataatgaaaatatcactttcaggtagacttaactcttcttgagtttttcgctttttaaaaatagaaattatgttctttatgtgtttcctggcttctgaatggatattttctagattatggaacacatttaagtatctttaaagataagtttaactttatattgaaaagtcaacaaagaaaaatgttagaacaaaaaggccacagttcatcagatcacaatgtgaaaaattacacattttggtatatggacatttctttaatggaagtgctagacttttcgattatttgataagatttacagggaagggaaaaaccctagcttatatttctttttcaatagctaattagaacagtttttctcaaacttttcatctcagacctctacacattcttaaaaattactggggactccaaagagtgtgtgttagctatgtgagttatatgtattgatatttactgtctcagaaagttttaagttttttattgtttacctatgtatttatgtctttctttatttttgagacggagtcttactctttcgcccaggctagagggcagtggcgcgttcttggctcactgcaacctccttctcccaggttcaagcaattctcctgctcatactccctagtagttgggattacaggcacccgccaccacgcccagcttttttttttgtatttttagtagagatggggtttcaccatgttggccaggctggtctcaaactcctgacctcagatgatccacccgctgtggcctcccaaagtgctgggattacaggcatgagccaccctgcctggctaaaatattgatgaaagtttaaaatattgatttgttaattatttaaaaataataaaccattatgtgttaacatacataatactttttaaatgaaagataactttttaaaaaatgaaagataagttttcgcaagacaaaattagtggcattgttttatatttatcaaatattgattttcacatctgcttctgaatgtagtctatgtgctagtcataagcctctggacaagtttacagcttatttggaaaaaatgaggatgaaaaagcaaataacatctcaggatcatgtagaaatagttctggtctcacagaccctacagaaaccctggcccacaattttagaaccactggtatgaaggaaagagtacaggctttggagtctgagtttttgaataggagcaccaccgcttaacgtcaccacctgacgttagtaagggtgtcaggacttcatttcattatctctgaagtgagggatcatatgccttcctggttagaggctcagtgagattagtagtaatgtcttttaagtgcttaacagtggggactcaaaaacaatacatctagcaagtgttcagaattgcctgttgcagagctttaagaagaatcttacatatttcaatgtcaaacattttcatagttgtttgactttacatccttggttttagtgaacacttatcaaatattgaggcttcgtatgtgcttttctttgagggagggagaacaatcttgctgtgtgagcaggaagatgcaggcaagaatatgccatgaaaagcacactgtagagatcagcactgatctttaaagtcattcttaaagtgggcgaggtgggggtctgggagggctttctgggggcagtgatgtctttgctgagatgtgaaggatcagtctaagttgagagaaggatggataaaggagggaaaagagtttaagatttaggaaacaatgagtgcaaagatcagaaagccctttgggccttgagtgtccctagtattgctggaatgtaggtctggggcttagtggacagaaagctgcatggtcctgggcccatggcactggagggcactaggaggtgttttcagcatggacacagcaccatggggctctttgcagcacccaggagtacgaagagggtggagagggggtggaaccaaaaatgaaaggtttatcagtacactgtgaacatggatgagaacaatctgcaaggaaggcacagagcaacattttgttcatttgaagagcttatctaaagaaagactaattaagtggattgttcttaaggttacaggcaagtccctgagtttctggatagaatttacactgcacagtccatagacgtgtcccagatcatggattatgctcttaaatggaaagttctagttgaatttttaggatctgcaacaaggtgtccttaaaataagtttattttggatacatttgtacctttttcattaatttggtcctgaaataacagtcatcatgaaacggaagtagaaaaaaaatttaaaagctactaagattgaggtgataggtaataatttcccatctcctcattttcccttgagattaaaaaaaacctggaagaatcagtggtacaatttttttttttttttttaaaaaaatagcctttcagggaaaaccttttattggtaaatctcaagtagcatcaatcttatactgagattctttaagtttacccagtaaataaagaattacaaggccgggcgtggtggctcacgcctgtaatcccagcactttgggaggtcgaggtgggtggatcacaagatcaggagttcgagactagtctggccaacatagtgaaaccctgtctctactaaagatacaaaaattagccaggcgtggtggtgcatgcctgaaatcccagctacttgggaggctgaagcaggagaatcgcttgaacccgtgaggcggaggttgtggtgagccaagatcatgccactgcactccagcctggtcaacagagcaagactctgtatcaaaaaaaaaaaaaaaaaaaaaaaaggaattacaaattacagacatgggcagagtaattggcaactaagtaaatttatggaaaaaggtggctgtgtttcttaaggattacgtatgcaggttgtaatcagaaatagacaaaaatacctttttaatggagagcagatgtatcttgtcaatactacctttctcacttctaaagacatctgggaaagatgggaaaacaaaatgtctctaaaaaaaaatcagcttttacctaagtggtattcaggggcttttgcaggtatatgcaccttcagaaaacaggcacccaggctggacctcattggagcaggttgccccatctggtgctcacagaaggaaggcaaaagaaatcactgctttctcacttgctgtggcccactgctagttcttcatgacatctttagttaaagcaaaccatccagcctttactggtctctctttcctgggccataggttgctctcaacagcctgtggtttctcacgaagactcttaaagtatttcttttgactacttcaatttatatatactacagcttattgagtaacctgtctgcgtttttcctcaacatccaacaagctggtttatcccagaggtcagaattataccaggtgtcaagttaaagcacagggaaaaatctactccatctgtcctttcaccccatagtctgaaagcatgaatggctgatagcctcgctccttagatggcttttattttgtaaaagagtattgttttatgtgacatcaaaaattttgtaggtgataagaatttagtttgttagtttacctttgaagcctggatattaggcctctgctaggtgtcccaattgatattcttaaaagaagccacttttggtgctgcattttcatcttggtgtcttaggtaccttcatgaaaggcagtaccacatgaaagaaatacttatttagtgcctgttatgtgccaaggactgtgttaaggagagattgctggtatggtggaaggcagggaggagacagcaacctccaccgaggtggaaagggaattttgttatttaagtataacatttctggctgtcctatctttgtgtacttactatgttctagaccagaactgtccagttatatgatgggagctacaaatacaacgcatttatgttgatacagattttctggtaaccacattttaccattaaagaaactggtaaaactaattttagtaatacatttaattaaaccaacatatccaagacatttcaacatgtagtcagtataaaaaattgcttgtgagatattttacgcaagaatttaaaacctgatatgtattttacacagattgcgtgagctgcatctcagttgctcagtgaccacacatggctggtggctgcatattaaacagcacatgctagactctttccctatcagttgctgcaaattctttttaaaaacaagtcagagtataaataattttattcacatgtaaataaatgtaaaattgttagtgtaattatgacagtcatcctccaagacaggtgttacccacctttgctgtaaggttaaggaagtagtagcggtgtttttaggtataatgaataaatgcagtactagggggtgtgcctgtgttagggatattagtatcagttcttgacaagatacgttattgaagtttgatttcatttgtttgagtttcaaagaaggctacataaatggtgtttgtcctgtgggaaaaaatagcgtgtttgtctgaaaggtggattacagacattttcaagattttagttttgagtggcgtttggatacttttggtagttaattcctcacctctatcccctagctttttgcctgtctctaatacaattgcttgtttcttcatgaaattgactctccaggataagggaaaaagccttcatttttattaatatgcatgatcccccctccccatttctttcacttttttcttctgtgctgcctttttcttccctgttataataatctttcagaacggcagtctctggtacagcagagcaatagttggctgaggaagaagaattgggaagtgggttagggggacaattaagggaacagcattgtgagaactaatctggagaatttaccctagccttgacatcttaatgttattttctattctctgtagttacagctgtaaatctatagataatccttaagtagccatgcagagatggccctggtatttcctttgttgctgaatgcagctcttgtatcagtgaagaaagtcagtagcaaacttgtacttgtccttttgccttgtaaaactttagtagtttatggtgtgtcaccaggagtgaggttttattttgtttttccttcacttagtgtaaaaaatggaggagaaccttcgagggctaggacatgactgcaggagtggtggagggctaggacatgattacaggtgatggagaacttgaagttggcaaaatgccaagaaattgacagcgttgcatttaaaaaagtcaacgtagatacaggactacctgcatcatcttgcttgttttttatcctggacaatttccaggacgatgggagtgatggccagggaaggctgcaaggcacttccttacctcttattttaaagattggatcaaaaacatgcctttttgatgctgtttaatattaatgaagactataatatttgtgatattctttaaagtgtatttgtcctgttttcctctactgctttctgtgtttagttctaaatcattctgtaccataggtttcgggagtcctagacgttaaccttaactatgttaactgtgtaacttggctcactgtgtgaaagcaaaaaaacaattgttttagggtgtaagcaagtgttattaatcttaaagagtctttttgtttgttttggccatgggtagaaagcattggagaatattgaggaggtgcaagcagtggtgctgggagactgtgtggagggtttttcgaatggcaagtgttctagcttaacttatgcctttcctgtctaatctattcatagactggctgaaacaggtttgcaatattagcataggaattccactctcacccatttggtgggctgtgaagtgttctggcctcttgccagcggctgctcagtttaggcagttgggaggttgcagggtgcatatcctttcttgtgaacaggcaaagaactttagatcattctttttctgaaaactttttgttttttgaaggtatgtatctaaatgtgctctttaatgaaaggggagggtatagacttaaaattcttattgaatatagaaatacttgacattaaagtttgatttttagatcatgtttcttgatggactcttgtaacttgaagattttcttccattaaaaaacaataatagaaaattgtgggatttttgcaatttgtgatgtgtttgttttcactgttatttttaaaaacaagtctagcatgaagagataccaagtttaaccactttggagtgtgctagaaataaactgtggggaactaacttggagaatttaccttgatcttgacatcttaatgttactctccattctctggagttacagctgtaaatctatagataatatctaagtaaccacagggagaaatggaactgggacaataaataagtagaatatgctgactttgctttaaattggcccattactaagctaactccatttttggctgctcaaatatgtcagagacatttccctgaatgagagctattgaaatgcatgaagacatcccttggattaaaggagataagtcagagttttttagggaaagtgttttatttaagtaagatgctaagtagtatttcatttttgtcatcgatttctctgaatgtttttttctgttcactttaaatatatttatccagacagtggaacatgtcaagggagtagtcatcttcatactggaataaggcgctgtgggaacccctgtgctcagtgtcctgcctaacctgacctctgatgcaacaacgtgtctttcttacttgaaaatcatggtagaagacttagatcaaagaaggaaataattcagtctaattttggaaaacatctttccttagatgtgagcttaaggcttgcagttttactttttgcaagaaagttcaaaaccaatattcacacataaataaggtctctaagctaggatatcattgatgaagaaaacaaacaacaacagtaagagactagccattcatagaataaaaatgagcccaataataagatcagttttttgttttgttttcttttgttttgttttcttttgagatggagtcttgctctgtcgcccaggagatggagtttgcagtggtgcgatcttggctcactgcagactccatctcctgggctcaagtgatcctcccacctcatcctccagagtacctggggctacagtcgcccaccaccgcacctggctgatttttgtatttttagtagagacggggtttcaccatgttggccaggctggtctcgaactcctttcctcgggtgatccacctgcctcagcctcccaaagtgctgggtttacaggtgtgagccaccgcgccctgctgcaaatcattaaatcagttttaataagctccccacgtcaaagagccatgttagatgctagagtggtatttcatactgaatataaatttaattccaaagtaagtaaatgcaaagagacaagtgtcagtttatttctttcatttaatgttttctctgtcattttttaagcctctcacccctccactattctgtgtagtggtcacacactaggtggagctgccaggactctgcccctcactgctagcacaggttgctgggcaggcaagagcacagagttgtgaagaccacaggcttcatatacactgagaactccatttaaatgtggctcttccatttttttcttaagtcatcttaaatgatacatacttaacttccctaaacctcagtttcttgatacagtgattgtaccgattatacagaattatgagaattaaatgagataatgactgtaaaatttttagcacagcatgtggtatatgcccaataaatgttaaatattttttattttaactactgttgtagtgattatcaaaatgagcttttggaattctttctttttttaccttctactctttcactttgaagtagactgactttcccttattttggaaaacaggacatcatctatcagtgccttaaaaatcaacttactagattctccataaggcagacaaaaattcataatgttttgtaggggggagcaaaaattaccatcacactactgtatttcttttcagttgaatctctaggaaatattactgtatataaaatactagctgctttctaagtgtttctttctaacttcaaccaaggtgaaaaccatcacttagttttcagaaacttcaaatggcaggttaagttgacgtcctgtttcatattgctagggatggtcgctggtattccctctagcatgcaagaagttcatccactgacctataatatatgtagttctacatagagaaagttcagtagtactaagtctttgttaagtataattttaaacttacaagtaccttaaatccagtgatccacttcatgcccttgttgttactagcatcttaccatgttttcatggtgtgctctccaaaaccctgagatgaacttatactttagtggatgggttcctgttgactggcactgaaggccctgttgtgaactcagttgatttatgaaggctatcccacttaagatttttataatgcttctttatcctaatctgtttttttttcttaaaaagtaacttcataggttttaaagtgtggaagacacaaaagaattgaaaggttggctgcagtgtaatttagtagctaaattttaaaaaataagaaggcagttcacattttttcaaataagtaaggaaggtttacatttttggagacagtttttatccataaaaaacatttatgggcagcactgtaacaccattgccattttttttaagaatttactatttagagcgagaagagacttgtgtaagaattgagcttggagccaggttttctctgcaagaaagagtggttctgtctttgctcaaatttaaatatagggagaagacccttttgtttattatcttccaactttatacactatagtttttaaatatttttaacaatattttaatgtatttttaaataaaaatattggtaaaaatgagattgaaaaaagtaaacagaaaacctatttatctaatgtccatcagttgtaatatgtttactaaatattgtgtatatttttatatgtattttattgaattgtaatctatatacaatctgtgtattaaatgaaatgtttcctgaattttatactatagagtggttgcaatccaggctgtcatgtatgttcagtcaactcaaggtttaaggaaagaaaacccttttaaatataaccgtgtactgaaatgtatcagaaagtatctaggattttccaagttattttttaaagaaggtttgccgtgttctttgatatcatgctaataatgagtgtttgtagaaaatatataacctagtactgtccgtgatctttctgtcatgatgaaaatgttctatatttgctcagtccaatatggtagccactagccacaaatggctactgtacccttgaaatggggctagtgaggctgaagaactgaaattttaattttatttgattttaatttaaatagccatgaggctagtgactttcatataggaccactgaagtataaccacacaagccaaattatttcaagtatcagaaaataagatgtagagcacaattaaaaatagaaaggagagttttttgttgcatatgtagccagtgtaagctttgtgtttccacttttattctctctcacctcttaataggtggccctgaaaccatgggtatctcgtgtctttggccttgtgatgtagtgataggatatagtcatctatacatggtaatgctgacataagtcacttcatgattttttggaataaatttttgctgggtatcagccaattgttaaacacagcatattgttttaactaatgcaagtatagcatcttgttttatggtataagtgatattttagaaagttgttaatcccaaaaaagtccctgtcacaaatgcttcatataaaatatttaaggccaggcacggtggtgtgcacctgtagcccagctatctggggggctgaggcaggaggattgcttgagcccaggagtttgaggaggttacagtgtgccataattgcacctgtgaatagccactgcactccagcctgggcagcatagtgagactgtctcttttaaatgcacacacacatacgcgcatacacacacacacatttaaaatggatggggtgggtgcattgcatatcttagttaatatccactagatttttggtttattaattaggtcatgggtaggaccttgatagaaaataatttgccaaatcctttaagtcatcaagtctaagcaaatatattaaatgccattgaagtgctcactttaaaatgcttaattttatgttacatgaatctcaacttgatttttaaaaagggtctaaagtactaattttacatcttattgctggagagaagagctccattctttgaaaaccagaaaagaggatcgtaggatgaatattctatattgagtctctaacatttgtcctcacctggatggaaatttcccacattctgctgggattggggccttaaaaaatgactgtaggaaatccagccctttattaaatgaagattccagagagctctgtccagtggaattttctgggatgatagaagtcttctttttggtgtccagtatggtagcctgtaggcccttgtggttaggaagcacttgaaatggggctagtatgacagaggaactgaattttaaattttaattttaaccaacttaaacagccatatttggctactgactactattggacagtgcaattctagaatcataattggtagagaagtagtcttcaaacttttttgtctcctaagagaattttaaaaaaaattctctttttcagtttgaatacatgcattaaaatgtgtttgtcttcatgacaattatctcactaaacaggcatttgtcacctggatgaaatgaaggactgccctcttgatatttattaactctctgctttgctgccaagtgactcttcctaaagaggttggtgtcccagaggtttttatactccagggcaacacactgtaataatatttgggatgagtgaaagccattttggtaaagagaagtgattgtaaaaaggaaggtggaaagggggacttttagaaaatagataccaaagatgacagtgttagttctgatagaatgtattttgagccactctgatttgatacttagataccagaactattctagttaataaaatgaggcatgattagtataagaaagaacacttaaccttcctgctactaaggcaggtgggggcattcatccagattatttaatatgtgagacaaatatgttcaggtaactgcttgtctgtttataattgttttatttaaagtaatagttctcaaatgttttagttttgaaatcctgatgctcttaaatattgagaaccccaaagagcttttgtttattctggttttatctgttgttatttaccatatcagaaatgaaaactaggaaatttaaaaaatacatttattcatttaaaaataataataacccccttattggttcattgaattatgccaatcttctgatttttgtatacatttttttttgaggtggtcttactctgtcacccaggctggagtgcagtggcatgatcatggctcactgcgtcctctacctcccaggctcaagcaatcctcctacctcagcctccttagtagatgagactacccacctggctaatttttttgtatcttttgtggagatggggtttcaccgtgttgcccaggctggtctcaaactcctgagctcaactgatccgcaccccttggccttcctgagtgctgggattacagggatgagccactgcacccagtctacaatattttttaaaaatcacatttgttggtattaccactgacttctcagaaaagtctttaaagattgagaagttgttgagctcatgggtgttttcaaaattctcacttttgtttgagagctcatattttattattgtaaataaacaccatgagttactttcgttgaagtgattggctcactttatttcaagagaattactgccaaatacttgagtctgaatatctgtggcttgtctttcagttggactttcaagtaaaaacaatattccttaaaaaaacaaaaagggtggcccattcaactcacaactctaggcagttgcgcgagcgctcttcttggtgatagccttccttggtgctttggtgagcagcagatatccttcatgtgcacttccagtttcctcacagaaaagattaaaaaggggcaggaataacaaatatcaagttttactgttttgtcaaggacatctttaaatgagttggcttactttttttcctaatgtgagttggtggccattgcaagaataacaattaccagcgtatttttctgtcactgccttgattgtgcttgcaccactgatgtaaatgtcaacacagtgaaaagggcagcgatgtcttagtatattatgaaaaagtgctgattttgtgaatgtcctgaaagagtctcagggacccctgagggtccacagaacacactttgaacactgctggtttaaagggaagttacaaacagtaactttttcttacaaaattgaaaacccatttttatctagaaaaaaaatctaactgtgtttgggagtgggaaggtaaagtgcagctggggtgctggccaccactgccaggtcatgtcttgagcaggaatgagtcagatagcctgtgagagaaggcagcgaatggattggtttttgctcttaagcaaacctattgtttctgatgctgtttgcttctctccctctccatctccctctccctctctctctctccgcctccctttctccctctccctctctcccgctctctgtctccctctctctctccctccctctctccctctctccctctctccctctccctctccctctccctccctctctccctctttctctcagtctctctcactctcaccttctggtgagagagcatttatggtaaacaactcactttaaattgaggcctggtactccgtaattgagaggtattcctgttgctctgcagaggtaagcccccgtcagtcatgcctagactctgctgtcccagggaagtagaacccaccatgtaagcctcttcttactcatgtctctagtatgggatttaaaaattctcttagtgaaaatcatgtgttaaataatgagtttaagctggagtgtgaaaaataaggttgttgagaacggaggacagctatgtagggtgagtcttggaggacggctgggtcttattgaggtcattcattcattcattcatccatctattcatcggatgtttagtgactgcctagtatgtgatacgtgctgagaatataatgttaaatgctatatttttcttgctgccaggaagctcagctgtggctcccactgagtggtaagcatgcatttggattgctgtgtagtaatgttggtgagaatgagcacaagtttagttcagggaagaggtagactgttcagtttggggtcagacaaggcttcacagaggttttcagctttggaaatctgaaatatacatatactcagagttgatgaggctttgggattgacttcataagatggtcctaggagttggtatctgaagacggtggaggccagttagtactttatagaccttaaaaatattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtggacaaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaggtgctggagaggatgtggagaaataggaacacttttacactgttggtggggctgtcaactagttcaaccattgtggaaggtcagtgtggcgattcctcagggatctagaactagaaataccatttgacccagccatcccattactggatatatacccaaaggactataaatcatgctgctataaagacacatgcacacgtatgtttactgcggcattattcacaatagcaaagacttggaaccaacccaaatgtccgacaatgatagattggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacgcatggacacaggaaggggaacatcacactctggggactgttgtggggtggggggaggggggagggatagcactgggagatatacctaatgctaaatgacaagttaatgggtgcagcgcaccagcatggcacatgtatacatatgtaactaacctgcacattgtgcacatgtaccctaaaacttaaagtataataataattaaaaaaaatatattcccagttccaccgttgcctttttctgctctcagggtacatgggaactcaaattcataatcagaccatgtttggtgcgaatagagtgggggcaaagggggtttatgtttctgaggtttatctaggatgttcatccaggcttccctatatctctgccagacagcagaggtctttttggtagaaggatttccataatccatgtattttctagaacttgttggctaaatggctaagtgaatgttttttggagtgctaccagaccctgcccttcctgttaataaatagattaattaattaatcagaaattttcttaaaatttagatgtacatctaagttggataaagtaagatcttcaggagcccttggccagtgtcagtatagaacatctacctgataatttcttctagagaactgggcccacttgggcttccccttggtaagagatgctgaggttctggttgggctggtcaggatctgatatgagtactgttgtattctctttacttcctttccaattgccatgagaggggagtctctgccccacatttttaaccagtccttcaccagactcttgggtcttagtctgtgtcatctcttcatgggcccttagcatgttctgtctgtgtaggtcctctcagtaaagtccttcttaaagcacaaataaacaaaagccccatcttcctctaactactgctccaggcacagtgaactgattttagttcttcacaaccttttcacccctgagcttctggcacataacactcacccctagtttagaaatccttatgtctgcaaagcctctgctgacactgctgaatgtggggtctgggcttctcctccacaccagtcttgctgtctctgttacgattattgctcctctgcacactttggaaggcagcacagcacaatgttgaagagcatggccctggagtcccgactctgtcacttagtgagctgtgtggcctggggtgaattacatagcttctctgtgcctcagttttctcacctctaacatgggaatcatacttggacctatttaaccgtgttattagaaagactgagataatacatgtactgtgcttagaattgtgcttggtacatagtaagttgtctgtaaattattactgctatcgatgccacattattactatttttgctgctactaggactctgtttttgctagtatactctgttgcccccactgtactctgagttgagtgaggtcagggttcctgtccctcattttctctgtcgtagcttcagtgtgtgggcacatacattctataggtgcttgttgaatgtgtgatatgctaggacagaggagtgggagcgaagagggatcttgcagggtggggagacaatggcattcagaggcctcctgctggaggacgtgtcttcagggctgagctatacctgatggctggaagctagccaggaccaaggatcacatgacagtagcacagaggccccgagggttggtgggggggcggcagggggaggtgggagaagatgggactgcagaggtgaggccagcaaagaaatgggagtcatgctgggcaggtcggtccagtgaggggagcagggtgtggccatatgtgccgtgtaaaattatctagtcaccatgttaaagagcaaaaagaaacaagcaaaattaactgtgatatatttcatttaatgcaagatatatccaaaagattgtgtcaacatgtaatatttaaccatttcaacaaatcatatttaatagagaaatactgatgagatattttacattgtttttgtactaagtctttgagatctggtgcttttgtacttgtagcacatctcagtttggattggccacattccaggtactcagtagccacacatggctggtggctgccacgtcagacagcatggcttggtagaagacagttgagaggtaatgggttttgaattaagacagtgtgggtggggagcggtcaggggagtagaactttacaggatgactgccatgtctcttgcttactagatgagtggtgacctcccagttgatggaagaatttaggaaaacaatgcaaggtttatttctttaatatttttcaggaataaaggggcaggaagtaagatgagttaagttttagagtttgagatttcgttgagacattggaccttgtggatagggagcttagtagagagtttatgatcttgaggcctgggaagaggagcagaagctctttaagcccagcataagactccctggcctatcccttcccctcctgagctgagcccaccactcacttggacatcctgtcactactcccatcctttctctggcttgagggctgtcttcttgggcttcagtggaagatagataatcacctcccaccccgaccagtcagtgggctgtggtcagagaggaaaagaggagcatagatgggtctgacttcacaaacatgccttaaccttcatctgcagtgactgaaatagttctttcttttgttctttctttttttttgagacagagtctcattctgtcacccaggctggagtgcagtggcacaatcttggctcactgcaagctccgcctcccgggttcaagccattctcccgcctaagcctcccgagtagctggtactacaggtgcccgccaccacgcccagataattttttttgtatttttagtagagacggggtttcaccatgttagccagggtggtctcaatctcctgacctcgtgatccgcccgcctcggcctcccaaagtgctgggattacaggtgtgagccaccgtgcctggcctgacagaaatatttcacagttcatgagccattcagattttaaagtttatttaaaaattatgtacaatgaaatcacaagccattttgaattaaaaagaagtaagattgagatagttcaactgctactggaaaatgtctgtacctttttatttttgatatcaaattctgagatctttttctgggtctctttctagcagtacttttgtttggcagtgtctctgggaatgagatgagggattgcaattagttcatggcagaaagggaatatttgttgcttgttgactcttatttagaatattcaaagatgaggtaagaagctcatccatctattcagccattcattcattcattcattcaccagtcaacattgttgtgcatttacaatgtgctggatgctatgtgaggtcctgaaggtattctcccctttaaaaatcccagttaccatgtagtgatgtaactgtaacaaagagataaatgcagacttgtatgggagaagaaatgcagggccaggaaggaaggtgaagcttgagccaggtgaaaggggtgatgaaggagaaacttacgcagacatagtacagaacatgtagctttcatagaacagcaaatgttgcaatattgccttgaaacagtcttcaaaatgtgctttcatttatgtgtgcatttgttagttctacaaaaggttcaaggcactgtgttgagcgctctggaggtgcagctgctttaaggtgtaaatgcacgaggcagcatgagtgcccttttcaagagcagagagcacatgagcagctgcagtacccagactgaggagatgtgacatccacattaacatttgaaggtgtcgtgggactttgatattccacccgcagacaataggcctctggtatgtgtcagtccctgcattagatgttggggatatgcatacacacacacacacacacacacacacgcacacgcatgcatgcacacacacatgtatttatatatgtgcatacacacacaccccacacacatatgcatgcatgcacgcacgtgtatttatatacatgcatacacacacacacacgtatgtatatataaatgacaagagtataacatgctgctgtccttcagcccctcacagtccagaggacctaataatagtcagacaacatgatgtatgttacttggccttgtgggagcacttgactccacctggagagattggggaaggccttgggaagaggttatatttaaactgagttttgaaggttgagtaggaattaacttggagaagagagtgggaaaggacattctaggcaggaggaatgataaatccacaagcactaaattgggaaagagcaaagtgcctttgtgcggctgctgctgctgagcttggtagggtgcagcgtgtgtggtggagaggaggacatgggccaggagggccgggggcagccccgcaccagtggtgctgagggtttcagctttcagtgtggttcacagggaatcaccagtcagttgtacagaagcatgggcgctttacattttagaatgatcttgctaaaaccagaagatttgctgacgaagatgagactagcaggagactgtgccatgcagacatggaatcctgatgaccacccagacttaagggagaacatagaggaaccaagtcaggaaaggacagacgagggaagaatggtcagtgacaagatataacagagagtagtggtgtagtagcaaagggtttccccaactttggtttttgaaaaacttctaatccacagaaaagttaaatgaataatacagtgcacacctgcttatcattcacctagaactaacagttgctaacactttgtcacttttgctttaatctgttgctgtcattgccctcctaaaggaagcaagggtggccatggagatattttggcaagaactctgagggcagagacagcctgtgcaaagtccctgaggtagaaggatgtgtagcttgttgtctgctggtaaggaattgatgtggctgaagtgagagaaagggggggaattatagaagtgttagggaggtagcagaggtccatatgattgagggccttgcaggccatggtgaggtgaggactttagatttttctgtgagggagatgggaaggtactggagatctttaagagaaacgtgatgcgatctgatttgcattttgaaagaattgctcagactgtgtagcagattaaccagggtagacggtagggctagcaacaggaggtcaggtagagaggtgactgctgtagtccaggcagggtctgatgtcacctgaataaggatagcagtggggacaggccactaggagtgtgtcctttgtctacattgaaggtggaggcagcgtgatttacagaatggattagaggtgattcaaatgtaagactaagtgaagggtcaagggtgactcaagtttttggcttctgctactggtgcagtaacagtttgtggagaaatcaagaacctgttttggaatgccttaaatttgaggtgcctgctgggatatctgcatgggtatatggactatacagctgaatagagaagtctagagttgaaggaagtggtgtggactggagaaaggactttaagaatcattgacatataggtagtatttaaagcaataggtagattctctcgctgggagagaaaaaagcacagatagagttgagatccaaactcggaggcctggagcgccccagaaattataggtcgagaagttgacgagaaccaggaagagcctggaagataggaggagagagggctgtcctgcatgtcatgcgaagaagcgaggagtgagcagctgtgacaggtgctgctgataggtcaggtgggatgagaaaggagagccttggagggcaccttggtgagagcaacttttgtggaatattagtgtgcagtcagagcaagttcaagaatgaatgagaggagaggaagtgaaaacagcaaatattgttgctctttcaaggattctgctctaaaggggagcagtgctggaggaagatgtgttgagaggctcagtagatgcttgaagaagtgaagaaggtgaggtagaaggatgtgcagcaggaaggaaggtcaggtaggagacaaattcaaaagtaggttggtaggtcactttggaggagatagctatttaaattagtccttgaggcagacttgttttaaatgactgaaagaatgttgctacaagggtgttctgtgttagagtgactgaaagccagtgcagagcttgccttggctggtgctcagtggctgccgaagctcatggcactctggtggtggatatctgtgctgttgcagccacatgctcagctgtgctgggaagaatttgggtccccagaggcttcctgtccttaactccctgaagtcaatgctgtctccctgcccagcagctctgtgcgggactcctcacggtgctgggactcactctgagtgactgctggttcttgtcctttctgctttctctttcttctcccctctctcttcgtggtttgtttgctgtggatctaggacttcagaggttcacaaacatgaatgaagtttttatacttaagcataattattctgtgcacggtgaactgtctaataattattattttatgacatatattcagcatagactaaagttactgcgagaaaacctcacagatgttagttaggtatctgaaatgagatggtatattataggtatgttgttctgaaagtttttttatgggaaaagtaaattgtatttgaaggtttagtttagatttgtattctagtatattttattttattctggcatttcatagtttttcaaatcaattttatttttctgtgtgtatctgagaaacttccttaatactcccctctgaaatcatttttacttcccccaccccgtcttacaaatacttcattccttactccattttcattttcgaagtgtggagatagttattattgaagcaggaccagagcagagacccccagatggtctgagagttagaagagactttatagagatcagttcatccaattccattctagatgaggaagttgaggcatcttgagttgttttcccatttgattattatgatcagaaaccaaacctaatattaaatccttcaaggtttactatccttccttctaacaacttctctaaaaggagccactcacaggcagtgactggtgtacttggatggggtggctgcagccctgcaataccatgggctgcccagtgttagggccatctgggccagcaccgctcagaccctgccctccaacttgtattagtttggtccttcctcattgagataaattcgttctgcatgttgtttcctgtttgccagctgtccctggggattgtgggggtggtgacagattcaaaaacctgtgagattgctcctcaagtaattgctatttacatttctgaatttgctgtagtagaaactgaagagaaaatctttaggctcttggtcagtactggactagatatcagacgactattacattttggtactacagagttcattcaaataattttgaataataacgttaagctaccatgaaaaaaaaaacctgcactcctttgtttgcaataattcatacataaatactgctaaaacaccccatcttatgtgactaagtacattcttattcatcaccccaaattgtattttaaatgagaatatcagaacattaagtatttgtattttaggctgaaatgaagatattctgtcataagtcatctaaagtaatatgttttcaaagtagggatgaatctttgatataaagaagttgaaatagaaaaaaacctcaagtataaatccttttgtaatagcatctctgtagcatttttcaaagcgttcaggtatttccaaataaactcatgtttaagaactctaactaaggctgctgaatagatgctaaggccaggctaaatcacacagccgtttaaactgaaacagctcagttcagagggtactgctgttttataaccatatttaaaaatgtgttcctcttttactccctcaaactgggttcagggatataatggatcccattataggtaaaaggtctgtgactcagccatcgagctactcaaactcttggctgttttaattgccaccattaaagctttagtacttttatctcataaaaatagatatcattgatgtaaaatgtgtgcctattgaagatacgtgtgtacctctgcccttatagttagctaatcaaccatttgagtttaaagttagttaggttttatgcagatgggaacatgacatagatcacagatttgttcaggtttagtcatttaattaagaaaaaaattccatgtagtagtaagggcaatatctaactagaatgtcttccaagatgaaacttattttgttttggtttgccttttaactacatttaattgacggaacgatggtgaatttttactagtctctttcttgaaagagaatagtgttttttttgtgattctaatactgtgacttcagtgattcaaggaaatacttgaaccactcttctgtccctatttgacacatctgtttaagtgtggtaattggagatgtttctctggttgtattttggtgtatacttgtagacaaaaataaagccctgcaaaggggaaaataccaaagtgtgaaggaaacttcaagaacacactggaaactaaatgttaagatgtgaaaagctagttctttctgggctttttcttccagtatttgagcatgtcacagccattcattattcatattgtgctatgcaaacaaggtgcagtgactctagaagagttctaaaatgagtacatctcaggaaagcttaactgcctaaccactgcgtacatacacattgctttctctgttgtgaaaataaattagcaaataattggtgggacagtttattaagttattctgttctgcagttgttattgagggattgtattcagataagagagaaaatctgactgtaaaagggactcaaatctgaacagttctaaaactaaaacctactcacacaaaacatttatgagctgatatacataaccaggcttctattcttgcccagctgtgtagattcaattataataattttctcacttgcacaacactgctgtttgtttattattgcgttattagttagtgaatgaacctccctctttttgacccctcagcagtgtttataaaacacttaattgctttggtgtcttctgtttcatgtgtagttccagctggaaggagtcatggggacacagtcccctctaagtgttaaactgactgtttgtaatatgcagcaaactttctttccaagtaagtatcaggaacctttaatattgcttataacacagctgcttagatatttttgcttgaaaatgcagaggtttttaatttttttttcttttttaatctccctgtgatgatttacatggtagttaactatctaacttgttagactctagctttttaaaatgctcttttgcttatcgtaggcactccctttatctcacctggactcttcctgtctgaacgggtcctacctctgcccagctgttaccttacaccaagttctctttgccattacatcttccacttctttggagaaacttaagcagaattgtgtgagcaacaacgattaggtagtaggcataatgtttgagaatgtgggctttgccagaggttgcctggtttgaatcttgattcttcttataaccagctttttgtgatgtgcagcaaatttcttaacctctttgaatgccttcatttccccatctgtaaaatggtgataacttcactggttgtctggaacagtgctgggcacagaggtgctcagtgatatcacagcagtggcctctttacaaaggcttaatgaaggaagtcctgctgtgctgtctttatgtgaaaggataaatatctcactaggaaaggggaatcctaggtagaaaaacaatttcagatgagagttgcagaagattttaaagtatacattagttatttattgttatgtgacactttacaggttgactatctctcattcaaaatgcttggattgagaagtgctttggatttcagatttgtttcagattttggaatatttgcattatgcttatttgttgatcatccctaatttgaatatctgaaattgaaaatgctccattgagcatatcctttgagtggtatttcagtactcattaagtttcagatttcggagcatttagatttcagatttttagattagggatactcactctgtaccacaaactttatggcttaaaacaatatctatttcctctctcagtttccgtagatcagagtttgggcatggtttagctgggtcctctactcgagcctcacaaggctgtagtcagacgtcattaggactgtgttctcatcttgactggggagtcttgactggggaggaatccatgttcagattcattcaggttgtccacagaattcatttcctatgctatatgacttgggtggggggcttcagtaattgctggctgttgcctggggccaccttcagctcctgaagtctgcctgaagttctgcaccatgttgggttccctggcaacgtagagttcccaccctcaagaagggtccccaccctctttaaaagtgtcccccagtcagacctagccagaataattgccctttaagtaactccaaaccaattgatttggaaatcttgattacacgtgaaatccttttaccttcgctgtattctgttggcttgagggtcgcaggtccctccatagtcagaagatagagataatggggccatcttggaattctgcctccccacaagatgtacgtgagtttttataggacaagagtagtctgtcattaagcaattattgaaaactaaatttgccagactctcaatctttgaatcctggagaacttgcctagagtgtgtaaattaactttatcactatgctccttataaattgattttttttcccttcaaaaattgttttgttcccaattctgcacaaacccctgggattgttcagtgttgcagacacacctttgacagtctttgaagtttgacttttaaaattcttaggaacagcatagtaagttacttttaatattgatccttttaaggtagtagaaacttaaatgcaaatttggtaaaaattgcttttccagaaccaaattctgcatttcttctttccagtttaaagattaaacatgcaaagcgttttgaccagccaggaagcactgctgttgtcttttgttttgccaagtttgatccttagtaagctgggtagcttcaggtgtgggtgtccactgccaaattcaaacttccagacacctctttgagaacactatggaccttagggccaacttgaaacaagacagatgccttgagactgaaataggttctatagattctcattcctgtatagttactaaggtgagcccactaagggaagggcaatatgcaaggtgatgaagaaaagagagaagggagagaatgaaatttactttgttaaggcccatgaacatactgtctttgtcatttttacttctagaaaataatgtccagtagaagaacatttgctgatttactgccataaggagctcaggaatttagaacaagagggtgaaagtatgactgtgtctcagattcctctaatgggctcatattttggtttgcttatggttagtcagaggcaccatgatgttcacattggagaccctgcgttttgttgggttattgctcttgttctgtcatttccattcagtcatttataaagcagcaacaatatcacccacctcaccaacctcatagggttattataggaatccaagagaagaggtatgtaaaatgttcaacagagaaaataggtgggcaggcctgctgcctcaggggggtacccctctgcttgtggcctgggagatctaggaagttactcactcttactgcaataaactttgtattgtgttgcatttgtggtggtttttgtttcttccctgcccagagaaatgatggtttctgttggccctcttttttctcacaaaattacttcagggataggagatgtaagatcaggaacacagtctaaatactggcataccctttttagaaggctggcacatgtaaaaacatcattcaagtcttgtataaacaagctaatttttgcaagcatttatgaagcaacagagacacatcaaaagcatgttcaatttagcattagctcaactctgtgccctaggggtgtgtgtgtagataaacaggctgtttcaactatatggcccctaagtgcaagcctgtgacttcatctggtacttttcctaagaagtagcaatgaatctgtgacaaagatggcgaaaactggcttagttacagtctttgaaatatagtagatggtgatttggggtggggagagttttcaaggcagggcaaggagcgggctaatttttttgtggttcctgaggaattggttcagtccctgggacaaattaggcctcgatattgattgcattgaattatgctagtggagtgatttttgagaatcatagtggataatgtttgttggctgcaaaacacaataagaatgccagttcttacctacatttttatctttgggtaaaaggttagtgattctctacagctttagttcggaactaaactagagttcttccctgaccctttgaaggcaaaaatctcaaatttgtattaaattttttagccatcttaacctgcagattagggttaggatcttaaatagaagtaaggcctttatggttttggagaaggacagcagtctactccctaggcttgtgctgtggctacaactagggttggagaactccacagccactccctctggctgaggataccactgttgggggtcctggtcacattccagaccttctcacaagaggcttggtaaagtatgtggattttgtagcagagctcctatgttaggattccagttttgccattttctagctgtgtaactttgggtaaattaatcttaaggtttcggttccatcatttatgaagcagcaataatataactcacctcaccagcctcatagggcattacaggaactgaagatgaggtatgtaaaatgcttagcagagcacatgccacatgtaactatacaacagatgattaaaggaaacattcagtacagtgttgcaggatggctttaggactggtactttggtgctgtctctctgctcagcaccctcttcccattgccctagaagggccaggctggggcagctttgctggcccagcagcgtggctctgtgcttgcagagctgaccctcgcccattggtacccctgggcctgcagggcagcacccaaccaagggtggacaactggtcagagtcatgttggttgaaaacagagagacaggaaaggggagaaggctggaagggcagtggtgggtatggcggagggtgaaggagctgggagcaaacaccttgctctcctccacttgcggggagctttgtttcatttagaatttctcagacatttagaaaagggtttagcattggcagagtttcactgcttatgttatcccagtcaatctgactatagaaacaccacagcatagtgttttacacattgtgaatgctgttggacagttcctgtggtatcactccactcctaaatatggagaacatgcttagtatgctgtttctgatgtgaaacttttcaacagtaaatctaacatgactgcttggttcattatttccattgtttcagatgctactaattcagaatgtgtttataatttagatgccataaaggtggctcatgttaatttgtagccatttaagattttgtttatatggtgaatctgttctaaggacagctttaaaacacaagcagaaaggcaaaggttcaaaaacgccttcagataatttttcagctagatgtttcaacagtaatttaaactttttatttttaaaatttaatgattctgaggtacatgctaagataaattatttcattatgctatttcaaaattcattttattttactttgtaattatcttgacatataggaatatgtaacaaaaattatacaagtcattcttatatgcttatactactttattcctaccagtaacttaaattgagaataaaataaactcagccaattcagtgagctgtttcagtgcattttatataaagttatatttgtgcatagtgtaatatactatcttttgaaacatttgataatcaatgttttgagaaagacagatggacagatacacatgcttacgtacccctgtgctagagaaggtgatgaatttgccatgctatcactatatcagtataatcaaaagtatattttgaaggacattttaattcaagatcttcatggaaagaagggaagccatggctaaacacccttaggacactctctgtactgtctccagtgccccctttcctcagtctattaagggcttggaaagtcctgcagtgaagaaaactgaattttggttagcacagaattctttatttttgaaacggagtcttgctctgttgcctaggctggagtacagtggcgtgatctcggctcaccgcaacctccaactcccgggttcaagcaattctcctgcctcagcctcccaagtagctgggattacaggtgcataccaccacgcccggctaattttttgtattttttagtacagacggggtgtcactatgttggccaggctggtctccaactcctgacctcaggtgatctgcctgccttggcctcccaaagtgctgggattacaggcgtgagccactgcatttagcctatcacagaattctttaaactcatgttacctgagacctgtttttatgtgacacatttgaatatccttaacttgttctatactttttgccttctcaattaattcatatagtcattcagtataaatatgttttcctggaaattgttaagaatgagctgaataaaactaactggcatatcaaaagacttgaactcagggccctgaattcattaatactgattttaatcaagcagaaaatacttcagtccttgattctcttaagaatatttttgtgctttttattttatatcaaataattaaagtttattaccccagttgaccattcaaactactatccgctcatcttgatctcctcccttacaaagcagattttaaaagcttgcttgtgaagcatttgcatgcctgcagccacccagtctcaggcaggatttgttgttcaagctggttcctctgcctccccctctctctcagcctgggacagtttttagaaagcctccctggtctcagcctgggttaggtgctctgcactctttcccagcaggtactatggctgccttgtttactgttagagcctcaaatatttgttgaataaatatatgaattgggtactagataccaaatgcatcttcttttttatcagtgtcattgttataatctcaataggacttgccgaaacgttgctaaatgctcttttgaatcattgcacactcttctggctgaagatcgagcttcacttttcataccagaattccttttttgaagagtgtagaggggtcaagaacctggggaatactggaaaaaataaaagttaagaatgtctgtaataaaaatgtgtctccaaagccatttttaagataccaaatagtatgtttcagtcttaaatgactacttgctatttgtattttcatgagccatttaagcaatagtttagtgttctaaaagcttgtatttatgttacttgggacttaattggcctgcctcttcttcaccagaatcttattttctctgagagcacaagtgcctcctcctcattgcctccctttagcttaatttgtggggaggcttttgttttcataagtaccatgttattctggtccgcttggtaccatcttttcttttcctataaagcattgttttgattttagacttgtttgtatgtaaataaacatgtaaataaatacatttgtctgtaaataaaatgtttatccttgggtgccctgtatgacaaaatgttggtttgcagagatcatacatgtggaagcattgcacacactgttaacattgcatcacttgctcatgctatactcaaaattgctaacaggctgaggcttcagcagtgtaattaaggcaaaacatgatgaaattagatagctttttaagccagaaaatgctgatgaattgtggaagaaaagcacattgagataaataaaaagttgcttttttacatatcttttcattttctttgatgattcttctatgcattttgggttggatttgcttaaaagaagcagagggattgctctcacttcccccatcgggtctcctttggttaaatttgcatcttgtccattctgctgttttatatacgataatttagttgtatgtcttttctgatttatatgttgtgaacaatggagttaaggaaaagaacaattgtctgtagcttatggtaatgttttcaacaaaacacactcaccttagatcatttttatttatagtttaagtatcagttatgctgtttaagttccaaaagttcatggcagtctttatatattccataatgttccaaatgggatatggaattatagtagaatatatgtcaagcagaaagtttgacaggatgttatttaaaaatacctttggtatctaacattctccatgtttgctctaataaatgagaggttttaggaatgccctacatggtaatatcagatgttaatggcattgattacctgtcaggcagtgggaattgatgggaaaatgtctgctgtaaaattaaatagtattagagaagactgtaccatgcatctggtggggtggggggtggagggggggacatggctgggcctgggagactttgtcagggtattactgggagctccaggtttttttccccacatgattaaggcaggccatctgttctttgttaaatgtttacaaaaacagcttttctctaaaagatttaaggagatgtgggtctggtaaacactgtaatatttctgagcacctttttcaccctatttcagatagtaccaaaacataattctgctgcatatcaaacagaattaatacttttttgtatttgatcttcacttttttcctccttatgcaagattaaattttttactgagttactaatttattgcttcatttattactaaaaggagcatctaacatgatttgcatgctaaagtgtgtaaactttaaatctttttgtgttatatgttttatgctttttctaattcattactgtgtgctggggaatctctcattagaagctggtgttctgttactggagcaaatgccatgcagattaaagaaaggtaaacatacctggtattaattctccattctaagttttaatcattgtttagactttcctcttttcctctctttccagaaacagctttttctttcatttcctgaaaaatagcttgtcccaaataagtttgatctccgtgtcctgtgcaaaaaagatagggctttttcctttttaattacattaaggaataatatgtacaaactaactcaacttatgcaaactaaatataaaacagttaaatcaggtccattgatacttaggtagtgataatttggacagtgcctctgttgatgtgtaagagtgtttgtgaggaaaggatagaggggcagagggtaactttggcagtgtttagttagttgtgttatccctgcatggaaatctgctcatgtagatctacatctgtgtattcttcttcaaactttgaccttgcctctgtgtttcctatatatcgttactcttttttcagcctcattctcccttagctatgaccagcaaagggcaataagtattttaagattttttaatgccacaggattttggaagaaactttggaaatcacctatcaatcacctaacccaaaaccttcattttgcagaaaaagaaactaaccccagatgggtgaagtgattttttcccagatgatatagctgacggtagggcctggacttgaattttaatctcttaactcagagttctgggctctttctcttacaccagtgcaattgagtgaaacctgtgagcctttcccagaaagatgctgtgtagaagatgttaggaagaggtggacagaatcagaaagtactagagttaggaaactagattcaaatcttagctccgtcactaactgtgtgacctggggtggccacatcaccttcttggacttttcctttctgaaagttgggggtaaattatcacttttttgttatgagattcaggggaattaacacatctagcaaacataacctagcttggtgcatggcatcaaatagccgctcagtcaatattaggtgtattggaatcgaatttacagtacctgtattttaatgtttgattctaaccttcctccttttctcgtagtaagccttggcgtgtacagtagtcacgaggctctggagatgtgggcctgggctcgtctgcctgctcctcttctgtaggtcatgtgctgaggagtgaggactctggagctattggctctgatggcagtctcagttctgtcacttaacatctgtacctcctcggacaagttacttcatcttagagtggcggtgtcttcaactataaaatttgaagaatcacctaacgcttagggctggtgtgaggattgaatggtaccacggtgtaaagcatatatgcctggcacatagtagatcgtttacattacagttagtgttacatgccagaagaagcatatgagaaaggcaggaaatgagagacatatgtagatttaatattttcaagtattttgttgaaatataaatgttcgttagatgtcataatttatggtatagatgataatccaggcagccctgctctggtttggatggtgagctatgagggaggctgttgtatgcaggagtcacttcctctgatcttggctgaccactcagaatcccattctaaatgtggttatttttctactctatttaagatagtctctgggtgtatccctagtgaaagtcaagaacctcccaaaggcatgtcacattaatttatttgggttatctctcccttggtgaaattttgaaatataaagccttaaagaggttaagaaaaacatgttccacctttcatgtcaatgcaagaaatttcaccaatccaaaatcatcaagtttgggtatgtgcttttaatttgatattttaatgttgtttaaaccagaaatgacttgtattgtattagatttatgtgttatgtttacacttttatttcagactttcacagtactagaatcttgcaatgttcagtatacttgctcattttaaaaatggctaaattatataccttttatttgagctcccattcccacatggggctagaactcaacttagatgtattctttgtggcttagtcttggtgctgttttgccattcaccattttcatgtaggctgtttaaaaaacagacagtgtcttcagttgagtgagtttttacttcctgaactgatttttttttactgtattaactaaagtgctattttaaaactttctttcttaaaagattctctcttaaacatacattttttttggatgagagaagctgatagattctacaactgtatagttggaaaaatatttgctacctgagtatagaataagtttcagaaacatcagccactaactttcagttcttttctttactgtgaagaatgataaactaatttcaattcctatttgtgtctctcagcattccccgtcggagccctttctagagaaaccagtgccggatatgactcaggttagtggaccgaatgctcagctagtgaagagtgatgattacctgccatcaatagaacagcagccacaacaaaagaagaagaaaaagaaaaacaaccacattgtagcagaggatcccagtaaaggttttggtaaagatgacttccctggtggggtagataaccaagaactaaataggaactcactggatgggtcccaagaagaaaaaaagaaaaagaaaaggtcaaaggcaaaaaaagacccgaaggaaccgaaagaacccaaggagaaaaaagagcccaaggaacccaagaccccgaaagcccctaagattcccaaagagccaaaggaaaagaaagcaaaaactgccacgccaaaacccaaatccagcaaaaagtcaaggtaggctgtgggcagaaaaaacaactgcaaaacattgagagtacagaaattagcgccaaatagttacagcctatgaaatgaggggtgggaggggacacaatgatttttgtcatcattgagtttctttccctaatatccaaactaaaaagctaaggcttttacgcattctgaaagttaggacttattgttgtgaactgttgatttacagaccttactggatacaaattaaaaatcaattttttatatttttatgaaaacttatcatttagcaaatggaatgaagttagcagtataattatttataagaatagaccagcaacctcattttcagtgatgatataaaactggataagaaggattatagaagaaaggtcactatatttcactaagcattccagcccttcttcccagaggttgaaccaggattgttaattctctccacttggcggagtaagccttccaggagcagggttgaaatcctagtgagcagcgcaagagaaatcaaatagtacttgtccattggatatgcattcaagagtagcatgaattttaggttctagggaagaccctctttcactccatattccccccatcaattctctgaccgctcccccaatttcttaccccatttattcggtaagaaaaactgagaggagaagacattgaagactaatttttttcatttgtagtgaatgtttcttacaactgttctgaaccagttccagacatctgaatctgtttttcagaatgtggctcatgttagaaaatatagtttccagatggaactatggtcagccttggttaatccgaatctgtttgcaaactccattagaaaacacgcccaccccataccctcatgtgcacgtgtaaacacacacctgtgcatgtacacagtcagttctgcatttgctgtgaactttttgagattgctgccctgtgtgtgcatgcccaagtacacaaacagaggagattaattttgtggctagaaagatgttgccttgaagtgaaaggacaaacttggacttgcaacttcctgctaaaaataatctaaacaactccaaatacattattatgtgatgttttaaaagtttggatcatagccatttaggaaattttgccctcaacaccttttatggtgccaaagtaactgaattacattcagtagctcagtcttacagataacttaatatttgcatttacttgtgaattttctttgatgcctcagtgtgtggtctcctaattgaaaaccatcacttttctccccctctttgtgaacatgtttttaaacttaacactttataaaatctgtttttatttaagaaatattaagtgcttattatttgcaggtactgttttaagagttagggatgtaaggatgaggaagaaagacatgggtagaattttagtgtgactttatgaggtagtttaaaaaataagtaattacctaaatctaagtatatgcttttggtaggagaaagcataagcttatttctcccaaggagaaagaaatcaaagcaaaaatcttaaaaagaatataatcttttttctttaacttaaaacataggagtctgtgttctaaagaagctttttggagctcaggaaatacatcattaatattaatcttagcatcaagatatatatctgattccagctttcatcttaatttttaaatttatcacctaatggtaaaaatggattaaaaaaagaaaataacactttatattagatattgttatgaatttccaagtatgtctttttaagttctgaatctacatcagactggctctatgtttaaaaacttacttagcatacccttacctcttgtagagtcctttggggcagatattaaaatgctgtatttaacaatgaaatttgttaaaattttcccaacaactgtaagaaactgtttgaaagttggagcaccaaatctagttagtcccaggcatgccatgtcttcttggtgcaaatatagaccctgtgtttatccactagagaaacattcagtgcaagcctcataggcttgctgtccaccctgaagtatgaatcagagtctgtgcagagtaagtgtttggcattgctgaatctgagtgttggctttgcaccagagtcacaagcttttggtaggaagaaaagggtgtattttctctgaaaaagtgtctagtaccttcccccctcctgcggcttttgattaatagtctcagtcaatgcctgctataggcaacagttatttttaccctaagtggtgtgaaaataattggatggaacacgtctgatgagcctgcggatttacaggttaaacgggagctgctgcagtgtggcccaaagacttaggatgccacactggggggggcggggcacaaagagtgttggtggcacctctgttggccctggtcacttgaccacttatagggccactctgatttacaatgaagggtggtaaggacattcctgaacttccctgttgttgacagtcaaacagggatggctgtccaagcatacggtagttgaattgaggttttaagtaaattaacaaaccagaccattattttgttgaacctcattgtttctcttgatctgataaattgagtatgtcgcattgtggtctcgttgttctactaagtgtagaaaggaaacagcatccctggagcaaggataactagagtgcatacaactacatgtaaattctgaatagcatagtagaataattatgtaaattgaatatgcagtgatgaaggtaatagggggtttgggttatgttagtactgggtttgaattgccgtagcagtttgcttttaagcactggaatacaacagtggcaattttgttttgcaaaatgttatgtgataccagttatttccatccttgaataagttaacttgatgaatttgtttatacagaaaataattttcctacagagagctaaaatagagggaataaacagaaccgaaatgaaaaatttagcacagaactgctgacatctttactctgcagccctgtatgccatatcattgctgtgttgtacaaacaagtgtgctgttctttgagctggaggtaaaggaatcggcccgagggtgctctagctttctctgtgctgtgtcactgtcagggagagagcttggtctgcatcacttacactcaccatggtaaaggacatgtgaaggctggccgttgtcaggggctgattttccttgtgtgtctcctcactgtctggcaccccatcttgttctgtaaaatggcagaagcttgaatttgtgaccattcccagagaactggcctttttgacaactaaaatatgatcatacatgtctttcctctgcaggaggacctaaaagaatctgcccagaaactgttacatagagtgatggtgaagcaggaaaagatgttcagcatcacagaaaaagacatgtaaaaccttgatgagaaaaacgggccacattcctattctctaatcaggctgtatcttttttccctttcccgttttatgttaaatatatattttttgtatcgatttttctagtgttctccccagttgtccttacagctttcaaatattcgttgctaatattgaaaataacagcgaaaacatttgtgggttggagaggataccgttttgcatgtggaaggattcatggagctggaatatgaggatttgcatccttttcaatgcattttctgttgtgcatgcatgtgccttgtgagatgagaaagaatttggaggaagtgcttcctttgaatgactcttgaaggatttaatggtccatttagctatataaagattctttgaatgtacagaaagaagggaacttggccaaagattgtgacttgactactgaagcttaagttaagtagaacaacacagacttgctgctaatgcagtttctaggaatgcctttcattccttgctctatgctctgtccctagtattaaacttagtagaaaactaaaatgttatttttcaattaagagtgaagttttatttttacatgctactcttattttaaaaaaacatatatagtacgagaaacatgtgagggtgctttttgcaaatcatactatcattatcattaatagtagtagtatttgtatagcagctttctctgaggaactcagcttttcaaacattgttttctcagttacgagcttacagagtagcaacgtttacctgagaaatacttttactcagccaccaagtccaatggtggtgtatttttataaactaatacatattttatggtgtactcttgtatatgtaaaatttcttaatagagattaggcacaaaagtaacccattatgctagttttggtagtaagtacaaaaacctaaatagtcagatatcttcctgtcaggtacatgggtaataaaataaattaaaccctcagccttcctttgattttttttttttgtagctgtcctgatgattttcttattctttattttactcacatgctatgatttactcttggtggaagacattggacatttgaaaagacagaactaaatgttttgcaccctgtgcctgtggaagagggtagagatttcttatgtgtgtgatgataaatgaatctttgagccctttcagtgttggtgcccatggacatagtgtggctttgtctcccgacctgtcctacccagtctctggttcattaaatccaagcttgtgctccctttcctgctgcctcaaaggctgtcttttcttcaacaaaaggaccatagcatcttttaaatcccgaatccttctttcctttagggtaaccacctcaaggccttccttttgctagccagcatcagtggccccattgtggcccttcctctatttaatttcatcttaaactggctgagtaagcagggtgagagagtcatcagctgcttttagtacagaccccggtgtctttgacgtgtgtggttcagttcatatccatcaagggaagagattgcctaataatactgaccttgaaagcaagtttgccaactcatggtctgtgccagatgcagggtgggctacactgggcctgctggaaatttgtttctgcccatccagtgaactgcagtggactccaaagcagtggccttgttcccactttggtttatatgggagaaggtggtgtagatcccactttcaacttccactgcacctatcaaatggaagttcaggtgtaaggaggccgtgagccgcagtgggatgttaaagggagatttttctggagacacattccttgaaagtcctaagtggaattttcagatggagcgtatgttgccatacagtagatgtggttatgatgttagggctggcaggtaaagagcagaaggaatcataggctgattttatcttttatttaaataagtctatatttgtgaaaatgaagtgctgttgaaaaatgaaattctgtacaaatgcagtttgcacctgatatgtaaagatctttatgttagttgtcttctgcgtggacgaaggcagtcttcgggtgcttgtgcaaagccactgtgcagagcatcagtcatctgaaatgccagccctcacttcagccacctttatgtagaagtctatgtgacttagcattcagacgttaaataggaaatggagagtgcaaatcaagaaaaaagacacttctttttttttctttaagttagacaacacccttaaacttccatagaatactaattttatgtgtagccctgacttctgtaggaataatataattttgtgggagtttggtttctcctgttggggtggatggtgatattttcttctttgttgtttttaccatttatttaatctgccaaagtctcatctcacctgaggcacctgattgaaatgtgggtgggcagcatggctcatttgttgtgttagccaccctggcagattagagaccgtaatgatgaatctagggagggggttctgactgccagagtcccccttcctacttcataggattgctgtgcgtgaataagagcggcatcttaaaatgtggcacagggagtcaaatgtgtgccctatagtttggcacttggaaagatacactatgataaaaggccattgaaaggcctattttttatatagttttgtagtgtctaattggtttaattctttatgttatatctaggaagtggagagtgtgaatcaagaaaaaaggcactttttttaagtaagacaacacccttaaacttccattagaatactaatttttatttgtagccctgacttctataggaacaatataattttgtgggagttaggcttccattataatgccaggtgatgccacatagccaaagtgttaatgtctgtgttaagcttctgtgatcagataacacattagctaactagacttcttttccatgttacttctggcagatctgaatttaatccataaaactcggtaacttgtagattttctttctttttttttttttttttttgaaacagactcgctctgttgcccagggtggagggcagtggcacgatctcggctcactgcaacctcaggttcaagcgattctactgcctcagcctccctagtagcttgggtctacaggcatgcaccaccacgccctgctaatttttgtgtttttagtagagttggggtttcaccatgttggccaggttggtctcaaacgcctatcctcaagtgatccgcctaccttggtctcgcaaagtgctgggattacaggtgtgatcactgcacccagccccaggtgacttttttttttttgagacagggtcttgctgtgtcgtgtaggccaaagtgcagtaacacagtctcagctcactgcagcctcagcctcctgggctcaagcagtcctccctcctcccacctcagtctctctttttttttatttttattttttgattctttcagatccagacctacagagacttttttgtattttttatagagatgaggttttgtcgtgttacccaggctggtctcgaactcctggcctcaagcggtccacctgccttggcttcccaaagtgctgggtttacaggcctgagccaatgtacccagctggtgactaattttgaagaacttaaaacatttattaataattcttcattgaacttgaacatttattgtccatcagtaaaacagaattcttccctcttcctttcctgctaacaggtctcctctttctttttcaactagaagagtagggtaaagaatttgtggctggggcttaggagttgagggtggcgaggcacctgcttggagtgaagcatgtgggtgccaggccagacgcctgagaaccaagggtgcctgaggctgctgggtgcaggattgcagacatctgggcagcgcactgagcactagtggggccttcgccaaaagggtactggatatcttggtgtgaagttgttgacctctgggtttattatctgccattcagagtttgatttgtccccttcctcattagtttattctgttgtccgcgttttattacattctagtttagctgttaaattttagtcttagaactttctttaaaatttttattttgtggggttgattttactctatgatgtaccagattttatgctgctttaattggctttttagaacttcatactttatcttttttagtttgcctttttgtcttttaattttctttttcattgtctaaaaaacttaaccaaatagtagacagggcttaaaggaaatgctctgctcttaagttgagaggctagacactctcctctgccagtattgagcccttggcctctaccatctagctgtgtattttagtgtggcagctcagatcattttagagttgtattttgtcacaaacaccctgcatcacattctgtgtggcatcccatgccacaaaaacatctcttttacttcttatccattaggttcatttctttattcagaagtcttttcaggatataaagtgtaagaatatgctttaatacctttcagtctttaaaagattataatgtaacattttggagaagcttgagtctctgaaaacaaacctgattaattctcatgacctaagcctcaaggttaatttttcccaatatggtgagaaacttcactaacttatcccatctgaagagactgattaagaactccttcccattgtccagacattctcattagctgaccatattcccatcacatttgggtccacaatgtggttctttttcaagttttctttctgttcaggacttagatctattaggccgacactaatcaatgtttaactgtgttctcttttgtaataaatcagggcagctacctggctttccagtaaattatggccgtttgtatcaagctttgtttagaaagccaacagaaggaattggttatctatactgaatccatccaaccccatttcaggtaatagcactaggccgtccttacgaacttacagttgtaagctgaacatgactacttgcataaaggtagattgcctagactatctctccatgtgacatatactgctctctgaatataaagtttgtgttcttcaaatgcctgcttctaagagtttgcattaagttggtgtatgccttggtgccattgggggtgattgcagaacttaagaccttggtcacttagctatggaccctgagcacatccagctacccaccagtgtaacccaattctcatcatgaaatgtgaaatgtaagtaaggctggaggaggagcagtggcccttcagacctccagcagcatcctcagaaaatgttctccatctgattacaagggcttgtctaaaatgaggagcagatggctctatatctcattgtcttgcttcatgagtggatggctctgtctctcagtctctagcctcatgagtggttggctccgtgtctctttagcctcacaagtggatggctctacgtctctctagcctcgtgagtggatggctctgtgtctctctagcttctctagcctcaggagggatggcctgctttttggtcattatcagtaatgatgtgagataatggtcacaaaagaggtttgtgagtatggaggcaaggtatgtagatggtattcttttctgttggttttttaaaaaatgctaggtttcactctatttttttgaactttagcccgattttactgagctttataggcgtttcatcaaggttgacgctatgtgggggtttcttatatgagttaatgagaaaaatatttagagtagtgcctggtacatacccagggctatgtatgtttctgctgttgttattgctattacttgtactgttgtaactagaccagttaacaattataagtaacctaccagagtaggctctagaaatgtaaacgtaataagacacagtttcttctctgcttgagcttacatgatagttggagaaagacacacatatagtgctttgattttaatacattgcagtaatgttaccaccaacttttgtgtattttatatatcccttgtatggggtacatcatgtgacatgtgggtggagtgaggagatcatgtctgatctagaccatggtgattagaaaatgcttcttggaatgagtggtgtccgcgcagggtcttgcagatgagtaggttgggataaaagtgtaagtagaagagatacatgtgtgttttggggaatagttctgtatgcctggaagcataagaggcaaaggttctggtacacccatatggagaatctcagacattatatgtagaggtttgaaacagaggaatgccccagtcagatttgccttccagctggttactctggtgacttgagatgagttttcaggtgatgttttggtggcattaccatgatgctgaggtgggaaatacaggagacagagcaggtttaggagaggaatgagggcagacatgatttcttcagtgctggtgccattcagggctggaatttacaggtgttccctgcacatggcctagttattcttccaactcacaggctgccatgtggctgtcggcttgagctaggcccatgagtagccatcactgcagctgttagaggagtcttgtggttctgtatctgcgtcaagcagctcagtggccttatcttcaatattgcaatgttggtttaaggaatgttacttcttaaagacattctcatccccccgacctagaacagtggcccttttcatacgttccagcttctgttgtaatttggaagaggaatatatgtctgtgttttgagtttgacattataaaagactagttttgacccttacggatataaatgataactatgcatgtggactctatgtcctttctccaccggtctgatgttgtatagccctgcatgtggggtgtgagggtgatgaggcagtggggagctgttgtgattaatagcctgggcgggaaatgatatgtgtctgaactaaagcagtggtcatgggcatggggaggagtgcactgtgggtctgtttgcttgcttattcttttagctagtgcttaggaatgtcgatgaaggctcttccttctatgtatgttgcttggatgaagtcatcctcagtgaagggggtcctgtctgtaagtctctgcagttgaatcggcccaaatgggtctgagccatgaccagagaatactttccagactcagctgcttgtttttcacatgggtgtggatgttaactatctgtgccattttctcatttaaacctcataataaatcttggaagactgtataaaatattaacgttattttacagatgaggaaactgaggctcagacaaattaagtaacttatccatggtcccagcctataaatgacagttcgaactggaactaaggtttgtcttgactcatatcagtgctcatatccaccattctagattacctttgtttgttaaaagaaaaatcttgacttggatatttttggacaaagcagttttaatacaacacttagttgaaaaatctcaattagcttattgcagaatagtagcaaaggcaatttaatttacataacttaattttgtccttgatggaaatgttggagggtggacactgaagattttgttgctttttttttgacttcctagggtgttctttgatttgtatattgatggatggaaatgcttagctgtccgttaacaacatgaatagtgaaaggtctgatgagtttagaaatctttccatactcagatctgggataagtgcttcccttatctacaggctttttgtctaaacatttggagagggactgtctgactttcagctatcttggaggttccatacagttcattcttgggaagggcagatggaaaatcattagcacttctctccttcagcaaattgatgtttcctcaaacctgggctctggtcggtttccagatagtaagccttttactcctgtaggaccacgcatgcagggcctggcagccctctaaattaaaccgtgtacatcgctctggtatagagaggtcactgtgaaaagcgcgagctgccaactcactttacctggcagtggttcaactctttgacaggcctacctctgatttaaacaaatttgagaaatatgtaaagttttggaagcagttttgcactgatttgataaaagaaaccacaaaacactgcagcgcaggtgttgagaatgtttgaaagctgattgagggaagcagatggctttagtcagtggcatccagccaaaagagcaggtgctggtcatgtgaccgctggttaccagggtaatctgattgctcttggcgtgcagatgaaaggaaaggggcccagtgttcagctgtagtattgtataatttgtggcagttagagcggaaataaatgctggaaatggaacctcatagtaggggagacttctgtccatgtgtagcgtaaacactaggacagttggatgaggaacggttgtatggatttttttttttaattttaaaaatattatgctttctgtggatctttcggagacagtttttagagcacggccttttttcttttcttttaaataaaaataactttttaaacctaactgccatttgctataatcttgaattgttattttcttatgtagctatttactatgctaaaatgttaacaaaataaaactctgagtattaagaataactagtttaagatgatcaaatattttatttagttgaaaaaatacattttaggtgtgtgatgggtagtttattaacaatacttttgaaatattttacatgacatatgctttattctaaaagcctatagatatcttggcttcttccttttgtagtagctgagggtaaaaacatgctgtttaatgcattctgtcagcacattttcctgagaacttacaaacttcaataaataaaatttttgaaggtttttgaaatacagcttttgtttttcacaatttattggaatttgaggctccctagaaatattttttaaaaaatcattactgaggttggattattttcagtgttggataacaaatagtaattggtgttagaaaatttgcaactgatggccgggcacagtgactcaatgcctgaaatctcagcactttgggaggccgaggcaggtggatcacctgaggtcaggagttcaagaccagcatgaccaacatggtgaaagcccgtctctactaaaaatacaaaattagctgggcatggtggtgcatccctgtaatcccagccacttgagaggctgaggcaggagaatcgcttggacccgggaggcggaggttgcagtgagccaagatcacgccgttgcattctagcctgggcaacaagagtgaaactgtgtctcaaaaaataaaaaaaaaactggagctgatttggaaatagaaatggaaggtagcgctaaatgtacataaagtcaggtaaaggttctagaggtaatggcaaatgtaaaacatttttttcttgaagtttatgtcttttgtcttatataatattcaaattctaataacatttgtcagcaacatactatgaaacatgcactttattagggttgctttactgtatttttatatttcagagaactgtctttcaaaaaaagggctaattgtgattatctcaaaaaacacgtagcaccaaaataaagcttatatttaattaagaacacagtacctactaaaattatgtacaacaggaaattgctatgtatttttattacattctaaaagattataagttgaacaaaaatgtaactggatggtataaaagaggataccttctagtactggtcaaaagaatacttaagtatgtaaaactatccacaaaaggcacaaagagaagatcatgatatcgtttttcatgacaattaaaaaaaagtgttctgtaccttaaaaattcgatagcaaaactacttcttaatctgattttttattatggcttgatatactggcaggcattttgcacaaatgtactatgtgtggtattagtttttgcatgcagtttatttttaattaggtcatatatttgctaaaagtcattaatatggagttttgccaggaaaacttaattgggagttgcatttaactgtaaatagccaatatgtatggatttatcagttgtcattgatacttttgggatattaatgtgggaaatataagagacatgcagaaacacattaaaagtgaacactaagcgatccactttgaattctagtaataagaaacctgactcagaagcaagtgctttgaagaaaaaggtcaacaagggaaaaacagaaggttctgaaaattcagacttagacaaaacacccccaccatctcctcctcctgaagaagatgaggacccaggtgttcaggtaatacaattattgtgattcccgagccttggttatttggcatgggtaactttagccatgtatgaagtacacaagacctcccctatcttgttatagagatgctcttgagatgtctttattgtagtctggaacattatctccatagcgatgtagggagggggagcgggcgtggaacaagaaattatactcctgacaagagtggcttggttttgctatctttgactctataattaataaggcaaagattcttcatttatttctgtaaatgtatattttgctgtttatgttattaacattgttaatatactggctcatataaagcttcattcacatttttaaatttctctaaagtttggttgattgtcacttttttgaattttgcagaattaaaaatcaagatataatttgtagtagcctgtctaaagtttctgacatctggcactcaaagttgagatatagtcatgtaatctaattcatgtaatactaaagtttctatgaacaagccagtgactttccaaatggcaactctgcagaatattctcccgactttaggagagttttataggaatgagttgaaatgctaaccctgaagtaaacgtgaggaatgtaggttcttgtgtgtaaagcatactgccttcactgattggactgagaaggacccttacaagtgacagttaaaaattatttccttgttaggttccctggaagcatgccagtgtggtccactgggatggctgggaatgtaacttatgtgaatgacatctaagttgtcaaggagcagttactgaagagttgtcctggagtaggaagccagcctctagaagcttactggactttttcttatttagtacacactcaggactttgcacctgtacccccaccagtcagaaacaaaatatttgtagtgtgcagctctgttccaaagaatttcagatatttttggctttggctttttgtttgttagagtagaactccctgatacctataacttcacagaatagccttaagctagacctgaaagggagggagagagagatgaagtgaatgaatatgttttggtttagttcggtttggttgtgtaactaacagtgatacctttggcagtgtgggttattatgtaattttattttatacatcaatggaaagatattgggaaggtaagtagatatcattttttaattgcgtaggctgttttacaactaaagtgttttattgatttttgtttttttactgagatctggtcttactgaatcaagtgttttaatgattttgagttttatttttatccgtaagggtattttctcctgatttatgtttgcttaaagcaggacctttatgtcaatagtatttggacaacattaagaatttgtttgcatcagtagaggaaattctgttatgttgttatttcacaaatactgctattgtttttttaaaagtctgtttatattaattcagactcagatggaccttatgaaatactagctttagggttttttttttttttcctgctgcatttcaaacatagaaaactgctaatcaattcaagtgaacattgatgtatcctttctaattggctagggcctaactgttacgtgttcaatagctaatataagcaaccacacaagatctgactttgaaagctgtgttttcttggtatgtctgacacaggaagtgatgctgactggttgtttattatgtttcttcctgtaacacatgcatgaagggcttagcattaaaattcttgagttttgtgattgatttactaaggtacatgtcatataattttaactaactcaaaattgtgtcacaaggtactgcaacagtgagatcatggaaacatttaaatgttctatttgttatacctgttttaagtatcttttctaaagcaatccaagtttaaaaagttgatatattattttagtgtcaattcaaaagttttgaattatggtttaaaggcagttcttacatttcattttgactcacaaaaatctttcagataataatagtttaccagatcacaatagaaacatgttatgtattaaataatttaattttacattggggaattgtaaaaggaaccttgatactcaaaataaatgtaagatcaattattattttaaaactagagaagccacgtaacattaaaaatttttatcaaattgagttataattgtattttggggtgtttttacataggaagtgacctcgtatccactgctaactaaccccatcactattgcacagatttatatcacaaagttgatatcaggaggaacttacattttaaaagttatacttaccaactcataaatttctatttaaaaagaagaaagcacactgtcttattgtactggatggaacccttctttaacatcagggtgggatttagcataaagtggatttgtcttagaccctatccagttacttatatggcacaacactgtgacagtggggtcttaagcagggaaacctgatgaaacatggcaggtagatcactaggagcacattgcttcttactggaatggtataaagatggaaatataaatgaatccatttaaattgagttaaattgacatatcaaatgaaatacaacatgttatgctaaattttgcaatattaaaattgttcttgataatggccttttatatcttgaagaaattggtggtccagaagtgaggaatggtaaagtgggcatgagagcaggagtaagtaggtcagctttggaaagaaaagggaagctgtacaaggtaactgggccatttttctttggaaagctggagctgattaatgatgactttagtcctactaattacatctcacattatgtaccatgtactgttctaaaagctttgaatgaattcccttatgcgatcttcatggtattcatatgaggtagttactgtcattaaccccattctacagaccaggagtccaaggtccacaaaattacttgtccaaggtcacatgataagagtcggggcaagttcaaacaagagcacttagctctaggacttacaaggtcaaattgccacctgggatgtgggaaagtattgcagatggcagaatactctgctggaatctctgtttcctccacctgggattgatctgggcagtgccaaagctttgtcctgtagaggagggtcccaggaggaacctctggcccatgtcactactccctccatgtaagccacaaggaagtctcttaataaactttttctagaatggtctcacatcagaaaagtactttgcacctctgtggccacagctgtgtgtggcttggagctaacaatatctaactatctatttgatggtcatattataccgagtttgtatcgtgaactgtctcaaatccctttttaagagcagggagaacataaacttaagattaaaatcaatcagtcccactctttggggaaaagtactgggattgtgttcatcctgacttgagaaatggtagtgcctgtcttgccttaggtgcacacaatgaatgttttgcctctctctgccttactttctcaactttaacattcttgagactctttaaaaagtgttatttcataattcttagaaaaaattttgtgtcaaaattttcctcaatatttttatttcttctttgtgctttgcaaactcattccataggttgtaatattcttgaattcattagcagcttaaaactttacatgtgtcattttcaaatttagatttgacatacatatatgaataaaaaggttatttctccttattaattagcttccaaaatgaattctttgacaaaacagttaaataatatagaattactctgaacagagttcagaacctcttgttctgttccatttgcttctctccccatctttatagctattaataatctgttgtctgtcttttcacattccttatttaaagccatgtacatatacattcatcttttagcaaatactcattgaggcatagagaagtaaacaagatatacagtctttttgtcttaagaagttaatatatcgatgaactgcacgtctaaatagatacacaacattttttatttatcttaaatagaatcttaagctacttcttgttatgtggcttgtttttcttcttattttacaattagtcttgcagatattcccaaacttcctggaagtgaaagtagtgagtcaaaggtctgcatgtttaagttttgatagataggaccacattgtcctgcaaggactgtgtgggttgcattttgaccacaggattgtgagaatacccagtttgccagtgatcctgctaatactggctattaccaatctttttaattttaaccactatggtaaaaacattatattttaaaaagtaaaattactgtccatagtcattcattatgaattttgccatttaacccttcatctcttcagaaattttcagagtatttcttttaggatcaagattaaaatacaaaaaccttttatttaaaatggcctgaaatatctggggcaccttggttagtattataacaatatttgtatagaactttgtaatttacagattattttctaaagcactgattttttttggactttttatatgggaaaaatgttaaaatgtacaaaggtagagagagtagtataatgaacccctatagattcattagccagctccagtattgctgccacttttgatggacatactgactgactgaggaactagatttgttatttccattttcccagttgaaggacatgtagctgggagtggcagggctacagctgtcccaggcgtctgactccagatttccacccatttctattgtatttgttagcactgtgatcttttcacatcatatataggattagcattatcaccttttccttaagattaatttaaaaaaattcatccttccactctgcgccattataaagaacatttttctttttttttttttaagacgcagtcttgctctgtcgtccagactgcagtgcagtggcgaaatctcggctcactgcaagctccacctcgtgggttcgcgccattctcctgcctcagcctcccaagtagctgggactacaggcacccgccaccacgcccggctaattttttttgtatttttagtagagacggtgtttcaccatgttagccaggatggtctcgatctcctgaccttgtgatccgcccgcctcggcctcccaaagtgctgggattacaggcgtgagccactgcgctcggccacatttttctttttaatcattaatttcaaggccactgtcttgggtttttgttttagaagagacggtccagcagacaggtgaagagaaagcgctacactgaagacctggagttcaagatttctgatgaggaggcagatgatgcagatgctgctgggagggattccccctccaacacctcccagtcagaacagcaggttagtaccagatctgtgggatttatggatgcattttaaagatggactagaaatttcattgctgcaatctgagaagtgcagtggaagcattggactttcagcaggggaacatccacctaatgttggataatgtgctatgggaaattcgttgtttagcaatatcttttaaaaagccctgttcactgcaatttatttttatataagactgtgatatgtaatttgacacaattttggagaattaatgttctatgctgaggaagagtcagagttggaatataaggaggctgaatatacctctgagaattcagtgctgtggcttctgggactttaataaaccactcaagcttgtctcctgctgttaggcactgtgagaacccctttatgaaattactgccttgtagtacccagcagggtgtactttattctctgtgcaatgtaaatgatggataaaacagtttgtataaaatatgggtagtgtaggattgattattgtaaagatcttttctaaaaaaataatgcttttttcttattgaaaagtatattaaatgcatctttgcattttatttggtaatttgttctatgttaagttgttacataatgttttatgtgacctccatagataaaagatgcctactatagcagaatgatgagtatatttaccccatgggtatagatgaagaaaagttatatttttgactgctaacgtgcagagattattttgtcttggtggctagaatttctgattgctctctagctttagggacctaggctggtccacgtaattaaaccatataatcatgaagtaatattaagcacagatctcctttttgcctttcagtagagtgagatttttgttcctttcaatcgtgtttctcactgataactttgtacccagtgacttaaaaggtgtggaggtggtagcaaaggggaatgatttcttgctcttatagcttaggatgagatgttttctatttggattgatgcacatgcctttttttttaggaatctgttgatgcagaaggcccagtggtagaaaaaattatgagcagtcgttcagtaaaaaagcaggtgagtgccattggagccattaaaatctgtgaggtgtatgtgactcttacaggattgttggctttgtaattttcttttaaaattctaatattataaaataaaacttccagtaatatttctaatcctgtctaatttattaacccaatatgaatctttgggatatttgaccccagatgaaattaaaatatatcaagcagtcagtgctttattacaccattcagagtggactagaaactcacaagtctccaaataaatgtatgggactttcagagttgtagactgcctttttcataaatattattcataaaaatcaaaacatgaatttacttctaatctctctcaggaaggttcccccctctttcatgttaggatggaaattctgtttgtcattttagcaagtaggtgttttctcatgtgttttgtaacattttctcatatacaattgaattattcattagtgtctttcttgccagtgcaaaggtgaaatacaggtctattttcagtgtaattttaaaaaatagttttgacttaatacttcagagttattcaaagtttctgttcatctgcaaaggtgagctctaagtatctgtcactagcctgctagctttgtcactgaggtactcatatgctctttaacaaaaaaatgccagtgacataccgtgttttcttttcctgatgaaaattccctgttttagctaactcccttcttacagcccactttgagaaaatgctttgcttagtttgaataattacataaacctgcaggtgcattaggtattacaacatgcagtttttcgtgtctctaggaagtagtctcctttagacataggtgtctgtgtcgcagcttcagtcattatcaattccacacagttcttttgtttttatttgctttcaagaaggatggaactacaagttcatgtttcagcatgtaaaacaaactttaaaaaataatatataataaagacatggtctagctgcgaactcctgggctcaaacatttctcctgccttgggctcccaaactgctgggattacaggtgtgagccatcctgcctaaagttgtttatttttagcaaaatgtatacaaagtatctcccagtaagagagttgaggaatggaggatttacaggactcagtgagagtcctataataaagtgagatcccaggcttatcaaataggaaaccattactattcaaatactgctattgagtgatccttgaacatgttattgcaccagcagtaaacttctctttactttcatttcattagtttgttttgctattgtgtgattcaaggtatgaatttttatcggaatatacatctctagtttataagaaaataatttagagcagtatgtcaaggtgttttccagttgagtataggggatacggggtatggagtgactggccatcttggtgactctttgaatgtgaagatttcctgatgaattaaatttcccacctgctcaagtaggaaacaagcactatttaactcattagaaggttgcatttttgtcctactaatgactctagaactgctaatttatgaattgtagatatacagtaaaatttaaatacttgacatgctttgaagaacaatccccttcactgaattgaagtgacttgtttgagtaaatagcatgtcgtttagatgggatatattaattttcattcaattggtagtgcttcagcaggcatactcagcaggtttaggggttgcaaattataattagctctattattcagagctatttagactatatattatgtagaacattgctttttctttctgttttgcccactttagggtttttgtcttcttttcctctttagctaccttttaaaaataggtacccatggtttaggaatagatactgttaaccatttaccgatgactgggtttgtcttatcataggagattaaaaatcactgtacaggagggtggacatttgttgagttgatgaatttgaagctggagaaaattaatggaaaaaattcttctggaagggagatatgctttgaggtatgatttaaaataaagaagagatgtggagctcatggaattgcttgtcagttactggtatttcttaaagggcaataaaaaaatccattagaaggtactaaacattaacaggtgctaactttttaaactgctaatattctcaaagtagatactttagttatcacctttaataacattggaagaaagtgttgcaaatagaaacaaaaggaaatttgagattttttgtggattcaatctatgcctgctggtctgtttcttattaccatgaataatttaataattggcagtgagaaggtgtctttatctctgccaggcagcactgtagaaactggctatgagctctcagagcctgtccctgcatggtgttgacccagagtggagactccatgtttttcaaagtcagttgacctcatcactgtggcctgagaagcatcatgatccattatgatggagttgtgcaaacataaaactcacctggcagaggcaccgtaagtcagcacctcatgttaaataggggtggctcaagcatttatgttgttctaaacccaggttaatgtctatgatacctagttgcatgaaatagttggtgcctatttgaattttgaggtagatatatgagtagatacttggattgtataaagcctaattattttgttttccttgtttagtcagcttgtagctgtttctgctttgagccattcatctttggaggataattcaaatccttttttttttgtatcagaaggccaaaagtagttttaaaagtgaattgtgactgtattccctaaaattctttatttttctttaagttaactacaggacgtattttcagagtgtgtgttttaagtatgtagctgagcctcctagagtgtaaagaaggcaaaactcttaatctcatccattgtcatgtccttattttttccctaagtgaactgtgatttggtgtctctagtaaagtatacagtagatagggccaaaagtgaaaagggattcatacccacgccttattgataactttattgaggtgctttttcattcttttgtgtattatttgacagagtgttctgtttttttgctctgtattttagtttcttgactgtgactacttaatttagtagtaggatgcataggaaaggcctaagttaggcctagactctgggtggctatttagaatccaggtggctggagaactcatttattgccttctcaaagtttctggtttgtttgaacagtgggacaagtatggcttaatatgtttgaaactttaagtgtcatatgaataataaggatttccctagactaattttggatctaatgaaaagatatatacatttctcagaaaaattctatttaattcataatattactgggttctcaaatttaaaggtagctgctcaagaaataaatctgagtgttgtgtgtatgtatgggaatagttctttgacttagttattcattgcctatgcctgttgtagaatggcttctgaaaatagggcttagaggtgagaggttttagggtaggggctgtttgaagctgtcaacagaggctggtcaaactgcctcccatttagtaaataattgaaatgatgtttctgagggcttatgaattcacacacttttgttcaattgttttactgttcagtaaaagaaaagaggtcagcatgatcatatttatatgaaaggaacggtgaaaaacagctctatttatagttttaggggcaagaaggtggtgatccaatatgtgtggtccattaaacagaaccaagtgttgtattctgaaacatccaaaagataacaggccctgggacacttctgtaccagctccaggtgctgctaaatgaagtttcagaacctggttggttcctcctaggcagccctagactctcttgtcaggcatcttcacagcaggttcccagaggaatagctgatcatgacaagaaaatgggtagtaatgagagttggggacagatggctgtaagagtcagagctttctgggaacagacttgagacaaaataaaaagtgtctttactgttcaagatttgatcctgtatgtgttggtgcccacttagaattatgggatgatgagaccatttagaatgagaagaaaagggacagtatgggagaaaagatcagacagaagaatcaggagaaataatacgagcatagacatgataaatcttgtttatgatttataacatatatatcagttatataaatgatacatttgatacatttgaaggcattgaaaatgccttcaaaattgaaaaaatataattattatcagaagggcaaaagctcagacatttgagttccattcttgatttgaatttcatgataatgctgtgtgaagaatcaaaggatctagtttcatccttgcttctctttttccctgatcatctaccatctttttgtctttctgctggaagtctggttctatataaagataatatatcttaaaatgggaggctgggcgcagtggttcaagcctgtaatcccagtactttgggaagccgaggtgggcagatgatgaggtcaggagattgagaccatcctgtctaacacggtgaaaccccgtctctactaaaaatacaaaaaaaattagccgggcatggtggcggggcctgtagtcccagctactcaggaggctgagacaggagaatggcgtgaacctgcgaggcagagcttgcagtgagccgagattgcgccactgcactccagcctggatgacagagcaagactccgtctcaaaaaaaaagggagtagaatggggaaatattaaggctagagagaaaaaggtagggtgggtcttggatggatggccacttgaacttggtagtatttatttataaattaattccatgttccatttatgttgctggttcttgaagccatccaacaaacatttctttttattttggataactaaaagtttatgacatagaaggtgttctgatacattggtttaaaatagtgctttatagttattacgtttcatagatccattatggcacaaccagatattaatagatattgaccactcctgcatatccagactccttcttgatgatttctagacaggccaaaactgtttaaaatataggtttagctcggtgtggtggctcatgcctgtaatcccatcactttgggaggctgagacggggggattgcttgagcctaagagtttgagaccagcctgggcaacatggtgtaaaacccagcctacggaaaatacagaattagctgagcatggtgatgtgtgcccgtagtcccagctacttggggaggtggtagggaggggcaggggttgctgaggcaggaggattgcttgagcctgggaggttgagtttgcagtgagccatgtttgcaccactccactcaagcctgggtgacaaagcaaatcctatctcagaaaagaaagaaaaaaaattaggtttaactgttataagtgagagtttcaaagaaaagtttaagttcacaatctttgaaaatggtttgaaggttggagattgaggggactagtacctttgaacagatctgtgccagtctgttatccagtagaagcctttgctcttttgtttgttctttgccatgttcctacttgccttgattttcttcgaagcatttcggaggtggctgaacagccatacatgaccctcaaggcaggcttggggtctcttgtaagagtgtaaaagcaatccccaaacatctgtaagtggtgtttatattttagatccctgatttatctgatcaaatgttccagaaggaaattacatattatgacttgtttaagagcctaaaaccaaaaggggaataaaaagagatgcctaaaataccatctgaacatcatcttctgcatacactacagcagataggattaagggagacattatagataatcttactactgaaaactcttgatttggctgacatgtatcacaattttaaccttacctaaatgtagtatttggagtgttaattttatttggctgctatgtgtgtgagacatcttgtctgagagattttaattgtaccattgagtgaaactaagactatgaatagtgatgcactgaaattacagcataagaacaaggtttacttttatatggtttcttgtttagagttattaagtatatggagaaataaatgtcttttaaatattttaaaacattacaaaacccacaatgtaaagttgccatgaggcagccaaaaataatacatatggcattcaggagagcagttgctaattggctgctgcctgagaaaatggtacacttggcgtctacttaacactgtgggtttggcagaaggccaaatttggggtcaggttgttgtgaatgaagctgcatgtggttagggaggagttaaagtgattcatgtcttagaagctctcgcacgttgagcagaggtgcgtgcatgggcctgagcgtggcagtcttcgtggccctggccacctcccagcacacggtgtgctcatcttacgtgaaggtcctttgctgctcttttcagtcctattttgtgctcatatgggagtaaatcattacttttaaaatattctagtagatggttttaaatacatgcctgaaattttcttttgttgcagaaggaatctggagaggaggtagaaattgaggaattctatgtgaaatacaaaaacttgtaagtaaattgtgattctgtttttaatggggggctatattttccaagtagtaaacgaccatttttttttaaagttgggaaattaagaaactttggtatgatttctttagtcatcatggcctgggaggccattttttaaccaacttttgtatgtttgatattttatgaatttttctggaaaatgtgtaattggtgtaaaagttgactaacttctgtgtataaccaataagtatttttttagagaggataaaaacttctacaataatagaaaaatgaataaagcagtatttccctgtcctctgatcatgaattctaccctgtggggctacacttcgtcccttcacctgtgcatagtgtgcgaggccctagagacaagaactctcctgtggaatgaaagctctagagaaccatgacatcactcaggttctaaaatgcagtgagctatagctttatctgtttttgtttgtttctgatatttatttagtagatttgaattcataacttaaaaatctgaattgaaaaacacggtgagttgttgtccttgtagattctgttgtaagcagtacacctggcccagacagatattgtgatgagctaggatgttttcagagtcagtaatcattctgctgaagaagactgaggccattttgtaacctaaataacaatcatagaacaaggacaaaaatgttcattgataatgtaaacattaaatttcttttttaccccttttaaggcaaagaactaaaccaccatattaatacattcttagggctttaaagagaggcttttgtgagttgctgtgcgaacagcctcagaaaatttaccccaccctagaaaatgaaagcatcaggtgccatgggttttctgtcattctctcttgttgtagttggcactgttaataaattgatgcacttctgaagaagttgtgagtaaaaccttttatcaagtaaaaagataaagaagtctctatcagttttatcatgagagttcaatgaaatacagtctgacaattttaaaaatgctcggaaaatgttaactgtcatcattcttttgtcctcagagcatgtcagtttacacatgtggaaattatgcctacaacacgatttcctatggtaaggaggaggtaaactaagtaaaccagagggagagagttcccttgtagatttaccaaattgaaacaagagcaaaggagttcaaatatcaatcaccaaaataatggcactaccagagagacctccagatcagtgtgtgacagtgaggcctgagctgcctccttccagtcagcctgttagtgaccccagagatgggctccgagttcctgaccaggtgccagtgccagaccaggagactctagccctcctcaaaagtcatttgaggtgaggtaaagggagttttgaaaaaaaaaaaaaaaaaaaaaaaaaagaaaaaaaaggttttctgactgtcattattgagagctaagagaaattaagatttccataaaactaagagtttttgttagccttatatttggatacaatttcacatttatagaaaaattgtaaaaaatagtacaaagaatttctgtttttctttttgtagttaatgtgtatcttccggaaagatactttaagacttaaatatggttgtggttgctaaggggtgatttactaattccatcatttcttctacattgattggttgggtttttaccgtaaggaagagctttaccctcttgtctatttgttaatttatagctgagcggacttgtggcttctcattttattcaagggattataactctttactgttgtagtatttactttgcccacattatcccagatttggtcagtgggagccccttcagactggctcttctgtctttttgccttgtccccatttttctttgaacattttcttgctttctggcaccagaggatgttccaggctcatctcgtaacttccctgttttagttatggagtcagttacttctccaagaaggcttggttgttttcagtgaaggggggggcattgagaaaccaagattggggctttaggtgtgctcctcgttgctgaggaattgttgcttctagtccctctcagtggataggactgggagagagagagagtgtgtgtgtgtgtgtgtgtgtgtgtgtgtatcgagttacacacacacttatctgtttattatatacacacacatatttacctacctctccaacacaacagcaaaaacaatgtgtatatattgatacttccagtattattccagcagcccagggttcattctctcctttcccctttaatattagtaattcccttcttcaaccagaataaacctggctctcttattttttatgtttgctttttttcagtcctaacatatataggaagtgatttcagagttactagcccatatttctgtgacaaagaagcctatatttggttagctttttgtctttagtttgagggcatagggactaaaactttatccaaaatgtccttgggttggttattctcttttcctaccccaccagtgtggtttgttatttatttcaggggtccccagtccccaggccatggatcagtactggtcagtgtcctgttaggaacctggccgcacagcaggaggtgagcggcaggcgactgagcattaccacctgagctctgcctcttgtcagatcagcgtaacattagtttctcataggaacgtgaactctggttgtgaactgtgcatgcgaaggatctaggttttgtgctccttatgagaatctaactaatgcctgatctgaggtgcaaccgtttcattccaaactgccctccaccaaggacccgccccagtccgtggaaaaattgtcttccacgaaactggtccttggtgccaaaaaggttggggcctcatgatttatttgatacacagtatgtttctttagttttggtttgtatttgtattcccttttagcccccgcttgttgatttttattgtttttcaagtttgtgaaatattaatatgttacaaaagtcagaactatacacaaaagaagtgtagtcctccctttccaccccattcctgcttacttccttactaatcccaggtttatcctttctgtaatttttggcatgagcatgcaggtataatttcctcttcgttcttacaaaaaaagaaattggtatactgttagtacatttttgtgctttgctttttttcacactacatcctggaaatcactctacatctgttcataggggtcctcctcattctttgtttcagctgtataatattccattgcatgactgccgtaaccattcaaccagcctcctgtgtatgtgggtgtgtaagtggcttctgatgttttccaattacggataatgctacaatatatattctcatacatatctatatattttcaaattattggaggcatggcttccaggtgaattcccggaagtgagtttactagatacaaaaggcaaacatgtatgtatttttaagagatattgccaaattcccttccttcatgttgtatgaatttatgttcctgtcaacaaagtatgcaaacacctgtttccccacaacctttctaatatagtgtgctgttttactttttaatttttgtaagaaattgtatttcagttgaggttttaattagcattttctcttattgtgaataagaacaccttttcataagattaatggccactttttacatcttgctttgtcagttgtctgtgtcttttgctcattttctgtcatgctcaacttttaagagctctttatatataagggatattagttctttatcttgggttatatgttgcaactatcttatctcagtttcgattgtcttttgacttcatggtgtttattgcattgcccattaaaattttttgtacggtcagatttatcaattttttcttttattgtttctagctttagtgtcatagctagaaagcctttccctatatccagattacagaggaatttgtccatgctttccttgtggtttcattttatctatttaggtgcctgatccatttggtgtttattcttgtgtattgtgtaagtcatggctctaatttaattctttttcaattgttgttctagcaccattattaaagagtcaatttttggccaggcacagtggctcatgcctgtaatcccagcactttgggaggctgaggcaggctgatcacgaggtcaggagcttgagaccagcctggccaacatagcgaaaccccatctctactaaaaatacaaaaaattagctgagcatggtggcgggtgcctgtaatcccagctactcgggaggctgaggcaggagaatcgcttgaacccgggaggcagaggtggcagtgagccgagattgcgccattgcactccagctgggcgacagtgtgagactacatctcaaaaaaaaaaaaaaaaagagtccatttttgactcagtgatttgagatccaaactttattttgtcctaaagtttttatttatttattttatttatttttttatttttctttatctgtactttatgcctttgaactgcttgtctatttataagccagtaccacactgcttagggaggctttatagtgtattttaatatctggtagatctatttccctagtagcttttctgttttattgttttccgggatattcttgcatgtttatttttatatataaaatgtaatactgtttagccccatataaatgcctgtttgcattttatttatttacattgtgttaaatttacaaatgtatgatgttgagttacacagtgtgacaatgatgtcttttcagttggtccagttctacttttgtgtcttgtaagagttttaaatattttcttatacaaattgtacacatttttaattaaatttattgctaagtattttatctttgttggtattgtgaaagaggttttctctaacatatccccttattggtaattgttgttgtgaatgaagacaatatgttggcttctgtatgctaattttatattctgctacattgctggattattttattatatgaattagttttctaattgattctctagggttctccaggtacctgatcatataatctgcaaacagagatagctttacttattattttctaattattatgtctcttattgttttgacttgtcagttacattggctaataacctcaaatacaatattgaataacagtggagatagtaggtatccatgctttctgatttttgtggaaaactgtggtgtttcttcatttagtaagatcctgtctttagaaccaaaatcttcaaatatgtgttaacaaaatacctatcaattcctatcttcctaagctttaaaaaatccattatgggtgttaaagtttgtcaaatgtttttgcagtgtcaatagaaataattgtgtgatttttctccttagatatattaatattgtgtatttttagtgaatttcctaatgttgaaccaaccttgcattcctgaaataagtaactacttggtcatgacatattattgtcttaatgtgatgtggagttgtgtttgttaatattttacttatatttacttataactataaatatttataagtattataaatataaatatttactactttgcactgatatgggtaagggatatgctctttcttttttaactgtcaagattaggtataaatatatacctgtttcataaagagtagttacatttttaaatgaaattttgttttccaaagtgaccatacactgtattatctgtagggcctagttcagattatttcttattagcttcataatatttttcttacattgacttcttcataacttttaaaaaatattttagttctagtccagttaggacgttttcttgccttaattatctattcagacaaagcagtcgtatttttgaccctttattcttccttcctcttcttcctaagcctccagaatgggttatcatcagagtctagaaagcagagtcacactgaaaatttcatcccagtttatagcagataaagcagggctggagccacttgcttatatgcttgtgtccagttcaaggctacacaggtggtgctttgaaggcttttgcacctcagccaaggcaagaatactaactgactgactgcacatgtgcctttttctgtcaaataatttggagactagagcagattatttttataatatgtgtttctttttgtgtgtgtgtggcagggggaagagggtctccctctgtcacccaggcttgaatgcagtggcgtgatctcagctcactgcaacctccacctctggggttcaagcaattctcccgcctcagcctcctgagtagctgggattacaggcacatgccaccacggcctagctgatttttgtatttttaatagagttgggttttcaccatattggtcaggctggtctcgaactactggcctcaggtgatctgcctgcctcgtataatatgtgtttctgattatgacagtattgcatattatttattggaaatttggaaactacaagttgaaagtagaaaataaaatacttgcagtcctagcacccagaaataataaatacaggttgagtatcccttatctggaatggttgagatcagaagtgttttggattttggattttttcaaattcagaatatttgcattatgctttaatggttaagcatcccaaatctgaaatccaaaatgctccattgagcatttccttcaagttcatgttggtgctcaaaaagtttcgagttttagagcattttgaatttcagattttcagatttggaacctgtattagcattttgatgcaatttcatctagtctgttttctgtgtgtgtatgtacagcatttatatcagttcatagctatgtaagtcatatgtatttaaaatccttttttccctcaattatagaaggactaaatgagtcctatctttgcaaatcatattagacatgattatcagttatgtgctacttaatatcataagcatttcctatatcatgaatcatttttgaaaaatttttaatggttgtataatttttgtttttactttttcttgttttaaacttctgacttctgtgaactaaagcacaatttctaagagtactagtatgttgattctgaaaggggtatatatattcaagatataatttctttttaatattgtcatcagaaagagaaataagaggctctcaaggctgtttgaggggcagggagagggtgatgggacaaaagaatattgaagaactaagcaaaagaatgtcagagttgccataaaacattaactgtgtacctgtgagtgttggagaagaaaagggaagtgcatatgtattccagttcaggtgagggaagacaccatgcatactcagaggaggggatggggagtcttgaggggagggggtttgcccagtgcaggtatagatgatagcaagggaaacattcacaggggaccaaggaatatcattgcagaaatcctggaggaacacagtctgggagaccaggaactgataagaagctggtgaggggcatggcccagtgttccaggagcagacagtggttctttcctcctagatttttctagaaggaccaggttaggtttccctttgggaccagtatgataggccttgggtgactctagggcaccctacacctcttatctccaaagaaactgctattttaaatttgaattattttaacttgataaaaacctatttctcaatgataagaggttcaaagtataaattcagaattaaggcctccctgtagtgctaattttatattgaagtataatccattcacttatggaaatagcttgttattaggccattctctctcttctctgtctcttttgtctgtctgtctgtctgtctctctctctctctctctctctctctctctctctctctctgtaacaggtaagagagctggaggcttaggacagaaggcaaattttaggcactaatattgattttctcttcttattctaaacagtggtgggtatattaaatgttgctcagcagccttaatgggtaattaagcaggttattttaattatctgtgtagttgacttttttgaataagacataataaaggattaattatattctacatatttcaaggatattgttttgttctttcagctcttatcttcattgtcagtgggcatctatagaagatctggaaaaagataagagaattcagcaaaaaattaaacgatttaaggcaaagcagggccagaacaagttcctttcagaggtacgacatacctgcttacttttccaaagtatttactttgttaaaatgttctaaatttaaaattttagttccatgaattaagaaaaactagttagtctcatttggtgctgtcaacttgcatattggtaactggttcttgctaacaaatttgtaaacaggaaatttctcattcttcctgttgcttaggctagaagatatgggtccttatgatattatgtggaaatagcggtgatggtatgataaaaatcgtgtaatgaaagtacagttagcagatgatgaaattaagtaagtggacagaagttctattgagatttagcaggttaagaaatctacaatgttaagtacaagttctaagatacaaaagcttgacttctgttggggaaagtatgtggcaaatttcttttgttgaagtcaatgcctaattacagagagttcactaaactcattttcgcaaatgctgtgctgtagtgtagaaactggtaataatatctttgcctgtgtccctttatcccaggtatcagtatagaagtacagcaatacctagggcagagaagaacatctgcatttactagaagtgccagttctgccctctgcctcctcagtatagtcaattacattttttaaaaagtgctttcacaagctgcttactagggtctctggacttaggatcgccaatttggtttcacttacagcctcaagtagataaaagaaaaaccctaacattgaaagataagacttgctgatttattagttcctcttttcctaaaagagttgacagaatgtagactttatgtaaaagaagcgtacaatttgatgcaaaatagtatctgtttaacaacctactttgtactgccacccctttttggagatgaaggaaagtgggacagaagagcacttagtacttttatgtcataaaattcttatactatcaggtagcaagtctgtgttcttctgggatctgatttccatggtcccaactggcctatggtaaagtccgcattcaatgggagatcatgtggttgttcttttactggacacatgtctgcatcactacccctggcactctgagtgtgcagcatttttggcagtgcagtgtttaggaccgagtggaatggagttactcgaatgtgactcaattcatagatcttggagaatattaagaagattcttcagaagaacttggaggaaaattcttttgaagaaagaatcttaatatttgattttgaggacaatgctgtgagattctatttttcatgcccttcttaatgaaaccagagttaaatttttatgacattggatgagctgaaatcattagcctccttttagaaagagacaccctgtgttctgctgaccttttctgtgggccagggggagggagacaggcaaaagcgcaatggtagctttccccccatccctaaatcctggtcctgtttattaagtttatttgtattctctctcctgtagtcacactgtctttaggaaattgtgcctagccctagctacacataccaaggttgaatgtacattatttacctggtaacttggcagctagaaatcttagtttctgtcctgagtgggagttagcagagaaggatagcaatccccttcctccctctcttttatacatgaaagtgcacacgcccccgtttgtttcatcccatacatgatcatggcttcaggtgttccatggctgtactgctttgagattttcagtttcagctgcttttacattctttgtttctccttaggctgccttacaagcctgctgcaactaaaaatgtctattcaaaaacatcatttagactggaaatttcgtcacatgtgtgatgccgcagattactcacttaaagggtagaaatgtgtaggaaaagttaaggattttaattcagcactgactgtgaaagcttatgtttaagaacaagttttcctaaagagagtttttgccatccaaacctagttttgggaaagtttaagtgtttctgctgtacatggataacacgtgtgtttacctacgtctagaagcttttgaaaagccagtgcattaatacactaatactttatattaattgaacatttcaatggatttttttttgccttactaatctacctctgtgtaaaagcctgagatacttgagacatatgtttgtgtttctgctttttgtttcataattcatggttcaaagcttcccaactgggtgttttaagagggccgaatagccagagaaagtttgttgttcttgagcagatgatgactgaactgcttatcttttccacctgcaattcaagggataagaatggtgtctaagtgacttctagtttaccttttgcaaaatattttaatgcagttatgttattgataagttaattgagaggtgcacataataaaatgtgtcttttgttttctaacatctgaaacttgtctgaccctaacttcttttgggtatggcttagtctataactctttttttgagacggagtgtcgccctctgtcacctgggctggagtgcagtggtgcgatctcggctcactgcaacctccgcctcccgggttcaggcgattctcctgcctcagcctaccgagtagctgagattacaggcacctgccatcatgcccagcttattttttgtatttttagtagagacggggtttcaccatgttggccaggctggtcttgaactcctgacctcgtgatccgcctgccttggcctcccaaagtgctgagattacaggcgtgagtcactgtgcccagcctataacttttttttgagtcatattctagtgttttatatgagatacctttgcaggcagcagtattactttacttttgtaaagattgtttaatatattggttaaatgagccaattatttaggcttcatttcgttatccttaatacttttgcctaaacacactatattcaatgtaaatcattagaaaacagattaatgatgagactgtgattctaaatgaggtactaatattggttgacaaatactaccaaacattataaactctgatcatgctaaaatatgaaattagctgcttgcagtgtatttggcttttgaataacattttgtagatatgctataaggcatcggacaactccaggagttacaatattccaagtaacactttgcatgactctgattcttcattgcaaactgtagtttcgagaatgctaaatgcatcgcatgccataagccttttggattgctcattagtgaattgtaatttcacacttcatttaaaatattcttaaacattctctcacagtaaaaggtttcacacggtaattaaaagacccagttaacgaagtctgagaagtctgatttcctcatggggagtgattttgctaaattgtagcatttcaattaatataatagaatttgccaaatgtaagttttatattgctgtgacccaaaatattattgcttggtgaaaagtggaatagtatttcatcttaggaaataagtaaacctttaacttttttttttccctttggtgtagattgaggatgagctttttaatccagattatgtggaggttgaccggataatggactttgcacgtagcacagatgaccggggagaggtaacaggagatcatttgtattacaaagtggtgattcaggcaacccatacatgtttatagagaagatggtagaatcctagacctggtcttggtcagagccttggactgtgacacacttggtctaaatttaactgaaacttaatgatttattattagttttatgacttaataatagtgctaaatatgttttatgtttagtctgagaacttttttaaaaaattgattttcaatatgaaagaaatacattgacattttgcacaattccacaatatgataaagaattcagtacattttggtataaatctgtcatgtagcacaaagtatccttatataattgagtgtctcttgtggcagaatggagtttaaggttatttagaattgggcatcattagtgaagttgatgaattcatttaatgtggtacacagaggctaatagacattatttctcttaaaagatcctagtctcaacactcttattttgctttgcaaaactctgtaagattataagggatatttgatagggaagtaagaatgaagacaagtgtagtgacttctgagtattgtgtcttgataatgatgtgcccacccaccatgaattgtgtccttcctggcttctccatgtaaattgaattttatatatacagtgtttggatcttgcttttctagggagggtctgcaaagaactctcattttcttccaaactctgtgtcatgacactctatgatgtttccaagaccatatctgtaacatgatctttacttttctaattttccttagttatacttcaaaaaattgtttcatagcatatttacattgtacaggaaatatttttcacatcacaactaggtcagtgttccttggtcctgaaatgaaggtcaacaaacccaagtgttttctagaggaaagacaaaggaaatcctgttgatctgcattacctgaaatattttgccctccacccttataaagctcaaatatgttattttaatgtgattggacacaaacagtatcactctttttaaggaaaaggtagagatcctaataaatttaagcgtatgtctcattttttaagaaaccagccaattatgtaaacattgaaatatgctaagatgatttaccatgtaagtctgaatcaaactcctgatgaaagatttgtacagataaaaaaaatctcaaattcagctttgctatttgctagctatttctttatactttttggctttcgaacatcacttaccaatgattttgataaaaggctaatttgttctgataatgcccaataatactgtttccagtttagacttgagactcttaactaggaacagctgtttatggccatagtttttaaatttctgtcaattcagacttactcatgctgggataatgtctattgataaatgaagtagagcatgcttttccttaatgtgtatgtaaatatacatgtatatgtatatatgtatatatataagcatgtatatacacctatgtgtatgtataagcatatatacacacatacatatgtataaacatatatatacatatgtatatgtataaacatatatatacacatacatatatatgtataaacatatatatacacacatacatatctatatgtataaacatatatatacacatatatatgtatatgtatgtatgtggtcaaatgaatccaattctgatttatttaaatctggtccagcctgtgactcactatctggtgaagtggtgttcacttccttatgaagacagcacgtgggagcggaggcaggacatagatcaagcaaagatcgaggagtttgagaaactaatgtccagggagccggaaacagagcgtgtggtaagaattggctgatggtagagaatttaatttgaaaatagcatagtggtgtggtctttgggaaaccactaatgggatttactatatttgaaacaggagcgacctcctgctgatgattggaagaaatcggagagttccagggagtataaaaacaataacaaactcagggaataccagttggagggagtaaactggctacttttcaattggtacaacatgtatgtaaaacaagtttttcttcacttttaaatatatctgtagttcctttcctttagttattgaaaataataaaaaagaacttaatgttttaactctaataagagctttttcaaaaaacaagcattgaaaatatatgtaatatttaataaatattaatacagagattgatataagtgtgtaaaaataatttttattctttgagaattttgtttgaaaatatattttgttgaatctaagagaacatctaaagcctttgggtatgcatttgtgggtacaatggtatatattttgtgaaatgacagcagtgtgtcatatccatactcattaaacttttgtacttcattttcctcctaaaggcgaaactgcattttagcagatgaaatgggtttgggaaaaactatccagtccattacatttctctatgagatatatttgaaaggaatccatggcccttttttagtaattgccccattgtccacaatccccaactgggaaagggaattccgaacctggacagagttgaacgtggttgtgtatcatgggagtcaagctagtcgtcggaccattcagttgtatgaaatgtacttcaaagatccccaggtaaaccttcacaggttgtattctttgtacttactctgtgcattttaaggtgttaaaaaaaaatcaaagtcttggtgacttgggaaggtctaaattttgccaaattgagaaatttgctttagatatctgactcaatttacatttgtattatctttctgtgtctatgaaaacagctcttcatttttatagctttggtttttctgattattagattagaaggaatgaaattttttgccttggatgatcactgaaatccatttaatgctttgatatgttaattagttttattttgcaagcctaagagaaaactaaacaaaaattggtaatattaaatgtgaatagaaagaatattttattatgctattgctagaagtgaaaaatagtaagcatgtaaaaagtccttgaaatatatgacacattgaatgaaacacatcccaagggaggaatttatgctttggctgttagtagcaattgctttaatttttttcttactctagttacctgtatgccattagtgtgtatcaacagtgaagtgttataaatgacatgataaggaagaataatatgtactaaaatagttttatgttatgggtagtaaatggaagtcctgtaaataggatctttgctatatatatgtttttgctatatatagatagatagatagatagatagatagatagatagatagatagatgtgtgtgtgcatgttctaagtataaaatctgacctacaattaaataactaaaggagaaaaaatattgaaatctgtgtttatctttagatttgggaaattattataaattctgtcctacgtgaatgtgtgactagaatgggtacgcttagtggtaattgatgcatgtgctctgttaggaaattagatccaaaatttactgacagttttctcatttgttttccaattctgttttaccatatcgtttaaaactgccaaaataacttgaaaacagaatgtatgtcacctaaaataaagagatctccaaagggataaatacgtatgttttatgctatttattcatccttaaagttatttatgtaaccattaatgcttaataataattcagagttgttcttatagggtcgagtgataaaggggtcctataagtttcatgccatcatcactacatttgagatgattttgactgattgtcctgagctgcggaatattccatggcgctgtgtagtcattgatgaagcccacaggctgaagaacaggaactgcaagctgttggagggactcaagatgatggacttggtcagtgaccatattggtgattgcactgaacctgaatagaattgttgctgacttgatagtcccgttgctcagaatttgatgcctgtaaacagtatttgaaaagcttgtcaaatattgtgatatattctctggcactttcagttattcaaaagttgttgccttttggattcttacattgttggctagtgtctgttaaacagttgtattatagcagagtgtaatcatgatagtttcactaaagtgagtttcaagtatttgttttaccctttgttcataaatacaggttgatcataccaaatacaaaaatcccagaatccaaaacgttttgagtacccacataatgctaaaaggaaatgctcattggagcattttggattttggattttctcatttgggatgttcaacccgtaagtataaatgcagatattccaaaatctaaaaatatctgaaatctgaaacactctggtcccaagaattttggataagggatacttaacctgtactgccatttcattaactgttgggccaagctttacttcagtgatgatagtccagttatttttcagtgctcataggttttgccatactgtggccagcaggacttgtagatgcaagttctcaatgagttgggtaggatatctggggttggtttagttcgcacagatgcttagaagtttggggcattacagtgcctcagatttgatctggagttttacaccacacttatcccatagtcttccagcttcccaagagatgatcaggtcttcctgattagattttctagatttttttttcagcaggagcatcatggaataacatatcgtaggagtagaaggatttgatttattttctgtctgatactgctgtgtgtgatttcctagtgggaattgcaacatgacctgtcatcctcaggcttcttttcactccatagtttatatagtggttatgatcacttatattttatttttaatgtacatttggaaagcaaagctcctgtcatttagcatgccttggatgatttgatgagtttcacggaagtacaaaaagggtttcaaagtatttttaatgctaatttctgcaggctaatttgatcttttgttaactgagagtttgagatgagaaggagtgttctgtatattcatggccatatgtttttagctgaagactggtattaccaaaaaacacctaaaagctttttgttgcagctgattctctgaaagagcagcttattttattcttaaagagattagaattgccagctatgcttttagtttaaaacaaacaaaatctagttttgcttaaaggaaaaagtctgactgaattatcctatttagggtgggatttcccatttttcttcctaatgaattattattaaagcgatcctaagatctgtctcaaagcagttgactattatttggtggccaatacacaaaacaagtgagagcgcttagaaacagtgaatagtctcagggaccttggtaagcatatggaaaagagaaactctgtgtttgtatttgttcactccaggtgatacttaagcattaaaatgaagtaaacttgtatttgcaggtaaacactaatgcttgtgatataacctaaatatatattctcagtagggatccaccttcatagttttctactaagagacagttatgtcaccatttcctgaaggcttaaacagtcatctgactgaacttatctgagttgtgttctattattagttcatgtgttcccagatagtaaattcttactgtaaaacattatttcattggtgagtacacattaatttaactccatcaagatcaaacaatctgattgtcattgggctatttttttttttaatttaagttctagggtacatatgcagaatgtgcaggtttgttacataggtatacatgtgccatgttggtttgctgcacccatcaacttatcatttacattaggtatttctcctaatgctatccctcccccagccccccacaatctttgggctatttcaaagagttttctattatttatactaacatttgataaatggattagaatctgttatccaaataattttcctattacatattgcagtgttcttaagctttttcacataatggcacgtatagaaaatgatagtagttgaatgccacactcaggtaaaaagagaaggctgcccactgccacgggacaccaccagtcctgggtgtcctgaccttccccaaggacttataacctgtactcatccttgactcaccaactgggaagctctgattagcacatgaacaaaatatttatttttctaatgatgaagaatttttatttgagaagaaatgttttcaagatggaacacattattgttcagaatataattatgtttgtccaattctgaacagctcgttgtctggtctttaaatccttacttaaaataagcatcttgagaacttagccactttctactttttattctttcctagaataagtcacagtcaaaatagtggttagtaactatatccaactacggcacaggccatagggaactgctgttacctgcactagactcagttgcgatgaaaatgcgcttgatggggattatctccaagtgcattcccagaaaggacgaccaatgagtgtcttcagctctgcagacaccaaggaaatgtttgtgaagatgatacattgaggggcagtcaccatcttcacagtcctccacaggagctctgggaaagcaaccatctcgttgtcccccatccacgaggaggggatgctgtggagatcatggtagttcttcattgattctagtatctctttcattgtcaggaaacctaacacaaaagagtctgcttaaaatgaaattaaatggacatcacttcatcagagctaaaaagaatggtaacgttgtcaaggcaaaagcacatctgctagcataggtggaggtgataagctccatcgcctgagtttcttacctgatgttttgtgagactgtgcatagtaatcgtgtattttttaattgttacccactttcaaattgatacctagttttattccactatttgtaggtaactgtatgaaaggattttgtgtataatcatttggtgtaactaattgaagggaagctgcataagaaaggagttcctaatgctagatgacgagttagtgggtgcagcgcaccagcatggcacatgtatacatatgtaactaacctgcacaatgtacacatgtaccctaaaacttaaagtataataaaaaaaaaaaaagaaaggagttctttccttttttcgaataagtttattttgaaattaataagttaaaaaggctttaacttttaaaatatttggttaagcagtcaagatttaatttaatgtcgtaataaaggatatgaaaaaactgggagacacgatatcaatacagctcaactactgcagtaactctttcctgaatatgtgatgggacttaaaaaaaaaagttcttgcatacagtaatccaggacttgggtatgtcagcgattgtggcccaggctatccacaagtgtggtgatactttagaaaaaaattgattgattgatccttactgtttatgaatttactgagtctgaagatgatggtcgtccatgaaacttcctcagagactttattcaaagggaagagaaggaggaatacaagcatattgaactccttcacctactttcaaagagcttcattaacagatatgacatggtagatattaagaaaattagcatgttcttacctcattcatctagtatttactgagcgtatactctgcttggcaaccgagacttgtcagattccaaattaagtcagaatattgctttctcaactactgggatgtataattactttctgaaatagttttgttagctgtgctgtgtaccaaatggccaaagtagaaaataatagggttcttaagattaatatctcactattgttaagactggccattgtaaaacagctcttctgtattgcatatatgaaaataggaagacagggtataactgcatgaggaaagctggggaaagagttcgtaaacaggaagaattaattaaagaaatacctaacttggttcaaagagacaaatttataaatagcatctgattaaaaaaaagtgattgtggtatttacaaccaagctgacctctttgctagttggaaatttttgcagaacaaaatagtttttcatatgctgttgcatgtagaacttcttttgtctctatgaagtgagtcatgcaggaagcagatggagagatgagagcactgttgatgtagagagcagaaagaagcatgcatgtttcatctgcgtctagggattctaggaaaaaaacttaactggtggggataaaagcattgagacttgggggacttaaaaagccgtgatactaaaatactgacctataaccccaggaagaaacaaaatggcaagacacatttaaggaccctgtagagttctggagaggactgtccatggatctgtctacctgacacagaaatcgtgttctaatacctctgttttcatgcctgattcctatactttgcatagggtagatgagtaggagtagaacaatgggtgtctagtgagaggctctggttttaagaaagtgtttttgttacaatttggttagtggctttccttgtgttacctcaggaacacaaagtgctgctgacgggaaccccactccagaacactgtggaagaactcttcagcttgcttcatttcttggaaccaagtcgcttcccttcagaaaccacatttatgcaagaatttggtgatctaaaaacagaagagcaggtatttatcagctccactttgtatttcagttataaaattgaagattagcccatgaaatggcaaagtattaagttattttaaagtgtgattatattacagtttttcccacctagtacacagaaccttagataccctttccttggactttccaggtcatcatcataaaggttttcttctttatttgtttgtctttttgctcttgtgaagggctgttgagatttatagagaggttacatacctgttgatgtaattttcagagatagctgtgctgtgcaggttggtagttttgctaggtatgtgtaattttggggatgatgtcagacgccactgacgttggtaggcctgtttgcctgctgcagttttgagtctctgttctttgtgaagcatctgtactcagccacaccgcttacttcttcaagcctacgtattttcactttagaaacttagggcataaccactgcacagtatttctgtgagaagtaaatgaagcattgtgtataaaaagtgcttgggccaggcgcggtggcttacgcctgtaatcccagcactttgagaggctgaggcaggcggatcacgaggtcaggagtttgagaccagcctggccaatatggtgaaaacccatctctactaaaaaaaatacaaaaattagccgggcgtggtggaacacgcctgtagccccagctactctggacgctgaggcaggagaatcacttgaacccgggaggcagaggttgcagtgagccaagattgcaccactgcactccagcctgggtgacacagtgagacttcatctcaaaaaaaaggaaaagaaaagaaaagtgcttggctattttatatgctgtaagagttatgtgggcattagttataatttgtgtgctgtatttgaaataaataacggagatagacttgaaatcttggtttttacgtgccccctccactgacttactgtctaaaacctgttagctcagttcagagtaaggtctgttttgtttttcttttctaaaataaaaactgtatggattactcagttctattgccaatcaatagaaaagagaaccagggagagacgtctctgctggctccttagtgcagggactagattgctcctggctcacttcctctcattctttagctctccctagaaaggaagagaatagaaacagagcattgccatgacattgtcttgtccctcttctctatcttccctatggcttaggacaaacagaagggaaagctacatgaatcagttggatttctcctgctgggtacttttcaagccttctggctgttcagggctcctggatgggtgaaatagttcatttgacataaaattatgcaaccttcatgcactgctcttatgaaagctgagagatgagctccttcatactctcactgggctttgaaaaatgaaaatggatgtttaatgaatgagataatcctgatgtttcatgttaaaatatgttttaacttgcaagcaaatcatgacactagtatttacttaaggtccttttttaggtgcaaaaacttcaagctattctaaagccaatgatgttgagacgtctcaaagaggatgtagaaaagaacttggcccccaaagaagaaactattattgaagttgagctaacaaacattcagaagaaatattaccgagccatccttgagaagaatttcacatttctttccaaaggcggtggtcaagctaacgtacctaacctattaaacactatgatggaattgcggaagtgctgcaatcatccgtaccttatcaatggtaaggctgccctgctcgcgaacttgcttaagtgacgattgaagcaccagaaatccctttctgcccccagactggggatttcatggtgtatagtcattcctgtctcctgtccactcagcatgggtttcaccagcttcccactttctgtgatgcctccttctgtggttgctgaaggtgagtgaccattgccccagcaatccctgaagtggaatctcaccttgcctttctcctgacctccctgtgcttgaaaagaggcgttagtgttccagggctagaagtcatctgaagtgctaacagccaaagagaaatgagcccctaatggaggttttcttggggtgtgtgtatttaaatcagagatgttaaagaggaacttaggtgtgagcagacagctatcagctgtctcaagcctttgatagcaaatgtcctcatcttcctctcagtccagagtcatctagcacctctatcctctgagaacaaaaaaattaacttaaagctttgataatttatggccctcctcttttcttaactaaattcatagtgttatgtaactcatggcttaaaacctttattatgtatttttggaaatcattaaggtagtaaatatttcatgcttatgttgtataagatactctggagaatgcaaaggtaaataagaagggagcattcgccacaagcagtcttcagttagctgagggattgagattgggggagtctttagaaggagatggtctttttaggcaagtctgcaggggtagaaaggattttgcgaggcagagttagaaaaagaaaagatgtttaggctgaagtaacgatacaagcaaagagagggggtcaggaaaacaatgaggaactttcccaaagtaaaaggcacacataagaaatgcaccttagacatgcttggatcctgctgcagaattccttaaaggctagtgcatggaacctccactctactctgcaggcagtgaagaaccatgactagtgtttgagctgagcattgattagaaatatgattcagggtgatgcgtcaggcaacactgcataaaaaggatgggaggaggaaagacagacaagcagaagaaccagctcagaggctattgtattctgggtagaagttaatgtgggttaaagaaaggtggtggcaggctaatttgggagacttgtacacgatgatagttggccagcagtgcaattagattcctttccaaggaaaagggagcacaacctggtctgtctttatcacagtttatgttcaaggacagctaatttaaagaatttctaatctttccccttttaataacgtgtaactcatcggccaccctagattcagaagtctccgttactaatggacagagtagtccactcctggaagatagtcttagagtgttgcacctgggatcattggtgtgatgcgacgaatcagtgaatttcttttttatatatatatacacagtttttttttcttgagataggttctcactctggcgcccaggctgtagtgcggtggcacgatctcggctcactgcagcctcgacctcccaggctcaagcatccctcccacctcagcctcctgagtagctgggactacaggcatgcgccacaacgcccagctaattttttttgtattttttgtagagacggggtttctccatgttgcccaggctggtatcgaactcctgagctcaagtgatctgcctacctcagcctcccaaagtgctgggattacaggtgtgagccactgcacctggccagtgaatttctttttgtgcttttagttttgtcttctaaagagagtatcatgtgtgatgattatgtatctgatactgccaatctgctaatcacagtatgtttagaagcttgtgcagccgttacggtgagtgttaactagccaggtcttgagttggcgagacagagcttagggcaactgatggagcgagatgaggacacgtgtgtgcatgcactgtgcacatacatgtgtttgcatttaatagctggtacaaaagaaaataaataatagcctccaaggggaaagaaaagaaaaggagatacaaaagggtttgaatgctaccagcaggatgtgtgtgaaaggggagatctcagcaatggtagttagattgacacccccagttccatcaagtttaccctgtttggtcatatgttaattatatgcattgaacattgtgggttgttttcccccaaaacacagctggtgtgtctcttcctttgatgattgctttccagggtcatcctgtatagcatatttgttcgcgaggagcctcttaggactccctaaggcttggcagatgtggcagttgtcctaattggtcacaccttgaggtcagcttttctgtcctgacaagaagtgtctgttaagcaggtgtctttgtccctaaatttggggaagttatagtgaaaaagtgtagataacatacaaactaagcgcacgcagctgcccagataacttacgcagacattgtattgtgtagaggttgctccagggcccgtactgttcattctcatccacagtctggagtaaaaacatatatccagcatttaaaaggaaattctttaatttgggagattacattgaaatttgaattggttgtggcagagtaaagaagcctcaatcaacattcaacaaaacacatttccaggattatgaaaaatagaagcaattttatatgtatgagttgaaagcttatgtatgagttattagctcaagctttatttcaatggaatttccaatttttaggttttgcaatgtgaagttaagaataatgttgaaaacatgtccaaggtaccctgctggttagagctgacttaagagttgttgctggttattgtttgaggcaggaggcgtgtagaggaagagtgggcaaaaagaaaacacgaatgaggcttacgtgatggagtgaatttcagagagaaaatagtaactttttttttctggtaatcgtcaagaacaaaatattttcttgtttgttcgtggcttttatatagctagaggacattgcagttactgtcccgacagtgaccatctgttgaagtgaaaagacttcaagctgtaagtgaatgcacacttgtttcaagttgtctttgatatacacactttccagtgtagtgccagccatacattaatttaggacggaaccaacaaagtgttttgggttggcatgacctatttccagttaatttttggattgatgtttacaaattgggtatcaaacattaatttgtaatcttgaaaatttagctgtgatatcacaagggagcagttgctttcctccccaacactcttcccaccctctttccttcaatgttgccacaataaaatgtcaagacaatcatataggaaaggtgtttgctgatactgtttttaaatgaaatattattagtacaaactggctgccagttgtaagaacctgaattcataacagagagctgaattaattaattcagaagtagcttttgtcaggtaagaaagaatgcattttttttctgactattctttttgatagtataaaaaaggcaaaaattatttttttaatctctgaataaatttaaaattaaaattctctgcaaatttgactgaattatttgttaaaaaaatttaactgaaacccaaatatctgatgtttattttgtcgaaatgattatttgctttttgaaaaatattcgttggccattaatttgttttaaatggctaaaatactatattttatattgtggattttaacttagtatggacaaaaaataattaaccaaatgtcataagagtaaaacttattctgaatttcagagcttatgatgtattgtacaacaagaatacacttgaaagatacctaatgtaacgtgcacttaaatctgtttcccctgtctcttgaggggcttgtcctgaatctagaagctgggtttctaaatttcatgttttaaaaaatatttaactttattcaagaacattcttgctagtgcccttaaacagcattttgctctttactcttgcatttattttccatacttaaagaaacattctgaatattagcttttcattcacttggaaaaaggagtgagggccagtctgccttcataagaagtcagtgtattttgtggaaggccttagtgcttgggaagacattaactgactttaatctgttctcagtaaattatttgttgattaataattaataggctgtatttctgcatttgaccatgtcataaggtaatttctacatgcagccttaaagtacagataggattgcacttttgttacatctgtgcttgttgcagcagtaccatgtgagaggctgtggttgtctgtcccactgacccaacctttaaagcctctttgaggtttatgtatccccatcttgtgtatagttagttcacatgttaaaaaccagtggtaggaaggtagttttaagtttctggcacagttaaagtctaggaaacaatcccattaagatgaatgtgtgtgtttgtattttctgaagaatagttgagcacatcctccaccttcagggaaaagagctaaacacaacagctatgtcctgattaaccccagaggcaggaggaggtcagaccaatgctgcgtaattctagttaagccacctaagcagttgaaggaagcttagcctgctgcttcctaaataagcgtgtgtcaggcagggatgtcatgggccatctttccttaggaagatgtcatcttcttgaggcctctttccaatgtacccaagtctttggaccagcaaaaatccatgtgggggaaaagaagggtttaagcatagaagtcttatgtcaaacacttaaaggtttgtttgtttttaattttaaaagatttggatagttcaagatagaatttttgtatcttaggaaaaattaccagatgggaatgaatgtggagggagatttagagattacaatagttgtatgcttaggtcccccacaaatattccaggaaattgtcctggaaataaattcctctttttgtagttcctttgcctatattaatatgcaattatagacccaaactactattgctcttacgctgtaattgttaggactctattcctttgttttttcatttcggaacagattttgttgtttgtgtttatgttcagctagtaaacatttcttcatttctttagcaatttaggttccaaattttctgtaggtatctggcccttggcttgtttctgccacttctggcttgacagtctgttgttgaaattccgtttttacagacagcaaacatttgtttgttgaaaaatgtggttttccccctgaatgcctcaatgtgttgtgcttaaaacttttaccccttttgtacatccacagttttgtatagacccaactatgagtaagtggatggattcttgttcataagcaggagtttggtgttctggttcctacagtttgcaatgggttttgaaagcaagtgcattgtttttagtaataaaaaccttttacagtattcacgttatgctgtccaatctctgcaggtgctgaagagaaaattttggaagagtttaaagaaacacacaatgcagagtctccagattttcagctccaggcaatgatccaggctgctggcaagctagtgctgattgacaagctgctgccaaaactgaaggctggtggccacagggtgcttatcttttcccagatggtgcgctgcttggacatactggaagactacctcattcaaagacggtgaggaccaccatatcagaataataaaaaggaaatctaaaattaccttcccaggggtccaagcagtccacctaaaagtggaatctatgataaaggggctagaatgggggaagtgcatcacatgtcatttttaaaactatagatgtacatgatgattattttatatgatgactacaggaggacactgcatacttttttaggcaattttatttccccattgcctttatttgagtaggggagaatagttcttacttaaaattgaaattatttgttatcttactgttataggtgtcagctgtttttagaatttaactatttccctggagaggaagtaaaataaaatttaatctttggtcattcaatcaattatataaaaaacgccaataaaccctatttgctctgagattagttctgttaagtcatattagtctttttaatatatattccatattgtaataattaaaaattaaaaaaaggagcaagtatgttgtcgctatgcgtcaggcctccttgttcacactgatgttttctaggtacccatatgaaaggatcgacggccgagtaagaggcaacctccgccaggcagctatcgacagattctccaaacctgattctgataggtttgttttcctcctgtgtacaagggcaggaggtttaggcattaacctcactgctgctgatacctgcatcatctttgattcagactggaatccccaaaatgacctccaggtaaatgcacaagaaagtcctgatgcctttaaaaaggaagtcattctgcttactatgacagagagtaccagtcagacccataaattaatgttgcgtcgtcactcaggctgtgtcctatgattcagagcaaataaccaactagtaatctgttgattaataatgtgagaagaaattttttagttttaaccttcttctaaactgcacctctatttattggcacatagatagggtcttagaactggcagatgagtcttgtcattctttggtagccgtcttagctcaggtctccttaacaaaataccataaattgggtggcttaaacaacagacatttatttctcacagttctggaggttggaagtccaaaatcagagtgccagcagagtcaggttcttggtgagggccctcttcctggtttatggacagttatcatcttgctgtgtcctcacccagcttaaagagagccagctctctcgcctctttatatgagcagtaatcctgttcgtgaggactccaccttcatgacctaattacttccctaaggcgccacctccaaataccatcacattggaatgagggtttcagcatatgaatttggtggggagacagaaacattaggttcattgcagtaactattaatttcatttttcttccaggctcaggctagatgtcatagaataggacagagcaaatctgtgaaaatctacaggctgattacaagaaattcctatgaaagggaaatgttcgacaaggctagtttgaaactgggcctggataaagctgtgctacagtctatgagtggaagagaaaatgctaccaatggggtaaaaccacccttgcccaaaccatttatttattctggcactttcctttatttaactaatagtaagaaattactcagcctttgattatttttcgacctcaatattttaagtgtattttgtaacactttcctttgttataatttaggtttactctctttgagaaaaatgcagcatttgtttagtctgcaaacctcttaattttaaattattttgagtattttaaatatttctctaaaacaggtacaacagctttccaagaaagaaatagaggatcttctacgaaaaggggcctatggtgcactcatggatgaggaggatgaagggtctaaattctgtgaagaagatattgatcagatcctcctacgtcgaacccacaccattaccattgagtcagaagggaaaggttccacatttgctaaggtgtgaatcgatctaaagaggccaggttttccatagaagcatgacagagttcatgtgaaaagtaccttgtaaaagtgcttacaagatgcattgggaattaatcaaattaatcattaactccctgtggaacccctggcacatgaagctttctttatgctttggtttatcttctgtgtacctgccactggtatttgccctcaccttgtcatccttgtatctgcttcccagctcctgaggctaatcgctcacttgtgttcttgactctattgtctccacttctgagatcctgctccgttggcatcttccttctctccccagatcctggtttttgaaacagcctataagaatgatcaagtcactcctttaaaaacacctcttctctattttcttctttagctaaatctccatacataaactcttcagagctaaaatccacacaaacgtaatctactgcagcctctactgtctccctttctacttatttttcagctttttcagcttccagcttgcacctgttccctgcctctctatcagagctgctctggccagggtcaccactgagtacaccagatggttccacctgagagccccttctgaggtttcacctgcattttgttctagccatctcagtgaggcccactctgtacttttatttttaatgactttattgaaatgtaattaactgaccatacaattaacctgtctttcgtgtacaattcaatgcctttaccatattacagacttgagcaaatattgccacaatctaagtttgtaacatttccatataccccagaaaggtcctcatgctcattagcaatcattccccattcctatccataccagtctgccatatctggaaagcatgaatctactttctttttctacagatttgccttctctggacagtggacagttcatataaatggaatcatatgatgtatgatcttttgtgtctgacttcattcacttagtataatgtttttgaggttcatccatgttgtagcatggatcagtagttcactcctttttattgctgaacaatattccattgtatgggtataccacctttacttgttgataatggacatctgggttgtttttactattggctattatgaagaatgttgttatggatatttgtgtacaaggttttgtatggacttgttttcatttctcttgggtatataccaggagtggaattgctgggtcctatgttaacttcatgtttgactctttgaggaactgccagactgttttgtaaagtgactgtactagtttccttccaagtcagatagtaagaagtatagatgaggatatggaggaaatggaactccatatcctccccaatactttttattatctgagtttttagttttagccatcctaatgggtgtgaggtcatatcccactctggtttttatttgcatttctctgatgatattgagcatcttttcatgtgcttattggccagatgtagatcatctttggaaaaaattctattcaagttctttgttcattttttgagtttctttttattaatgtttcagacttaaaatatgttctgtatgaaggttctgtattaatatgattgcagatattttctcctactctcttcttaatagcatataattttaatgaagcccagtttaccaaatttattttatcgcttgtgtttttagtgcattgtcaaacccaagctcacaaagatttatgttttctacagatttgcctactctggacggtgggcagttcatataaatggaatcatatgttatatgatcttttgtgtctggcttcattcagttagcataatgttattcactagtgtaacttagattccaagatttatagtttttaactcttacattttggtctgtgatcccatttggatagagttttgtgtatggtgtgaggtaggggtccaacgttcgttttgcatgtggctatccagttgtcctagccgctccaatctggaaaggctcttctcctgtgggttttgagacccacatcttctcctttacatctttcagccttgtgtcagattattttctcagagctcacaggcactgtgtattcaatatgtgcacagccaaacttatcacccctgtctctcctcctgcccctatctctgtttgtccacctgactgacatcattcagatgcctgagatggatgctgaggtttttctggcttccgcttctttcatatttcacttgtacccagattctgactccattgattttgccttttgttttattttatttttgggatgatatctcactatgttgcccaggccagacttgaacacatggctcaagtgaccttccaccttcagcttcccaataattttaccttttaaagaatatgtttcttttttttttttgacagagtcttgctctgttgcccaggttggagtgtagtggcgcaatctcggctcactgcaacctccacctcctgggttcaagcaattctcttgcctcagcttcccgagtagctgggattacaggtgtgcaccaccatgcctggctaatttttgcattttttgtagagacagggtttcaccatgttagccaggctggtctcaaactcctgacctcaagccatctacccacctcggcctcccaaagtgctgggattacaggtgtgagccaccatgcctggcctaaagaatatgtttctaaaccaccttcttttctccattttgttatttcttctgtaaattattacagtggcttcttctgctgtgttctgacctccatgctccaagcattggtatgacctttccaacttgtgactctggttatgattgtgtccataatgagattattcctattttcaaatagttcctggttccttcgggatagagttcaaactctgttaactctgttaacatatacagacactgcttgacctggcttctctctccctcaccagctcgacctctggctcttcttccctgactacccttatcccctttactctctgtgccttggcacatgctctgctgtgaacatttccacatgctttcctgttttataaatgttttagaatggttcaggcatcattttatggaagagacttttcttttcggtttccagcaacaccctgcctgaaccaggttaggggcccctcctctgtatatcacttgcactggtctatacacttgctccctatcatttatcactctgcagtgtaattcttggtttggtctcaggccctggtcagtgagctgcctgagggccagtctgtcattctagtcccatctactgtagtgtctggcataagtggaggaatgcacaatatcggagcaaatacataaacaaaagctgctttacattctgcttctgagaaaggcctctcaaagtaatgcgtttcttttttctctttaggccagttttgttgcatctggaaataggacagatatttccttggatgatccaaatttctggcaaaagtgggctaagaaggctgaattggatattgatgccttaaatgggagggtgagtaagaagtcccattcgaacacctatctgatctaaaccaagagccactctttgagaaatgtcaaatgtatctcctcttttattattagaacaacctggttattgatactccaagagtgagaaagcagaccaggctctacagtgcagtgaaggaagatgagctgatggagttctcagacttggaaagtgattctgaagaaaagccctgtgcaaagccacggcgtccccaggataagtcacagggctatgcaaggagtgaatgtttcagggtggagaagaatctgcttgtctatgggtaagtaggactcactacgtaagatagaattttattgtaacagtagttagaattcccaactggtagagaaaaactatatttgtgtttgaatttgtgtgacacccctttgcacagtcaaatgaatgcttctgcagtaactttacagggctttgaagccatttggttaacataatctaagttgttcagatgcttctggttcagaggtcacctgaagttaaggtgcttgtgtataccttaaggaattatgccagatctagagttacatgttgattattaataattaagaacaaagtgtcaaaattatgtaatcttttctcactttacaagctttgcataaaatttatgactgtcgtaagcttttaatatttctcttataaaaaattgtcaaaggcagtaatctcacttgttaaattcttccttgcaactcatatgaaacatgaatggtcatttgaactttgtgaaagtgttgtatttttcctgctggactataagtttctgaaagggaggatccatgtccaatttatctctgaatcactgtgatgcccaaagtggtactttgaatggcagggtgctcagtaaatatctgaattggtcaataagagttctctagcagattgtgggactacaggcaactcctgttaaaaaaaaaactgcagctagagtaacctttctacagatctgatgacgtcctgtcttggatgatttcttccaatgaattaccattagtttcagagtaaacacaaacatatgctgacatggcatccagagctcttctgggaccttgtcttctgttggttctttcccatgggtagtccaagcttctgttaggacagacggcttcatctccttcagtgcgccacgctccatctcatctgtgtctttgcacaagctcttcccactgcctagaggaccccccacttgcacctccgctgggaggtgacctacctcccttctgctctccgtgggtgtccgacgcaggcatcagcttgtgctctgcaactgagtctggcctgcacttcccatcacactcatcatgttgtttacaatttttgagtcgcctccctctttcagtttgcagctccttgaggatggaagctccttcattgtgccctcagtgtgtagtgcagtgtgagcagacacacagtgctgataaatgcttgttcaacagaagtccatcattatctgtgaagctggacatcctctcttgtctcttcttacatggggcagagactcaccccctgcgtcccaaaagccctgccccgcaaaagccctttgctacccatgcctgctgccatgtttcagcacaatcatcagatttgagagttctgtgggtaactttaggaatggaacacataaataactcctacagctaagaagtgtgcttagcgcagattgtctttcagtcgagcccttccctcttcccatagttgtcactatgtactgaacacctatgtgctaggcactgtctaggatcctctcagtcactaggggtggagctctgagcaagacagtcatggctcaggcaggcaggtgagcaagtagaagtggtgcagactgtgacaatactgtgacagggaagcactctgctgtggagcatagagcctgtcagctcactgttaagacacagctccagtgttgtctccccacttctggggttaggaggaatgaaaggaggaattccacaaaaggtggcatgtacagcttgtgacttggtggatatcacaaatcagccagggtaagagggagtgctggggtttgggtagggaagggaagtgaggtaccggcagatagagcagtgtgttccaaggcctagcagtgagagctagccctgtggttggagaaacttgaagaagttcacaggagccagagaggaccagggagtgacaagagaccaagtgagaggcagggcctgagggaggatgtgcgctgctctctgctccaaacacaactctcagtctgcagcagaggggctgttcataccatgagcactgccttggtggctcagtctgctgtcgcctgggagaagacatggctcacatagcacctgctgctgcctgcccccgtacctatttgttgtgtggtcttactccatagctcccagatgagacagcacagcactgtttagcctgggattataacacaaaacaggcagtcagtccccatggtgtgttgtctgtttgcttctgtcttctgtccatagtcgtttctcccactcatttctcatgaggacctgagggttggcagaatatcttgcctgtgatggttcttatgcttggggttattactccgtttcaaaaggaacctcagagctttccagaacctttcaccagtgactgtggcatccccttagaggtgggttgatgcggccatactgctcagcatcgcatccttgattttggggtagtcacaccttttatcttgagttgccttttgtctcagatggttggtcaacatcaaaatgtactaatcatgacagtgtgaagcaaagtccatgatttccaggccctcggatgcactcatgtcctgaaaattgctgctacagccttcatgtacctggaaaggccagggttagctttgtgggtgttattcttgtggcagttcaactcatgcgcttagaagcagtgaactgaggggcagcttactgtataaaggagtgtttttaactcttgcaccctggatttctttcctatcacccagtgtgaattgttgctagttttgacccaggatttcccaacgctggtacctgacttaaagtaaagccataaatcaaaactcacaggcacctctgcatgctggatatttgctttgcagttggggacggtggacagacattctttcccacggacgctataaacgccaactcactgagcaagatgtagaaaccatctgcagaaccatcctggtgtactgtcttaatcattacaaaggggatgagaatatcaaaagcttcatctgggatctgatcacacccacagcggatggccagactcgagccttggtcaaccattccggtaggtctccaccatgctgtttgtgctacagggtcacaaagccaccaggaacttttgtgacacactgttgataaagagatgtgacataaaccccatatttccctgcctcgtgcattaagctctctgccattgacactataattggaatgtaaaaggcttctattattattatgatggtgattctaggtttgtcagctcctgtgccaaggggaaggaagggaaagaaggtgaaagcccagagcacacagccggtggtgcaggatgccgactggctggccagctgcaacccagatgccctgttccaggaggacagctacaagaaacacctgaagcatcactgtaacaagtatgttattagagggtggacctggagagcttaattccctttttattctttaaaaaatacatgcagccggcccttcacgtctgcagatgcagaactcgcagatttggagggtcaactgagggacctgagcatctgcggatcttggtgtctgaggggggtcctggaaccatactcccgcggatatggagggacagctctgttattaagacttttaaatggtatagttattgcctttgcacagccttatcatttttcttgaaatgtggtgtcaagttgcaggagagcgtacctttaggtgactgattattttttaacatggtaagatacacaacacaacgtttaccatttttaccatttataagtgaacaattcattggcattaattacactcacaatgctgtatactcactatctgtacctgaaatgtttccatcttcccaaatataaacactgtatcaattaaacagtaacttgcctggcccctggcaatcaccattctactttctgtttctattagtttgtctattctgtgtatctcctaggggaatcacagattatttgtccttctgtgcctggcttacttctcttaatattttcaaggttcatttgtgttacggtgtcagaatttcattcctgtttatggctgaatagtattccattgtgtgtatatgccacgttttgtttgtcccagtcatctgttgacggacacttgggctagttatcatggctgttgtgaataatggtgctatgaacattgtagaggactggtttttaaccagtatcggttagagaatagtagtcagcattatatgatcccactttcaactaactgcgtacagtggagggaagactggggagttcatgtattattttttgcttaatattacctcagttgctgggtccattttttctgcctgtgagcttggaatcatatttcttacctttatttccaaaaactgattatagataattgaagaatattgaaactaaatttatttcattgcttggggttctgttaacagttcctattaaactaacatctgcatatgttgtttccttattctgaatatgcatttttccgtatcactagttcaggcaacaatgctactgatcagctctatgtcctagcttcgtgtgaccttgagcaagttattcagcctcttgaggactcactttcctggtgagtccagtagacctcggcagcaagatctcaactggataaggcaggatgtaaataagtatgcatttctctttgtaaaagtagcagcaacaaagtctgagcacataatactggcagcatgccaagcgctttgtatggattatctgtttgaattgtctaagattagtatgatttttatccccatttaactgacaagaaaactgagactaaagttgagtaacctcctcaaggaccctcagccagttagggggcagaaccaggtttgaacccgagtagatgagggcagcctcagcttggaagtcttccctgctccttggggctgtggtgaggctctgaggtgtcttcagaaccattacctccaacccttttggtatctcagaaacttggtggttactgctgtggcataagagtgctccctaaaatccgaccccacttacactcttagaaaatatctggtcagtatggtacagtcaatgtttaatctcatgagttaacaagagaaaaaaatctaaagaaatagaaatgagttatccaaagtgagtctcttcagggatttataagctcacacttggcctatccagaacccatgctggccgtgagtaggctcgtggttgggggagggcctgttgaggagcatctgttgatgtgtgattgggagttgtctgttctggtgaatcctagttgttattttgaagttttagggacagtttccataccctgagaacagcatggtgtagtagagcctgaagacctagttccagttgtgccatgtgcaaggtaactctggccttagatttgtcacttatcttctgctaccatcagttttcccatttgaaaacggaaattataacttgccctgcttcatcatagggttatcgtgaagatcaaaagggctagtataagtgtgagacattgattgtaaagtgctgtacaagtacatgatgggattattcagctggggaaatagcatttgtattaccatgtactcatggccaagaaggctgcgattcacgtatcagtcctgaatgcacaccagggctgtccagcaggggatgctagctttggtagacactggcttttgggacttaccaggtggactttattgaaagaattatgttttcgccattgagaaactccatgcaggactgaaaatctagttcctagaattccaagggttttaaaaaatcgatttcttgagaatgattaagaatgtcagtgaattggacacattttaattttctaatgtttaatttttttttcaagctactacagcttaggttcccaggtacagtaaactagaaggaataaaaatgtctaacatagtatttcatacaggagaagagcaaggacacaccttctaccccaccctgtcaccatcttcctttctcggaagcaaagttgtataatctgaaaaacctgacattccatattgagggtttattgtaaggtagtaaaaccagattttatatctcatttattcctacaacttctgatgtgcttccaaaaatggtattaaggcagcagctgaggaaattttatgagataatgaagcagaacagttactgaaagccatctgctcagttgtttacaaacttgcttcaatacttcagaggcaatggtagggtacgtgtctaaacttcacaagctgcactaggtagaactaaatgaagtgcgcctgggctgggctgagctcgggccctctctgtgcagtgtgagcggttgccaggcaggcctgttggaagccagcagaaagcaccacacagaggtgattatgtgccaccatctgtcacgcttcaagcctaccatacagcatggctaatcagccttggcaggatgatggatgaacagcagcagctgccaaaagccactgttggcaaacagtcctgaagttaagaactttttcccccctctgtcttcctctccagggtcctgctgcgtgtccgcatgctgtactacctaagacaagaagtgataggagaccaggcggataagatcttagagggtgctgactcaaggttagtgcgagctcacatttgttctcaacctcagtgagataatctgggtagccggaaaacatcatggattgtgtttcagaaccttcataaaccactagtaacccatctccttttttgcatcttgaatgcagtatttgtccttcgtgcttggggatgtgatgagaatcaggaaaaggctgtttgcatttatgtttgtagtgtaaagagatgtgaactaaagcactggtgttctgagatgacccttaaaatgggataccatgtgataaagttcatttctggtcatggcagagggctactgactcatgccctttcttttaaccttgctgatacctccccaccatgctcagatgtttatcgtgggagagagggcatgtgagctatgtatcacattcattacttggaattcttttttaatactaatatttcttataaatgttgtctttcagtgaagccgatgtgtggatccctgaacctttccatgctgaagttcctgcagattggtgggataaggaagcagacaaatccctcttaattggagtgttcaaacatggtaagtgacgtttctgtttgaatacatctcaactgtatggcttggtctttatttagaactctttacatactcttttccaaagtcataatattaatgaggatagttccaaaggactcttggcgtctaccatttttctgtactaaaaatctaatatgaactgtaaatatcagatgctgtttttgaatgtttgttgagcatttgagaagaaaacatttctttcttggctgtaaataaaacccaaaccatatttgttttaataatagccaagttgtactatagctctccctaaactttgcttccagcgcggcttcccttgctaactctgccaaccagtgtcaaagtggacggtgggcttaacctctgctattaatctgtacaagtgcctcctgggctttgttccaagcaatatttcacaaatgtcagtgctgagaactcgcggctcccctgagtgggatgcagccttgttaactttgaaaggctggggatgcagaactggcatgatatatacagtgagcgattcctgattataatcccaattctctggaggtcgcggaggtattctcagcagcccagcctgactaaaggggagaatgatggcttataaaacctttcatgattacagtttggcttgcggctctacagcagttaggagcggtgtgttgtagtacacatcctaattgaattgtgctgttctgcctatgtactgcagccacattttgtgagctcagcctcaaaatcattttcccgcagtgcactgttgggatctgccattttccatctagtcaacttgggcagtcaaaaagcaaattgcagtttgaaaaccatagagggaaccgtgtcatcttactgacatgcatcatcctaaacctaataagacaggttcgctggccttatgtatatggggatttttcagccagccatgcgagttcctgcaggactgatgctattcacagagtggatgggggtggactcagtgcacccctgcagaggtcataaaggaacattgcgaatccttctaaatgtcaagcaaaattagatctggggaaaaatagggtcagaaatcctcccaggcatcttgcagttattctgaacctgtttttctattagtgtttgtggtaattctgataatatccctgaagtgtaacttggctcccagtagcttccctagaaggagcgttccatagaatgatctactaaaacaaggtccacttggattcaacagagatgctaaccttgactgaaaaacaaacttgtgttgtggcagtgctgtgattttgccagtgatggggcctttctttgtttctgtgtgttttctgtgcacggatgggcacggcacaggctatgagaagtacaactccatgcgagctgaccccgcgctgtgctttctggaacgagtcggtatgcctgatgccaaggccatagctgccgagcaaagaggaacagacatgctagcagatggtggtgacgggtaagaaggacattttaaaatttgaataaactttatgtcagtttcacatctattggcagggttcagttcttaccctgcagtacacactgtattgtgtctgatttgaagttcaggagatgtttaccagtctactctatttgtatgtcgtaatgactgtttaaacaatatacattatcttgataatctgaaacttgtttttcttttccaaatgtcatttcccgcaatctccccagaccccctccaccacactgccatggctgcatgttttaaatactgatagagttgcttttgatgtcaaacccataattaaaagtagcactgggcagattattactctttcctacccaccccccttccttcttttgcttatcagtatgattcaaataatttttgtgtttgttttacataggggagaatttgatagagaagatgaagacccagaatataaaccaaccagaacaccgttcaaagatgaaatagatgtatgaacttgagtatattggcttttatagctccattaaaatattatatgcccacataagacttgttaaactttatagataatgaccttttctttaaaagacaaagaaaaatgagaccccaaattaaagtaattctgtttcttgctttgctttcaaggaatttgcaaattctccttcagaggataaggaagaatccatggaaatacatgccacaggtaaggtcccagaaaagcttgtgtagccgagcagacgtgcactgagcagtcattgttcacgtggtagggactgtcctgcttcatgacagcagtgtcttaacaccttatttcttctacactgacctgttttgtgaatcattttaattcttgttaatggctgtgttttcatgacattgaatttcttagataggataactatttctttgatgataattagctgatttatattttacactaattagtgaaaaattttaagcatctaaactatagctcttgggaatagagcatagagcatttgctaagtattcacctaaaatattttcagtttatttagaatattgaccttttaccgaatataaaatcattacacaacaattatgcagttattttttatactcaagatgattattgcacatacattagaggagagtaccttataagaagtttatgctgtaaagtgtgtttctttatgtaggactaataaataatgttttcatcccctctaaggaggtaaaaaagaaataagtgtatatattccaagtgaatgttattacttatttatattttaaaaatgagggcactgagatgccctttcccacactgtcatttgaatcttaatgagtcatcctgttttgttggaatactctgtattgcaagattgcagctacacatttcaaaaatgtttttccacttccccaggcaagcacagtgagagtaatgctgagttaggccaactttactggcctaacacttcaaccctgactacacgtctgcgccggctcattactgcctatcagcgcagctataaaaggcaacagatgaggcaagaggccctaatgaagactgaccggcgcagacggcggcctcgagaggaagtgagagctctggaagcggaaagggaagctattatatctgagaagcggcaaaagtgagtttcttcaaggtttccactcagctcccggtacatgcccctctgccctgctcctgtagacccacaagagacaggactcatatcaaaggtagtgaccaccaaagaaaggctcgctccaacaaagcagtctgtttccccacccccaaataactaccatgtataaagtctggggggaagaagaaaagaaacagtaaatattaagtcttttcctgaagtatgatgcaagctaatataatctttctaacaggtggacaagaagagaagaggctgatttttaccgtgtggtatccacctttggggttatttttgaccctgtgaaacagcaatttgactggaaccaatttagagcctttgccaggcttgacaaaaaatctgatgagagtttggagaaatacttcagttgttttgtggccatgtgtaggcgagtatgtcgaatgcccgtcaagccagatgatggtaggtacatttagcaacaaagttctatacaaaaagacgagtaaagtgaaaaataagaaagtgtacaatgtagaatgcccttgaattctccccaagtaaatatgagcccttctgtgttacagaaccgcccgacctctcctccataattgagccgatcacagaggagcgagcctctcgaactctgtaccgcattgagctgctacggaagatccgcgagcaggttctccatcacccccagctgggagagaggcttaagctctgccagccaagcttggatctgccagagtggtgggagtgtggacggcatgaccgagacttgctggttggtgctgctaaacacggggtcagtcggacggattatcacatcctcaatgaccctgagttatccttcttggatgcacataaaaactttgctcaaaacagaggggcaggtaatacatcttccttgaacccactggcagttggatttgtccagactcctccagtcatctcatctgctcatattcaagatgagagggtactggaacaagccgaaggcaaagtggaggagcctgaaaacccagctgccaaggagaaatgtgagggcaaagaagaggaagaagaaaccgatggcagcgggaaggagagcaagcaggaatgtgaggcagaggccagctctgtgaaaaatgaactgaaaggtgttgaggtcggcgcagacactgggtccaaatctatttcagagaaaggttccgaagaggatgaagaggaaaagctggaggatgacgataagtcggaagagtcttcccagcccgaaggtaaggccttaccactggcccctctcctgaccctgcagcagctggttgtgagatgcgttgctttctggcagcacggcacctgctctttttcacgagtacttagtgtacattttcttctgtgaagggataatttcaagttatgcttatatctgtgttttgctctcgcaccttatagcacctaaccatggtattttgaagaacataaactctaagaagggttgcatggacacattagcaatttctggtttaaggatggaagttaacttgtagtgagtgacagtgtattaagaattctatgtgattttaattttgacaaatgtgagggaaggtggtcattcactgagtaaatattgttaatcattttgaaacaactggtgcttgttatgttttgattcagaagtaaagagtgggaatagaatctaaaaataaccaattttttaagtcacagtacggttgctgaaactggcccagaataaaaatagagcacgtactgtgctgtagctggaaccttcaacttttgacagaaggtcagcccttttttctgtgtggaagaacatagactcttgagtcaatgacttggttggctatcagcctcttgtaaggtttacttgcacggtgctaggtggctagtgactaacctctctaagcctctgtgtcatcatctgcaagatggaaataacaccatctatgttaaagggctgttgtaagctttagacaacagtgcccaataccattctagccatgtagtaggtactcaataaaatggagctgattagtattcacatttttaatcatgtcctttctaaacttcagtttccctgatactgtggttgtgagtaatgcacattaactcatttctcagcaggagctgtctctagagggaagaattttgatgaagaaagcaatgcttccatgagcactgctagagatgaaacccgagatggattctacatggaggacggagatccttcagtagctcagctccttcatgaaagaacatttgccttctcgttttggcctaaggttggcaggtttttgttgctgttgttttgctgaccaaaaaggattagggtagaggaaatctttctagcttgatttttcaagtaattttaaggtaaacttttgacacagtatatgaagactatagatttttcttatacttttaaagaatgatctgaaaaagcccaaagaaaaaaattgtagaacacttttctaataggatgggaaatgtgatgtgaaagaaagataataagaaatagaagtgtgtatatggattgatctttggctccatgtggcttttaggttacttacccccgttgtctagcataatgtatggattatcactgtgttttaaaatttttttgtgaaataaagccttcagatttaagacaactttatagttttggaaacctaccagcttcttgacttggaagagggtgtactgttgacccatttgcttttgacgcattatgagataattccaaatgtagttatctgtaaccaaaagcaaaatggaaattacttttttggctaaatagtataattttataataattccctgtgtaatttaggtctgtttttcagggtgaggaaataatcatcctaatcaccataacagggctgtctggtttaaaacaacacaaaaaatgagcttcagtcagcctaccccccaggctcgtctttcccagtattattgtgtaagaaacaaggtgaaaattttgaccaaagaatgtactgtcaaagacattttgtttcctctctctatccctttagttcccctgttatgctaacctcctttattgagtgtaggagggagtttcccagatcagtcaaaggttatagtagcaggcacttttaatctatggaaactcagtctaaagctgtaattagaaatttttaatgtacacgcttcaatgaaatttgaagtgataataggtagggaatgcaaattgacattcattaggtgttcctaggttggtgcccacttcataatgctgaactttattaatagtgacgctaatgatgtcctacttcctgggactgcaatccagcctgtagatctgaagggccagggcggcaagaagctaatgcagggtttccattgtcatctactgacatccaccagcagagctctatggagcttgtacaagagttactttttaaatatgaagatattttgaaggtggtgattatgtagtacatttttctgttttatgtagttcagtgttcgtaattaaaaatagcatgttttctgtgttgaagccacctaggaccttctgccagagcaatgccattataggagattttgtttatttactttcttgtttgatttcttgccttgttttcttttactttttgtcctccagttgacttttaaacattttatgctcttttgcatcttgatggatgtatttatctagtaattttaaccagggctttgttaaaatttcttgtgacttttcttctccctccaggatagagtaatgataaaccgcttagacaacatctgtgaagcagtgttgaaaggcaaatggccagtaaataggcgccagatgtttgatttccaaggcctcatcccaggttacacacccaccacagtggacagccccttgcagaagaggagctttgctgagctctccatggtcggccaagccagcattagtgggagtgaggacatcactacgtctcctcagttgtcaaaggtgaattagaatggcttgtttctgcagcttaaaagggagctctctaagccttaactgagtttgcgagcttatatttcactggccttgcttagaaataagatagctgctgtttcctcagctctgtgcaccagtcatgaatgcttaattccttaagcttcttgttccttatttctaaaagccagcccatatagcagtactgttttggctcactgcaactctgttctgttggaatttttcaataggaagatgccctcaacctctctgtccctcgccagcggaggaggaggaggagaaaaatcgaaattgaggccgaaagagctgccaagaggcgaaatctcatggagatggttgcccagcttcgagagtctcaggtggtctcagaaaatggacaagaaaaagttgtagatttatcaaaggcctcaagagaggcaacaagctctacctcaaatttttcatctctttcttcaaagtttatcttgcctaatgtctcaacaccagtgtctgatgcctttaagactcaaatggaactgctccaagcaggcctttcgcgcacacccacaaggcatctccttaatggctccctagtggatggagagcctcccatgaagaggaggcggggaaggaggaaaaatgtggagggacttgatctgcttttcatgagccacaaacggacgtcattgagtgcagtaagttggggagcttgcctgcatggcgattgcacgtgttgacagctgagggtcctgtgatgctcacgatgctgggctgtgtttctctcagcagcattgtatgaaagccagcttcctccactaaagaaatagttttacaataaacagtcatgattctgatcattgatacagatcacttggcctgaacgaagtgtagcttgaggatgtattcttcccaagttctgatgtgttgattgctctcagaagaacagccaaacctagaaacatgttcttctgaatctagaattgttatctctgaattcttgaggtggaacaagtttcattgatatgttttaggcctggcatttattaaaattagtataaatgtttcattttggacctaagatttgggttaacataaaaagctagtgactgcaaattctcctgtctccttaagtagatattttaaaaatttgagctgtgcttttgctagaataggtttgaatagaatgtgtgaaccaatggattttgacttttcctttctcagttcagaggaaataaattaatgcagtataatcaaaatgattttctttcttaatctgcttcaactacatctcacccaaaaatgtggtgcctgactcactgatgaccagaattttatcccaaagagcacaattacatgtgcttttttaaaaaatggtttagcactatatatcttgaacctattgaccagaagccccagtcaccatagtggctggaactccttgtctgtgttgtgaggagtgggtgctccaggaagccttccaggtactgggccatcctggacccttcttcaagcagtgggacacagtttgggaaactgaaatttgagattgagggaagacagttgtctgtttcaacatgtttttacttacaccatccctattattatttgcccattttctatttcttgaactcagagaaagcttaataagatggcaggaaaagacatggttgagttaaagttcagaaatgaaaaataacatccactgaaatttctttgccctctggtggggtctaattaaaacagaagcattcaggtggctaagagtaaattttcaaaattgggccgggcatggtggctcacgcctgtaatcccagcactctgggaggccaaggcaggtggatcacttgaggtcagcagttcaagaccagcctggccaacatggcaaaaccttttctctactacaattataaaaattagcctggtctggtagcacgtgtctgtgatcccagctactcaggatgctgaggcaggagaattgcttgaacccaggaggcggaggttgcagtgaatcgagattgcatcactgcactccagcctgggtgacagagtgagactctgtctcaaaaaaataaagaaaatttttttcaaaattgattaccaatgcagtgatcatcataatggtcatatttgttgatggtatgattgttttcagaatcctgtaaaagtacactttgtaatggactagctgtgacttacatgttttctgtaagttaaaatgccatttctaggggtatggccctcagacagagttgtagcactagtaaatagccttcctgtttgaaactacttctttgatagattttgttgactgataaattctttctccataaactttaacaaattgggaagtttctgcagctgacacttctttttgtttgttatcatgttcaatatttgtaggtttttttgtttttgaaacagggtttgtttttgagacagggtctcactctttcgcccaggctggagcacaatggcgcagtctcggctcagtgcagcctccaacttctgggctcaattgattctcccacctcagcctccctagtagatgggactacaggcgcgcaccaccatacctggctaattgttttgtatttttggtggggacggggtttcaccatgttgcccaggctggtctcaaacttctgggctcaagtaatccacccacctcagcctcctgaagtactgggattacaggcaatcatgttcagtatttggatcacgacacagctttgtctctggatcaggtgttaggaattaataatgcaacacacgtgcttttttcctattgcaagtacacattctattttaaatctgagactgattttattcatttcactattttaagccgttgttaagaatttgttgatatttttctttttctaaagtcccatttagaaagcctgagagaattcctaattgaagttagagaatgtatttttaaaactttttttttttaactgtcacattttgaaatgtagggattcctcatttggtgttgtcgggggtgatgtgcatgcacataaaatacaaggaaagcactgctcgatctgtaaataaaccaagtaggaaaagatgtaaaggccagcagtgttacctggatgaaagaggacagatcctagaatttagtattttgtcagcactctaactgtgctgccatgaaaaagtaagagtgcattcagcaacagtggacaagctggcactattccctgtgccagcactgagagtcaaaaaatacagtcctgacaagtgcttgcactggagaatgcagtgtttaggatggggtagcacataaatcataatgtgtcctggttgttcatgtgtgccacgaccaagggatgtctagggtactttgtgagcccaaaggaagcctgggagtggagggaagaggatatggggagaaacagatgaagaagtttccctatggatggctgtacttcaattaagttttgaagatcatgtagtagttggtcattttaaaagggttggcagagaacatgtgtaagaggagagagcctcttgggtttgaagaactgaggaatttgctgaggaagtgagcttcagcagagatgagcttgcagagaaggcaggatgcaaatcatggagggccttgatgccattcggaagaacttggattttgtcctggaggtaatagggatgcaattattgaaaaaaataggagagtgatgtgacataattttttgaactgggaagggctgcattttagaaaactgactccagcgtagtggtgtggaggttggattgaagataggtgggattagaatcagggagaccatttaggaatattgcaataacctgggtgggaagtgacaaaagcctgggccatggtagagctgtggggaaggagaaatgggtgtctggaggttgaaataactgtagacttcagttagtggtggtctttccaatgttgccacacatgtctgagacaaagtgtcccactaccaacaaaattatattgtgcacagagtgcccataagttacatatagactggcttttagaaattcctttagtataaattatctttaatatcattatccggggatctccaagagagactgagaggccgcctttcatgcatatcagctcagactataccccccatgttgtattcccagtggctggcttaggatttcagagcatggaaccttagtggactataaattttttacctaattactagttctacagtgtgaagaatgatataaaagtttcgtcttcttctttttatttttatttttttgagacgaagtctcactctgttgcctaggctggagtgcagtggcacagtctctgctcactgcaacctctacctcctgatttcaagtgattctcctgccccagcctcccaggtagctgggattacaggcaagtgccaccatgcctggctaatttttgtattttttgtaaagatggggtttcaccatgttggccaggctggtcttgaactcctgacctcaggtgatccgcccacctcggcctcccagagtgctgggattacaggcgtgagccaccgcgcccagcctcattttctgacttttaatagctgttcccaaacaactagacattgtttctagtaactattttctctttttgataaaagatccattctaggatagcgttttcttgaaataggacattgtcagaggctctctcttcgtgtgagaattcataccattgtgaactttctgcaggaggatgctgaggtgaccaaagcttttgaagaagatatagagaccccaccaacaagaaacattccttctcccggacagctggacccagacacacggatccctgttatcaatcttgaagatgggactaggctggtgggggaagatgctcctaaaaataaggatttagttgaatggctgaagctgcaccctacttacactgttgatatgccaagttatgtaccagtgagtattgcagagtttagagttggaaggaatcttgcaggccggtccacttcattcccttacaacatagaaatccctgacagctggtccctctgccttttccttgaatgtttcctggtctcaaacatttcccaggtctttgttgttgaatcttcttcattacagatactagcttcaggtctgtcttactgaaggcagccttacagttatttgaagatgcgcgttatgcatttccttactgtttgcttctcccatcaaactcatgtgacttcttcagttattctttccatggcatcgtttccaggcagtcttagtattggggtaacactgttgaatgcactttctccagtctccagacgaggccccgccatcccagagtgctatgaagccaattacttccagagatttgaccagttagtgcagcccaagattgtattagctgcttttatggcaactaatcctggtgccttatattaaacgttagacagttcatatctccaaatggtttgtcacacgaactgtttgctagctagcaatgcaagtcttttgctttctgtatttatgtgattgattttttaaaacttaaatgtagagttttacattttattttgttgggttcagcctagagttcttgccactcagaaagtacccccaccccctacaagatctgtctgtttgttggttagttctcattacagacagtctcatgttgttgatggggtatcatctctgtgttcattggagccactaactagaaattagtaaaagtactacagaaagcctcctttaaaagtatcatgacttggttaaacatttaaagaaaaactttaagtgaggttattgatagataaaaggaaaagccaattctcacttatgtattccttaatggacgggtaaaataggagttttttctttcaaagagaaaaatatggtttctaatattaataattaaaatgattcttgaaacttccataataattgaagatgatctgacagttctctttggcatttatatagagaagaataagtactaaataccaattttactaaatatgttttttcttttgcagaagaatgcagatgtgctgttttcctcatttcagaaaccgaaacagaaacgacatagatgtcgaaaccctaataaattggatataaacactttgacaggagaagaaagggtgcctgttgtcaataaacgaaatgggaagaaggtaaacgctgggaaagggaattgatcactatgcgatttcttagcccagaaggaagtgttttatcctgccttcttctataggggaaaagaatcctgtctgcccgaatgcgtgtgtgcgtgtatgtgtgtattatagaagggggagggagtagattaacagaaaggggagggaagactgtgtttttaatcatttgtcaaatgcctctacccagatgggtggagctatggcgcctccaatgaaggatctacccaggtggctggaagaaaatcctgaatttgcagttgctccagactggactgatatagttaagcagtctgtaagtacaaactgcatttctatcaagaaaggtagctatacaaaactgttttccttagtctttcttattttctgttggccattaattattcagttgtaacttagcttaaaagaattgacataatacatcattttcatacatcatttcatacatcattaatacatcattaatccaaagtgaattcatttatcagctccaatttaaaaggtttgtatggaaacatacattcacaatcttagaggtagacttctccaggggggattgccccagctaagcctacttaacagctcacctgtggaataggatgtatggtggttgagatcattaagattaactgtgatttctgatttaaaaacaaaacaaaacaaaacaaaacaaaaatacaacagttctgcctaaaagatttgttaccattagctttttaaaaattcgttcatgacatgctggttctttgttttaattatacattaaaaatgtctttcggtgtaacattctgttgatcttaacacacgtgtgagtttgtgaactgacaccgtagtcagaatagggttccatcccccacccccaccaccccgagttccctcacaccgtcctttccccgaccccagcccctggctgccgctgacctgttgtccatccctgtctttttgagaatgtcctgaaatggaagcatgaaggacataagtcttgaagcagtttctttcgctcatcatatggaaggtcatcgatggtcacatgtgtcacagttatctcctttctgttgccaagtagctgtctccattgcatagatgtgacactggacggcttagccctcacacactgaaggacatctgggttatttcctgatttttgaaactatgattagagctgctataagcaattgtgtacaggttttggtgtgaacataagttttcatttttctagggtagatactaaaatataattacattttccatatttcaaaaatacttttacatatatttgaaatatccaaaataacacattatagagggcataaaacatcctgggtttatattatgttatactattttataatttttctcccatacaatatctttttttttcttttttttttttttttttgagacaaggtgtttgtcacccaggctggagtgcagtggtgaaatcacagctcactacagcctcattctcctaggctcaagcaatcctcccacctcagcctcccaagcagctggcactacaggcacacatcaccaagcttggctagtttttgtattttttgtagagaaggcattttgccacgttgcccaggctggtctcaaactcacctcaagcaatctgcctgccctgacctcccaaagtgctgagattacaggtgtgagccactgtgcccagccaaaatttttttttaattgacagatatttaattgacaaaaattaattgatgaatcaaatatatatgcaaggtgtacagcacagtgtttttttcttttaagagacagggtcttgctgtgtcacccaggctggagtgcaatggtgcaatcatagctcactgcagcctcaaactcctgggctcaagcagtcctcccacctcagcctcctgattagccaagtagctgggatgacaagcatatgccaccacacctggatattttttttttattttgtagagatagggtcttgctatgtgccccaggctggtctcagactcctgggctcaagaaatcctctagtcttggcctcccaaagtgttgggattacaagcatgaaccacggcacctggcttcaaagtgatgatttgatataattatacattatgtactttcctttttaaaaatttgttatgggtacatagtaggtgtatatatagggtacatgagatattttgtacaagcacacagtgcataatgatcatgttgggtagatgaggtatgcatcacctcaagcatttaccctttgtattacaaacaatgtgattatactcttttagttattttaaaatatacagtaaattattgttgactgtgtagtcaccctgttgtgttatcaaaaactagatcttactcatcctgtctaactctatttttgtaccccataatgtactttctgatgtatgatttcttgagttagttatggatgcagctaacttgacatttacctcactgatgagtagccttgagcaatttttctgcagttcagcaagctaacataataataaaaacaagttttgctgtcattaagttttatcattgagctgttaggagggaagaactacttaggtatttccatttggaatggcaggttcaccacagaggctcacattgagatcaagttgtcttcgacagcctttatagccactgtttgcctcccctgtactccagggttttgttcctgagtcgatgtttgaccgccttctcactgggcctgtagtgcggggagagggagcgagcagaagaggaagaaggcccaaaagtgagatcgccagagcagccgcggccgccgctgctgtggcctccacgtcagggatcaaccctttgctggtgaacagcctgtttgctggaatggacctgacgagccttcagaatctccagaatctccagtcgctccagctggcaggcctcatgggcttccctccaggactggcaacagctgccaccgccggaggcgatgcgaagaaccctgctgctgtgctgcccctgatgctgccaggaatggcgggcctgcccaacgtgtttggcttgggcgggctgttgaataaccctctgtcagctgctactggaaacaccactactgcttctagtcaaggagaaccggaagacagcacttcaaaaggagaggagaaaggaaatgagaatgaagacgagaacaaagactctgagaaaagcacagatgctgtttcggctgctgactctgcgaatggatctgttggtgctgctactgccccggctggattgccctcaaacccgctagccttcaaccctttcctcctgtccacaatggccccgggcctcttctacccatccatgtttctacctccaggactggggggattgacgctgcctgggttcccagcattggcaggacttcagaatgccgtgggctccagcgaagaaaaggctgctgacaaggctgagggaggaccctttaaagatggagagacccttgaaggcagcgatgccgaggagagcctggataagactgcagagtcctccctcttagaagacgaaatagcacagggtgaagagctagactcacttgatgggggggatgaaatagaaaacaatgaaaatgatgaataaccagtaccagttccagttcaagtgtttaaaacttttgacaagtggtagtcctactgtttacactcacagttaatgttcatacctagttttataagctgttctgtaacatagtgtagcaaaaaaaaaagttcaagtcatgttatacaggtgtgtcaaaaggtatcttggtcattaagtattgtgcagtgcattatttattatccctaggagagatgaaatttgagaggtgatcatgtctttttaaggaaacttacataatgctctgctttttttttttctcttggtaccattggtattataataaagagcaatttgtaactgagtggcactaatggaagaaagtgctgctcaaaggaagtatgaagttatatatttaattttttaattttaatttttaatttttttgctgtgaaggtcaagctgaaatttaccatacatatcatacttgctcatttgtttccctttttgactgtatgggggttcccacactcgtgcatacacacacatccatacactctgacaatctccacgctagtgtgaacgcctctgtcccgaggcgcagcaataataaggcagctgttgaatgtgaagggtccctttggaaaattaacctactgggagggttcttgccagacagaactacagttccattgtctcgtggtcttgtaatgcactggtaaaaacaaaataaatagatgaataaataaagagtgagagaagagagaatcaggtaccttttttaaattaaaggactttgttactttagccacaaagctaaaacagcattacctcagctctaaactagccttgaagtttacagacatgactttgtaaatgtattgtttttctttgttgtgatgtccttttatttttttctttgaaaactgctatcatgtaagataaaatgtaaattgctgccaactgtagtaatgatgcttttaataaaagtgacccatgatatgcagagatgtaattatagaatgtagtatatagggaaactggtgttcactctattttttttgtattcgcaatagatgcaaatacagcattctggcttttgtacagtttcttgatatatcctcttatactagattagcttttggtaagacactaaactgtctcgaagactagacaggaaggaaaaccttgaattactctcacataattccactccagatatctcaacagaaatgcatacaaaaagctcctattactccctcaaaagggcatctgagaccgagaatacttagaaatgtgtgcagcgtgtgataatgtggtacactgaagaacaaaagggcaaaagaaaaatgaggctttaacaggcacaatatctaggtcatttatccttggttaatgggtagaaaaacacaatgcggtagtgtcagcaagggacacaaaggcactctggtgtcctgcagaccagcgctcgatgccagaaaccagtgtgtggaaaaacccatgtggaattgaaacagacccacttaagcacgcacgcgcgcacgcacggtctcaggagctactgatttgtggacccctttttgacctttggtatttaaagtaaaatataatttgagatctactgttttcacctttttatgtcacctgaaccaacacaaagccatatttccatccagttaaaaagcaggggaagggatgtggacgagagtgtttcgtgtgtgttgccttcctccacacccttcccccaggacgtccgcacacagtccacctccagccagtgtgctgccagacaggtggtctaaattcctcccagactgtgagattcagttcgtttatgccccaagatgaaaatatgccccttaatgattctgggaaagaaacaacctgaaccctccaccttacagatcctgtgattgcttttatttatcatcgtcgttgtctgctgaaagtgaatgggccgtgcacactggaggaaagtgccttgaagagaatattttttgaaagggaattatttgaacacgggaaagtgaaactaggtctgcatgaagtataggaaatttaagtatttaagtaacaaagatgttagcagggagaatttgcttaataaaatgagtcattaaagggtgttttttttaa

SEQ ID NO: 1626 - DNA, 51120 bp, Homo sapiens
cttttaaatttgcgttgtaagatttattttggctctccccgcctgttctttgcacattaaaaatgaaaaagtttgtagaactaagctaagcagatggtcttcctgcaaaaagaccgggctgaagtaaagcattgttttggagctggttcacagaaaaaaggcaaaactggttatcctgacttcaagctccaacataaactgctcgctttctccgggaaacttgccccgccacacacacttgactgcgtggccagttctttcgaagcctctcgctcccaacacggagttcctcccatttcttcacagtcggctctcagcagctgctgctggtttctcggctccagcaccacgagtaccgcactctgaggtttacaaagcactctgcttcaccgactgtgatcctcacagtcctgtccggtggcctcacgcaggtggcggtgcagcctttcaggcccagagcggccaggagcgaagcccgcagccccgcctggaagcgcagcgcggtcggtcgcgcgcccctgaggcttggaggcctgggcttcccccagcagcgctcgagcaccgcccagtcgagcctcacaccggatgccacttcatatttgggcccagagctcaattcgcgccgatgcggtccgccgtccttaaatctcttcagccaggatctctccccgactgcaaagcagccctgggcgggagcggcaacatctccacgtcacccttttggagccgccgacattcagaggggcaggacacgggaacgcgcgctgtcttgctttacggcgcgggtgcgcgagtttgcggcagcgtgacgccctcaagttttggcgggaaaagcgctgcatttggattcctgcagtggtgggcaaaggacagtccggtgaggaagggcggccggtagagtagggaaggtttctaaagaaggagttcggggtctagattagtgagggagggcatggtgggagaaagttagcattgactagcgcaggggattggagagactcctgcggaggggcggtttcggagggtggaggaatggtaccaggaggttcccgttgtgggggcgggggcaggagggactaacccgctgctagctaagaaccccaaggaagagtcccagcccttcctttcgcctctgggggcagtttggccccgccccggcctttgggacgggtggggctgtggatggggatgggaattggaattgagcaattgggaggaggcgctgccgcaggcgttttctgccccataccgctccctatatcctcttcctctcttccccagacccccacctctccctcctccttccccagtcgttcgccggaaagcatttgtctcccacctcttcataacaacaattaatttcctctggggcctgaggagggcagaatttcaaccttcggtgtgcttgggagtggcgattgtgatttacacgacaaaatggtcaggtttagaatagttgttcgtggttgaaagacttggataaatgtggatgagatagaaggggaaggcaagagctgttaattttcgtgggcaatcctggggagaggcggggctcagtggcttcactggtgatcttacactctacatcttttctggattcctgccttttacagccgaggtgctcggtggagtcatggcagtgccctttgtggaagactgggacttggtgcaaaccctgggagaaggtgcctatggagagtgagttcttttaagcttgccttcgttttctgagtgcatattcattgttttggagtctcacactctggtgatttagaaagtagatgtttgagatccaagggttttggcaactgaagttacacagccttttgctaggattaaaaattttttccttccctttaaaaaaaaaagttttctttgtagagagctggaagggacacgaagttattgtttccatgcccacaaatggcttctcagggtttaagcattgcggttaatgagcaaatgagcagactctggagattgcctgcctggtttcagatccttgctctatcacatactggtcattgttttgtgatcttaggcaagcttcttaatgtcattgtgtacctctccttcactacctttagggtggcaataatcgcatctaccccataggagcttaggacagtcagttacacaagcacatatagtatgggattaatgctcttaaaagtatatgagtagaacatgtatatatgtgatgtggcttagaattatctcaatctattttatgaagcgtttattaaatgacttgtgtgacagcataatgacgtctttggagggttagctattgtatttcacattttagaaaagagtagtgtgtgttgagaacatagcagaaaccacttccttggtttctcctttgtggaaaaagtaatagaggtaaaatcgttttggatgagtcatgtttaatctttggaagttttagaagaaatggaattctgtaatgttaaaactcttttcctttttagagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaataggtatggaagaaatttaagataattattttaaacaagtttttaaatttgttttttaaatcttgggcatgctatttggtcgttgtcctttcaaaattgctcatgcaactgtgaaattggaatacattatctttaaaaaatttttccacctggtgttaataacataaaagcatatatagagtcaatgaaagaaaacttctttcccaagttatataagtgattttgatttaagattggtgtcttacagaatttaagagtgacaaacaagttttatggtacatcataaatgcagtgtatcctaaatgcaatgtattgcctacacaattttttctttgtagacattctagttacatgaaatcattgtatacattttatacatttacagatctaaaatagcatgctgtttcctcttggtttacatgaaataattgagaattttctaggattgctttttgtatattaagtaaattctatgtttgctattaatacttaaatattcgatgtagaatcaaaggattgatatttcagaacactgagaagtacataaaatctggatctaaatttataatttaaatttataatttaaagctattgtattaaataagtttatcagttaaaaactgataaagaggtattaggatctccagtgtgactcaggagagagttgagggtaaaagaaatggagttaatgagagagatcaaaatataaaaagataactgataaaagaactttcataataaaactgtttcacgaaggacctcacaggcatttgtggttttgtactgtgagactatatgaagtttaaatctgagccaggtgtggtggtacatgcctgcaatcctagctacttaggaggcaggaggattgcttgagctcaagagttccaggttacagtaagttatgatctcacgccagggcactccagcctgggtgaaagaacaagaccgtatctctaaaaaaagttaaattataaaagaagtataatctgtaaaatatttagtgaaattggcttagatttgcccagacttcccctttggcattatatttcaggaatgagaaaaataattagcatagcatttagaagaaatggggggaatttcaaggttactaaataaatcagggttagtataagaggaagcagaggctttgaagtcatggcttgcattcttgatttggatattggttttctctttataatttttctgtgatgacgccttttgccacctaacacaggtaaatgtgagttaagccccatatgtgttagtggactcctgaatcttttgttggcatttgcttctgtttgcctaagcacatttgtaaatgtctaagcttcaaattaagaagctatgtggttgctacctgattatatttagtcaataaacttactttcatatttgttttagagccagacataggcatgcctgaaccagatgctcagagattcttccatcaactcatggcaggggtggtaggtatagttgtctatttcccttttacttaaaattagagtgaatacattacattaccaaattctagtgtgtttctctctgcatccctcttaggtttatctgcatggtattggaataactcacagggatattaaaccagaaaatcttctgttggatgaaaggggtaagtttagcattttatcactacctaaaataaaataaaataattacctaaattattttaattacctaattattttaatatagccatacaaggcaaaatcaagtctttttgcattactggaatttcaagacaagatctgaaaaatcaaggaaattttggagacttcgtatatttggaaatcacaagtctcattttgcaatacaagtgcggatcaggtagagaaatctgacctaggtgcaagcctagctcactatatgtataagaataatttttttttttttgatacaggctcactgtgttgtccagtctggggtgcactgtattatcacagttcactgcagccttgacctcctaggctcaagcaatcctaccatctcagcttcccgagtagctaggaccaaccacaggcaggtgccaccatgcctggctaatttttgattttttgaagaggtggagtcttcctgtgttgctcaggctagtcttgaactcctggactcaagcagtttaccagccttagcctcccagagtgttgggattatagacgtgagccaccatgcctggccaagaatagtttaaaataatcctttaatggattaataaagggaagttcctgtggaataccctggaccttagtcttgtcctgttcactctttttttatgtatgacgtggataaaaatgtaagaaatttagttatattttctgaatgtcatcaaattgagaaggatggatagcgaaagctttaagcttacagggtcagaatcaaaaaagaaatgtcagctgtatgaggcagtagtttttgtctggtttaatgctttattcttagtattagaatagtgcttaacaaatggtcagcttttttttttttttgaaacagagtcttgctgtgttgcccaggctggagtgtagtgacatgatctcggctcactgtaacctctacctctctggttcaggtgattcttgtgccttaggcccctgagtagctgggattacaagcctgagtcaccacacctggctcatttttatatttttagtagagatggggttttgtcatattggccaggctggtctcgagctcctggcctcaagtgatctgcctcccttggcctcccagagtgctgggattataggtgtgagccgctgtacccagcctatacatgcttttttcttatgtgcatatggattttactttttacccctttaaactgagtttatatgacataaaaatctttatttttatttaaaactttaaaaattcaggtacacaaaaattcttatgtattataatgaaatgtaaatatatgtatatcaacccacctggtttaaaaatacaacattattcgtatataagaatgctcacagtggtgatgtttttaatatagcaggaaactaacccaaatgtctgtcaacaataaattatgaaatgcatggcttttcaagccatgtcacaagcagtgacacaagcatgtcacaagcagtgacatggatgaatttcaggtatataatgatgtagagcaaaaagagacagttgcaaaagaattcatatggtctgattctgtttatacaaagttcaaaaatatgtaaaacctagtatattgttcaagtatgtaaacatggagaaaaaaacatgcagaaaagcaagggtataataaaaccaaattcagaatggtctaagaaagtaggggagggaatgtatttaaggaagtatttaaagatttcaaaggaaatagagcattgtttttctaaagtgagtgggtgtttattacattgttattctttatatcttgtattaatatacaagatataattctttgtttctatttaatatttaggagtcttttaaaaaaagaaataaaatgttaccagtatttaatgtcctcctgtttatttcatcacaaatatattcttcctttgtttttctaagagctaaacacattcctacatttaaattttattatgtgcagttctctaacatagctgagtattatgttgcagacataacaaagtccaaggaatactatagttatccattagtattttaagtgattactactcataagtaatttgaaactcaatctcagtggtttgtccaatagtgtcatatttaactactgaaaagataatcaactgggtgcagtagctcatgcctgtaatcccagaggctgaggtgggacgattgagtgattctaggagtttgagaccagcctagacaacatagaccctgtctttatgaaaaattaaaaaaaaaaattagctagacatggtggtgcacacctggagtcccagctacttggaaggctgaagcaggaggattgatcacttcagcctaggaggtcaaggctgcagtaagctgtgatcacatcactacactctagtctgggcagcagagtgagacactttctcaaaaaaaaaaaaaaaaaaaaaaaaaaagggtaatcacagtagctacctcctaagtcagatagaggtaaacatttcattggtttacatattgtgtgaatgtacttgatttttaaagaaatcagtcccctattttgagacatttaagttgtttctaacttataaaataggacagtgatggcttctatcaatttgtgtaaaaggccaatataaaaattgcgtcatgctataatattttttatgctataatattttttatgccattagcctttttgtcccacttacacactatttcatgttagtatgtatagatataccttgttgattgttttcaaaacctacctccacattttccattgtacaaatttggacatttatttacaaataatattgctatgaatattcttatgtttatgaatttgtgggattatttctatggatatagaagtgggaattgctagttcaaagagtgaatgtttcacagtttagtatgttttgccaaattgccctctgataatagagggccttttctaactcttaagactgggttacattcctttgctctaagatcctatagtgctctatatttttataaccttcataacagttttctattgtcagtcttcactaatttatctattacctgcattggctggcatagtgtctgtcactaagttacagtagatattcactaaacataagttaagtcctgcctgcagtttttgtgtgttgaagatgggaagttagggtggaagttgggtcttctgatattttttttttgtacagagtttgtcctctttttctcagactctctactttgaagaaaaaaattactgtggtttgttgaattttggtgtgtcttcacatattttcttctgccaactgggtttgtttgctgctgagaaagttgtgcctaacatactactgatgtttccttcctgccctccaccctacctgatgaggggccttgctttactttcatctcaggtttagagtgctcttttccagaagggcagccccttctgactccagcctctttctttaatctggtccagactgttctgtgtgttgataatacttcttttaagttaatagaagaggtgaggcctttttctacttttagcatagatgatgatttattttatttttttaaatttctttttgtctattttgcttattttaagagaagttctacaaaccttaagtaacaccagtgattttttttcagtaaaacttaattcctgtaagtatatctatttgcaaaacatttttattcagtgtcatctttttttcttttggtttagataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggaggtaagagctatttaatcatggtaaaactcctataaaaagtcagattagttatactgaaataaatgaaataaaccaaggaattcatgtttatataatagtttttgttttcttttttaagagacagggtctcactcttggccagactggagtacagtgagctgttatagctcactgcagcctcaaacttctaggctcaagcaatcctctggcctcactcttccaagtagctaggaccagtggtgcctgccacaagacatctggctaagttttaaaaattcattgtagagatgggatcttgctgtgttgtccaggctggtcttaaacacctggtctcaagcaagccttctgtcttggtctccaaactgttaggattaaagtaaagacatgagccatggtacccagcttttatagtagtattttaatagtgtcttgatcggtttggtaactgctgtaacaaagtatcatagactgcatagcttataaacagcaaatttatttctcacagttctggaggctgaaaatatgagattaggggtgccaacctggtcatgttttagtgagggccctcttcctgatttgcagatggctgtcttgctgtgctctctcatggtggacagccaagagagcagaagcaagctctattgtggtttttttttttttttttagaccagagtcttgctctgtcacccacgctggagtacagtgatgtgatctcagctcactgcaacctctgcctcccaggttctagcaattctgtcccaggctcccaagtagctgggattacaggcatgcatcatcacacccggctaatttttgtattttgagtagagacagggtttcaccatgttggccagactggtctcaaactcctgacctcaagtgatcccccaacctcagcctcccaaagtgctgttttttgggttttttgttaaatgaccagatgttgtgagatattgtgtctgttttttgtttttttgtggttttttttgagacagggtctcactctattgcccaggctggagtgcagtggcacaattcaaggctcactgcagccttgagctcccaggctcaagcgatcctcctgcctcagtctcctcagtatctgggtctacaggcgtgcaccaccacacctggctaatttgttgtgggttttttttcacagacggtctctccatgttacgtaggctggtcttaaactcctgggctcaagtaatctgcctacctaagcctcccaaagtgctgggattatataattagtgccctataaagatacaatattgtccgggcacacaagcccttattagacattaataagctcttaataagagcactaataccattttttgagtggtcccatcaccaggacctaattacgtctcaaaggccccacctccgaatgccattgcattatgagttaggatatcaacatgacttttgagggggatacaaatatttagcacattgcaaatagtaacttatttataatcccaaagattttttaagctaaggcatgcatagttattaaatatcacaacacttatctctcctgtgtatcatgtaaacatttgtgaaaacaagactagggcaagaaatgattcatctgttttttggtttttttttttttgagacaaagtcttgctctgtcgcccaggctgcagtgcagcagtgtgatcttggctcactgcagtcttgacctcttgggttcaagtgatcctctcactttagcctcctgaggagccaggactacagatgcacaccatcacgcccagctaattttatttattttttgtagagatggggtctcactatgttgcccaggctggtcttgaactcctgggctcaagcagtccttctgcctcagcctcccaaagtgctgtgattacaggcctgagctgccatgcctatcctgattcatctatctttgaagtgcctctaaagtttccaagttgggattcttagtgtgaaaaccatattgaattaattcaaaggaaacttttcatggatttatattattatttttccttgaaatctttataataagaacatttaaaaaaactgggacttgctttgtttttagaattgccatgggaccaacccagtgacagctgtcaggagtattctgactggaaagaaaaaaaaacatacctcaacccttggaaaaaaatcgattctgctcctctaggtaactgaattatcttgagtgaaagagtaccgatttcttggatatgaagtcttgtgctatttgaattttttcttacttttttttttgttttaaacttacaaataattcatgttcgttgtagataaaatagtaactataagtaaaaaattaaggaaaaaataactctttagtcccagaactctgcaatagatttttaaaaatattttggggagtgtatattcagagcaacttgaatctgctcttagatggctttttacttaaagttttcatatgtgctatactttgttgcaaatacactcgtttgttgcttaattatagggatgcactctaacaaatgtttcattaggtggtttcatcattgtgtgaacatcatagagtatatttacataaatctagatagtatagcttactataaatctaggctatttggtataccctattgatctcaggctgcaaacctgtacagcatgttactatactgagcactgtaaggaattgtaacataatggtatttgtgtatctaagtatagaaaaagtatagtaaaaatacagtattataatctaatgggactgtctgttatacgtgtggtccattcctgactgaaacatcattaatgtggcccataagtatgtaaaatgaatatatgtatattatttatatgtgtttttatacaaaatgagatcacactaataatattttgtaactgtttttggttttagtgcgcagcgaacattcttccatgactataattgtaggtctacatcgttggtttaaaggctgtgataatattctgccatgtggatatgccttactttactcttttaatcactttgttggagatttttctaaattttcacagatacaaaagagatataagtatctgtgtaacttaatcatgacacatacccttaaattgttcattgaaatccccagaagcaaaattgcaggatcaaggatgtagtttttattattatggcttattttgtcaaattgcttcccgaaagttcgaaccatttcatcacagtctcatcaatttacattaaggaaaaaaactttaaataatagtttttcatttttattttaaatttaatactaatgaagttgtataccctttatgtatgtattagttttttgtctattttgctcatttttgtcaaggatattgtttttcttaccactttgaagcttttttttttccttgataacacattgacctttgcacttgttacaaatacttttcacaatttatcatttattttcattttgttttgctatattgacattcaaatctattatcttgtcctttgtggtccctgactataatttctttggaaaggtcttctacctctactatttaaaagttccctatgttttcatttagtgtttttatggcttcatttttccatttaaatctttggtccattaggaaataatcttcacataggaagatacgtgaattttttctcaagaaaattaagataccttaggatggttagttagattactgtctcttaaaaagttattggtaagtaaatgttcattataaaactgtgtgaataaggaggtcacgtgagaacatgacattgaagtaatgaaattcggtattgaaaatggataagaggggtttctgtatctttttgttaatctcgtcacatgaggagaaacatttccatctggctcttgttctcagttgcaaacaattgagaatcagatcagggaagactactccaagatacagcagcagagaaaaactgcatgaaattaaagcagtaatttagtagctttaattctttctcttccccaggaataatatttagacataagtaggctaacagaaaatgtgtttcttacctcaagccataggcttctctaacatgattctttcgtgaatgttgtcgtaatgtttgtttttagctctgctgcataaaatcttagttgagaatccatcagcaagaattaccattccagacatcaaaaaagatagatggtacaacaaacccctcaagaaaggtaatatccttaaactacaagtttgtttgtttttctgtggaagaaaaggtaattgcaaagttattatcacaagtcaacaacacatgatagctatgatctctgtcctcatggagattataatgtccagtagaaaaaaatacagaaataattttgtttattaataattataaaggggaaagtcagggtactatagctaagtgtttgaccaagtctaagggacagggaagacttttcttcctgaagaaattacattaaatctaagatttgaagattaaagggaagctaggcaggcaaagtaagtggcagatttgattctgaacaggggaagcagtatttgaaaaatcttagattttagaaagtctgatgcttttgagaaacttgaaagatcagtatggcacaagccgtgtctgttgtgttcatcattgtatcatcagtgctttagcacagtatatggtgcaccataggcactcattaaatatttgttgagtgagtgaacagggaagtgggagaggaagacaggtttgagatgaggccagagaggtcgctagtggccaatttgtggaagaagaccttgtaagccatgttaaggattttgggctttaacttaagaccactggggagacctctgagagattttaagcaagactatgacatagtcatatcttcggtttaaaaatatttctctgacttccttattttttttccattgttttttatgaatagggaaagattcagggtgctgtaggtttttctgctagttgtctagaagtgggaggctggtggcttggaataggttagggcaatggtattggagaaatgagatgattccaaagaaatttaagaactagtattgataggactgttaggctgtgaatggaaggagagaggacaatgactagagatgatgaatgaaaaacattcagagagttattaatgtttaactctgtcctcatggatagaaaagagttaatgtttaaacattcactcttctttaatacctctctgcatgtttcttcctccttgtcctaacttaaagtccaattctcccctgaggacactgcttcctctgaagcggtaggtgttttctttcccataccctcatgtcctttgatctggacatggtacaggtgtcctccttattcttcattgtcactttctcccatcttcctttatgtctctcccctctaacttttgaaccccaaattaaaatttctgccgtactatcacagtctgcaaaatgactcttgatgttattttcgtcatgattcttggtgatttaaatatttatttggatcatcctcctgatatcctgacttcactgtttcttgaccctctctcctatagtgatgttgtctttgaacacgctgcactgatcaccagtataattttttctgacttcctcccttaatattctaacttaaacagtcctttgtatctggacttgcaattaattaattctatctcttcagtctcttacctgctccctctctaggtccttgatttcatctttacctatcttaaatctttaggttagtcattataaatgactgctttgcgttcatcatcttcaatttccttgtccccttctctcttcatcatacttagtgggtaaaacccagtaagtagtttctgggtttaatctagtagttttctacgtactgcacacttgtacctgcacaacagattgcagcaggagaaaaatacccaaaaatgttcactttaaattcaggattactaatctcaagtgggcccttaatgcttcctggcatttggccttcgtttccccacatctttctctgtcctgttctcctaaatcacgtttttataatacttttctcttttttttttttttttttttgagacagggtctaggctggagtgcagtggcgccatctccactcacttcaacctctgcctctcaggttcaagcgattcgattctcgtgccttagccacccgagtagctgggattacaggtgtgaaccaccacacctggctaatttttatatttttagtagaggttttgccatgctggccaggctggtctcaaactcctagcctcaagtgatccccctgcctcagcctcccaaagtgctgggtttataggtgtgagctactgtgtctggtcccttaacttttattatcttctctccatcctcactctcagttgttcactttgcttcctgtgtcactgggaaatgaaagccacaagagaacttaggcaagctcccaccaccatctcctccatactaactgcctctatgctcatgtattctctttcatcctgtattgctgtagataaattgctctggatgtaagccaggtctttctcttacccactcaatgactttgtctagcaatttttctccctctcctacattattaatttttccttctctaccggatctttctcatcagcatatctacatgctttttctcccattttaaaatcaaatcataatggtaataaaatttctcttaactccacttttccctaccattccatcttcttcacaattgaatattcctaaaattgcttctcatctctaacacctcaaaactagttttcaatttcatctattttgttgccaagagtcacagtgatttttggaacgtgttgccaagttcaatgtaatagtccactgtggtcaaccgaggtctgaaaagattaaatggaaagtaccagaagtaaacaattcatcaattcatgggttttggccgggcgcggtggctcacgcctgtaatcccagcactttgggaggccaaggcgggcggatcacgaggtcaggagatcgagaccatcctggctaacacggtgtcaccccgtctctactaaaaatacaaaaaattagccgggcgaggtggcggtcgcctgtagtcccagctactcgggaggctgaggcaagagaatggcgtgaaccccggggggcggagcttgcagtgagccgagatcgcaccactgcactccagcctgggcaacagcgagactccgtctcaaaaaaaaaaaaaaagaaattcatgggttttatttatttatttaattcgagacgggatctcgctctgtcgcccagactggagtgcagtggcgtggtctccacttactgaaacctctacctcctgagcttaaatgatcctcccatctcagcttcccgagtagctgggactacaggtgtgagccactatgcccggctaatttttgtatttttggtagagatgaggtttcgccatgttgcctatgcttttctaccaaaaatacaaaaattagccaggtgtggtggttcacgcctgtaatcccagctgttctcaaactgctgggcttaagcaatccacccaccccggcctcccaaagtactgggattataggcatgagccacaatgccctgccataggttttaaattgtgtgctgttctgagtagcataataaaatcttgtgctgtcctacttcatctcacttgggatgtgaatcactcctttttccagtgtattcacgttccatgtgctacctgcttgtaactcccttagtagctgttttggttattagatcgaaagaacatatatagggtttggtaccatttgtactttcaggcatccacttgaacatatccctctgtggataaggggggtactactgtagtcagttctcagacctcttgttttatctcatcaatattttatacagttgatcatgccctcctcctttaaacactttcttcatttggcttccaggcgttacactcttctgattttcgtccttctcactggtcgctcttttcagtctcttgatggttttttttcatctgctcagcctcctactattggagttctccagggctgaatctatggatctcctttgttttcttctccacactcactccattagtgatattacttggtttcatggctctaaataaaactatatgttgatagtcacatttatatcaacctagacctttcctctgaattccaaacttacatgtcttaactgccttctgaaatttcacttgaatgttaagaggcatctcacacttgatgaattccaaactgagttactgatcttttcctttcaaacccattccttttcaaagtctttcccatgttggttaatggcaactgcattattcttattatgcagatcagaaactttggaatcatccttcatttttctcattctcttttacttcacatccagtacaccagctaattctgttaacctctatctttaaaaaaatcttagaatctgattaccttttttttttttacctctactgttaccctatcattccaaattaccatgatatctttccaaaatgttctgatttaaaagtgaattagaatatatcactattctacccaaatcctccaatgctttagttctcacgtgtagtgtaagctaaaatcagttcatgacctgtgagttcttacacaattttgttccttacattacctctccaacctcagttctgctttgctcccccttggtcatattgttgttcttcttattgttctccaagtgctctaggcacacttctacctcactgtttttgtagtgactgttcctatgtctgaaaatgctttttcccatgggacttatttgcatgtcttattctcttactttctttggatattgacttcagtgtcatctttccaataagcctttcctggccatgctatttaaaatggtatcctcttccctctaacacatttcttaaatttttaaaatttttactctcttgtggacatacgcaatccaacacgtttcttcattttattttccttcagtgtacttaccaccatttagcttactgatttttaactgtatttgtatttattttatgttattttgtctctcctcagtagaatgtaggatttaaaaggtcaagagttttttttctattttgctcactgctgaatacctgatacctagaataatgcctggcacagagtagacctaataaaatatctgaatgaatggattaataaataaaaagcaggtttaaaaaaaaacttgagcatgtttaaaaagaaacaaacttaagcatgtttaagtggtttgggtacggatcctgtagagaggaagaggctgacagtctaagagaaaggaaataaataacagaggatcaagatccctaaggaggtagaagggtatgggctccagagcacaagtagagagatgaacatttgatgggagaatggaagggatgaaaagatgtataataatacaaataacttagctttggtagggataagttgatgtagtttctgtctaatggctttattttttctctgaaatgggaggtggtagtataggtactggatggtagtcttgggaattacagaaaagtgtagttttgaaatgatccttgtggagaaaaggaaaggaaactagagaaacaaatattatctggcaatattgaggtttagctagggattgtaaccataaatttacagtggcgtcattttccatataatattcttctttataaagcttttccaaggaatcaaagaatgttggctatagcagattcataatgtttattgctattatcataaattattttttattttaaaaagttctagtcctttagccaggtctgttgtcttcatagaacattgttctgttacccataaaagatgccattaagactgtggcctgggccgggcgcagtggctcacgcctgtaatcccagcactttgggaggccgaggcgggtggatcacgaggtcaggagatcaacaccatcctggctaacatggtgaaaccccatctctcctaaaaatacaaaaaaaaaaaaaaaaaaaattagctgggcgtggtggcgggtgcctgtagtcccagctactcagggggctgaggcaggagaatggcgtgaaccctggagacagagcttgtagtgagccaagatcgcgccactgcactccagcctgggtgacagagcgagactccgtctcaaaaaaagaaaaaaaaaaagattgtggtctgagcatactccacactttgaacatgtctacagatcatacttaggtattgtaaaatacctaatttgacaaatgagttttagtaattttataacttggccatattttttataaaatcatataggaagactttgttttatatcttacaaaaattttgtgttaaataaatagatttagacatagttttacttcttcaagttgccagttgggttaatttaaaaacatacttgcatagaagacttgaaagcatttgtatttgttttcttttttaggggcaaaaaggccccgagtcacttcaggtggtgtgtcagagtctcccagtggattttctaagcacattcaatccaatttggacttctctccagtaaacagtgcttctaggtaagactgataaagattgagtagtttttgattgtagtattccccatgaagaataatacatgtatgtgttttttcataataatcgacattaacataatactgtaagcatgagaacttgtgtgtgatataagaaaggcctgatagattttattttattaaatgtatgtttctttctgtcttaatgcctcagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacaggtgagggaatttaattttttaaaagtaatggcagctctttattttttattgtcttaaagtccttttttaatgtgtaaatcttagatatataacttttaaatcacatgtattcttttttggtcaaggaagaaagagaggagggaggccttcatgcaaaataattttaagtcagactaaatagctatgatattactgtctttagtcctaatggatttattcatttgtcttctgtttgacatgtagaacccctggcagcggttggtcaaaagaatgacacgattctttaccaaattggatgcagacaaatcttatcaatgcctgaaagagacttgtgagaagttgggctatcaatggaagaaaagttgtatgaatcaggtgtgtttcattgattttcattataccttttcctgaagaagaatttaaatatttgagtaaaagctatcattagtatattttttaaatataggctgtggctcacacctgtaatcccagctttttgggaggctggggtgggcggatcacctgaggtcaggggttcgagaccagcctggccaacatggtaagaccctgtctctactaaaagcacaaaaattagccggcctggtggtgcatggctgtaatcccagcttctcgggaggctgaggcacgagaattgcttgaacctggaagacggaagttgcagtgagccgagatcctgccagtgcactcctgcgtggccaacagagtgagactgtctcaaagaaaaccaaacaaacataaaaatacaaagtaattagttaatttgaaaaagaaactatttaagtaaaatgttctttactttaagaaataatacttttttttattttgttttattttttaatttttaatttttagccactgtgcctggcctaagaaataatatttcttaaaagacctttttattgttattaaaaatagtagggagctggaatcattatctttgtaaaaactatgtatacttaaactgtagacaataacagttgactgcctactatgaaagacgaatacattagcaatcccacactttctcccatctcccttgattgcacccgtcaatttttattgtttatattattagagcatagttataacattggtattctaaactgtctttaaggcttttcaaaaaaaatgttaatgtcaatgaaagacaaatagggtagctgttttttactcaaggagactaaagaggcctgataactaagtgcaagtgcaatgcatgatctttcactagatcatgtatttgaaaaaaactataacggacattattggaacaattggggaaatttgaatatggactgtatattaattaggtaatgtttttgtatcagcgtcagatttcttgggtgtgataatactgtggtttgtaggagaatgcccttgttcaaaggagaacaagtgtcaaagcaaagttgaagtgaagtgatattttcattcagcttaaaatttaaaaaaataaagggcaaacaactacataaaggccaataaacacacacatatctggtagataaggccaatgaagagtatatggttatttattatactcttttttcagtttttctgtagattcgagttttcaaaattaaaaattgggggaactgttactgtgtagaaatctgaggtcagcctgatagtcttctcactcacataggtgattcactttctttcaggtagactcagagataaaatttgcataacataagaatcatcactttaaccattttaaaatgtaaaatgcagtgctttttagtatattcacaaggttgtgcaaccatcgcccctaattccagaacattgcatcaccacggggaaaaaaaaacaaaacacctctgtaccacctagaatcactctttattcctttcttgctccattcccagacaacctcgaatctactttctgtctttagggattgcctttttggacattttatataaatggaatcatataacatgtagtcctttgggtctgtctgctttcatttagcacgttttcaaggttcatagcatctatcagtactttattcctttttatggctgaataatattctgttgtgtgtatgtattacatttcgtttatccattcatccactcatggacatttgggttgtttctactttttcatcattatgaataatactgctgtgaacaatcttgtaccagtttttgtgtgaccatatgttttcaatttcttagatatatatggaggaatagaattgttggagcatatggtaactcttcatttaactttttgagaaactgtgaaatgatttttccaaagcacctgtaccattttacgttcccatcagtaatgtaagagggttccaatttctctacaaccttgccaacacttactgcctcccctttttgctatggccatcctagtgtgtatgaagtcttatctcattttgcttttgattttcatctctctaaagactaatgatcttgagcatattcttatatgcttattggccatttctttataacagtatccggatattttgtccatgctttaactggcttgtttttattgttgagttgttagagttcttttacattctggacactagaaccttgtcaggtacctgatttgcaaatattttatcccattctgtgggagaaaattcccccattcttttgttttcttgttagtgtcgtttgatgtactcaagttttagattttgatgaattccagtggatctataatttctcttttgttgcctatgcttttagtgtcaaatttaagaaactgttgcctgatgtaagattgtaaagatttatactttatgctttcttttaggagtcccagcctcctaagtagcggggactacagtcttaaagtttagctcttatatttaggtctttgtccattttgagttaatatttgtatatagtatgatgtagggtgcaaattcaaatgtttgtatgtgaatattcagattccagcaccatttgttgaagatatgttttactattagatggtcttggcacctttgttgaaaataaataggtcatagatgtatgggtttatttctggaatctcaattctttttttttccttttttttttcttcccctgtggactcaattcttttatttcatggatctatatgtctgtgctatgccgttaccacactatgttgattactgtagctttatagtgaattttgacattagaaaatatgagttgtccaagtttgttctttttttcaaggtattttggttatttgtggccccttgtttttctgtcttttaggattatcttatttctgcaagaaaaaaatttggaattttaaaagagattacattggggagtatttccattttagtatatattgagtattctttattcaaggtgcttgggaccaaaagttttgtggattttacatttgtttggattttggaatatttgcatatgcatattgagataacttacagatgggactcaagttgaaacatgaataattttatttatgcttcatatatacctgatacagatagcctgaaggtaattttatacaatgttttaaataattttgtgcatgaaacaaagtttgtacattgaactatcagaaagcaaacctgtcaggtatgaaattttcagtttgtcacatgatgtcagcacctgaaaagttttggagtttggaacattttggatttcagatttgagattaaggatgctaaacctctaatagtaactcttctaatccaataacatggggccttttttttcccatttttttagggtctttaatttctttcaagaatattttgtagttttcagtgttcaagtcttgcacttcctaggttaaatgtaatcctgtttattctttttttttttatcctgatgctgatgtaaatggaattttttaaaattttattttcaaattgttcattgctatatgcaaatgaattttgtatattgatcttgtatcctgaaaatttgctgaattcattaactccagtagtttttttgacaaattctttaggttttttaatatattaagattacattatttggcagggcgtggtggctcacgcctgtaatcccagcactttgggaggccgttgcgggtggatcatgaggtcaagcgtttgagacctgcctggcccacatagtgaaaccccgtctctactaaaaatacaaaaaattagctgggcgtggttgcgggcaccggtaatcccagctactcgggaggctgaggccggagaatcacttgaacctgggaggcggaggttgcagtgagccgagatgacgccactgcactccagcctgggcgacagatcaagactccgtctcaaaaaaaaaaaaattacattgtttatcaatagagatacaggaaattgttttacttttttttttttttttaacccagatgccttttaattctttttgtttagttgtcctggctaggacttccaacattatgttgaacagaaatagagtctttgtcttgttcttgatcttagggttaagtttcgagtctttcagcattaagtatgatgttagctgtggggtttttgtttttatggtgaaagagtattggattttgtcaaatgttttctccgtctattgagataatcatgtggattttttttccctttattaatatagcttgacctcctgtgcccaagtgatcctctcatctcagcctcctaagtagctgggactacaggtgtacactatcatacccagctaactttttaaaaatgtttttgtagagatgcagtctctgtgtttaccaggctggccttgaccttctgggctcaagtgatcctcctgagtagtgggtactacaggtgtgcaccaccatgcccagctaaattgacagttttcatcagtctgtttattttgtctaatgttagtatatccacatcagctcaccagctatcttgtgtattttcctttttttagatggagtctcactatgttgcctaggctagactgtagtggctacttaaaggcacgatcatagtgcaatgcagcctcaaattcctgggctcaagtgaccctcctgccttggcctcccaagtaggtgggactgcaggcatgtaccaccatacccagctaccagctctcttttggttattgtttccatggtctattttttttttccttttccttttaacctatttgtgtctttgaatctaaagtgccttagccaggtgtcatggctgacacctgtaattccagcactttaggaggctgaggtgggtagatcacttgaggccaggagtttgagaccagcctggccaacatggtgaaaccccatctctactaaaaatattttaaaaattagttgggcgttgtggtgtgcacctgtaatgccagctattggggaggctttaggtgggaggatagtctgagccattggagatcaaggctgcagtgagtcgtgatctgattgcatgactgctctccagcctgggtgacagagcaagactgtctcaaaaaaaaaaaaaaatcgcttcttagccttttggctaagatcaagtgtagtatctattcctatcagtttaagtgccttaatttctcttccactttttggacaggtagttttgctggatatagaattcttattagcttttgtctttcagcactttgattatgccactactgccttctagcctttgtggtttctgatgagaaatcagctgttaatcttactgaggatctcttttatgtgagacgttgctgctctcttgctgcttttatgtttctctgttgaccacagtttgactatggtgtatcttggtgtggatttcttttttcattctgttcggagttcgttgagcttcttggatatgtaaattaatgtttttaatcacacttgggaagtttttggccacaatttcttcagatttttttttttatatctaactctcctctccctcttggactcattatgtttattgttggtatacttgatgtgccacagttcttagactctgttcatttttctttattcttctttctttatgtttctcagggacagttttggttgctgtttttcctttataagggccatactttgtttccttacatgctttgtaattttttgttgaaaactggacatattgtggcaatatgtggcaactctagaaagtcagattttcccctcttgccagtgtttgttaccgcttgatgtagttgtttgttttttttagtggtgtttgtttttttttttttttgagacggagctttgctcttgttgcccaggctggagtgcagtggcgtgatcttggctcactgcagcctccacctcctggcttcaagtgagtctcctgcctcagccttccaagtatctgggactacaggcacctgccactgtgcctggctttttgtatttttattagagatggggtttcatcatgttggccaggctggtctcgaactcctgacctcaggtggctgggattacaggtgtgaggcaccatgcccggccctagtgatttttcttatataattttttaaagttggtattgtttgtcatgcatggctgtacaatttctgtcccattagttttagtggtcagctaatgattggacagagatttccttaaattctgtataccaaaaacaaaaaatctgcagagtgttctgtatttgtgttggggcacacctgcaatactcaaccaagaagtttacaacgttgcttcagccttcgctatctgcttgtgcaaaatgcaaagttagggcacatgtagagcttaggggccttctcagctctttcctaagcatatgtactgccctggtcatgggtgtgtctttttagattcccaggtatatgttggaccttttcagagtcctattccccagaaacatctcactccctaacctcttcttccaaacttcttgggtagtctgtttgcaccagttgctttcattgcttcaggcaacagagactaaagcattttcctgtaagtgttttcagcaaacgctactcaggagtagctttagcacaaggtgagttagagttacaaaggtgaaataaagacaagcctctttttttttttttttttttgagatggagtctcgcactgttgcccagtctggagtgcaatggtgtgatctcagcccactgcaacctctgcatcccgggttcaagcgattctcctgcctcagcctcccaagtagctgggattacaggcgcctgccaccacaccctactaatttttgtatttttagtacagacagggtttcaccatgttggtcaggctggtcttgaactcctgacctcaggtgatccacccacctcggcctccccaagtgttgggattacaggcatgagccactgtgcctggccaggacaagccttttgatcaggtcattttagagggtcagatcggcttaagatagtttgtaaatgaggtttattctgctcccacctggacctatgccttaaatatgaactgttattttcaaggctgctactgagtgaggagcaggggataaacagggtaagttaaaatgccagaaagctcactgttcttactgcgtttcacttgttttgaataagttgctgcaagcttttagctagtttacaatgttctgaaaaagttgattctgacaggctttggcaggtttttaaaattgcttttgtggagtaatggacttctggagttcttttctctgccattttcactgacatcactccttgattcactctctctcagttcttgaagtattttctttgtctttgaagtttaagagcttaattcagatgtgttgagttgaatatcttgtattaattttcccagaacatagtgggttatttcagtgctgcacagtcgtggtatggttgtgtgttttcatagtttcttgaagtaagaattattacaaaaacttttgtaatttgggctgtgttttttgggcaaatctgctgatctcgctcgggcttaactcatccagctgtagtcatttgatgtctttactgtggctggtggtctaaaacatccttactcccatatttggagtcttggcactgtctgttagctgagtcttttctttctgcatcattcagctaggctgagcgtctttccatgccataggaacgttctaaaagactgaaagtggaagttgaaggcctctcaagacctttgccatcttctaattgccgctctagcttttcagccacaagtcaggcctttttctttctcacattttaataatcttgtttttcctcccattatgttttcatctttgattgtttcttctttcagtggtattttggtaaaagacagtaagttttgttgctatgagttcatatacactcaatccctaggagctgcacccctgttgatagattgggttggggacacacatacccactgggagaagagagactctggaatgagtgagattatcagcatacttaatattactcctgttatggaggtagccagcaaattttttttaattgatacaataattgtaatgtattcatggggtatgtagtgatgttttgattcatataatgtataatgatcagatcaggataattagcatattcataatttcaaacattgtgggaatgggaatgttcagtgatgggaatgttcagtatccttctagcaatttgaaactctattattgttaagtatagtcatcctacagtggtctagaacttactcctatctagctgtaattttgtattctttcatgaatctctatctttcccttccctctccccttcctggactctagtatcctctgttctgccttctacttctatgaaattaacagtttttttgtttccacatatgagtgagaacatgtgatgtttaattttctgttcctggcttatttcactttacataatgtcctccagttccacccatgttgctgcaaatgacaggatttcattcctttatatggctgagtagtatttcattgtgtatatatatcatattatcctcatctgtttgcttggctttttgttttgtttttttgagacagggtctcgctctgtcgcccatgctagagtgcagtggcgcaatcatagctcactgcagcttcaacctcctgggctcaagtgacccttctgcctcagccccctgagtagctgggcctgtaggcatgcaccaccatgcccgctaattttttgggaattttagtagagatgaggtatcgatatgttgcccagcctggtctgaagcgatccttctgctttggcctcccaaagtgctggattacaggcgtgagccacagtgcctggcctacactcatctgttgttggatacctaggttgattccatatcttggctattgtgaataatgctgtagggttgcaaatttctcttccatataatttcctttcctttggatcagtagtgggattgctggaacatataggtagttttatttgtagttttttgagaaacttctattctgttcttcatagtgggtttactagtttattatctactcacccatgtggcttaaccttatttttgttgccttaggttactatatcaacaactgataggagaaacaataaactcattttcaaagtgaatttgttagaaatggatgataaaatattggttgacttccggctttctaaggtatttttatgttttattgtattctttctatggaaatatttctatatgaatttttttaatggcattatgtttgtatatatgtggcatttgtaaataggttacttgcttttttcgtttaatattatgagcatgtgttttcgttatctatttttcccgaacattgtttttttcaaatgacattttccttattataaaagtttttgccaggcgtggtggctcatgcctgtaatcccagcactttgggagtccgagacgggtggatctcgaggtcaggagtttgagaccagcctggccaacatagtgaaaccccatctttactaaaaatacaaaaaattagccaggcgtggtggcgggtgcctgtaatcccagctacttgggaggctgaagcaggagaatcatttgaacctgggaggcggaggttgcagtgagccgagatgacgccactgcactccagtctgggtgacaatacaagagactctgtctcaaaaaaaagaaatttctgcttttgtgaaaaatgtagataagcaaaaaatgagaaaataaaaataattctaaattttcagtgatcacattaatatttcgaagcattttaatatttttcttaatttatgtcttttaataaaaattatgatttgttacaaatatttcattataatttaatgaacctttaccagttataataattctgtgattgctattttatgcatagatttttttgttcatatttctgatgatttctttagaaatcattgattctaagatgatagtattacagcccttgatatataaaaccaaaataacatttttctctattttctgagagattgtatgtggctctaaagagggttggaggggtagctgctgtgttagagcatttgccgcagtactctttgtattagagatttgctgcaatactgtttttcagatgcttgctacagaattaaattaagatcgtagtataatgaaattcttctcataactaaatctattgattttggtcagtagtgttatgacaacaagacttcagtttagttgtatagtttattgttagtttccaaaccctcactgcctatggaatgtaatgacttaggtccagatataccaacacctgaaacagataggatgccatgtttatctgctctctgagctcagtgcagtaggaacagtgatgggcatgaaaccacatcagaattatttgtgtaacaattttctcttccaggatatttggtcttcataaacagaccgaaaagaaaatggtagctagacatacctaaagatgtttgtctcttgttaccactacaaagagattgattttaggacagaattttgtttttgtttttgttttgacataattttttaatactatttctaatatagggtgatggattggagttcaagagacacttcctgaagattaaagggaagctgattgatattgtgagcagccagaagatttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattctaagatgaaccaataaagacataattcttgtgacttttggacagtagatttatcagtctgtgaagcgaagccagcttcaaaacatatccccaagatttgtacttatattttcaaaagggcctggccagttatataaacctgtttttgaattataatgattaattaaaattgcaagtaggtgttttttccagtgtagttagtaaaatacttgtattttacagtgttgcataaactctagtgcttaactaactttactctaaaaattactgttgaacatcttaaatatttttctatattttctactttcatagccatattttaaccttttcaacttactggtgaccaagcttttaggtgataaagaataaaagagggaagggaagagtaaggaagctataagaaaaatagatctgattctttgttcctttacctgttagacttacaaaaagtttgtttttctaataaaatttgtatcaactttggggcatattaggttgaggccttggctcctgcctgtagtcccagctacttaggaggctgagagaggaggatcgcgtgaacctggaagtttgaggctgtagtgagctatgattgcaccagtgcactccagcttggatgacagagtaagaccctacctctaataaaaatttttaaaattgtaaaacattataaaattaatcagttattttaatctgaagccaagaacatgtagaatgttatgattagagtttatcacatattaatgtatactggcaaattgtgttactggagtatacccataggaggaataaattcaaacctgttttatttatttgaacctatttacggtatgcttaagaattgaatcagtataaattctcaaatatgggagaaattttgttcttgagaattatctgagtcattaatatttttcaaaaacagctctcactgacttgaacctcttctgtaagctctaaccttttacctgctttacatttccacttgaatgtctagtaggcatctcttgaccaaaaacagcttttgattcctgttctccaacctgttcctctcctagttttctccatctcagaaatgttacttcctctgcaaagtctttccctgacttatctaaaataataacctcctctgtttgctgtgggaatttgtatagaatggtgggaaaatttcaagtttcatatttggattagctctgacatttatttatctgaacactggtaattgcctcagtaaagacactgataataagtaccttttagagttattttaatctttaatgctttaatgtgtaggaagagtatagtgtcctgttttgcacagaaaggcattctgtaaataataagttgccttaattttcctgtaatgttcattatattgttgtgggaaggtatttactcctattattaaaaataaaaatgtgtaaaatttactacctgaagataacagttcaaattttgatggaaaaatcaacctatgcttgtgtgtgtgtgtgtgtgtgtgtgtgtgtgtaatgtgtacagtgtgtgtggttgttgagataagcataattatataaaaatatgtgtgtgtgtgtttaatgtgtacagtgtgtgtggttgttgagataagcataattatataaaaatacataaaatatgtacacttcaatgtgcagttgtaaagttaacattcacttaaccacaactcaattgtagaaagatcatttacagacccttaagaacttcctatatgcagtctcccaatcacaacccacttctttcccccagaaataatcacaaaatagactttggtgataatcttttccttcgtgtgttttagagtgttctcagctatttatgcaaataatatcatttagtttatgtatttttaattaatatggtttttattaacgaactttatatacattttgctgtatttttcatgtgttgattttttatagccatgcttttgtgcatattgaattcattaattttaatttttatataggatgtatttatgaacatcccactaactattctgctgctaattgatatttggattgtgtacagttcgatgctattataaaattcttctaaggacattcttgtacatgttcatttgttttgctaggtcctagagtctaaggtatatatccagaagaggaatagctggatattaggatagaataatgacaaactgttttctaaagtgattgtacagattagtgtttccataggagaaaagtgtacagttactggaaaaacagtttggaatgatctaaagcataagaatgttcatagcaacagaatgtatttctagtattccaaattttcacctacagttggtgtggtcagtataagttgttgtttttgtttttgttaatgtttttttttcctttgagacagggcctcactttgctgcccaggctggagagcagtggtacaaacatgactcactgcagccttagccttgcaggctcaagcaatcctcctgcctcagcctcccaagtaactgggaccacaggcacatgccaccacacctggctaacttttgtattttttgtagagacagggtctcaccatgttgcccagtctggtctagtctgttttaacaagttgttgctgtgtaatgatatatgtgtggtgttaatttgcttgttcctaagtttaaatgaggtagagcattttatgacatgcctgttctagtcttttgcttatttttctaattgccttttctttttcttaataatttcagttcttcatatgttcagcatactagtcctttgtcaatttacatgtattgaatatatatactctcccattctgcggcttattgttccattcttcatgaacatttgtaattttaatgtcctatttagacctttcctctgtctattgttttatattttgtattaaaggagtcattcattactccaagatcatgaagattttcttgtatgtaatcatgtaatcttcttaaaagcttcatggcttttgcttttttttttttttttttttttttttaagagtcttgttgtgtctccaaagctggagtgcagtggcacaatcacagctcactgcagcctcagcctccctggcccaagtgatccttccacctcagccttctgagctgggactatagccatgcaccaccatgcccagcaaattttttattttttgaagagaccagatttcactgtgttgccgaggctggtttcgaatgcctgggctcaagtgatcatcctgccttggcctcccagagtgctgggattacaggtgtgagccaccatgtctgcctggcctgttttttggctgatttaggtctataattcatctgaaattggcttttgtgtagaatgtgaggtagagattaggtttcatttttttccttcatatggctatccagtttagcactggttattgaaaagatcattattttttttcactagtcttcattgatatccaatcaagtactcaaatgttttaattattttttatactttgtattgaatcagatccaaataaagtttaaacataataatcgattgatgtcttttaagttgcttttagtctgtaagttccctctttattcccttttttttctcttgcagtttattggttgaagaatccagctggtttactctatgattttcttaagtctagatttgtgggtttgattgctatgatagtttcagatctttcttctattttctgcatatcctataaatacattcgagatactagtcctgtgtcaattatatgttgcatataggcattttataaatttcctaagtaccatttttcttcatgccacaaatttttatgtgtactatttttgttatccagctcaaatttttttctaatattgttatgacttttttctatatttttacattgtagttctcagatctttatatgatttattttttgatccataaattattttgaattatgtttctgaatttccaggcctttgggaattgtttttatttaaaaaatgtttttattgagatattcacatagcttaaaattcactttttaaagtgttgtactccctttaaagtgcacttctgtggtttttagtatgttcataaagttatgcaaccatcaccactctcaaattctaaaacaatttcatcctttcagaaagaacctccctgctcattagcagtcactccccactttttcttcctccagtctctggaaaatactaacctacattttgtctctgtggatttgcttattccagacatttcatataaatagaattggataatacatgtgtggcttctttcacttaatggtttcaagattctccatgttgtagcatgtatcaggactccttatggctgaataattttcgtgtgcgtgtgtgtgtgtattgtacattctgttcattatgtggacattttagttctttttacttcttggttattatgaataaggctgctgtgcacattcttttacagcttggtgtgtgtccacacattttcagttttcttgggtatgtacctagaagtagaattttttgatagtgatagtttttacaattgttgggtacaggcttctgtatatctccatgtaattaactgagttaatcatattcagatcttacatatctttactgcttatacagtgaattactagagaagcatgttaaaatttactatgatttggatttgtgtatttttacttgtggttctcatttttttctttttttaagagacagggtctcattatattgcctaggctacactcaagctcctaggctcaagcgatcttcctgcctcagtctcccaactagctgggactacaggtatatgccaccatgcctggctaggttctgttaattttgctttatacattttgggactatttccttaggttatatactgatacatacttgtcatatcttcttagtgaattaaaccatttatttatttagaagtaacttctttatagatataatacttttgccttaaatattctttatctgatattaatctagccccacttgctttcttttggctaatatttatatgattttcataaaggatttattaacaaaaaaaaaaaagaaaaagtttgcatggcataacttttttgagacggagtttcactcttgttgcccaggctggagtgaaatggcgcgatcttggctcactgcaacctccgcctcctgggttcaagcgattctcctgcctcagcctcccgagtagctgggattacaggcatgcgccactacgcctggctaatttttgtatttttagtagagatggggtttctccatgttggtcaggctggtctcaaactcctgacctcaggtgatcagcccaccttgtcctccccaagtgctgggattacaagcgtgagccactgcgcctggcctggcataactttttatctttttacttttacttttctaaatcatataaaatgtccctcttttaattatcttaaaaatccaatctgacagtatttgtttttcaatggaccattgattccatttgctttcactgtaattactgatatatttggatttatttctatcatcttactttggttccactggatttgcattcttttctaccattttttttttgccttaaaaaattttttttcttgcttagtattttatttttgagacagggtctcactctgtcacccaggctagagtgcagtggtaccatctcagctcactgccacctctgcctcctgggtgcaagtgattcttgtgcctcagcctccccagtagctgggattataggcgtgtgccatcatgtctggctaatttttgtatttttagtagagacagggtttcatcgtgttgtccaggctggtctcaaactcttggcctcaagttatctgcccgccttggcctcctaaagtactgacattacaggcgtgagccaccgcgcccaaccttgcttagtattttttaaaaatcactgtatttatcctcctctcctaatttggaatctatatgctttttttttttgagggttactctagctattacaatatgcatacttgttatagtctgaagtcagtctcttgtcctctttctgacaatcaaagatctttacacttttataatttatatacaattgtctattttgataatatatatgtgtttctatgtgaatatatgtacatacatatctttgaagagatagtagatttgcatgtagttgtaagagttaatactgagacatcctgtgcacctttcactcagttttccccactggtatccaataaaataatataacgaggatattggcattgataaggtcaagataggacatttccatcagcaccagaattcctcatgatacccttttatagcaacattcactttcctcccacttctggcaactattaatcttttctctgttcctgtaattttgtcattataagaatggtatcttagcctgtttaggcttctagaacaaaaacactgtaaactgtgtggcttataaacaacaaacatctatttctaacaattctggagtctgggaagtccgagttcaaggtgccagcagattcagtgtctggtgagggcctcttccccatagatgtcacctttttactgtgtccccacatagtggaaggggcaaagcagctctttagggcctcttttttaagggcactaattccattcaggaaggtcctgccccataacctaatcacttcccaaagtccccatttcccaatactatcacattgggaattgggtttcagtatattaatttgtctggaggggaatacgagcattcagactacagcggttacataaataaaatcacatagtattgtaccttttggaactggcttttttcactcaacataattctctggagattcatccaggttgttagcctgtatcaagttcattcctttttattgctatgtggtatccacggtattgtttaaccattcacctgttgaaggacatctttgttatatctactcttttgctattgtgactaaagctgctataaatatctacaggcttttgtgtgaatatagtctttatttctctgggataaatgtactggagtggcactactcaattatatggtagtcatatgtttagttttcgagaaaactgccactcatttccagaatggctgtaccattttatattctcaccaccaatatatgagtaatgcagtttcttcacatcctcatcaatgttgtcactattttttgttttagccattctgataggtatgtagtaatatctcattgtgagttgaatttgcatttccctagtgggtaatgatgttgaacatcttttcatgtactcatttgtcatctatgtatctttggtgaaatatctcttcatgtcttttgttcgtgttccaattagatttgtttacattgagtttttaaagctacttatgtagtcgagatactagtcctttgtcaaatatgtcatttgtgaaaaaaaaaaaacaaatatgtctcccattctgttgcttatcttttcatcctgttaacagagtgctttatagggcagaagtttttaatttcaatgaaatccagtttaccaattttttcttatatggatcatgtttctgttgtctatcctagaataagcctagattctgaagattttttccagtgttttttcttaaattttgacagtttaagactgaagcatttcaaattaattttcgtataggtgtgaaccttaggttgaatttcatttttttgcctctgaatcttaagttgttccaccatttgttgaaaaggctatccttcctccactgaattgctttttaaaatttaatattagagagcagtttttatttttatttgtttatttttatgtatttttccttttaagttccttgtagattctggatattagaccttcgttgaattatgtggtttgcaaatattttcttcctttccatagattgtctctttactctgttgatagtttcttttgccatgcagaagctctttagtttaattagatatcatttgttaatttttgtttttgttgcagttgcttttgatgtcttcatcataaaatcttttccagggcctatgtcaaaatggtgtttcctgggttatcttccagggtttttatagttttagttttacatttaagtctttaatccatcttgactttatttttgtttgtggtacaggaaaggagtccagtttcagtcttctgcatatgggtagtcagttatcacagcatcatttattgagtcctttttccattgcttgtttgaatccactttccatttgagtgcttttccccttgcttgtttttgtcaacttggtcgaagatcagatggttgtaggtgtgcagcattacttctgtgctctctattctgttccacaagtctatgtgtctgcttttgtacttagtgctatgctgttttggttactgtagccttgcagtatagtttgaagtgaggtagtatgatgcctccaggataatagccattttaacaggagagatatctcaatgtggtatctcaatgtggtaatatgcatttccctgctgattagccatgttgaactattttttttttttttttttggagacagagtctcactctgtcgcccaggctagagtacaatggtgcgatctcagctcactgcaacctccacctcctgggttcaagcaattctcctacctcagcctcccaagtagctgggattacaggcacccgccactacgcctggctaattttttgtatttttagtagagacagggttttaccacgttgaccaggctggtctcgaactcctgacctcaagtgatccacccatctcagcctccccaagtactgggattacaggtgtgagccaccatgcctggccgaacattttttcatatacctattggccatttgtatgtcttttgagaaatgtctgttcagttcttttgcccattttaaaatcagatttcttttgttttatttgctattgagctgtctgagtttcatatgaattctggttattaatcccttgtcagatggatactttgcaaatattttctcccattctgtaggttgtctcttcattccgatttttttttgctgtgcagaaatgttttaacttgatgtaatactatgtctgtttttgcttttgtttcctgtacttgtgatgtcttccacagaaaaacctttgcccagacccgtgtgtcctcttagtgttttccaaatgttttcttctagtagttttatagttgcaggtcctacatttagaactttaattcattttcagttgatttttgtgtgtgtgtatggtgaaagatacggctctagtttcattcttttgcctatggatatccagtttttctagaatcatttattgaagagactgtccccagtgtaggttcttggcatctttgttgaaaatgagttggctataaaaatgtagatttatttctgggttctctattctgtttcattggtctacgtgtgtatctgtattccagtatcggtctgttttggttactatagctttgtagtataatttgaagtcaggtggtatgatgtctccagctttgttttttttttttttttggtttctgtccttgattctattgatgttgatatgtcatgtttattgatttgcatatgttgaactacccttacatccctaggatgaattctacctgatcatggggaagatctttttaatgtgttttttggattctgttttgtagtattttgttgacggtttttgcatctatatttatcagggatattggtctggaattttctttttatgttacatctttgcctgattttggtattatggtaatgctggcctggtaaaatcagtttgataggattccctcctcttcacttttttgagtagtttgggtagaattgatattagttgttctttaaacgtttgatagaattcaacagtgaatcatcaggtcctgagcttttctttgatggaagactttttattactgctttgatcttgctactcattattgatatgttcaggttttctatttctttatggttcaatcttgataggttgtttgtatccaggaatttatccatgtcttctagcttttccaattttttggcatatagtgttcatgatagtctctaatgatcttttgtgtttctgtggtaccagttgtcatttttcctttttcatctctgattttatttatttgggtcttcattcccctttttttttttttttttttttttttgtagtctaggtaaagatttcttgaatcttgttgatcttttccaaaaaacaactttttgtttcatttatcttatgcacttttgtctaaatttatttatttctacattgatctttatttctttgcttctattaactttggatttgatttttttaaaaaaatttggttctttgttttagttccttgaggtgcatttttaggttgtttattttttttctgtttttttatgtaagcatttattgctacagatttcctttttagcactatttttgctggatcccatagattttgatgtatgtcatgtttccattttcatttgttttaagaaatttttaattttacttctaattttttttttctttttacttattggtctttcagaagcacattgtttaattttcatgtatttgtacaacttccaaagttcctcttattattgatttctagttttattccagtgtggttgggcaatatacttgatatgattttgacttttttgaatttcttgagacttgttttgtggcctctcatatggtctgacttgaaaagtgttccatatgtgatgacaagaacatgtattctgcagtagttggatgaaatgttctataaatgtctgttagatctgtttggtctaaagtatagtttacctctgatgtttctttgatgatctggatgatccgttcactgccaaagtgggttgttgaagacccctaatattactgtattgcagtcggtctcttcctttagatctagtaatatttgctttatatatttaggtgctatggtgctgggtacatgtatatttactatttttatttctctcgctatattgacttctttaacaatctataaggatgttctttatttccttttacagtttttgcttaaagtctatttgatataaatacaggtaatcctggtcttttttgctttctgtttacttggcatatatttttccaacccttcactttcagtttatatgtatcttcgtaaagtgagtttcttgtgggcaggatatagttgaatcttgattttttttttcaatccattcagacaacttttgttgttgttgttgttgttttgtgtttttcggtgtttttttttttaaagaaaaatttacctttgttatagattaaagggtacacatgccggtttattacatgggataatttcacgatgctgaggcttggggtcccagtgatcctgttaccaaggcagtaagcatagtacccaacagatggttcttcagtccattcccccatctctctctctccctgctattgatccccactgtctattgttctcatctttacattcatgtatactccatgtttagcttccacttataaatgagaacatgttgtatttggttttctcttctcgcattaggtcacttagtataaaggcctcctgctctatccatgttgctgcaaaggtcattatttcattctttttcatggctgcatattattccttgtaaatgattcctctctattgtaaatgagattgtgctcttgaattggttctcagctggaacactattggtttataaaaatgctagtgattgtcgtacattgattttgtcaattccaggagccttgtgtcagattctttagggtttttcatgtatggactcatatcatcagtaaagagagagagtttgacttttcctatttgaatctctttcatttctttttcttgcctcattgctctggctaggacttccagtactaagttttttgtttttgagacagagtcttgctctgtcacccaggctggagggcagtggcacgatctcagttcactgcaacctctgcctcctgggttcaagcaattcttgtgtctcagcctcccaagtagctggaattacaggtgcatgccaccacgcccggctaatttttgtatttttggtagagatggggtttcaccatgttggccaggctggtctcgatctcctgacctcaaatgatccacccacatcagcctcccaaaaagtgctgggattacaggcatgagccaccacacctggctgatttttaaaagagtttccagtaagttttagttactatgttcattgtaaggattagtctaaataatgtatcccatcattaagtctcagttgctagtatttttcctctaattaattcagtatgtatttccttagaataaagaccttctcacagacaacctggtttagttaacagaaatgagggtatttaacattgatataacactattgtctagttcaaggtccgcattcaaattttatcagtcctaacaatgtcttttgtaaaaaaaagtttttccccttgcctgtgttcaaacccagatcatgcatggttttcatgtccccttagtctcctttcatttggaatagttcctcgatgtttatatttcttgaccttgatactttagaaaaatacagaccagctattttgtataatttccctaaattttgttttatctcatgttctcacattattgggttcaagttatgcattttcacaagaccactgtagtgatgatgtatactcaattgttgatatttggatttttgccattttttttgtttaacatttttatttgacccacctaattgttgggggttttttaaaatttcattttaatttctcatttttaattaattatttatttatttttgagacaagatctgttgtctcaaaaacagaccttgtctgttgtccagggtatagtgcagtagcacaatcatagctcactgcagcctcaaatccctgggctcaaggaattctcctgccttagtctctgggtaactgggactataggcgcatgtcaccatgaccagatacttttttaaaaaatagtttttagagagggggtcttgctgtgttgcccaggctggtcttgaacttcagggcttaagcaatcctcccatgtcagcctcctaaagttctgagattacaggtataagccaccgtccccagccttcattttatttattagctttttaactgtacctttctgtattttttaaattcttttttccaaggattatcatatcttatcacagtttaaagttaatattgtactacttcacttaaaaataagaacctttcaaaagtataggtccacttatctcctcatcctttgtgctattattgtcatatatatctacttacattaaaaaaaagtctgtgcaggcatggcttttaaaattcagaaaaatagtatgtatgtcttaaatttacccacatctttactatatctggaactgttcatttctccctgtaggtcagggtttccacgtggtattgtttctctttagcctgaagttcttttagcttgtgtgcatctactggttgtgaattctcttagctttggtttatatggaaatgtgttaccttcgcttttgaagggttattatcttggagataacattctgctgacagtattttcccttcattacttcgaagtatctcctcttgttttctgctctccattgtttctgatgagaaatcagtcaacatttgtatcagtgttccactatatgtaatgtatcttttctttagaccagttttgaatttttctctttgaatttcagtaatttgcttattatgtgcctaggtatatttctttttcttttcttttttcctttttttttttttttttttgtgatgaagtctcgctctgtcgcccaggctggagtacagtggtgcgatctcggctcactgcaacctccgcctcccgggtttaagtgattctcctgcctcagccttccaaatagctgggattacaggcgcccaccaccacgcctggctaatttttgtatttttttagtagagacgggatttcaccatgttggccaggctagtcttgaactgctgacctcgtgatccacccgcctcggcctcccaaagtgctgggattacaggcatgagccactgtgcccgaccatgcctaggcatatttctttgtatttatcctcccttgagtttattgagcttcctagattttataagtttatgtttttcacccaatttggcaaaatttagttattatttatttaaatgtctttttctgtctcatctctttcctattctcaactgcaatatcttacatattatttgttatgttccacagttcactgaagctttattttaattcttttcctgtgttcttccgatttgataattactattgatctgtcttcaaatttggtgactaaacatggtctccaatatgctattaaaccatgtagggatttttctcaattattgcacttcttagtacagtaaatacaataatttccattggttcatttttatagtttcagtatctgtgtaagattcattgtctgtttattcgtatggcactattttcctttacattcttgaatgtatctttaatagctgtttattgcctttgttcactttgttccagtatctgtgattcatatgggggtcaaggtctatagactgcttttttttcttggctatgggtcacaattccctgctttttctatgtgtaataattttttattacatagtagacatagtaaatgaggaattgtagagattctgtactcttctgttcctctgaagagtattgacttttgttctattaggtctgtctccttcaatgtggacagaagctaaaatcactgccctattttttcagctttcagatgttattgtttttgagcctcctggagtcagtgaccagacaataatttggtcagaggttatcctcaaatttaggggcttctctgtggctgtcttattttcaggagtaccccctaattttgcagctgctctgctagtcccaacctatgttctctgaaacttcaaaccagtgagcctgtggctttttgccagcctgtgatgcatggattgagaagtaccctccagcataagctcacaaatctctctttttagtggtgacttctcttcagttcctttggaggagctttcaaatcttttttttatgttttgtccagaacatataattgttacctgtgagagggttacttcaaattattccactataaatggaagccagaattttcctacccttaaattttttttttaagatgagtctcactatgttgcccaggctgtctttgaactcctgggctcaagtgattatcccacctcagcctcccaagtaggtaggcctattgacatgagccatcatacccagttaattttttaactttttgtagagacggggtcttgctgtgttgcccaagctggtctcaaattattttcctgcctcagcttcccaaagcactgggattacaagtgtgagccatcatgcctggctccttaaattttaacaacatatttgaacttacatttttccctcaacacctatacctagtagactattatttatcttctcccttcaaaaaaaaaagttattagtgttgacaatgttggcaggctttcatttcccttctggccaagttgaaaattcatttaggattttagttcctgctttggggattttatttttgtatactattttatctaggggtatgagtataagttcaaaataattttccttcagaagtttgaagatgttccattttcttccagcttaccattattgccagtgaagagcttgttagcaatatattttggggaaggggtcatgatgtgtatatatgttgaaattttaaattttatatacagtaaaattgacttcttgttgtactgttctaagagttcttagaaccattctggctactttcattgtggtggaaacagctcagatttagatcttgcagatttggttgtggaatctgcctatagctctctgtagctctgtaaccttggtaaatttggaacaacatggagtatgaataaagaaaacatctctgtgtcacatttccttatttgcaaaaaaggatgatgccatctttcctgtctaccactctgggatctttcctgaggatcagatgagaccgtgtatgtgaaaacatcttgaagaacataacacttatatgagggaccgtttagtatttccatttgccctcctatcctgtatagatgattcagtaacattgtgtgtgaaaaaaatgatttaagcattatgaactgctgcaatatatagcaaataaggaatcattatactattatcattatgttagtagtggactactgaagactagaaactctcaagagccaaagaagagttgagtttttgtatgccataataaatggaagagtgtgtagggatggaaaagggggggtgtcagaagtacctgcacgtttacaccctgtaaaagattaatacctactttgcattcctctttgttgtctctgcccttggagactcctttactttcataaatatggaatgcttaaacaatgcacccagtttagtgtcggtgtggaaggaagctcatgttgaccctgcaactagattaatgggggaaaaaaaggtctgtcttgagcctgtgtgctttaaccatgtgaaatttattgaaaaaaaaatcaggaatattgagagaaagagttggagcagggaagacaggacagagaagaatggataaaagcatgaatagaagaagaaagataggatgtttgagcatcctaatgctcaggcagaggcagatgtggtcagttgttgactggggaaggaactaaatataaaatgagccaaatagagtgatggaggctttttactgcctgagtcaaaacaagcaagggcccaggcttctagatcttattgcagaaagattgatttcgacagcatataatttgcatcctcgttccatgggagaagaggttcatagatgggcacatgttctcacacccttgaaccatgaattggagttttccacctgaaaggagcagagacagactagtgagcagaaagcttcgtcctccaaccttagcctttatctgtgatgctcagtgtctccatgcaggatggtcaagacctccacttgtccattatcccttctctttctcttctatttgcttcctctgggaacttgccccccatcagttgcccactcctttcttatattgtcagtccgtttctatggactccttttttggtttacaaggatgctcaggttaccccaaatttaaaatactttctcttaatcgtgctactcccctagcactatccttcctttccttacagccttcccagagtctgcctatcctcctcaccttggcccctcacagtttgaatcatgaccctactatgccgaaacctctctcaaaagtcatagagatctactcatcaaattctgcatccttttctcaggacttttttaacctctttgcttgcacatcatactgtggactacaccctttcttttcttttcttttttttttttgagacaatctcgctctgttgcccaggctggagtgcagtggtgcaacctcagctcaccgcagcctccacctcccaggttcaagcgattgtcctccctcagcctcctgagtagctgggattacaggcgcaccaccacacctggctaatttttgtaattttattagagacggggtttcaccatgttggtcaggctggtctcgatctcctgaccttgtgatccgcccacctcagcctcccaaagcgctgggattacaggcgtgagccactgcacctggcctgaaactacaccctttcttgatactctctgcttctgacaaggtcttccccactgctcatctactcctctggatccaattatttctgctctcccaagttgaactgtcacattaccaactaaccgatgatcacctccatgccaatatgctaagggcatctaaaacttactatgcccaaaatgaaactcattactttcctccccaaacctgcttgtttttgtgagtttcctttatatacttcctgtaccacaccttcaaaacctctgtcatctctgattcttccctttgctttttccatccaatttgttgtgaaggtctgtcagttctacttgcaatctagtttgtttctgtcactcggtttccatttatcaaacatttggccgggcacagtggctcatgcctgtaatcctagcactttgggaggccgaggcaggtggatcacttgaggccaggagttcaagaccagcctggccaaaatggtgaaacactgtccctgctaaaaatacagaaattagccaggcaggcgcttgtgatcccagctactcaggagggtgaggcaggagaatcgctggggggcagaggttgcagtgagctgagatcgcgccactgcactcagcctgggtgacagcaagactccatctcaaaaaaaaaattaacggacctagtaaggaactatgctagactctggagaatgcaaagattaataacatcatttgatgtcaagagctgagagagataaaaatagccaattattacatgcaatggaaaaaccatgttatatgctatgctggcaaataaatgattaattttggtattttgattaaggggggcatagtatcaaggaaattcttaggaaggaagtgagactgaactaagctatgaagaattgttagcatttcgattagaaaggaaagaggataatttcaggctgaagcataactggagaaaacatgaaaacatgaaactgttcaggaagtggtgacttgcgtagctggagtaagtgtagagtgtaaacagggatgcagaatgagtgaaaagacatgggagagatgttaataagtctttccatcagtcactcctattaccttttactgaaatattacaatagccctttaacaggttctcttgtgtccactgtaacttgcttctaaggtaatcttcctgaagaagcgctttgaccaacctggatgggctactggctctgccttttcctagtaacaggtctttaggcaagctcctactttgtgaggattaaatgataaagggtattttaaaatgcatatcatactgtctggaagcaataaataaaggagaactattaaattcaaactctttttaactgacactgaagctcttgtatcagctggctccagtcaacctttccaagtttatcttctatgtctctgctcaccatcctcaaaaaactctttgctctttttcctatttacatcctgcacttttctgacttttgctttcattccctgtctctggaatacccatcaaccattgctgtatgactaaatcagtatctctttaatcttgactgcacatcggaattgtctaggagcctttaaaaaaatactgatgcctggattctattcccagagatcctggtttaattgctttggtgcaacctgaacattaggattttttaaagttgctcaggtgattgtaatgtacaaacaagattgagaactcctggcccaaatcgtaaatgttccctcaaagcattttctgaataccaccttctccccatacttctctgcacctctaatctttcctttccctgaactctctgcactttatatgtgcctttcttaagacacaattttctcccttgtgatattgtttcttatttcttacattataacataatctctttgtacacagtttatatttgagtcatctttctgtagttcatggtatgtgtcattaatgttttccgagtgatggtggatgaatgtctgcatgtagaaataggaaaatgacatttctagtgaggaagaagaaaaactacaagaggagtcaggcagtgtggttcctgggatggaaataaccagtatcccttattttagggatgaggaactgagagtaagggtaaagaggtgtgggaatatactcagactggtctggtaacctgtgaacacagacttgtagacagttgtttattagtttatccattcaatatttactaaatgcctaccatatgcttgacattgtgctaggtcccaggaatatatagctatagcttacagtcaatgtcccaatggctcatggggcaatcaacacattgctttaatgggaagagacagctagtctctctgccttctcttaggcctaatgggaagggcatctatctcttcatcagtacctggtggtagaataaagaattctattctttattttctttctttctttattttttttagatggagtttcactcttgtctcccaggctggagtacaatggcatgatctcagcttactgcaacctccgtctcctgggttcaagcgattctcctgcctcagccttccaagtagctgggattacaggtgcccaccaccacacctggctaggttttgtatttttagtagagatggggttttttcatgttggccaggctgatctggaactcctgacctcaagtgatccacctgccttggcctcccaaagtgctgggattttaggtgtgagccacctcgcctggcaagggattctgttcttagtccttgaaaaaataaagttctgaatcttcaa

SEQ ID NO: 1627 - DNA, 32012 bp, Homo sapiens
cttttaaatttgcgttgtaagatttattttggctctccccgcctgttctttgcacattaaaaatgaaaaagtttgtagaactaagctaagcagatggtcttcctgcaaaaagaccgggctgaagtaaagcattgttttggagctggttcacagaaaaaaggcaaaactggttatcctgacttcaagctccaacataaactgctcgctttctccgggaaacttgccccgccacacacacttgactgcgtggccagttctttcgaagcctctcgctcccaacacggagttcctcccatttcttcacagtcggctctcagcagctgctgctggtttctcggctccagcaccacgagtaccgcactctgaggtttacaaagcactctgcttcaccgactgtgatcctcacagtcctgtccggtggcctcacgcaggtggcggtgcagcctttcaggcccagagcggccaggagcgaagcccgcagccccgcctggaagcgcagcgcggtcggtcgcgcgcccctgaggcttggaggcctgggcttcccccagcagcgctcgagcaccgcccagtcgagcctcacaccggatgccacttcatatttgggcccagagctcaattcgcgccgatgcggtccgccgtccttaaatctcttcagccaggatctctccccgactgcaaagcagccctgggcgggagcggcaacatctccacgtcacccttttggagccgccgacattcagaggggcaggacacgggaacgcgcgctgtcttgctttacggcgcgggtgcgcgagtttgcggcagcgtgacgccctcaagttttggcgggaaaagcgctgcatttggattcctgcagtggtgggcaaaggacagtccggtgaggaagggcggccggtagagtagggaaggtttctaaagaaggagttcggggtctagattagtgagggagggcatggtgggagaaagttagcattgactagcgcaggggattggagagactcctgcggaggggcggtttcggagggtggaggaatggtaccaggaggttcccgttgtgggggcgggggcaggagggactaacccgctgctagctaagaaccccaaggaagagtcccagcccttcctttcgcctctgggggcagtttggccccgccccggcctttgggacgggtggggctgtggatggggatgggaattggaattgagcaattgggaggaggcgctgccgcaggcgttttctgccccataccgctccctatatcctcttcctctcttccccagacccccacctctccctcctccttccccagtcgttcgccggaaagcatttgtctcccacctcttcataacaacaattaatttcctctggggcctgaggagggcagaatttcaaccttcggtgtgcttgggagtggcgattgtgatttacacgacaaaatggtcaggtttagaatagttgttcgtggttgaaagacttggataaatgtggatgagatagaaggggaaggcaagagctgttaattttcgtgggcaatcctggggagaggcggggctcagtggcttcactggtgatcttacactctacatcttttctggattcctgccttttacagccgaggtgctcggtggagtcatggcagtgccctttgtggaagactgggacttggtgcaaaccctgggagaaggtgcctatggagagtgagttcttttaagcttgccttcgttttctgagtgcatattcattgttttggagtctcacactctggtgatttagaaagtagatgtttgagatccaagggttttggcaactgaagttacacagccttttgctaggattaaaaattttttccttccctttaaaaaaaaaagttttctttgtagagagctggaagggacacgaagttattgtttccatgcccacaaatggcttctcagggtttaagcattgcggttaatgagcaaatgagcagactctggagattgcctgcctggtttcagatccttgctctatcacatactggtcattgttttgtgatcttaggcaagcttcttaatgtcattgtgtacctctccttcactacctttagggtggcaataatcgcatctaccccataggagcttaggacagtcagttacacaagcacatatagtatgggattaatgctcttaaaagtatatgagtagaacatgtatatatgtgatgtggcttagaattatctcaatctattttatgaagcgtttattaaatgacttgtgtgacagcataatgacgtctttggagggttagctattgtatttcacattttagaaaagagtagtgtgtgttgagaacatagcagaaaccacttccttggtttctcctttgtggaaaaagtaatagaggtaaaatcgttttggatgagtcatgtttaatctttggaagttttagaagaaatggaattctgtaatgttaaaactcttttcctttttagagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaataggtatggaagaaatttaagataattattttaaacaagtttttaaatttgttttttaaatcttgggcatgctatttggtcgttgtcctttcaaaattgctcatgcaactgtgaaattggaatacattatctttaaaaaatttttccacctggtgttaataacataaaagcatatatagagtcaatgaaagaaaacttctttcccaagttatataagtgattttgatttaagattggtgtcttacagaatttaagagtgacaaacaagttttatggtacatcataaatgcagtgtatcctaaatgcaatgtattgcctacacaattttttctttgtagacattctagttacatgaaatcattgtatacattttatacatttacagatctaaaatagcatgctgtttcctcttggtttacatgaaataattgagaattttctaggattgctttttgtatattaagtaaattctatgtttgctattaatacttaaatattcgatgtagaatcaaaggattgatatttcagaacactgagaagtacataaaatctggatctaaatttataatttaaatttataatttaaagctattgtattaaataagtttatcagttaaaaactgataaagaggtattaggatctccagtgtgactcaggagagagttgagggtaaaagaaatggagttaatgagagagatcaaaatataaaaagataactgataaaagaactttcataataaaactgtttcacgaaggacctcacaggcatttgtggttttgtactgtgagactatatgaagtttaaatctgagccaggtgtggtggtacatgcctgcaatcctagctacttaggaggcaggaggattgcttgagctcaagagttccaggttacagtaagttatgatctcacgccagggcactccagcctgggtgaaagaacaagaccgtatctctaaaaaaagttaaattataaaagaagtataatctgtaaaatatttagtgaaattggcttagatttgcccagacttcccctttggcattatatttcaggaatgagaaaaataattagcatagcatttagaagaaatggggggaatttcaaggttactaaataaatcagggttagtataagaggaagcagaggctttgaagtcatggcttgcattcttgatttggatattggttttctctttataatttttctgtgatgacgccttttgccacctaacacaggtaaatgtgagttaagccccatatgtgttagtggactcctgaatcttttgttggcatttgcttctgtttgcctaagcacatttgtaaatgtctaagcttcaaattaagaagctatgtggttgctacctgattatatttagtcaataaacttactttcatatttgttttagagccagacataggcatgcctgaaccagatgctcagagattcttccatcaactcatggcaggggtggtaggtatagttgtctatttcccttttacttaaaattagagtgaatacattacattaccaaattctagtgtgtttctctctgcatccctcttaggtttatctgcatggtattggaataactcacagggatattaaaccagaaaatcttctgttggatgaaaggggtaagtttagcattttatcactacctaaaataaaataaaataattacctaaattattttaattacctaattattttaatatagccatacaaggcaaaatcaagtctttttgcattactggaatttcaagacaagatctgaaaaatcaaggaaattttggagacttcgtatatttggaaatcacaagtctcattttgcaatacaagtgcggatcaggtagagaaatctgacctaggtgcaagcctagctcactatatgtataagaataatttttttttttttgatacaggctcactgtgttgtccagtctggggtgcactgtattatcacagttcactgcagccttgacctcctaggctcaagcaatcctaccatctcagcttcccgagtagctaggaccaaccacaggcaggtgccaccatgcctggctaatttttgattttttgaagaggtggagtcttcctgtgttgctcaggctagtcttgaactcctggactcaagcagtttaccagccttagcctcccagagtgttgggattatagacgtgagccaccatgcctggccaagaatagtttaaaataatcctttaatggattaataaagggaagttcctgtggaataccctggaccttagtcttgtcctgttcactctttttttatgtatgacgtggataaaaatgtaagaaatttagttatattttctgaatgtcatcaaattgagaaggatggatagcgaaagctttaagcttacagggtcagaatcaaaaaagaaatgtcagctgtatgaggcagtagtttttgtctggtttaatgctttattcttagtattagaatagtgcttaacaaatggtcagcttttttttttttttgaaacagagtcttgctgtgttgcccaggctggagtgtagtgacatgatctcggctcactgtaacctctacctctctggttcaggtgattcttgtgccttaggcccctgagtagctgggattacaagcctgagtcaccacacctggctcatttttatatttttagtagagatggggttttgtcatattggccaggctggtctcgagctcctggcctcaagtgatctgcctcccttggcctcccagagtgctgggattataggtgtgagccgctgtacccagcctatacatgcttttttcttatgtgcatatggattttactttttacccctttaaactgagtttatatgacataaaaatctttatttttatttaaaactttaaaaattcaggtacacaaaaattcttatgtattataatgaaatgtaaatatatgtatatcaacccacctggtttaaaaatacaacattattcgtatataagaatgctcacagtggtgatgtttttaatatagcaggaaactaacccaaatgtctgtcaacaataaattatgaaatgcatggcttttcaagccatgtcacaagcagtgacacaagcatgtcacaagcagtgacatggatgaatttcaggtatataatgatgtagagcaaaaagagacagttgcaaaagaattcatatggtctgattctgtttatacaaagttcaaaaatatgtaaaacctagtatattgttcaagtatgtaaacatggagaaaaaaacatgcagaaaagcaagggtataataaaaccaaattcagaatggtctaagaaagtaggggagggaatgtatttaaggaagtatttaaagatttcaaaggaaatagagcattgtttttctaaagtgagtgggtgtttattacattgttattctttatatcttgtattaatatacaagatataattctttgtttctatttaatatttaggagtcttttaaaaaaagaaataaaatgttaccagtatttaatgtcctcctgtttatttcatcacaaatatattcttcctttgtttttctaagagctaaacacattcctacatttaaattttattatgtgcagttctctaacatagctgagtattatgttgcagacataacaaagtccaaggaatactatagttatccattagtattttaagtgattactactcataagtaatttgaaactcaatctcagtggtttgtccaatagtgtcatatttaactactgaaaagataatcaactgggtgcagtagctcatgcctgtaatcccagaggctgaggtgggacgattgagtgattctaggagtttgagaccagcctagacaacatagaccctgtctttatgaaaaattaaaaaaaaaaattagctagacatggtggtgcacacctggagtcccagctacttggaaggctgaagcaggaggattgatcacttcagcctaggaggtcaaggctgcagtaagctgtgatcacatcactacactctagtctgggcagcagagtgagacactttctcaaaaaaaaaaaaaaaaaaaaaaaaaaagggtaatcacagtagctacctcctaagtcagatagaggtaaacatttcattggtttacatattgtgtgaatgtacttgatttttaaagaaatcagtcccctattttgagacatttaagttgtttctaacttataaaataggacagtgatggcttctatcaatttgtgtaaaaggccaatataaaaattgcgtcatgctataatattttttatgctataatattttttatgccattagcctttttgtcccacttacacactatttcatgttagtatgtatagatataccttgttgattgttttcaaaacctacctccacattttccattgtacaaatttggacatttatttacaaataatattgctatgaatattcttatgtttatgaatttgtgggattatttctatggatatagaagtgggaattgctagttcaaagagtgaatgtttcacagtttagtatgttttgccaaattgccctctgataatagagggccttttctaactcttaagactgggttacattcctttgctctaagatcctatagtgctctatatttttataaccttcataacagttttctattgtcagtcttcactaatttatctattacctgcattggctggcatagtgtctgtcactaagttacagtagatattcactaaacataagttaagtcctgcctgcagtttttgtgtgttgaagatgggaagttagggtggaagttgggtcttctgatattttttttttgtacagagtttgtcctctttttctcagactctctactttgaagaaaaaaattactgtggtttgttgaattttggtgtgtcttcacatattttcttctgccaactgggtttgtttgctgctgagaaagttgtgcctaacatactactgatgtttccttcctgccctccaccctacctgatgaggggccttgctttactttcatctcaggtttagagtgctcttttccagaagggcagccccttctgactccagcctctttctttaatctggtccagactgttctgtgtgttgataatacttcttttaagttaatagaagaggtgaggcctttttctacttttagcatagatgatgatttattttatttttttaaatttctttttgtctattttgcttattttaagagaagttctacaaaccttaagtaacaccagtgattttttttcagtaaaacttaattcctgtaagtatatctatttgcaaaacatttttattcagtgtcatctttttttcttttggtttagataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggaggtaagagctatttaatcatggtaaaactcctataaaaagtcagattagttatactgaaataaatgaaataaaccaaggaattcatgtttatataatagtttttgttttcttttttaagagacagggtctcactcttggccagactggagtacagtgagctgttatagctcactgcagcctcaaacttctaggctcaagcaatcctctggcctcactcttccaagtagctaggaccagtggtgcctgccacaagacatctggctaagttttaaaaattcattgtagagatgggatcttgctgtgttgtccaggctggtcttaaacacctggtctcaagcaagccttctgtcttggtctccaaactgttaggattaaagtaaagacatgagccatggtacccagcttttatagtagtattttaatagtgtcttgatcggtttggtaactgctgtaacaaagtatcatagactgcatagcttataaacagcaaatttatttctcacagttctggaggctgaaaatatgagattaggggtgccaacctggtcatgttttagtgagggccctcttcctgatttgcagatggctgtcttgctgtgctctctcatggtggacagccaagagagcagaagcaagctctattgtggtttttttttttttttttagaccagagtcttgctctgtcacccacgctggagtacagtgatgtgatctcagctcactgcaacctctgcctcccaggttctagcaattctgtcccaggctcccaagtagctgggattacaggcatgcatcatcacacccggctaatttttgtattttgagtagagacagggtttcaccatgttggccagactggtctcaaactcctgacctcaagtgatcccccaacctcagcctcccaaagtgctgttttttgggttttttgttaaatgaccagatgttgtgagatattgtgtctgttttttgtttttttgtggttttttttgagacagggtctcactctattgcccaggctggagtgcagtggcacaattcaaggctcactgcagccttgagctcccaggctcaagcgatcctcctgcctcagtctcctcagtatctgggtctacaggcgtgcaccaccacacctggctaatttgttgtgggttttttttcacagacggtctctccatgttacgtaggctggtcttaaactcctgggctcaagtaatctgcctacctaagcctcccaaagtgctgggattatataattagtgccctataaagatacaatattgtccgggcacacaagcccttattagacattaataagctcttaataagagcactaataccattttttgagtggtcccatcaccaggacctaattacgtctcaaaggccccacctccgaatgccattgcattatgagttaggatatcaacatgacttttgagggggatacaaatatttagcacattgcaaatagtaacttatttataatcccaaagattttttaagctaaggcatgcatagttattaaatatcacaacacttatctctcctgtgtatcatgtaaacatttgtgaaaacaagactagggcaagaaatgattcatctgttttttggtttttttttttttgagacaaagtcttgctctgtcgcccaggctgcagtgcagcagtgtgatcttggctcactgcagtcttgacctcttgggttcaagtgatcctctcactttagcctcctgaggagccaggactacagatgcacaccatcacgcccagctaattttatttattttttgtagagatggggtctcactatgttgcccaggctggtcttgaactcctgggctcaagcagtccttctgcctcagcctcccaaagtgctgtgattacaggcctgagctgccatgcctatcctgattcatctatctttgaagtgcctctaaagtttccaagttgggattcttagtgtgaaaaccatattgaattaattcaaaggaaacttttcatggatttatattattatttttccttgaaatctttataataagaacatttaaaaaaactgggacttgctttgtttttagaattgccatgggaccaacccagtgacagctgtcaggagtattctgactggaaagaaaaaaaaacatacctcaacccttggaaaaaaatcgattctgctcctctaggtaactgaattatcttgagtgaaagagtaccgatttcttggatatgaagtcttgtgctatttgaattttttcttacttttttttttgttttaaacttacaaataattcatgttcgttgtagataaaatagtaactataagtaaaaaattaaggaaaaaataactctttagtcccagaactctgcaatagatttttaaaaatattttggggagtgtatattcagagcaacttgaatctgctcttagatggctttttacttaaagttttcatatgtgctatactttgttgcaaatacactcgtttgttgcttaattatagggatgcactctaacaaatgtttcattaggtggtttcatcattgtgtgaacatcatagagtatatttacataaatctagatagtatagcttactataaatctaggctatttggtataccctattgatctcaggctgcaaacctgtacagcatgttactatactgagcactgtaaggaattgtaacataatggtatttgtgtatctaagtatagaaaaagtatagtaaaaatacagtattataatctaatgggactgtctgttatacgtgtggtccattcctgactgaaacatcattaatgtggcccataagtatgtaaaatgaatatatgtatattatttatatgtgtttttatacaaaatgagatcacactaataatattttgtaactgtttttggttttagtgcgcagcgaacattcttccatgactataattgtaggtctacatcgttggtttaaaggctgtgataatattctgccatgtggatatgccttactttactcttttaatcactttgttggagatttttctaaattttcacagatacaaaagagatataagtatctgtgtaacttaatcatgacacatacccttaaattgttcattgaaatccccagaagcaaaattgcaggatcaaggatgtagtttttattattatggcttattttgtcaaattgcttcccgaaagttcgaaccatttcatcacagtctcatcaatttacattaaggaaaaaaactttaaataatagtttttcatttttattttaaatttaatactaatgaagttgtataccctttatgtatgtattagttttttgtctattttgctcatttttgtcaaggatattgtttttcttaccactttgaagcttttttttttccttgataacacattgacctttgcacttgttacaaatacttttcacaatttatcatttattttcattttgttttgctatattgacattcaaatctattatcttgtcctttgtggtccctgactataatttctttggaaaggtcttctacctctactatttaaaagttccctatgttttcatttagtgtttttatggcttcatttttccatttaaatctttggtccattaggaaataatcttcacataggaagatacgtgaattttttctcaagaaaattaagataccttaggatggttagttagattactgtctcttaaaaagttattggtaagtaaatgttcattataaaactgtgtgaataaggaggtcacgtgagaacatgacattgaagtaatgaaattcggtattgaaaatggataagaggggtttctgtatctttttgttaatctcgtcacatgaggagaaacatttccatctggctcttgttctcagttgcaaacaattgagaatcagatcagggaagactactccaagatacagcagcagagaaaaactgcatgaaattaaagcagtaatttagtagctttaattctttctcttccccaggaataatatttagacataagtaggctaacagaaaatgtgtttcttacctcaagccataggcttctctaacatgattctttcgtgaatgttgtcgtaatgtttgtttttagctctgctgcataaaatcttagttgagaatccatcagcaagaattaccattccagacatcaaaaaagatagatggtacaacaaacccctcaagaaaggtaatatccttaaactacaagtttgtttgtttttctgtggaagaaaaggtaattgcaaagttattatcacaagtcaacaacacatgatagctatgatctctgtcctcatggagattataatgtccagtagaaaaaaatacagaaataattttgtttattaataattataaaggggaaagtcagggtactatagctaagtgtttgaccaagtctaagggacagggaagacttttcttcctgaagaaattacattaaatctaagatttgaagattaaagggaagctaggcaggcaaagtaagtggcagatttgattctgaacaggggaagcagtatttgaaaaatcttagattttagaaagtctgatgcttttgagaaacttgaaagatcagtatggcacaagccgtgtctgttgtgttcatcattgtatcatcagtgctttagcacagtatatggtgcaccataggcactcattaaatatttgttgagtgagtgaacagggaagtgggagaggaagacaggtttgagatgaggccagagaggtcgctagtggccaatttgtggaagaagaccttgtaagccatgttaaggattttgggctttaacttaagaccactggggagacctctgagagattttaagcaagactatgacatagtcatatcttcggtttaaaaatatttctctgacttccttattttttttccattgttttttatgaatagggaaagattcagggtgctgtaggtttttctgctagttgtctagaagtgggaggctggtggcttggaataggttagggcaatggtattggagaaatgagatgattccaaagaaatttaagaactagtattgataggactgttaggctgtgaatggaaggagagaggacaatgactagagatgatgaatgaaaaacattcagagagttattaatgtttaactctgtcctcatggatagaaaagagttaatgtttaaacattcactcttctttaatacctctctgcatgtttcttcctccttgtcctaacttaaagtccaattctcccctgaggacactgcttcctctgaagcggtaggtgttttctttcccataccctcatgtcctttgatctggacatggtacaggtgtcctccttattcttcattgtcactttctcccatcttcctttatgtctctcccctctaacttttgaaccccaaattaaaatttctgccgtactatcacagtctgcaaaatgactcttgatgttattttcgtcatgattcttggtgatttaaatatttatttggatcatcctcctgatatcctgacttcactgtttcttgaccctctctcctatagtgatgttgtctttgaacacgctgcactgatcaccagtataattttttctgacttcctcccttaatattctaacttaaacagtcctttgtatctggacttgcaattaattaattctatctcttcagtctcttacctgctccctctctaggtccttgatttcatctttacctatcttaaatctttaggttagtcattataaatgactgctttgcgttcatcatcttcaatttccttgtccccttctctcttcatcatacttagtgggtaaaacccagtaagtagtttctgggtttaatctagtagttttctacgtactgcacacttgtacctgcacaacagattgcagcaggagaaaaatacccaaaaatgttcactttaaattcaggattactaatctcaagtgggcccttaatgcttcctggcatttggccttcgtttccccacatctttctctgtcctgttctcctaaatcacgtttttataatacttttctcttttttttttttttttttttgagacagggtctaggctggagtgcagtggcgccatctccactcacttcaacctctgcctctcaggttcaagcgattcgattctcgtgccttagccacccgagtagctgggattacaggtgtgaaccaccacacctggctaatttttatatttttagtagaggttttgccatgctggccaggctggtctcaaactcctagcctcaagtgatccccctgcctcagcctcccaaagtgctgggtttataggtgtgagctactgtgtctggtcccttaacttttattatcttctctccatcctcactctcagttgttcactttgcttcctgtgtcactgggaaatgaaagccacaagagaacttaggcaagctcccaccaccatctcctccatactaactgcctctatgctcatgtattctctttcatcctgtattgctgtagataaattgctctggatgtaagccaggtctttctcttacccactcaatgactttgtctagcaatttttctccctctcctacattattaatttttccttctctaccggatctttctcatcagcatatctacatgctttttctcccattttaaaatcaaatcataatggtaataaaatttctcttaactccacttttccctaccattccatcttcttcacaattgaatattcctaaaattgcttctcatctctaacacctcaaaactagttttcaatttcatctattttgttgccaagagtcacagtgatttttggaacgtgttgccaagttcaatgtaatagtccactgtggtcaaccgaggtctgaaaagattaaatggaaagtaccagaagtaaacaattcatcaattcatgggttttggccgggcgcggtggctcacgcctgtaatcccagcactttgggaggccaaggcgggcggatcacgaggtcaggagatcgagaccatcctggctaacacggtgtcaccccgtctctactaaaaatacaaaaaattagccgggcgaggtggcggtcgcctgtagtcccagctactcgggaggctgaggcaagagaatggcgtgaaccccggggggcggagcttgcagtgagccgagatcgcaccactgcactccagcctgggcaacagcgagactccgtctcaaaaaaaaaaaaaaagaaattcatgggttttatttatttatttaattcgagacgggatctcgctctgtcgcccagactggagtgcagtggcgtggtctccacttactgaaacctctacctcctgagcttaaatgatcctcccatctcagcttcccgagtagctgggactacaggtgtgagccactatgcccggctaatttttgtatttttggtagagatgaggtttcgccatgttgcctatgcttttctaccaaaaatacaaaaattagccaggtgtggtggttcacgcctgtaatcccagctgttctcaaactgctgggcttaagcaatccacccaccccggcctcccaaagtactgggattataggcatgagccacaatgccctgccataggttttaaattgtgtgctgttctgagtagcataataaaatcttgtgctgtcctacttcatctcacttgggatgtgaatcactcctttttccagtgtattcacgttccatgtgctacctgcttgtaactcccttagtagctgttttggttattagatcgaaagaacatatatagggtttggtaccatttgtactttcaggcatccacttgaacatatccctctgtggataaggggggtactactgtagtcagttctcagacctcttgttttatctcatcaatattttatacagttgatcatgccctcctcctttaaacactttcttcatttggcttccaggcgttacactcttctgattttcgtccttctcactggtcgctcttttcagtctcttgatggttttttttcatctgctcagcctcctactattggagttctccagggctgaatctatggatctcctttgttttcttctccacactcactccattagtgatattacttggtttcatggctctaaataaaactatatgttgatagtcacatttatatcaacctagacctttcctctgaattccaaacttacatgtcttaactgccttctgaaatttcacttgaatgttaagaggcatctcacacttgatgaattccaaactgagttactgatcttttcctttcaaacccattccttttcaaagtctttcccatgttggttaatggcaactgcattattcttattatgcagatcagaaactttggaatcatccttcatttttctcattctcttttacttcacatccagtacaccagctaattctgttaacctctatctttaaaaaaatcttagaatctgattaccttttttttttttacctctactgttaccctatcattccaaattaccatgatatctttccaaaatgttctgatttaaaagtgaattagaatatatcactattctacccaaatcctccaatgctttagttctcacgtgtagtgtaagctaaaatcagttcatgacctgtgagttcttacacaattttgttccttacattacctctccaacctcagttctgctttgctcccccttggtcatattgttgttcttcttattgttctccaagtgctctaggcacacttctacctcactgtttttgtagtgactgttcctatgtctgaaaatgctttttcccatgggacttatttgcatgtcttattctcttactttctttggatattgacttcagtgtcatctttccaataagcctttcctggccatgctatttaaaatggtatcctcttccctctaacacatttcttaaatttttaaaatttttactctcttgtggacatacgcaatccaacacgtttcttcattttattttccttcagtgtacttaccaccatttagcttactgatttttaactgtatttgtatttattttatgttattttgtctctcctcagtagaatgtaggatttaaaaggtcaagagttttttttctattttgctcactgctgaatacctgatacctagaataatgcctggcacagagtagacctaataaaatatctgaatgaatggattaataaataaaaagcaggtttaaaaaaaaacttgagcatgtttaaaaagaaacaaacttaagcatgtttaagtggtttgggtacggatcctgtagagaggaagaggctgacagtctaagagaaaggaaataaataacagaggatcaagatccctaaggaggtagaagggtatgggctccagagcacaagtagagagatgaacatttgatgggagaatggaagggatgaaaagatgtataataatacaaataacttagctttggtagggataagttgatgtagtttctgtctaatggctttattttttctctgaaatgggaggtggtagtataggtactggatggtagtcttgggaattacagaaaagtgtagttttgaaatgatccttgtggagaaaaggaaaggaaactagagaaacaaatattatctggcaatattgaggtttagctagggattgtaaccataaatttacagtggcgtcattttccatataatattcttctttataaagcttttccaaggaatcaaagaatgttggctatagcagattcataatgtttattgctattatcataaattattttttattttaaaaagttctagtcctttagccaggtctgttgtcttcatagaacattgttctgttacccataaaagatgccattaagactgtggcctgggccgggcgcagtggctcacgcctgtaatcccagcactttgggaggccgaggcgggtggatcacgaggtcaggagatcaacaccatcctggctaacatggtgaaaccccatctctcctaaaaatacaaaaaaaaaaaaaaaaaaaattagctgggcgtggtggcgggtgcctgtagtcccagctactcagggggctgaggcaggagaatggcgtgaaccctggagacagagcttgtagtgagccaagatcgcgccactgcactccagcctgggtgacagagcgagactccgtctcaaaaaaagaaaaaaaaaaagattgtggtctgagcatactccacactttgaacatgtctacagatcatacttaggtattgtaaaatacctaatttgacaaatgagttttagtaattttataacttggccatattttttataaaatcatataggaagactttgttttatatcttacaaaaattttgtgttaaataaatagatttagacatagttttacttcttcaagttgccagttgggttaatttaaaaacatacttgcatagaagacttgaaagcatttgtatttgttttcttttttaggggcaaaaaggccccgagtcacttcaggtggtgtgtcagagtctcccagtggattttctaagcacattcaatccaatttggacttctctccagtaaacagtgcttctaggtaagactgataaagattgagtagtttttgattgtagtattccccatgaagaataatacatgtatgtgttttttcataataatcgacattaacataatactgtaagcatgagaacttgtgtgtgatataagaaaggcctgatagattttattttattaaatgtatgtttctttctgtcttaatgcctcagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacaggtgagggaatttaattttttaaaagtaatggcagctctttattttttattgtcttaaagtccttttttaatgtgtaaatcttagatatataacttttaaatcacatgtattcttttttggtcaaggaagaaagagaggagggaggccttcatgcaaaataattttaagtcagactaaatagctatgatattactgtctttagtcctaatggatttattcatttgtcttctgtttgacatgtagaacccctggcagcggttggtcaaaagaatgacacgattctttaccaaattggatgcagacaaatcttatcaatgcctgaaagagacttgtgagaagttgggctatcaatggaagaaaagttgtatgaatcaggtgtgtttcattgattttcattataccttttcctgaagaagaatttaaatatttgagtaaaagctatcattagtatattttttaaatataggctgtggctcacacctgtaatcccagctttttgggaggctggggtgggcggatcacctgaggtcaggggttcgagaccagcctggccaacatggtaagaccctgtctctactaaaagcacaaaaattagccggcctggtggtgcatggctgtaatcccagcttctcgggaggctgaggcacgagaattgcttgaacctggaagacggaagttgcagtgagccgagatcctgccagtgcactcctgcgtggccaacagagtgagactgtctcaaagaaaaccaaacaaacataaaaatacaaagtaattagttaatttgaaaaagaaactatttaagtaaaatgttctttactttaagaaataatacttttttttattttgttttattttttaatttttaatttttagccactgtgcctggcctaagaaataatatttcttaaaagacctttttattgttattaaaaatagtagggagctggaatcattatctttgtaaaaactatgtatacttaaactgtagacaataacagttgactgcctactatgaaagacgaatacattagcaatcccacactttctcccatctcccttgattgcacccgtcaatttttattgtttatattattagagcatagttataacattggtattctaaactgtctttaaggcttttcaaaaaaaatgttaatgtcaatgaaagacaaatagggtagctgttttttactcaaggagactaaagaggcctgataactaagtgcaagtgcaatgcatgatctttcactagatcatgtatttgaaaaaaactataacggacattattggaacaattggggaaatttgaatatggactgtatattaattaggtaatgtttttgtatcagcgtcagatttcttgggtgtgataatactgtggtttgtaggagaatgcccttgttcaaaggagaacaagtgtcaaagcaaagttgaagtgaagtgatattttcattcagcttaaaatttaaaaaaataaagggcaaacaactacataaaggccaataaacacacacatatctggtagataaggccaatgaagagtatatggttatttattatactcttttttcagtttttctgtagattcgagttttcaaaattaaaaattgggggaactgttactgtgtagaaatctgaggtcagcctgatagtcttctcactcacataggtgattcactttctttcaggtagactcagagataaaatttgcataacataagaatcatcactttaaccattttaaaatgtaaaatgcagtgctttttagtatattcacaaggttgtgcaaccatcgcccctaattccagaacattgcatcaccacggggaaaaaaaaacaaaacacctctgtaccacctagaatcactctttattcctttcttgctccattcccagacaacctcgaatctactttctgtctttagggattgcctttttggacattttatataaatggaatcatataacatgtagtcctttgggtctgtctgctttcatttagcacgttttcaaggttcatagcatctatcagtactttattcctttttatggctgaataatattctgttgtgtgtatgtattacatttcgtttatccattcatccactcatggacatttgggttgtttctactttttcatcattatgaataatactgctgtgaacaatcttgtaccagtttttgtgtgaccatatgttttcaatttcttagatatatatggaggaatagaattgttggagcatatggtaactcttcatttaactttttgagaaactgtgaaatgatttttccaaagcacctgtaccattttacgttcccatcagtaatgtaagagggttccaatttctctacaaccttgccaacacttactgcctcccctttttgctatggccatcctagtgtgtatgaagtcttatctcattttgcttttgattttcatctctctaaagactaatgatcttgagcatattcttatatgcttattggccatttctttataacagtatccggatattttgtccatgctttaactggcttgtttttattgttgagttgttagagttcttttacattctggacactagaaccttgtcaggtacctgatttgcaaatattttatcccattctgtgggagaaaattcccccattcttttgttttcttgttagtgtcgtttgatgtactcaagttttagattttgatgaattccagtggatctataatttctcttttgttgcctatgcttttagtgtcaaatttaagaaactgttgcctgatgtaagattgtaaagatttatactttatgctttcttttaggagtcccagcctcctaagtagcggggactacagtcttaaagtttagctcttatatttaggtctttgtccattttgagttaatatttgtatatagtatgatgtagggtgcaaattcaaatgtttgtatgtgaatattcagattccagcaccatttgttgaagatatgttttactattagatggtcttggcacctttgttgaaaataaataggtcatagatgtatgggtttatttctggaatctcaattctttttttttccttttttttttcttcccctgtggactcaattcttttatttcatggatctatatgtctgtgctatgccgttaccacactatgttgattactgtagctttatagtgaattttgacattagaaaatatgagttgtccaagtttgttctttttttcaaggtattttggttatttgtggccccttgtttttctgtcttttaggattatcttatttctgcaagaaaaaaatttggaattttaaaagagattacattggggagtatttccattttagtatatattgagtattctttattcaaggtgcttgggaccaaaagttttgtggattttacatttgtttggattttggaatatttgcatatgcatattgagataacttacagatgggactcaagttgaaacatgaataattttatttatgcttcatatatacctgatacagatagcctgaaggtaattttatacaatgttttaaataattttgtgcatgaaacaaagtttgtacattgaactatcagaaagcaaacctgtcaggtatgaaattttcagtttgtcacatgatgtcagcacctgaaaagttttggagtttggaacattttggatttcagatttgagattaaggatgctaaacctctaatagtaactcttctaatccaataacatggggccttttttttcccatttttttagggtctttaatttctttcaagaatattttgtagttttcagtgttcaagtcttgcacttcctaggttaaatgtaatcctgtttattctttttttttttatcctgatgctgatgtaaatggaattttttaaaattttattttcaaattgttcattgctatatgcaaatgaattttgtatattgatcttgtatcctgaaaatttgctgaattcattaactccagtagtttttttgacaaattctttaggttttttaatatattaagattacattatttggcagggcgtggtggctcacgcctgtaatcccagcactttgggaggccgttgcgggtggatcatgaggtcaagcgtttgagacctgcctggcccacatagtgaaaccccgtctctactaaaaatacaaaaaattagctgggcgtggttgcgggcaccggtaatcccagctactcgggaggctgaggccggagaatcacttgaacctgggaggcggaggttgcagtgagccgagatgacgccactgcactccagcctgggcgacagatcaagactccgtctcaaaaaaaaaaaaattacattgtttatcaatagagatacaggaaattgttttacttttttttttttttttaacccagatgccttttaattctttttgtttagttgtcctggctaggacttccaacattatgttgaacagaaatagagtctttgtcttgttcttgatcttagggttaagtttcgagtctttcagcattaagtatgatgttagctgtggggtttttgtttttatggtgaaagagtattggattttgtcaaatgttttctccgtctattgagataatcatgtggattttttttccctttattaatatagcttgacctcctgtgcccaagtgatcctctcatctcagcctcctaagtagctgggactacaggtgtacactatcatacccagctaactttttaaaaatgtttttgtagagatgcagtctctgtgtttaccaggctggccttgaccttctgggctcaagtgatcctcctgagtagtgggtactacaggtgtgcaccaccatgcccagctaaattgacagttttcatcagtctgtttattttgtctaatgttagtatatccacatcagctcaccagctatcttgtgtattttcctttttttagatggagtctcactatgttgcctaggctagactgtagtggctacttaaaggcacgatcatagtgcaatgcagcctcaaattcctgggctcaagtgaccctcctgccttggcctcccaagtaggtgggactgcaggcatgtaccaccatacccagctaccagctctcttttggttattgtttccatggtctattttttttttccttttccttttaacctatttgtgtctttgaatctaaagtgccttagccaggtgtcatggctgacacctgtaattccagcactttaggaggctgaggtgggtagatcacttgaggccaggagtttgagaccagcctggccaacatggtgaaaccccatctctactaaaaatattttaaaaattagttgggcgttgtggtgtgcacctgtaatgccagctattggggaggctttaggtgggaggatagtctgagccattggagatcaaggctgcagtgagtcgtgatctgattgcatgactgctctccagcctgggtgacagagcaagactgtctcaaaaaaaaaaaaaaatcgcttcttagccttttggctaagatcaagtgtagtatctattcctatcagtttaagtgccttaatttctcttccactttttggacaggtagttttgctggatatagaattcttattagcttttgtctttcagcactttgattatgccactactgccttctagcctttgtggtttctgatgagaaatcagctgttaatcttactgaggatctcttttatgtgagacgttgctgctctcttgctgcttttatgtttctctgttgaccacagtttgactatggtgtatcttggtgtggatttcttttttcattctgttcggagttcgttgagcttcttggatatgtaaattaatgtttttaatcacacttgggaagtttttggccacaatttcttcagatttttttttttatatctaactctcctctccctcttggactcattatgtttattgttggtatacttgatgtgccacagttcttagactctgttcatttttctttattcttctttctttatgtttctcagggacagttttggttgctgtttttcctttataagggccatactttgtttccttacatgctttgtaattttttgttgaaaactggacatattgtggcaatatgtggcaactctagaaagtcagattttcccctcttgccagtgtttgttaccgcttgatgtagttgtttgttttttttagtggtgtttgtttttttttttttttgagacggagctttgctcttgttgcccaggctggagtgcagtggcgtgatcttggctcactgcagcctccacctcctggcttcaagtgagtctcctgcctcagccttccaagtatctgggactacaggcacctgccactgtgcctggctttttgtatttttattagagatggggtttcatcatgttggccaggctggtctcgaactcctgacctcaggtggctgggattacaggtgtgaggcaccatgcccggccctagtgatttttcttatataattttttaaagttggtattgtttgtcatgcatggctgtacaatttctgtcccattagttttagtggtcagctaatgattggacagagatttccttaaattctgtataccaaaaacaaaaaatctgcagagtgttctgtatttgtgttggggcacacctgcaatactcaaccaagaagtttacaacgttgcttcagccttcgctatctgcttgtgcaaaatgcaaagttagggcacatgtagagcttaggggccttctcagctctttcctaagcatatgtactgccctggtcatgggtgtgtctttttagattcccaggtatatgttggaccttttcagagtcctattccccagaaacatctcactccctaacctcttcttccaaacttcttgggtagtctgtttgcaccagttgctttcattgcttcaggcaacagagactaaagcattttcctgtaagtgttttcagcaaacgctactcaggagtagctttagcacaaggtgagttagagttacaaaggtgaaataaagacaagcctctttttttttttttttttttgagatggagtctcgcactgttgcccagtctggagtgcaatggtgtgatctcagcccactgcaacctctgcatcccgggttcaagcgattctcctgcctcagcctcccaagtagctgggattacaggcgcctgccaccacaccctactaatttttgtatttttagtacagacagggtttcaccatgttggtcaggctggtcttgaactcctgacctcaggtgatccacccacctcggcctccccaagtgttgggattacaggcatgagccactgtgcctggccaggacaagccttttgatcaggtcattttagagggtcagatcggcttaagatagtttgtaaatgaggtttattctgctcccacctggacctatgccttaaatatgaactgttattttcaaggctgctactgagtgaggagcaggggataaacagggtaagttaaaatgccagaaagctcactgttcttactgcgtttcacttgttttgaataagttgctgcaagcttttagctagtttacaatgttctgaaaaagttgattctgacaggctttggcaggtttttaaaattgcttttgtggagtaatggacttctggagttcttttctctgccattttcactgacatcactccttgattcactctctctcagttcttgaagtattttctttgtctttgaagtttaagagcttaattcagatgtgttgagttgaatatcttgtattaattttcccagaacatagtgggttatttcagtgctgcacagtcgtggtatggttgtgtgttttcatagtttcttgaagtaagaattattacaaaaacttttgtaatttgggctgtgttttttgggcaaatctgctgatctcgctcgggcttaactcatccagctgtagtcatttgatgtctttactgtggctggtggtctaaaacatccttactcccatatttggagtcttggcactgtctgttagctgagtcttttctttctgcatcattcagctaggctgagcgtctttccatgccataggaacgttctaaaagactgaaagtggaagttgaaggcctctcaagacctttgccatcttctaattgccgctctagcttttcagccacaagtcaggcctttttctttctcacattttaataatcttgtttttcctcccattatgttttcatctttgattgtttcttctttcagtggtattttggtaaaagacagtaagttttgttgctatgagttcatatacactcaatccctaggagctgcacccctgttgatagattgggttggggacacacatacccactgggagaagagagactctggaatgagtgagattatcagcatacttaatattactcctgttatggaggtagccagcaaattttttttaattgatacaataattgtaatgtattcatggggtatgtagtgatgttttgattcatataatgtataatgatcagatcaggataattagcatattcataatttcaaacattgtgggaatgggaatgttcagtgatgggaatgttcagtatccttctagcaatttgaaactctattattgttaagtatagtcatcctacagtggtctagaacttactcctatctagctgtaattttgtattctttcatgaatctctatctttcccttccctctccccttcctggactctagtatcctctgttctgccttctacttctatgaaattaacagtttttttgtttccacatatgagtgagaacatgtgatgtttaattttctgttcctggcttatttcactttacataatgtcctccagttccacccatgttgctgcaaatgacaggatttcattcctttatatggctgagtagtatttcattgtgtatatatatcatattatcctcatctgtttgcttggctttttgttttgtttttttgagacagggtctcgctctgtcgcccatgctagagtgcagtggcgcaatcatagctcactgcagcttcaacctcctgggctcaagtgacccttctgcctcagccccctgagtagctgggcctgtaggcatgcaccaccatgcccgctaattttttgggaattttagtagagatgaggtatcgatatgttgcccagcctggtctgaagcgatccttctgctttggcctcccaaagtgctggattacaggcgtgagccacagtgcctggcctacactcatctgttgttggatacctaggttgattccatatcttggctattgtgaataatgctgtagggttgcaaatttctcttccatataatttcctttcctttggatcagtagtgggattgctggaacatataggtagttttatttgtagttttttgagaaacttctattctgttcttcatagtgggtttactagtttattatctactcacccatgtggcttaaccttatttttgttgccttaggttactatatcaacaactgataggagaaacaataaactcattttcaaagtgaatttgttagaaatggatgataaaatattggttgacttccggctttctaaggtatttttatgttttattgtattctttctatggaaatatttctatatgaatttttttaatggcattatgtttgtatatatgtggcatttgtaaataggttacttgcttttttcgtttaatattatgagcatgtgttttcgttatctatttttcccgaacattgtttttttcaaatgacattttccttattataaaagtttttgccaggcgtggtggctcatgcctgtaatcccagcactttgggagtccgagacgggtggatctcgaggtcaggagtttgagaccagcctggccaacatagtgaaaccccatctttactaaaaatacaaaaaattagccaggcgtggtggcgggtgcctgtaatcccagctacttgggaggctgaagcaggagaatcatttgaacctgggaggcggaggttgcagtgagccgagatgacgccactgcactccagtctgggtgacaatacaagagactctgtctcaaaaaaaagaaatttctgcttttgtgaaaaatgtagataagcaaaaaatgagaaaataaaaataattctaaattttcagtgatcacattaatatttcgaagcattttaatatttttcttaatttatgtcttttaataaaaattatgatttgttacaaatatttcattataatttaatgaacctttaccagttataataattctgtgattgctattttatgcatagatttttttgttcatatttctgatgatttctttagaaatcattgattctaagatgatagtattacagcccttgatatataaaaccaaaataacatttttctctattttctgagagattgtatgtggctctaaagagggttggaggggtagctgctgtgttagagcatttgccgcagtactctttgtattagagatttgctgcaatactgtttttcagatgcttgctacagaattaaattaagatcgtagtataatgaaattcttctcataactaaatctattgattttggtcagtagtgttatgacaacaagacttcagtttagttgtatagtttattgttagtttccaaaccctcactgcctatggaatgtaatgacttaggtccagatataccaacacctgaaacagataggatgccatgtttatctgctctctgagctcagtgcagtaggaacagtgatgggcatgaaaccacatcagaattatttgtgtaacaattttctcttccaggatatttggtcttcataaacagaccgaaaagaaaatggtagctagacatacctaaagatgtttgtctcttgttaccactacaaagagattgattttaggacagaattttgtttttgtttttgttttgacataattttttaatactatttctaatatagggtgatggattggagttcaagagacacttcctgaagattaaagggaagctgattgatattgtgagcagccagaagatttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattctaagatgaaccaataaagacataattcttgtgacttttggacagtagatttatcagtctgtgaagcgaagccagcttcaaaacatatccccaagatttgtacttatattttcaaaagggcctggccagttatataaacctgtttttgaattataatgattaattaaaattgcaagtaggtgttttttccagtgtagttagtaaaatacttgtattttacagtgttgcataaactctagtgcttaactaactttactctaaaaattactgttgaacatcttaaatatttttctatattttctactttcatagccatattttaaccttttcaacttactggtgaccaagcttttaggtgataaagaataaaagagggaagggaagagtaaggaagctataagaaaaatagatctgattctttgttcctttacctgttagacttacaaaaagtttgtttttctaataaaatttgtatcaactttggggcatattaggttgaggccttggctcctgcctgtagtcccagctacttaggaggctgagagaggaggatcgcgtgaacctggaagtttgaggctgtagtgagctatgattgcaccagtgcactccagcttggatgacagagtaagaccctacctctaataaaaatttttaaaattgtaaaacattataaaattaatcagttattttaatctgaagccaagaacatgtagaatgttatgattagagtttatcacatattaatgtatactggcaaattgtgttactggagtatacccataggaggaataaattcaaacctgttttatttatttgaacctatttacggtatgcttaagaattgaatcagtataaattctcaaatatgggagaaattttgttcttgagaattatctgagtcattaatatttttcaaaaacagctctcactgacttgaacctcttctgtaagctctaaccttttacctgctttacatttccacttgaatgtctagtaggcatctcttgaccaaaaacagcttttgattcctgttctccaacctgttcctctcctagttttctccatctcagaaatgttacttcctctgcaaagtctttccctgacttatctaaaataataacctcctctgtttgctgtgggaatttgtatagaatggtgggaaaatttcaagtttcatatttggattagctctgacatttatttatctgaacactggtaattgcctcagtaaagacactgataataagtaccttttagagttattttaatctttaatgctttaatgtgtaggaagagtatagtgtcctgttttgcacagaaaggcattctgtaaataataagttgccttaattttcctgtaatgttcattatattgttgtgggaaggtatttactcctattattaaaaataaaaatgtgtaaaatttactacctgaa

SEQ ID NO: 1628 - DNA, 32012 bp, Homo sapiens; identical to SEQ ID NO: 1627

SEQ ID NO: 1629 - DNA, 32012 bp, Homo sapiens; identical to SEQ ID NO: 1627

SEQ ID NO: 1630 - DNA, 30919 bp, Homo sapiens
aagaaccccaaggaagagtcccagcccttcctttcgcctctgggggcagtttggccccgccccggcctttgggacgggtggggctgtggatggggatgggaattggaattgagcaattgggaggaggcgctgccgcaggcgttttctgccccataccgctccctatatcctcttcctctcttccccagacccccacctctccctcctccttccccagtcgttcgccggaaagcatttgtctcccacctcttcataacaacaattaatttcctctggggcctgaggagggcagaatttcaaccttcggtgtgcttgggagtggcgattgtgatttacacgacaaaatggtcaggtttagaatagttgttcgtggttgaaagacttggataaatgtggatgagatagaaggggaaggcaagagctgttaattttcgtgggcaatcctggggagaggcggggctcagtggcttcactggtgatcttacactctacatcttttctggattcctgccttttacagccgaggtgctcggtggagtcatggcagtgccctttgtggaagactgggacttggtgcaaaccctgggagaaggtgcctatggagagtgagttcttttaagcttgccttcgttttctgagtgcatattcattgttttggagtctcacactctggtgatttagaaagtagatgtttgagatccaagggttttggcaactgaagttacacagccttttgctaggattaaaaattttttccttccctttaaaaaaaaaagttttctttgtagagagctggaagggacacgaagttattgtttccatgcccacaaatggcttctcagggtttaagcattgcggttaatgagcaaatgagcagactctggagattgcctgcctggtttcagatccttgctctatcacatactggtcattgttttgtgatcttaggcaagcttcttaatgtcattgtgtacctctccttcactacctttagggtggcaataatcgcatctaccccataggagcttaggacagtcagttacacaagcacatatagtatgggattaatgctcttaaaagtatatgagtagaacatgtatatatgtgatgtggcttagaattatctcaatctattttatgaagcgtttattaaatgacttgtgtgacagcataatgacgtctttggagggttagctattgtatttcacattttagaaaagagtagtgtgtgttgagaacatagcagaaaccacttccttggtttctcctttgtggaaaaagtaatagaggtaaaatcgttttggatgagtcatgtttaatctttggaagttttagaagaaatggaattctgtaatgttaaaactcttttcctttttagagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaataggtatggaagaaatttaagataattattttaaacaagtttttaaatttgttttttaaatcttgggcatgctatttggtcgttgtcctttcaaaattgctcatgcaactgtgaaattggaatacattatctttaaaaaatttttccacctggtgttaataacataaaagcatatatagagtcaatgaaagaaaacttctttcccaagttatataagtgattttgatttaagattggtgtcttacagaatttaagagtgacaaacaagttttatggtacatcataaatgcagtgtatcctaaatgcaatgtattgcctacacaattttttctttgtagacattctagttacatgaaatcattgtatacattttatacatttacagatctaaaatagcatgctgtttcctcttggtttacatgaaataattgagaattttctaggattgctttttgtatattaagtaaattctatgtttgctattaatacttaaatattcgatgtagaatcaaaggattgatatttcagaacactgagaagtacataaaatctggatctaaatttataatttaaatttataatttaaagctattgtattaaataagtttatcagttaaaaactgataaagaggtattaggatctccagtgtgactcaggagagagttgagggtaaaagaaatggagttaatgagagagatcaaaatataaaaagataactgataaaagaactttcataataaaactgtttcacgaaggacctcacaggcatttgtggttttgtactgtgagactatatgaagtttaaatctgagccaggtgtggtggtacatgcctgcaatcctagctacttaggaggcaggaggattgcttgagctcaagagttccaggttacagtaagttatgatctcacgccagggcactccagcctgggtgaaagaacaagaccgtatctctaaaaaaagttaaattataaaagaagtataatctgtaaaatatttagtgaaattggcttagatttgcccagacttcccctttggcattatatttcaggaatgagaaaaataattagcatagcatttagaagaaatggggggaatttcaaggttactaaataaatcagggttagtataagaggaagcagaggctttgaagtcatggcttgcattcttgatttggatattggttttctctttataatttttctgtgatgacgccttttgccacctaacacaggtaaatgtgagttaagccccatatgtgttagtggactcctgaatcttttgttggcatttgcttctgtttgcctaagcacatttgtaaatgtctaagcttcaaattaagaagctatgtggttgctacctgattatatttagtcaataaacttactttcatatttgttttagagccagacataggcatgcctgaaccagatgctcagagattcttccatcaactcatggcaggggtggtaggtatagttgtctatttcccttttacttaaaattagagtgaatacattacattaccaaattctagtgtgtttctctctgcatccctcttaggtttatctgcatggtattggaataactcacagggatattaaaccagaaaatcttctgttggatgaaaggggtaagtttagcattttatcactacctaaaataaaataaaataattacctaaattattttaattacctaattattttaatatagccatacaaggcaaaatcaagtctttttgcattactggaatttcaagacaagatctgaaaaatcaaggaaattttggagacttcgtatatttggaaatcacaagtctcattttgcaatacaagtgcggatcaggtagagaaatctgacctaggtgcaagcctagctcactatatgtataagaataatttttttttttttgatacaggctcactgtgttgtccagtctggggtgcactgtattatcacagttcactgcagccttgacctcctaggctcaagcaatcctaccatctcagcttcccgagtagctaggaccaaccacaggcaggtgccaccatgcctggctaatttttgattttttgaagaggtggagtcttcctgtgttgctcaggctagtcttgaactcctggactcaagcagtttaccagccttagcctcccagagtgttgggattatagacgtgagccaccatgcctggccaagaatagtttaaaataatcctttaatggattaataaagggaagttcctgtggaataccctggaccttagtcttgtcctgttcactctttttttatgtatgacgtggataaaaatgtaagaaatttagttatattttctgaatgtcatcaaattgagaaggatggatagcgaaagctttaagcttacagggtcagaatcaaaaaagaaatgtcagctgtatgaggcagtagtttttgtctggtttaatgctttattcttagtattagaatagtgcttaacaaatggtcagcttttttttttttttgaaacagagtcttgctgtgttgcccaggctggagtgtagtgacatgatctcggctcactgtaacctctacctctctggttcaggtgattcttgtgccttaggcccctgagtagctgggattacaagcctgagtcaccacacctggctcatttttatatttttagtagagatggggttttgtcatattggccaggctggtctcgagctcctggcctcaagtgatctgcctcccttggcctcccagagtgctgggattataggtgtgagccgctgtacccagcctatacatgcttttttcttatgtgcatatggattttactttttacccctttaaactgagtttatatgacataaaaatctttatttttatttaaaactttaaaaattcaggtacacaaaaattcttatgtattataatgaaatgtaaatatatgtatatcaacccacctggtttaaaaatacaacattattcgtatataagaatgctcacagtggtgatgtttttaatatagcaggaaactaacccaaatgtctgtcaacaataaattatgaaatgcatggcttttcaagccatgtcacaagcagtgacacaagcatgtcacaagcagtgacatggatgaatttcaggtatataatgatgtagagcaaaaagagacagttgcaaaagaattcatatggtctgattctgtttatacaaagttcaaaaatatgtaaaacctagtatattgttcaagtatgtaaacatggagaaaaaaacatgcagaaaagcaagggtataataaaaccaaattcagaatggtctaagaaagtaggggagggaatgtatttaaggaagtatttaaagatttcaaaggaaatagagcattgtttttctaaagtgagtgggtgtttattacattgttattctttatatcttgtattaatatacaagatataattctttgtttctatttaatatttaggagtcttttaaaaaaagaaataaaatgttaccagtatttaatgtcctcctgtttatttcatcacaaatatattcttcctttgtttttctaagagctaaacacattcctacatttaaattttattatgtgcagttctctaacatagctgagtattatgttgcagacataacaaagtccaaggaatactatagttatccattagtattttaagtgattactactcataagtaatttgaaactcaatctcagtggtttgtccaatagtgtcatatttaactactgaaaagataatcaactgggtgcagtagctcatgcctgtaatcccagaggctgaggtgggacgattgagtgattctaggagtttgagaccagcctagacaacatagaccctgtctttatgaaaaattaaaaaaaaaaattagctagacatggtggtgcacacctggagtcccagctacttggaaggctgaagcaggaggattgatcacttcagcctaggaggtcaaggctgcagtaagctgtgatcacatcactacactctagtctgggcagcagagtgagacactttctcaaaaaaaaaaaaaaaaaaaaaaaaaaagggtaatcacagtagctacctcctaagtcagatagaggtaaacatttcattggtttacatattgtgtgaatgtacttgatttttaaagaaatcagtcccctattttgagacatttaagttgtttctaacttataaaataggacagtgatggcttctatcaatttgtgtaaaaggccaatataaaaattgcgtcatgctataatattttttatgctataatattttttatgccattagcctttttgtcccacttacacactatttcatgttagtatgtatagatataccttgttgattgttttcaaaacctacctccacattttccattgtacaaatttggacatttatttacaaataatattgctatgaatattcttatgtttatgaatttgtgggattatttctatggatatagaagtgggaattgctagttcaaagagtgaatgtttcacagtttagtatgttttgccaaattgccctctgataatagagggccttttctaactcttaagactgggttacattcctttgctctaagatcctatagtgctctatatttttataaccttcataacagttttctattgtcagtcttcactaatttatctattacctgcattggctggcatagtgtctgtcactaagttacagtagatattcactaaacataagttaagtcctgcctgcagtttttgtgtgttgaagatgggaagttagggtggaagttgggtcttctgatattttttttttgtacagagtttgtcctctttttctcagactctctactttgaagaaaaaaattactgtggtttgttgaattttggtgtgtcttcacatattttcttctgccaactgggtttgtttgctgctgagaaagttgtgcctaacatactactgatgtttccttcctgccctccaccctacctgatgaggggccttgctttactttcatctcaggtttagagtgctcttttccagaagggcagccccttctgactccagcctctttctttaatctggtccagactgttctgtgtgttgataatacttcttttaagttaatagaagaggtgaggcctttttctacttttagcatagatgatgatttattttatttttttaaatttctttttgtctattttgcttattttaagagaagttctacaaaccttaagtaacaccagtgattttttttcagtaaaacttaattcctgtaagtatatctatttgcaaaacatttttattcagtgtcatctttttttcttttggtttagataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggaggtaagagctatttaatcatggtaaaactcctataaaaagtcagattagttatactgaaataaatgaaataaaccaaggaattcatgtttatataatagtttttgttttcttttttaagagacagggtctcactcttggccagactggagtacagtgagctgttatagctcactgcagcctcaaacttctaggctcaagcaatcctctggcctcactcttccaagtagctaggaccagtggtgcctgccacaagacatctggctaagttttaaaaattcattgtagagatgggatcttgctgtgttgtccaggctggtcttaaacacctggtctcaagcaagccttctgtcttggtctccaaactgttaggattaaagtaaagacatgagccatggtacccagcttttatagtagtattttaatagtgtcttgatcggtttggtaactgctgtaacaaagtatcatagactgcatagcttataaacagcaaatttatttctcacagttctggaggctgaaaatatgagattaggggtgccaacctggtcatgttttagtgagggccctcttcctgatttgcagatggctgtcttgctgtgctctctcatggtggacagccaagagagcagaagcaagctctattgtggtttttttttttttttttagaccagagtcttgctctgtcacccacgctggagtacagtgatgtgatctcagctcactgcaacctctgcctcccaggttctagcaattctgtcccaggctcccaagtagctgggattacaggcatgcatcatcacacccggctaatttttgtattttgagtagagacagggtttcaccatgttggccagactggtctcaaactcctgacctcaagtgatcccccaacctcagcctcccaaagtgctgttttttgggttttttgttaaatgaccagatgttgtgagatattgtgtctgttttttgtttttttgtggttttttttgagacagggtctcactctattgcccaggctggagtgcagtggcacaattcaaggctcactgcagccttgagctcccaggctcaagcgatcctcctgcctcagtctcctcagtatctgggtctacaggcgtgcaccaccacacctggctaatttgttgtgggttttttttcacagacggtctctccatgttacgtaggctggtcttaaactcctgggctcaagtaatctgcctacctaagcctcccaaagtgctgggattatataattagtgccctataaagatacaatattgtccgggcacacaagcccttattagacattaataagctcttaataagagcactaataccattttttgagtggtcccatcaccaggacctaattacgtctcaaaggccccacctccgaatgccattgcattatgagttaggatatcaacatgacttttgagggggatacaaatatttagcacattgcaaatagtaacttatttataatcccaaagattttttaagctaaggcatgcatagttattaaatatcacaacacttatctctcctgtgtatcatgtaaacatttgtgaaaacaagactagggcaagaaatgattcatctgttttttggtttttttttttttgagacaaagtcttgctctgtcgcccaggctgcagtgcagcagtgtgatcttggctcactgcagtcttgacctcttgggttcaagtgatcctctcactttagcctcctgaggagccaggactacagatgcacaccatcacgcccagctaattttatttattttttgtagagatggggtctcactatgttgcccaggctggtcttgaactcctgggctcaagcagtccttctgcctcagcctcccaaagtgctgtgattacaggcctgagctgccatgcctatcctgattcatctatctttgaagtgcctctaaagtttccaagttgggattcttagtgtgaaaaccatattgaattaattcaaaggaaacttttcatggatttatattattatttttccttgaaatctttataataagaacatttaaaaaaactgggacttgctttgtttttagaattgccatgggaccaacccagtgacagctgtcaggagtattctgactggaaagaaaaaaaaacatacctcaacccttggaaaaaaatcgattctgctcctctaggtaactgaattatcttgagtgaaagagtaccgatttcttggatatgaagtcttgtgctatttgaattttttcttacttttttttttgttttaaacttacaaataattcatgttcgttgtagataaaatagtaactataagtaaaaaattaaggaaaaaataactctttagtcccagaactctgcaatagatttttaaaaatattttggggagtgtatattcagagcaacttgaatctgctcttagatggctttttacttaaagttttcatatgtgctatactttgttgcaaatacactcgtttgttgcttaattatagggatgcactctaacaaatgtttcattaggtggtttcatcattgtgtgaacatcatagagtatatttacataaatctagatagtatagcttactataaatctaggctatttggtataccctattgatctcaggctgcaaacctgtacagcatgttactatactgagcactgtaaggaattgtaacataatggtatttgtgtatctaagtatagaaaaagtatagtaaaaatacagtattataatctaatgggactgtctgttatacgtgtggtccattcctgactgaaacatcattaatgtggcccataagtatgtaaaatgaatatatgtatattatttatatgtgtttttatacaaaatgagatcacactaataatattttgtaactgtttttggttttagtgcgcagcgaacattcttccatgactataattgtaggtctacatcgttggtttaaaggctgtgataatattctgccatgtggatatgccttactttactcttttaatcactttgttggagatttttctaaattttcacagatacaaaagagatataagtatctgtgtaacttaatcatgacacatacccttaaattgttcattgaaatccccagaagcaaaattgcaggatcaaggatgtagtttttattattatggcttattttgtcaaattgcttcccgaaagttcgaaccatttcatcacagtctcatcaatttacattaaggaaaaaaactttaaataatagtttttcatttttattttaaatttaatactaatgaagttgtataccctttatgtatgtattagttttttgtctattttgctcatttttgtcaaggatattgtttttcttaccactttgaagcttttttttttccttgataacacattgacctttgcacttgttacaaatacttttcacaatttatcatttattttcattttgttttgctatattgacattcaaatctattatcttgtcctttgtggtccctgactataatttctttggaaaggtcttctacctctactatttaaaagttccctatgttttcatttagtgtttttatggcttcatttttccatttaaatctttggtccattaggaaataatcttcacataggaagatacgtgaattttttctcaagaaaattaagataccttaggatggttagttagattactgtctcttaaaaagttattggtaagtaaatgttcattataaaactgtgtgaataaggaggtcacgtgagaacatgacattgaagtaatgaaattcggtattgaaaatggataagaggggtttctgtatctttttgttaatctcgtcacatgaggagaaacatttccatctggctcttgttctcagttgcaaacaattgagaatcagatcagggaagactactccaagatacagcagcagagaaaaactgcatgaaattaaagcagtaatttagtagctttaattctttctcttccccaggaataatatttagacataagtaggctaacagaaaatgtgtttcttacctcaagccataggcttctctaacatgattctttcgtgaatgttgtcgtaatgtttgtttttagctctgctgcataaaatcttagttgagaatccatcagcaagaattaccattccagacatcaaaaaagatagatggtacaacaaacccctcaagaaaggtaatatccttaaactacaagtttgtttgtttttctgtggaagaaaaggtaattgcaaagttattatcacaagtcaacaacacatgatagctatgatctctgtcctcatggagattataatgtccagtagaaaaaaatacagaaataattttgtttattaataattataaaggggaaagtcagggtactatagctaagtgtttgaccaagtctaagggacagggaagacttttcttcctgaagaaattacattaaatctaagatttgaagattaaagggaagctaggcaggcaaagtaagtggcagatttgattctgaacaggggaagcagtatttgaaaaatcttagattttagaaagtctgatgcttttgagaaacttgaaagatcagtatggcacaagccgtgtctgttgtgttcatcattgtatcatcagtgctttagcacagtatatggtgcaccataggcactcattaaatatttgttgagtgagtgaacagggaagtgggagaggaagacaggtttgagatgaggccagagaggtcgctagtggccaatttgtggaagaagaccttgtaagccatgttaaggattttgggctttaacttaagaccactggggagacctctgagagattttaagcaagactatgacatagtcatatcttcggtttaaaaatatttctctgacttccttattttttttccattgttttttatgaatagggaaagattcagggtgctgtaggtttttctgctagttgtctagaagtgggaggctggtggcttggaataggttagggcaatggtattggagaaatgagatgattccaaagaaatttaagaactagtattgataggactgttaggctgtgaatggaaggagagaggacaatgactagagatgatgaatgaaaaacattcagagagttattaatgtttaactctgtcctcatggatagaaaagagttaatgtttaaacattcactcttctttaatacctctctgcatgtttcttcctccttgtcctaacttaaagtccaattctcccctgaggacactgcttcctctgaagcggtaggtgttttctttcccataccctcatgtcctttgatctggacatggtacaggtgtcctccttattcttcattgtcactttctcccatcttcctttatgtctctcccctctaacttttgaaccccaaattaaaatttctgccgtactatcacagtctgcaaaatgactcttgatgttattttcgtcatgattcttggtgatttaaatatttatttggatcatcctcctgatatcctgacttcactgtttcttgaccctctctcctatagtgatgttgtctttgaacacgctgcactgatcaccagtataattttttctgacttcctcccttaatattctaacttaaacagtcctttgtatctggacttgcaattaattaattctatctcttcagtctcttacctgctccctctctaggtccttgatttcatctttacctatcttaaatctttaggttagtcattataaatgactgctttgcgttcatcatcttcaatttccttgtccccttctctcttcatcatacttagtgggtaaaacccagtaagtagtttctgggtttaatctagtagttttctacgtactgcacacttgtacctgcacaacagattgcagcaggagaaaaatacccaaaaatgttcactttaaattcaggattactaatctcaagtgggcccttaatgcttcctggcatttggccttcgtttccccacatctttctctgtcctgttctcctaaatcacgtttttataatacttttctcttttttttttttttttttttgagacagggtctaggctggagtgcagtggcgccatctccactcacttcaacctctgcctctcaggttcaagcgattcgattctcgtgccttagccacccgagtagctgggattacaggtgtgaaccaccacacctggctaatttttatatttttagtagaggttttgccatgctggccaggctggtctcaaactcctagcctcaagtgatccccctgcctcagcctcccaaagtgctgggtttataggtgtgagctactgtgtctggtcccttaacttttattatcttctctccatcctcactctcagttgttcactttgcttcctgtgtcactgggaaatgaaagccacaagagaacttaggcaagctcccaccaccatctcctccatactaactgcctctatgctcatgtattctctttcatcctgtattgctgtagataaattgctctggatgtaagccaggtctttctcttacccactcaatgactttgtctagcaatttttctccctctcctacattattaatttttccttctctaccggatctttctcatcagcatatctacatgctttttctcccattttaaaatcaaatcataatggtaataaaatttctcttaactccacttttccctaccattccatcttcttcacaattgaatattcctaaaattgcttctcatctctaacacctcaaaactagttttcaatttcatctattttgttgccaagagtcacagtgatttttggaacgtgttgccaagttcaatgtaatagtccactgtggtcaaccgaggtctgaaaagattaaatggaaagtaccagaagtaaacaattcatcaattcatgggttttggccgggcgcggtggctcacgcctgtaatcccagcactttgggaggccaaggcgggcggatcacgaggtcaggagatcgagaccatcctggctaacacggtgtcaccccgtctctactaaaaatacaaaaaattagccgggcgaggtggcggtcgcctgtagtcccagctactcgggaggctgaggcaagagaatggcgtgaaccccggggggcggagcttgcagtgagccgagatcgcaccactgcactccagcctgggcaacagcgagactccgtctcaaaaaaaaaaaaaaagaaattcatgggttttatttatttatttaattcgagacgggatctcgctctgtcgcccagactggagtgcagtggcgtggtctccacttactgaaacctctacctcctgagcttaaatgatcctcccatctcagcttcccgagtagctgggactacaggtgtgagccactatgcccggctaatttttgtatttttggtagagatgaggtttcgccatgttgcctatgcttttctaccaaaaatacaaaaattagccaggtgtggtggttcacgcctgtaatcccagctgttctcaaactgctgggcttaagcaatccacccaccccggcctcccaaagtactgggattataggcatgagccacaatgccctgccataggttttaaattgtgtgctgttctgagtagcataataaaatcttgtgctgtcctacttcatctcacttgggatgtgaatcactcctttttccagtgtattcacgttccatgtgctacctgcttgtaactcccttagtagctgttttggttattagatcgaaagaacatatatagggtttggtaccatttgtactttcaggcatccacttgaacatatccctctgtggataaggggggtactactgtagtcagttctcagacctcttgttttatctcatcaatattttatacagttgatcatgccctcctcctttaaacactttcttcatttggcttccaggcgttacactcttctgattttcgtccttctcactggtcgctcttttcagtctcttgatggttttttttcatctgctcagcctcctactattggagttctccagggctgaatctatggatctcctttgttttcttctccacactcactccattagtgatattacttggtttcatggctctaaataaaactatatgttgatagtcacatttatatcaacctagacctttcctctgaattccaaacttacatgtcttaactgccttctgaaatttcacttgaatgttaagaggcatctcacacttgatgaattccaaactgagttactgatcttttcctttcaaacccattccttttcaaagtctttcccatgttggttaatggcaactgcattattcttattatgcagatcagaaactttggaatcatccttcatttttctcattctcttttacttcacatccagtacaccagctaattctgttaacctctatctttaaaaaaatcttagaatctgattaccttttttttttttacctctactgttaccctatcattccaaattaccatgatatctttccaaaatgttctgatttaaaagtgaattagaatatatcactattctacccaaatcctccaatgctttagttctcacgtgtagtgtaagctaaaatcagttcatgacctgtgagttcttacacaattttgttccttacattacctctccaacctcagttctgctttgctcccccttggtcatattgttgttcttcttattgttctccaagtgctctaggcacacttctacctcactgtttttgtagtgactgttcctatgtctgaaaatgctttttcccatgggacttatttgcatgtcttattctcttactttctttggatattgacttcagtgtcatctttccaataagcctttcctggccatgctatttaaaatggtatcctcttccctctaacacatttcttaaatttttaaaatttttactctcttgtggacatacgcaatccaacacgtttcttcattttattttccttcagtgtacttaccaccatttagcttactgatttttaactgtatttgtatttattttatgttattttgtctctcctcagtagaatgtaggatttaaaaggtcaagagttttttttctattttgctcactgctgaatacctgatacctagaataatgcctggcacagagtagacctaataaaatatctgaatgaatggattaataaataaaaagcaggtttaaaaaaaaacttgagcatgtttaaaaagaaacaaacttaagcatgtttaagtggtttgggtacggatcctgtagagaggaagaggctgacagtctaagagaaaggaaataaataacagaggatcaagatccctaaggaggtagaagggtatgggctccagagcacaagtagagagatgaacatttgatgggagaatggaagggatgaaaagatgtataataatacaaataacttagctttggtagggataagttgatgtagtttctgtctaatggctttattttttctctgaaatgggaggtggtagtataggtactggatggtagtcttgggaattacagaaaagtgtagttttgaaatgatccttgtggagaaaaggaaaggaaactagagaaacaaatattatctggcaatattgaggtttagctagggattgtaaccataaatttacagtggcgtcattttccatataatattcttctttataaagcttttccaaggaatcaaagaatgttggctatagcagattcataatgtttattgctattatcataaattattttttattttaaaaagttctagtcctttagccaggtctgttgtcttcatagaacattgttctgttacccataaaagatgccattaagactgtggcctgggccgggcgcagtggctcacgcctgtaatcccagcactttgggaggccgaggcgggtggatcacgaggtcaggagatcaacaccatcctggctaacatggtgaaaccccatctctcctaaaaatacaaaaaaaaaaaaaaaaaaaattagctgggcgtggtggcgggtgcctgtagtcccagctactcagggggctgaggcaggagaatggcgtgaaccctggagacagagcttgtagtgagccaagatcgcgccactgcactccagcctgggtgacagagcgagactccgtctcaaaaaaagaaaaaaaaaaagattgtggtctgagcatactccacactttgaacatgtctacagatcatacttaggtattgtaaaatacctaatttgacaaatgagttttagtaattttataacttggccatattttttataaaatcatataggaagactttgttttatatcttacaaaaattttgtgttaaataaatagatttagacatagttttacttcttcaagttgccagttgggttaatttaaaaacatacttgcatagaagacttgaaagcatttgtatttgttttcttttttaggggcaaaaaggccccgagtcacttcaggtggtgtgtcagagtctcccagtggattttctaagcacattcaatccaatttggacttctctccagtaaacagtgcttctaggtaagactgataaagattgagtagtttttgattgtagtattccccatgaagaataatacatgtatgtgttttttcataataatcgacattaacataatactgtaagcatgagaacttgtgtgtgatataagaaaggcctgatagattttattttattaaatgtatgtttctttctgtcttaatgcctcagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacaggtgagggaatttaattttttaaaagtaatggcagctctttattttttattgtcttaaagtccttttttaatgtgtaaatcttagatatataacttttaaatcacatgtattcttttttggtcaaggaagaaagagaggagggaggccttcatgcaaaataattttaagtcagactaaatagctatgatattactgtctttagtcctaatggatttattcatttgtcttctgtttgacatgtagaacccctggcagcggttggtcaaaagaatgacacgattctttaccaaattggatgcagacaaatcttatcaatgcctgaaagagacttgtgagaagttgggctatcaatggaagaaaagttgtatgaatcaggtgtgtttcattgattttcattataccttttcctgaagaagaatttaaatatttgagtaaaagctatcattagtatattttttaaatataggctgtggctcacacctgtaatcccagctttttgggaggctggggtgggcggatcacctgaggtcaggggttcgagaccagcctggccaacatggtaagaccctgtctctactaaaagcacaaaaattagccggcctggtggtgcatggctgtaatcccagcttctcgggaggctgaggcacgagaattgcttgaacctggaagacggaagttgcagtgagccgagatcctgccagtgcactcctgcgtggccaacagagtgagactgtctcaaagaaaaccaaacaaacataaaaatacaaagtaattagttaatttgaaaaagaaactatttaagtaaaatgttctttactttaagaaataatacttttttttattttgttttattttttaatttttaatttttagccactgtgcctggcctaagaaataatatttcttaaaagacctttttattgttattaaaaatagtagggagctggaatcattatctttgtaaaaactatgtatacttaaactgtagacaataacagttgactgcctactatgaaagacgaatacattagcaatcccacactttctcccatctcccttgattgcacccgtcaatttttattgtttatattattagagcatagttataacattggtattctaaactgtctttaaggcttttcaaaaaaaatgttaatgtcaatgaaagacaaatagggtagctgttttttactcaaggagactaaagaggcctgataactaagtgcaagtgcaatgcatgatctttcactagatcatgtatttgaaaaaaactataacggacattattggaacaattggggaaatttgaatatggactgtatattaattaggtaatgtttttgtatcagcgtcagatttcttgggtgtgataatactgtggtttgtaggagaatgcccttgttcaaaggagaacaagtgtcaaagcaaagttgaagtgaagtgatattttcattcagcttaaaatttaaaaaaataaagggcaaacaactacataaaggccaataaacacacacatatctggtagataaggccaatgaagagtatatggttatttattatactcttttttcagtttttctgtagattcgagttttcaaaattaaaaattgggggaactgttactgtgtagaaatctgaggtcagcctgatagtcttctcactcacataggtgattcactttctttcaggtagactcagagataaaatttgcataacataagaatcatcactttaaccattttaaaatgtaaaatgcagtgctttttagtatattcacaaggttgtgcaaccatcgcccctaattccagaacattgcatcaccacggggaaaaaaaaacaaaacacctctgtaccacctagaatcactctttattcctttcttgctccattcccagacaacctcgaatctactttctgtctttagggattgcctttttggacattttatataaatggaatcatataacatgtagtcctttgggtctgtctgctttcatttagcacgttttcaaggttcatagcatctatcagtactttattcctttttatggctgaataatattctgttgtgtgtatgtattacatttcgtttatccattcatccactcatggacatttgggttgtttctactttttcatcattatgaataatactgctgtgaacaatcttgtaccagtttttgtgtgaccatatgttttcaatttcttagatatatatggaggaatagaattgttggagcatatggtaactcttcatttaactttttgagaaactgtgaaatgatttttccaaagcacctgtaccattttacgttcccatcagtaatgtaagagggttccaatttctctacaaccttgccaacacttactgcctcccctttttgctatggccatcctagtgtgtatgaagtcttatctcattttgcttttgattttcatctctctaaagactaatgatcttgagcatattcttatatgcttattggccatttctttataacagtatccggatattttgtccatgctttaactggcttgtttttattgttgagttgttagagttcttttacattctggacactagaaccttgtcaggtacctgatttgcaaatattttatcccattctgtgggagaaaattcccccattcttttgttttcttgttagtgtcgtttgatgtactcaagttttagattttgatgaattccagtggatctataatttctcttttgttgcctatgcttttagtgtcaaatttaagaaactgttgcctgatgtaagattgtaaagatttatactttatgctttcttttaggagtcccagcctcctaagtagcggggactacagtcttaaagtttagctcttatatttaggtctttgtccattttgagttaatatttgtatatagtatgatgtagggtgcaaattcaaatgtttgtatgtgaatattcagattccagcaccatttgttgaagatatgttttactattagatggtcttggcacctttgttgaaaataaataggtcatagatgtatgggtttatttctggaatctcaattctttttttttccttttttttttcttcccctgtggactcaattcttttatttcatggatctatatgtctgtgctatgccgttaccacactatgttgattactgtagctttatagtgaattttgacattagaaaatatgagttgtccaagtttgttctttttttcaaggtattttggttatttgtggccccttgtttttctgtcttttaggattatcttatttctgcaagaaaaaaatttggaattttaaaagagattacattggggagtatttccattttagtatatattgagtattctttattcaaggtgcttgggaccaaaagttttgtggattttacatttgtttggattttggaatatttgcatatgcatattgagataacttacagatgggactcaagttgaaacatgaataattttatttatgcttcatatatacctgatacagatagcctgaaggtaattttatacaatgttttaaataattttgtgcatgaaacaaagtttgtacattgaactatcagaaagcaaacctgtcaggtatgaaattttcagtttgtcacatgatgtcagcacctgaaaagttttggagtttggaacattttggatttcagatttgagattaaggatgctaaacctctaatagtaactcttctaatccaataacatggggccttttttttcccatttttttagggtctttaatttctttcaagaatattttgtagttttcagtgttcaagtcttgcacttcctaggttaaatgtaatcctgtttattctttttttttttatcctgatgctgatgtaaatggaattttttaaaattttattttcaaattgttcattgctatatgcaaatgaattttgtatattgatcttgtatcctgaaaatttgctgaattcattaactccagtagtttttttgacaaattctttaggttttttaatatattaagattacattatttggcagggcgtggtggctcacgcctgtaatcccagcactttgggaggccgttgcgggtggatcatgaggtcaagcgtttgagacctgcctggcccacatagtgaaaccccgtctctactaaaaatacaaaaaattagctgggcgtggttgcgggcaccggtaatcccagctactcgggaggctgaggccggagaatcacttgaacctgggaggcggaggttgcagtgagccgagatgacgccactgcactccagcctgggcgacagatcaagactccgtctcaaaaaaaaaaaaattacattgtttatcaatagagatacaggaaattgttttacttttttttttttttttaacccagatgccttttaattctttttgtttagttgtcctggctaggacttccaacattatgttgaacagaaatagagtctttgtcttgttcttgatcttagggttaagtttcgagtctttcagcattaagtatgatgttagctgtggggtttttgtttttatggtgaaagagtattggattttgtcaaatgttttctccgtctattgagataatcatgtggattttttttccctttattaatatagcttgacctcctgtgcccaagtgatcctctcatctcagcctcctaagtagctgggactacaggtgtacactatcatacccagctaactttttaaaaatgtttttgtagagatgcagtctctgtgtttaccaggctggccttgaccttctgggctcaagtgatcctcctgagtagtgggtactacaggtgtgcaccaccatgcccagctaaattgacagttttcatcagtctgtttattttgtctaatgttagtatatccacatcagctcaccagctatcttgtgtattttcctttttttagatggagtctcactatgttgcctaggctagactgtagtggctacttaaaggcacgatcatagtgcaatgcagcctcaaattcctgggctcaagtgaccctcctgccttggcctcccaagtaggtgggactgcaggcatgtaccaccatacccagctaccagctctcttttggttattgtttccatggtctattttttttttccttttccttttaacctatttgtgtctttgaatctaaagtgccttagccaggtgtcatggctgacacctgtaattccagcactttaggaggctgaggtgggtagatcacttgaggccaggagtttgagaccagcctggccaacatggtgaaaccccatctctactaaaaatattttaaaaattagttgggcgttgtggtgtgcacctgtaatgccagctattggggaggctttaggtgggaggatagtctgagccattggagatcaaggctgcagtgagtcgtgatctgattgcatgactgctctccagcctgggtgacagagcaagactgtctcaaaaaaaaaaaaaaatcgcttcttagccttttggctaagatcaagtgtagtatctattcctatcagtttaagtgccttaatttctcttccactttttggacaggtagttttgctggatatagaattcttattagcttttgtctttcagcactttgattatgccactactgccttctagcctttgtggtttctgatgagaaatcagctgttaatcttactgaggatctcttttatgtgagacgttgctgctctcttgctgcttttatgtttctctgttgaccacagtttgactatggtgtatcttggtgtggatttcttttttcattctgttcggagttcgttgagcttcttggatatgtaaattaatgtttttaatcacacttgggaagtttttggccacaatttcttcagatttttttttttatatctaactctcctctccctcttggactcattatgtttattgttggtatacttgatgtgccacagttcttagactctgttcatttttctttattcttctttctttatgtttctcagggacagttttggttgctgtttttcctttataagggccatactttgtttccttacatgctttgtaattttttgttgaaaactggacatattgtggcaatatgtggcaactctagaaagtcagattttcccctcttgccagtgtttgttaccgcttgatgtagttgtttgttttttttagtggtgtttgtttttttttttttttgagacggagctttgctcttgttgcccaggctggagtgcagtggcgtgatcttggctcactgcagcctccacctcctggcttcaagtgagtctcctgcctcagccttccaagtatctgggactacaggcacctgccactgtgcctggctttttgtatttttattagagatggggtttcatcatgttggccaggctggtctcgaactcctgacctcaggtggctgggattacaggtgtgaggcaccatgcccggccctagtgatttttcttatataattttttaaagttggtattgtttgtcatgcatggctgtacaatttctgtcccattagttttagtggtcagctaatgattggacagagatttccttaaattctgtataccaaaaacaaaaaatctgcagagtgttctgtatttgtgttggggcacacctgcaatactcaaccaagaagtttacaacgttgcttcagccttcgctatctgcttgtgcaaaatgcaaagttagggcacatgtagagcttaggggccttctcagctctttcctaagcatatgtactgccctggtcatgggtgtgtctttttagattcccaggtatatgttggaccttttcagagtcctattccccagaaacatctcactccctaacctcttcttccaaacttcttgggtagtctgtttgcaccagttgctttcattgcttcaggcaacagagactaaagcattttcctgtaagtgttttcagcaaacgctactcaggagtagctttagcacaaggtgagttagagttacaaaggtgaaataaagacaagcctctttttttttttttttttttgagatggagtctcgcactgttgcccagtctggagtgcaatggtgtgatctcagcccactgcaacctctgcatcccgggttcaagcgattctcctgcctcagcctcccaagtagctgggattacaggcgcctgccaccacaccctactaatttttgtatttttagtacagacagggtttcaccatgttggtcaggctggtcttgaactcctgacctcaggtgatccacccacctcggcctccccaagtgttgggattacaggcatgagccactgtgcctggccaggacaagccttttgatcaggtcattttagagggtcagatcggcttaagatagtttgtaaatgaggtttattctgctcccacctggacctatgccttaaatatgaactgttattttcaaggctgctactgagtgaggagcaggggataaacagggtaagttaaaatgccagaaagctcactgttcttactgcgtttcacttgttttgaataagttgctgcaagcttttagctagtttacaatgttctgaaaaagttgattctgacaggctttggcaggtttttaaaattgcttttgtggagtaatggacttctggagttcttttctctgccattttcactgacatcactccttgattcactctctctcagttcttgaagtattttctttgtctttgaagtttaagagcttaattcagatgtgttgagttgaatatcttgtattaattttcccagaacatagtgggttatttcagtgctgcacagtcgtggtatggttgtgtgttttcatagtttcttgaagtaagaattattacaaaaacttttgtaatttgggctgtgttttttgggcaaatctgctgatctcgctcgggcttaactcatccagctgtagtcatttgatgtctttactgtggctggtggtctaaaacatccttactcccatatttggagtcttggcactgtctgttagctgagtcttttctttctgcatcattcagctaggctgagcgtctttccatgccataggaacgttctaaaagactgaaagtggaagttgaaggcctctcaagacctttgccatcttctaattgccgctctagcttttcagccacaagtcaggcctttttctttctcacattttaataatcttgtttttcctcccattatgttttcatctttgattgtttcttctttcagtggtattttggtaaaagacagtaagttttgttgctatgagttcatatacactcaatccctaggagctgcacccctgttgatagattgggttggggacacacatacccactgggagaagagagactctggaatgagtgagattatcagcatacttaatattactcctgttatggaggtagccagcaaattttttttaattgatacaataattgtaatgtattcatggggtatgtagtgatgttttgattcatataatgtataatgatcagatcaggataattagcatattcataatttcaaacattgtgggaatgggaatgttcagtgatgggaatgttcagtatccttctagcaatttgaaactctattattgttaagtatagtcatcctacagtggtctagaacttactcctatctagctgtaattttgtattctttcatgaatctctatctttcccttccctctccccttcctggactctagtatcctctgttctgccttctacttctatgaaattaacagtttttttgtttccacatatgagtgagaacatgtgatgtttaattttctgttcctggcttatttcactttacataatgtcctccagttccacccatgttgctgcaaatgacaggatttcattcctttatatggctgagtagtatttcattgtgtatatatatcatattatcctcatctgtttgcttggctttttgttttgtttttttgagacagggtctcgctctgtcgcccatgctagagtgcagtggcgcaatcatagctcactgcagcttcaacctcctgggctcaagtgacccttctgcctcagccccctgagtagctgggcctgtaggcatgcaccaccatgcccgctaattttttgggaattttagtagagatgaggtatcgatatgttgcccagcctggtctgaagcgatccttctgctttggcctcccaaagtgctggattacaggcgtgagccacagtgcctggcctacactcatctgttgttggatacctaggttgattccatatcttggctattgtgaataatgctgtagggttgcaaatttctcttccatataatttcctttcctttggatcagtagtgggattgctggaacatataggtagttttatttgtagttttttgagaaacttctattctgttcttcatagtgggtttactagtttattatctactcacccatgtggcttaaccttatttttgttgccttaggttactatatcaacaactgataggagaaacaataaactcattttcaaagtgaatttgttagaaatggatgataaaatattggttgacttccggctttctaaggtatttttatgttttattgtattctttctatggaaatatttctatatgaatttttttaatggcattatgtttgtatatatgtggcatttgtaaataggttacttgcttttttcgtttaatattatgagcatgtgttttcgttatctatttttcccgaacattgtttttttcaaatgacattttccttattataaaagtttttgccaggcgtggtggctcatgcctgtaatcccagcactttgggagtccgagacgggtggatctcgaggtcaggagtttgagaccagcctggccaacatagtgaaaccccatctttactaaaaatacaaaaaattagccaggcgtggtggcgggtgcctgtaatcccagctacttgggaggctgaagcaggagaatcatttgaacctgggaggcggaggttgcagtgagccgagatgacgccactgcactccagtctgggtgacaatacaagagactctgtctcaaaaaaaagaaatttctgcttttgtgaaaaatgtagataagcaaaaaatgagaaaataaaaataattctaaattttcagtgatcacattaatatttcgaagcattttaatatttttcttaatttatgtcttttaataaaaattatgatttgttacaaatatttcattataatttaatgaacctttaccagttataataattctgtgattgctattttatgcatagatttttttgttcatatttctgatgatttctttagaaatcattgattctaagatgatagtattacagcccttgatatataaaaccaaaataacatttttctctattttctgagagattgtatgtggctctaaagagggttggaggggtagctgctgtgttagagcatttgccgcagtactctttgtattagagatttgctgcaatactgtttttcagatgcttgctacagaattaaattaagatcgtagtataatgaaattcttctcataactaaatctattgattttggtcagtagtgttatgacaacaagacttcagtttagttgtatagtttattgttagtttccaaaccctcactgcctatggaatgtaatgacttaggtccagatataccaacacctgaaacagataggatgccatgtttatctgctctctgagctcagtgcagtaggaacagtgatgggcatgaaaccacatcagaattatttgtgtaacaattttctcttccaggatatttggtcttcataaacagaccgaaaagaaaatggtagctagacatacctaaagatgtttgtctcttgttaccactacaaagagattgattttaggacagaattttgtttttgtttttgttttgacataattttttaatactatttctaatatagggtgatggattggagttcaagagacacttcctgaagattaaagggaagctgattgatattgtgagcagccagaagatttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattctaagatgaaccaataaagacataattcttgtgacttttggacagtagatttatcagtctgtgaagcgaagccagcttcaaaacatatccccaagatttgtacttatattttcaaaagggcctggccagttatataaacctgtttttgaattataatgattaattaaaattgcaagtaggtgttttttccagtgtagttagtaaaatacttgtattttacagtgttgcataaactctagtgcttaactaactttactctaaaaattactgttgaacatcttaaatatttttctatattttctactttcatagccatattttaaccttttcaacttactggtgaccaagcttttaggtgataaagaataaaagagggaagggaagagtaaggaagctataagaaaaatagatctgattctttgttcctttacctgttagacttacaaaaagtttgtttttctaataaaatttgtatcaactttggggcatattaggttgaggccttggctcctgcctgtagtcccagctacttaggaggctgagagaggaggatcgcgtgaacctggaagtttgaggctgtagtgagctatgattgcaccagtgcactccagcttggatgacagagtaagaccctacctctaataaaaatttttaaaattgtaaaacattataaaattaatcagttattttaatctgaagccaagaacatgtagaatgttatgattagagtttatcacatattaatgtatactggcaaattgtgttactggagtatacccataggaggaataaattcaaacctgttttatttatttgaacctatttacggtatgcttaagaattgaatcagtataaattctcaaatatgggagaaattttgttcttgagaattatctgagtcattaatatttttcaaaaacagctctcactgacttgaacctcttctgtaagctctaaccttttacctgctttacatttccacttgaatgtctagtaggcatctcttgaccaaaaacagcttttgattcctgttctccaacctgttcctctcctagttttctccatctcagaaatgttacttcctctgcaaagtctttccctgacttatctaaaataataacctcctctgtttgctgtgggaatttgtatagaatggtgggaaaatttcaagtttcatatttggattagctctgacatttatttatctgaacactggtaattgcctcagtaaagacactgataataagtaccttttagagttattttaatctttaatgctttaatgtgtaggaagagtatagtgtcctgttttgcacagaaaggcattctgtaaataataagttgccttaattttcctgtaatgttcattatattgttgtgggaaggtatttactcctattattaaaaataaaaatgtgtaaaatttactacctgaa

SEQ ID NO: 1631 - DNA, 30792 bp, Homo sapiens
cgctgccgcaggcgttttctgccccataccgctccctatatcctcttcctctcttccccagacccccacctctccctcctccttccccagtcgttcgccggaaagcatttgtctcccacctcttcataacaacaattaatttcctctggggcctgaggagggcagaatttcaaccttcggtgtgcttgggagtggcgattgtgatttacacgacaaaatggtcaggtttagaatagttgttcgtggttgaaagacttggataaatgtggatgagatagaaggggaaggcaagagctgttaattttcgtgggcaatcctggggagaggcggggctcagtggcttcactggtgatcttacactctacatcttttctggattcctgccttttacagccgaggtgctcggtggagtcatggcagtgccctttgtggaagactgggacttggtgcaaaccctgggagaaggtgcctatggagagtgagttcttttaagcttgccttcgttttctgagtgcatattcattgttttggagtctcacactctggtgatttagaaagtagatgtttgagatccaagggttttggcaactgaagttacacagccttttgctaggattaaaaattttttccttccctttaaaaaaaaaagttttctttgtagagagctggaagggacacgaagttattgtttccatgcccacaaatggcttctcagggtttaagcattgcggttaatgagcaaatgagcagactctggagattgcctgcctggtttcagatccttgctctatcacatactggtcattgttttgtgatcttaggcaagcttcttaatgtcattgtgtacctctccttcactacctttagggtggcaataatcgcatctaccccataggagcttaggacagtcagttacacaagcacatatagtatgggattaatgctcttaaaagtatatgagtagaacatgtatatatgtgatgtggcttagaattatctcaatctattttatgaagcgtttattaaatgacttgtgtgacagcataatgacgtctttggagggttagctattgtatttcacattttagaaaagagtagtgtgtgttgagaacatagcagaaaccacttccttggtttctcctttgtggaaaaagtaatagaggtaaaatcgttttggatgagtcatgtttaatctttggaagttttagaagaaatggaattctgtaatgttaaaactcttttcctttttagagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaataggtatggaagaaatttaagataattattttaaacaagtttttaaatttgttttttaaatcttgggcatgctatttggtcgttgtcctttcaaaattgctcatgcaactgtgaaattggaatacattatctttaaaaaatttttccacctggtgttaataacataaaagcatatatagagtcaatgaaagaaaacttctttcccaagttatataagtgattttgatttaagattggtgtcttacagaatttaagagtgacaaacaagttttatggtacatcataaatgcagtgtatcctaaatgcaatgtattgcctacacaattttttctttgtagacattctagttacatgaaatcattgtatacattttatacatttacagatctaaaatagcatgctgtttcctcttggtttacatgaaataattgagaattttctaggattgctttttgtatattaagtaaattctatgtttgctattaatacttaaatattcgatgtagaatcaaaggattgatatttcagaacactgagaagtacataaaatctggatctaaatttataatttaaatttataatttaaagctattgtattaaataagtttatcagttaaaaactgataaagaggtattaggatctccagtgtgactcaggagagagttgagggtaaaagaaatggagttaatgagagagatcaaaatataaaaagataactgataaaagaactttcataataaaactgtttcacgaaggacctcacaggcatttgtggttttgtactgtgagactatatgaagtttaaatctgagccaggtgtggtggtacatgcctgcaatcctagctacttaggaggcaggaggattgcttgagctcaagagttccaggttacagtaagttatgatctcacgccagggcactccagcctgggtgaaagaacaagaccgtatctctaaaaaaagttaaattataaaagaagtataatctgtaaaatatttagtgaaattggcttagatttgcccagacttcccctttggcattatatttcaggaatgagaaaaataattagcatagcatttagaagaaatggggggaatttcaaggttactaaataaatcagggttagtataagaggaagcagaggctttgaagtcatggcttgcattcttgatttggatattggttttctctttataatttttctgtgatgacgccttttgccacctaacacaggtaaatgtgagttaagccccatatgtgttagtggactcctgaatcttttgttggcatttgcttctgtttgcctaagcacatttgtaaatgtctaagcttcaaattaagaagctatgtggttgctacctgattatatttagtcaataaacttactttcatatttgttttagagccagacataggcatgcctgaaccagatgctcagagattcttccatcaactcatggcaggggtggtaggtatagttgtctatttcccttttacttaaaattagagtgaatacattacattaccaaattctagtgtgtttctctctgcatccctcttaggtttatctgcatggtattggaataactcacagggatattaaaccagaaaatcttctgttggatgaaaggggtaagtttagcattttatcactacctaaaataaaataaaataattacctaaattattttaattacctaattattttaatatagccatacaaggcaaaatcaagtctttttgcattactggaatttcaagacaagatctgaaaaatcaaggaaattttggagacttcgtatatttggaaatcacaagtctcattttgcaatacaagtgcggatcaggtagagaaatctgacctaggtgcaagcctagctcactatatgtataagaataatttttttttttttgatacaggctcactgtgttgtccagtctggggtgcactgtattatcacagttcactgcagccttgacctcctaggctcaagcaatcctaccatctcagcttcccgagtagctaggaccaaccacaggcaggtgccaccatgcctggctaatttttgattttttgaagaggtggagtcttcctgtgttgctcaggctagtcttgaactcctggactcaagcagtttaccagccttagcctcccagagtgttgggattatagacgtgagccaccatgcctggccaagaatagtttaaaataatcctttaatggattaataaagggaagttcctgtggaataccctggaccttagtcttgtcctgttcactctttttttatgtatgacgtggataaaaatgtaagaaatttagttatattttctgaatgtcatcaaattgagaaggatggatagcgaaagctttaagcttacagggtcagaatcaaaaaagaaatgtcagctgtatgaggcagtagtttttgtctggtttaatgctttattcttagtattagaatagtgcttaacaaatggtcagcttttttttttttttgaaacagagtcttgctgtgttgcccaggctggagtgtagtgacatgatctcggctcactgtaacctctacctctctggttcaggtgattcttgtgccttaggcccctgagtagctgggattacaagcctgagtcaccacacctggctcatttttatatttttagtagagatggggttttgtcatattggccaggctggtctcgagctcctggcctcaagtgatctgcctcccttggcctcccagagtgctgggattataggtgtgagccgctgtacccagcctatacatgcttttttcttatgtgcatatggattttactttttacccctttaaactgagtttatatgacataaaaatctttatttttatttaaaactttaaaaattcaggtacacaaaaattcttatgtattataatgaaatgtaaatatatgtatatcaacccacctggtttaaaaatacaacattattcgtatataagaatgctcacagtggtgatgtttttaatatagcaggaaactaacccaaatgtctgtcaacaataaattatgaaatgcatggcttttcaagccatgtcacaagcagtgacacaagcatgtcacaagcagtgacatggatgaatttcaggtatataatgatgtagagcaaaaagagacagttgcaaaagaattcatatggtctgattctgtttatacaaagttcaaaaatatgtaaaacctagtatattgttcaagtatgtaaacatggagaaaaaaacatgcagaaaagcaagggtataataaaaccaaattcagaatggtctaagaaagtaggggagggaatgtatttaaggaagtatttaaagatttcaaaggaaatagagcattgtttttctaaagtgagtgggtgtttattacattgttattctttatatcttgtattaatatacaagatataattctttgtttctatttaatatttaggagtcttttaaaaaaagaaataaaatgttaccagtatttaatgtcctcctgtttatttcatcacaaatatattcttcctttgtttttctaagagctaaacacattcctacatttaaattttattatgtgcagttctctaacatagctgagtattatgttgcagacataacaaagtccaaggaatactatagttatccattagtattttaagtgattactactcataagtaatttgaaactcaatctcagtggtttgtccaatagtgtcatatttaactactgaaaagataatcaactgggtgcagtagctcatgcctgtaatcccagaggctgaggtgggacgattgagtgattctaggagtttgagaccagcctagacaacatagaccctgtctttatgaaaaattaaaaaaaaaaattagctagacatggtggtgcacacctggagtcccagctacttggaaggctgaagcaggaggattgatcacttcagcctaggaggtcaaggctgcagtaagctgtgatcacatcactacactctagtctgggcagcagagtgagacactttctcaaaaaaaaaaaaaaaaaaaaaaaaaaagggtaatcacagtagctacctcctaagtcagatagaggtaaacatttcattggtttacatattgtgtgaatgtacttgatttttaaagaaatcagtcccctattttgagacatttaagttgtttctaacttataaaataggacagtgatggcttctatcaatttgtgtaaaaggccaatataaaaattgcgtcatgctataatattttttatgctataatattttttatgccattagcctttttgtcccacttacacactatttcatgttagtatgtatagatataccttgttgattgttttcaaaacctacctccacattttccattgtacaaatttggacatttatttacaaataatattgctatgaatattcttatgtttatgaatttgtgggattatttctatggatatagaagtgggaattgctagttcaaagagtgaatgtttcacagtttagtatgttttgccaaattgccctctgataatagagggccttttctaactcttaagactgggttacattcctttgctctaagatcctatagtgctctatatttttataaccttcataacagttttctattgtcagtcttcactaatttatctattacctgcattggctggcatagtgtctgtcactaagttacagtagatattcactaaacataagttaagtcctgcctgcagtttttgtgtgttgaagatgggaagttagggtggaagttgggtcttctgatattttttttttgtacagagtttgtcctctttttctcagactctctactttgaagaaaaaaattactgtggtttgttgaattttggtgtgtcttcacatattttcttctgccaactgggtttgtttgctgctgagaaagttgtgcctaacatactactgatgtttccttcctgccctccaccctacctgatgaggggccttgctttactttcatctcaggtttagagtgctcttttccagaagggcagccccttctgactccagcctctttctttaatctggtccagactgttctgtgtgttgataatacttcttttaagttaatagaagaggtgaggcctttttctacttttagcatagatgatgatttattttatttttttaaatttctttttgtctattttgcttattttaagagaagttctacaaaccttaagtaacaccagtgattttttttcagtaaaacttaattcctgtaagtatatctatttgcaaaacatttttattcagtgtcatctttttttcttttggtttagataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggaggtaagagctatttaatcatggtaaaactcctataaaaagtcagattagttatactgaaataaatgaaataaaccaaggaattcatgtttatataatagtttttgttttcttttttaagagacagggtctcactcttggccagactggagtacagtgagctgttatagctcactgcagcctcaaacttctaggctcaagcaatcctctggcctcactcttccaagtagctaggaccagtggtgcctgccacaagacatctggctaagttttaaaaattcattgtagagatgggatcttgctgtgttgtccaggctggtcttaaacacctggtctcaagcaagccttctgtcttggtctccaaactgttaggattaaagtaaagacatgagccatggtacccagcttttatagtagtattttaatagtgtcttgatcggtttggtaactgctgtaacaaagtatcatagactgcatagcttataaacagcaaatttatttctcacagttctggaggctgaaaatatgagattaggggtgccaacctggtcatgttttagtgagggccctcttcctgatttgcagatggctgtcttgctgtgctctctcatggtggacagccaagagagcagaagcaagctctattgtggtttttttttttttttttagaccagagtcttgctctgtcacccacgctggagtacagtgatgtgatctcagctcactgcaacctctgcctcccaggttctagcaattctgtcccaggctcccaagtagctgggattacaggcatgcatcatcacacccggctaatttttgtattttgagtagagacagggtttcaccatgttggccagactggtctcaaactcctgacctcaagtgatcccccaacctcagcctcccaaagtgctgttttttgggttttttgttaaatgaccagatgttgtgagatattgtgtctgttttttgtttttttgtggttttttttgagacagggtctcactctattgcccaggctggagtgcagtggcacaattcaaggctcactgcagccttgagctcccaggctcaagcgatcctcctgcctcagtctcctcagtatctgggtctacaggcgtgcaccaccacacctggctaatttgttgtgggttttttttcacagacggtctctccatgttacgtaggctggtcttaaactcctgggctcaagtaatctgcctacctaagcctcccaaagtgctgggattatataattagtgccctataaagatacaatattgtccgggcacacaagcccttattagacattaataagctcttaataagagcactaataccattttttgagtggtcccatcaccaggacctaattacgtctcaaaggccccacctccgaatgccattgcattatgagttaggatatcaacatgacttttgagggggatacaaatatttagcacattgcaaatagtaacttatttataatcccaaagattttttaagctaaggcatgcatagttattaaatatcacaacacttatctctcctgtgtatcatgtaaacatttgtgaaaacaagactagggcaagaaatgattcatctgttttttggtttttttttttttgagacaaagtcttgctctgtcgcccaggctgcagtgcagcagtgtgatcttggctcactgcagtcttgacctcttgggttcaagtgatcctctcactttagcctcctgaggagccaggactacagatgcacaccatcacgcccagctaattttatttattttttgtagagatggggtctcactatgttgcccaggctggtcttgaactcctgggctcaagcagtccttctgcctcagcctcccaaagtgctgtgattacaggcctgagctgccatgcctatcctgattcatctatctttgaagtgcctctaaagtttccaagttgggattcttagtgtgaaaaccatattgaattaattcaaaggaaacttttcatggatttatattattatttttccttgaaatctttataataagaacatttaaaaaaactgggacttgctttgtttttagaattgccatgggaccaacccagtgacagctgtcaggagtattctgactggaaagaaaaaaaaacatacctcaacccttggaaaaaaatcgattctgctcctctaggtaactgaattatcttgagtgaaagagtaccgatttcttggatatgaagtcttgtgctatttgaattttttcttacttttttttttgttttaaacttacaaataattcatgttcgttgtagataaaatagtaactataagtaaaaaattaaggaaaaaataactctttagtcccagaactctgcaatagatttttaaaaatattttggggagtgtatattcagagcaacttgaatctgctcttagatggctttttacttaaagttttcatatgtgctatactttgttgcaaatacactcgtttgttgcttaattatagggatgcactctaacaaatgtttcattaggtggtttcatcattgtgtgaacatcatagagtatatttacataaatctagatagtatagcttactataaatctaggctatttggtataccctattgatctcaggctgcaaacctgtacagcatgttactatactgagcactgtaaggaattgtaacataatggtatttgtgtatctaagtatagaaaaagtatagtaaaaatacagtattataatctaatgggactgtctgttatacgtgtggtccattcctgactgaaacatcattaatgtggcccataagtatgtaaaatgaatatatgtatattatttatatgtgtttttatacaaaatgagatcacactaataatattttgtaactgtttttggttttagtgcgcagcgaacattcttccatgactataattgtaggtctacatcgttggtttaaaggctgtgataatattctgccatgtggatatgccttactttactcttttaatcactttgttggagatttttctaaattttcacagatacaaaagagatataagtatctgtgtaacttaatcatgacacatacccttaaattgttcattgaaatccccagaagcaaaattgcaggatcaaggatgtagtttttattattatggcttattttgtcaaattgcttcccgaaagttcgaaccatttcatcacagtctcatcaatttacattaaggaaaaaaactttaaataatagtttttcatttttattttaaatttaatactaatgaagttgtataccctttatgtatgtattagttttttgtctattttgctcatttttgtcaaggatattgtttttcttaccactttgaagcttttttttttccttgataacacattgacctttgcacttgttacaaatacttttcacaatttatcatttattttcattttgttttgctatattgacattcaaatctattatcttgtcctttgtggtccctgactataatttctttggaaaggtcttctacctctactatttaaaagttccctatgttttcatttagtgtttttatggcttcatttttccatttaaatctttggtccattaggaaataatcttcacataggaagatacgtgaattttttctcaagaaaattaagataccttaggatggttagttagattactgtctcttaaaaagttattggtaagtaaatgttcattataaaactgtgtgaataaggaggtcacgtgagaacatgacattgaagtaatgaaattcggtattgaaaatggataagaggggtttctgtatctttttgttaatctcgtcacatgaggagaaacatttccatctggctcttgttctcagttgcaaacaattgagaatcagatcagggaagactactccaagatacagcagcagagaaaaactgcatgaaattaaagcagtaatttagtagctttaattctttctcttccccaggaataatatttagacataagtaggctaacagaaaatgtgtttcttacctcaagccataggcttctctaacatgattctttcgtgaatgttgtcgtaatgtttgtttttagctctgctgcataaaatcttagttgagaatccatcagcaagaattaccattccagacatcaaaaaagatagatggtacaacaaacccctcaagaaaggtaatatccttaaactacaagtttgtttgtttttctgtggaagaaaaggtaattgcaaagttattatcacaagtcaacaacacatgatagctatgatctctgtcctcatggagattataatgtccagtagaaaaaaatacagaaataattttgtttattaataattataaaggggaaagtcagggtactatagctaagtgtttgaccaagtctaagggacagggaagacttttcttcctgaagaaattacattaaatctaagatttgaagattaaagggaagctaggcaggcaaagtaagtggcagatttgattctgaacaggggaagcagtatttgaaaaatcttagattttagaaagtctgatgcttttgagaaacttgaaagatcagtatggcacaagccgtgtctgttgtgttcatcattgtatcatcagtgctttagcacagtatatggtgcaccataggcactcattaaatatttgttgagtgagtgaacagggaagtgggagaggaagacaggtttgagatgaggccagagaggtcgctagtggccaatttgtggaagaagaccttgtaagccatgttaaggattttgggctttaacttaagaccactggggagacctctgagagattttaagcaagactatgacatagtcatatcttcggtttaaaaatatttctctgacttccttattttttttccattgttttttatgaatagggaaagattcagggtgctgtaggtttttctgctagttgtctagaagtgggaggctggtggcttggaataggttagggcaatggtattggagaaatgagatgattccaaagaaatttaagaactagtattgataggactgttaggctgtgaatggaaggagagaggacaatgactagagatgatgaatgaaaaacattcagagagttattaatgtttaactctgtcctcatggatagaaaagagttaatgtttaaacattcactcttctttaatacctctctgcatgtttcttcctccttgtcctaacttaaagtccaattctcccctgaggacactgcttcctctgaagcggtaggtgttttctttcccataccctcatgtcctttgatctggacatggtacaggtgtcctccttattcttcattgtcactttctcccatcttcctttatgtctctcccctctaacttttgaaccccaaattaaaatttctgccgtactatcacagtctgcaaaatgactcttgatgttattttcgtcatgattcttggtgatttaaatatttatttggatcatcctcctgatatcctgacttcactgtttcttgaccctctctcctatagtgatgttgtctttgaacacgctgcactgatcaccagtataattttttctgacttcctcccttaatattctaacttaaacagtcctttgtatctggacttgcaattaattaattctatctcttcagtctcttacctgctccctctctaggtccttgatttcatctttacctatcttaaatctttaggttagtcattataaatgactgctttgcgttcatcatcttcaatttccttgtccccttctctcttcatcatacttagtgggtaaaacccagtaagtagtttctgggtttaatctagtagttttctacgtactgcacacttgtacctgcacaacagattgcagcaggagaaaaatacccaaaaatgttcactttaaattcaggattactaatctcaagtgggcccttaatgcttcctggcatttggccttcgtttccccacatctttctctgtcctgttctcctaaatcacgtttttataatacttttctcttttttttttttttttttttgagacagggtctaggctggagtgcagtggcgccatctccactcacttcaacctctgcctctcaggttcaagcgattcgattctcgtgccttagccacccgagtagctgggattacaggtgtgaaccaccacacctggctaatttttatatttttagtagaggttttgccatgctggccaggctggtctcaaactcctagcctcaagtgatccccctgcctcagcctcccaaagtgctgggtttataggtgtgagctactgtgtctggtcccttaacttttattatcttctctccatcctcactctcagttgttcactttgcttcctgtgtcactgggaaatgaaagccacaagagaacttaggcaagctcccaccaccatctcctccatactaactgcctctatgctcatgtattctctttcatcctgtattgctgtagataaattgctctggatgtaagccaggtctttctcttacccactcaatgactttgtctagcaatttttctccctctcctacattattaatttttccttctctaccggatctttctcatcagcatatctacatgctttttctcccattttaaaatcaaatcataatggtaataaaatttctcttaactccacttttccctaccattccatcttcttcacaattgaatattcctaaaattgcttctcatctctaacacctcaaaactagttttcaatttcatctattttgttgccaagagtcacagtgatttttggaacgtgttgccaagttcaatgtaatagtccactgtggtcaaccgaggtctgaaaagattaaatggaaagtaccagaagtaaacaattcatcaattcatgggttttggccgggcgcggtggctcacgcctgtaatcccagcactttgggaggccaaggcgggcggatcacgaggtcaggagatcgagaccatcctggctaacacggtgtcaccccgtctctactaaaaatacaaaaaattagccgggcgaggtggcggtcgcctgtagtcccagctactcgggaggctgaggcaagagaatggcgtgaaccccggggggcggagcttgcagtgagccgagatcgcaccactgcactccagcctgggcaacagcgagactccgtctcaaaaaaaaaaaaaaagaaattcatgggttttatttatttatttaattcgagacgggatctcgctctgtcgcccagactggagtgcagtggcgtggtctccacttactgaaacctctacctcctgagcttaaatgatcctcccatctcagcttcccgagtagctgggactacaggtgtgagccactatgcccggctaatttttgtatttttggtagagatgaggtttcgccatgttgcctatgcttttctaccaaaaatacaaaaattagccaggtgtggtggttcacgcctgtaatcccagctgttctcaaactgctgggcttaagcaatccacccaccccggcctcccaaagtactgggattataggcatgagccacaatgccctgccataggttttaaattgtgtgctgttctgagtagcataataaaatcttgtgctgtcctacttcatctcacttgggatgtgaatcactcctttttccagtgtattcacgttccatgtgctacctgcttgtaactcccttagtagctgttttggttattagatcgaaagaacatatatagggtttggtaccatttgtactttcaggcatccacttgaacatatccctctgtggataaggggggtactactgtagtcagttctcagacctcttgttttatctcatcaatattttatacagttgatcatgccctcctcctttaaacactttcttcatttggcttccaggcgttacactcttctgattttcgtccttctcactggtcgctcttttcagtctcttgatggttttttttcatctgctcagcctcctactattggagttctccagggctgaatctatggatctcctttgttttcttctccacactcactccattagtgatattacttggtttcatggctctaaataaaactatatgttgatagtcacatttatatcaacctagacctttcctctgaattccaaacttacatgtcttaactgccttctgaaatttcacttgaatgttaagaggcatctcacacttgatgaattccaaactgagttactgatcttttcctttcaaacccattccttttcaaagtctttcccatgttggttaatggcaactgcattattcttattatgcagatcagaaactttggaatcatccttcatttttctcattctcttttacttcacatccagtacaccagctaattctgttaacctctatctttaaaaaaatcttagaatctgattaccttttttttttttacctctactgttaccctatcattccaaattaccatgatatctttccaaaatgttctgatttaaaagtgaattagaatatatcactattctacccaaatcctccaatgctttagttctcacgtgtagtgtaagctaaaatcagttcatgacctgtgagttcttacacaattttgttccttacattacctctccaacctcagttctgctttgctcccccttggtcatattgttgttcttcttattgttctccaagtgctctaggcacacttctacctcactgtttttgtagtgactgttcctatgtctgaaaatgctttttcccatgggacttatttgcatgtcttattctcttactttctttggatattgacttcagtgtcatctttccaataagcctttcctggccatgctatttaaaatggtatcctcttccctctaacacatttcttaaatttttaaaatttttactctcttgtggacatacgcaatccaacacgtttcttcattttattttccttcagtgtacttaccaccatttagcttactgatttttaactgtatttgtatttattttatgttattttgtctctcctcagtagaatgtaggatttaaaaggtcaagagttttttttctattttgctcactgctgaatacctgatacctagaataatgcctggcacagagtagacctaataaaatatctgaatgaatggattaataaataaaaagcaggtttaaaaaaaaacttgagcatgtttaaaaagaaacaaacttaagcatgtttaagtggtttgggtacggatcctgtagagaggaagaggctgacagtctaagagaaaggaaataaataacagaggatcaagatccctaaggaggtagaagggtatgggctccagagcacaagtagagagatgaacatttgatgggagaatggaagggatgaaaagatgtataataatacaaataacttagctttggtagggataagttgatgtagtttctgtctaatggctttattttttctctgaaatgggaggtggtagtataggtactggatggtagtcttgggaattacagaaaagtgtagttttgaaatgatccttgtggagaaaaggaaaggaaactagagaaacaaatattatctggcaatattgaggtttagctagggattgtaaccataaatttacagtggcgtcattttccatataatattcttctttataaagcttttccaaggaatcaaagaatgttggctatagcagattcataatgtttattgctattatcataaattattttttattttaaaaagttctagtcctttagccaggtctgttgtcttcatagaacattgttctgttacccataaaagatgccattaagactgtggcctgggccgggcgcagtggctcacgcctgtaatcccagcactttgggaggccgaggcgggtggatcacgaggtcaggagatcaacaccatcctggctaacatggtgaaaccccatctctcctaaaaatacaaaaaaaaaaaaaaaaaaaattagctgggcgtggtggcgggtgcctgtagtcccagctactcagggggctgaggcaggagaatggcgtgaaccctggagacagagcttgtagtgagccaagatcgcgccactgcactccagcctgggtgacagagcgagactccgtctcaaaaaaagaaaaaaaaaaagattgtggtctgagcatactccacactttgaacatgtctacagatcatacttaggtattgtaaaatacctaatttgacaaatgagttttagtaattttataacttggccatattttttataaaatcatataggaagactttgttttatatcttacaaaaattttgtgttaaataaatagatttagacatagttttacttcttcaagttgccagttgggttaatttaaaaacatacttgcatagaagacttgaaagcatttgtatttgttttcttttttaggggcaaaaaggccccgagtcacttcaggtggtgtgtcagagtctcccagtggattttctaagcacattcaatccaatttggacttctctccagtaaacagtgcttctaggtaagactgataaagattgagtagtttttgattgtagtattccccatgaagaataatacatgtatgtgttttttcataataatcgacattaacataatactgtaagcatgagaacttgtgtgtgatataagaaaggcctgatagattttattttattaaatgtatgtttctttctgtcttaatgcctcagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacaggtgagggaatttaattttttaaaagtaatggcagctctttattttttattgtcttaaagtccttttttaatgtgtaaatcttagatatataacttttaaatcacatgtattcttttttggtcaaggaagaaagagaggagggaggccttcatgcaaaataattttaagtcagactaaatagctatgatattactgtctttagtcctaatggatttattcatttgtcttctgtttgacatgtagaacccctggcagcggttggtcaaaagaatgacacgattctttaccaaattggatgcagacaaatcttatcaatgcctgaaagagacttgtgagaagttgggctatcaatggaagaaaagttgtatgaatcaggtgtgtttcattgattttcattataccttttcctgaagaagaatttaaatatttgagtaaaagctatcattagtatattttttaaatataggctgtggctcacacctgtaatcccagctttttgggaggctggggtgggcggatcacctgaggtcaggggttcgagaccagcctggccaacatggtaagaccctgtctctactaaaagcacaaaaattagccggcctggtggtgcatggctgtaatcccagcttctcgggaggctgaggcacgagaattgcttgaacctggaagacggaagttgcagtgagccgagatcctgccagtgcactcctgcgtggccaacagagtgagactgtctcaaagaaaaccaaacaaacataaaaatacaaagtaattagttaatttgaaaaagaaactatttaagtaaaatgttctttactttaagaaataatacttttttttattttgttttattttttaatttttaatttttagccactgtgcctggcctaagaaataatatttcttaaaagacctttttattgttattaaaaatagtagggagctggaatcattatctttgtaaaaactatgtatacttaaactgtagacaataacagttgactgcctactatgaaagacgaatacattagcaatcccacactttctcccatctcccttgattgcacccgtcaatttttattgtttatattattagagcatagttataacattggtattctaaactgtctttaaggcttttcaaaaaaaatgttaatgtcaatgaaagacaaatagggtagctgttttttactcaaggagactaaagaggcctgataactaagtgcaagtgcaatgcatgatctttcactagatcatgtatttgaaaaaaactataacggacattattggaacaattggggaaatttgaatatggactgtatattaattaggtaatgtttttgtatcagcgtcagatttcttgggtgtgataatactgtggtttgtaggagaatgcccttgttcaaaggagaacaagtgtcaaagcaaagttgaagtgaagtgatattttcattcagcttaaaatttaaaaaaataaagggcaaacaactacataaaggccaataaacacacacatatctggtagataaggccaatgaagagtatatggttatttattatactcttttttcagtttttctgtagattcgagttttcaaaattaaaaattgggggaactgttactgtgtagaaatctgaggtcagcctgatagtcttctcactcacataggtgattcactttctttcaggtagactcagagataaaatttgcataacataagaatcatcactttaaccattttaaaatgtaaaatgcagtgctttttagtatattcacaaggttgtgcaaccatcgcccctaattccagaacattgcatcaccacggggaaaaaaaaacaaaacacctctgtaccacctagaatcactctttattcctttcttgctccattcccagacaacctcgaatctactttctgtctttagggattgcctttttggacattttatataaatggaatcatataacatgtagtcctttgggtctgtctgctttcatttagcacgttttcaaggttcatagcatctatcagtactttattcctttttatggctgaataatattctgttgtgtgtatgtattacatttcgtttatccattcatccactcatggacatttgggttgtttctactttttcatcattatgaataatactgctgtgaacaatcttgtaccagtttttgtgtgaccatatgttttcaatttcttagatatatatggaggaatagaattgttggagcatatggtaactcttcatttaactttttgagaaactgtgaaatgatttttccaaagcacctgtaccattttacgttcccatcagtaatgtaagagggttccaatttctctacaaccttgccaacacttactgcctcccctttttgctatggccatcctagtgtgtatgaagtcttatctcattttgcttttgattttcatctctctaaagactaatgatcttgagcatattcttatatgcttattggccatttctttataacagtatccggatattttgtccatgctttaactggcttgtttttattgttgagttgttagagttcttttacattctggacactagaaccttgtcaggtacctgatttgcaaatattttatcccattctgtgggagaaaattcccccattcttttgttttcttgttagtgtcgtttgatgtactcaagttttagattttgatgaattccagtggatctataatttctcttttgttgcctatgcttttagtgtcaaatttaagaaactgttgcctgatgtaagattgtaaagatttatactttatgctttcttttaggagtcccagcctcctaagtagcggggactacagtcttaaagtttagctcttatatttaggtctttgtccattttgagttaatatttgtatatagtatgatgtagggtgcaaattcaaatgtttgtatgtgaatattcagattccagcaccatttgttgaagatatgttttactattagatggtcttggcacctttgttgaaaataaataggtcatagatgtatgggtttatttctggaatctcaattctttttttttccttttttttttcttcccctgtggactcaattcttttatttcatggatctatatgtctgtgctatgccgttaccacactatgttgattactgtagctttatagtgaattttgacattagaaaatatgagttgtccaagtttgttctttttttcaaggtattttggttatttgtggccccttgtttttctgtcttttaggattatcttatttctgcaagaaaaaaatttggaattttaaaagagattacattggggagtatttccattttagtatatattgagtattctttattcaaggtgcttgggaccaaaagttttgtggattttacatttgtttggattttggaatatttgcatatgcatattgagataacttacagatgggactcaagttgaaacatgaataattttatttatgcttcatatatacctgatacagatagcctgaaggtaattttatacaatgttttaaataattttgtgcatgaaacaaagtttgtacattgaactatcagaaagcaaacctgtcaggtatgaaattttcagtttgtcacatgatgtcagcacctgaaaagttttggagtttggaacattttggatttcagatttgagattaaggatgctaaacctctaatagtaactcttctaatccaataacatggggccttttttttcccatttttttagggtctttaatttctttcaagaatattttgtagttttcagtgttcaagtcttgcacttcctaggttaaatgtaatcctgtttattctttttttttttatcctgatgctgatgtaaatggaattttttaaaattttattttcaaattgttcattgctatatgcaaatgaattttgtatattgatcttgtatcctgaaaatttgctgaattcattaactccagtagtttttttgacaaattctttaggttttttaatatattaagattacattatttggcagggcgtggtggctcacgcctgtaatcccagcactttgggaggccgttgcgggtggatcatgaggtcaagcgtttgagacctgcctggcccacatagtgaaaccccgtctctactaaaaatacaaaaaattagctgggcgtggttgcgggcaccggtaatcccagctactcgggaggctgaggccggagaatcacttgaacctgggaggcggaggttgcagtgagccgagatgacgccactgcactccagcctgggcgacagatcaagactccgtctcaaaaaaaaaaaaattacattgtttatcaatagagatacaggaaattgttttacttttttttttttttttaacccagatgccttttaattctttttgtttagttgtcctggctaggacttccaacattatgttgaacagaaatagagtctttgtcttgttcttgatcttagggttaagtttcgagtctttcagcattaagtatgatgttagctgtggggtttttgtttttatggtgaaagagtattggattttgtcaaatgttttctccgtctattgagataatcatgtggattttttttccctttattaatatagcttgacctcctgtgcccaagtgatcctctcatctcagcctcctaagtagctgggactacaggtgtacactatcatacccagctaactttttaaaaatgtttttgtagagatgcagtctctgtgtttaccaggctggccttgaccttctgggctcaagtgatcctcctgagtagtgggtactacaggtgtgcaccaccatgcccagctaaattgacagttttcatcagtctgtttattttgtctaatgttagtatatccacatcagctcaccagctatcttgtgtattttcctttttttagatggagtctcactatgttgcctaggctagactgtagtggctacttaaaggcacgatcatagtgcaatgcagcctcaaattcctgggctcaagtgaccctcctgccttggcctcccaagtaggtgggactgcaggcatgtaccaccatacccagctaccagctctcttttggttattgtttccatggtctattttttttttccttttccttttaacctatttgtgtctttgaatctaaagtgccttagccaggtgtcatggctgacacctgtaattccagcactttaggaggctgaggtgggtagatcacttgaggccaggagtttgagaccagcctggccaacatggtgaaaccccatctctactaaaaatattttaaaaattagttgggcgttgtggtgtgcacctgtaatgccagctattggggaggctttaggtgggaggatagtctgagccattggagatcaaggctgcagtgagtcgtgatctgattgcatgactgctctccagcctgggtgacagagcaagactgtctcaaaaaaaaaaaaaaatcgcttcttagccttttggctaagatcaagtgtagtatctattcctatcagtttaagtgccttaatttctcttccactttttggacaggtagttttgctggatatagaattcttattagcttttgtctttcagcactttgattatgccactactgccttctagcctttgtggtttctgatgagaaatcagctgttaatcttactgaggatctcttttatgtgagacgttgctgctctcttgctgcttttatgtttctctgttgaccacagtttgactatggtgtatcttggtgtggatttcttttttcattctgttcggagttcgttgagcttcttggatatgtaaattaatgtttttaatcacacttgggaagtttttggccacaatttcttcagatttttttttttatatctaactctcctctccctcttggactcattatgtttattgttggtatacttgatgtgccacagttcttagactctgttcatttttctttattcttctttctttatgtttctcagggacagttttggttgctgtttttcctttataagggccatactttgtttccttacatgctttgtaattttttgttgaaaactggacatattgtggcaatatgtggcaactctagaaagtcagattttcccctcttgccagtgtttgttaccgcttgatgtagttgtttgttttttttagtggtgtttgtttttttttttttttgagacggagctttgctcttgttgcccaggctggagtgcagtggcgtgatcttggctcactgcagcctccacctcctggcttcaagtgagtctcctgcctcagccttccaagtatctgggactacaggcacctgccactgtgcctggctttttgtatttttattagagatggggtttcatcatgttggccaggctggtctcgaactcctgacctcaggtggctgggattacaggtgtgaggcaccatgcccggccctagtgatttttcttatataattttttaaagttggtattgtttgtcatgcatggctgtacaatttctgtcccattagttttagtggtcagctaatgattggacagagatttccttaaattctgtataccaaaaacaaaaaatctgcagagtgttctgtatttgtgttggggcacacctgcaatactcaaccaagaagtttacaacgttgcttcagccttcgctatctgcttgtgcaaaatgcaaagttagggcacatgtagagcttaggggccttctcagctctttcctaagcatatgtactgccctggtcatgggtgtgtctttttagattcccaggtatatgttggaccttttcagagtcctattccccagaaacatctcactccctaacctcttcttccaaacttcttgggtagtctgtttgcaccagttgctttcattgcttcaggcaacagagactaaagcattttcctgtaagtgttttcagcaaacgctactcaggagtagctttagcacaaggtgagttagagttacaaaggtgaaataaagacaagcctctttttttttttttttttttgagatggagtctcgcactgttgcccagtctggagtgcaatggtgtgatctcagcccactgcaacctctgcatcccgggttcaagcgattctcctgcctcagcctcccaagtagctgggattacaggcgcctgccaccacaccctactaatttttgtatttttagtacagacagggtttcaccatgttggtcaggctggtcttgaactcctgacctcaggtgatccacccacctcggcctccccaagtgttgggattacaggcatgagccactgtgcctggccaggacaagccttttgatcaggtcattttagagggtcagatcggcttaagatagtttgtaaatgaggtttattctgctcccacctggacctatgccttaaatatgaactgttattttcaaggctgctactgagtgaggagcaggggataaacagggtaagttaaaatgccagaaagctcactgttcttactgcgtttcacttgttttgaataagttgctgcaagcttttagctagtttacaatgttctgaaaaagttgattctgacaggctttggcaggtttttaaaattgcttttgtggagtaatggacttctggagttcttttctctgccattttcactgacatcactccttgattcactctctctcagttcttgaagtattttctttgtctttgaagtttaagagcttaattcagatgtgttgagttgaatatcttgtattaattttcccagaacatagtgggttatttcagtgctgcacagtcgtggtatggttgtgtgttttcatagtttcttgaagtaagaattattacaaaaacttttgtaatttgggctgtgttttttgggcaaatctgctgatctcgctcgggcttaactcatccagctgtagtcatttgatgtctttactgtggctggtggtctaaaacatccttactcccatatttggagtcttggcactgtctgttagctgagtcttttctttctgcatcattcagctaggctgagcgtctttccatgccataggaacgttctaaaagactgaaagtggaagttgaaggcctctcaagacctttgccatcttctaattgccgctctagcttttcagccacaagtcaggcctttttctttctcacattttaataatcttgtttttcctcccattatgttttcatctttgattgtttcttctttcagtggtattttggtaaaagacagtaagttttgttgctatgagttcatatacactcaatccctaggagctgcacccctgttgatagattgggttggggacacacatacccactgggagaagagagactctggaatgagtgagattatcagcatacttaatattactcctgttatggaggtagccagcaaattttttttaattgatacaataattgtaatgtattcatggggtatgtagtgatgttttgattcatataatgtataatgatcagatcaggataattagcatattcataatttcaaacattgtgggaatgggaatgttcagtgatgggaatgttcagtatccttctagcaatttgaaactctattattgttaagtatagtcatcctacagtggtctagaacttactcctatctagctgtaattttgtattctttcatgaatctctatctttcccttccctctccccttcctggactctagtatcctctgttctgccttctacttctatgaaattaacagtttttttgtttccacatatgagtgagaacatgtgatgtttaattttctgttcctggcttatttcactttacataatgtcctccagttccacccatgttgctgcaaatgacaggatttcattcctttatatggctgagtagtatttcattgtgtatatatatcatattatcctcatctgtttgcttggctttttgttttgtttttttgagacagggtctcgctctgtcgcccatgctagagtgcagtggcgcaatcatagctcactgcagcttcaacctcctgggctcaagtgacccttctgcctcagccccctgagtagctgggcctgtaggcatgcaccaccatgcccgctaattttttgggaattttagtagagatgaggtatcgatatgttgcccagcctggtctgaagcgatccttctgctttggcctcccaaagtgctggattacaggcgtgagccacagtgcctggcctacactcatctgttgttggatacctaggttgattccatatcttggctattgtgaataatgctgtagggttgcaaatttctcttccatataatttcctttcctttggatcagtagtgggattgctggaacatataggtagttttatttgtagttttttgagaaacttctattctgttcttcatagtgggtttactagtttattatctactcacccatgtggcttaaccttatttttgttgccttaggttactatatcaacaactgataggagaaacaataaactcattttcaaagtgaatttgttagaaatggatgataaaatattggttgacttccggctttctaaggtatttttatgttttattgtattctttctatggaaatatttctatatgaatttttttaatggcattatgtttgtatatatgtggcatttgtaaataggttacttgcttttttcgtttaatattatgagcatgtgttttcgttatctatttttcccgaacattgtttttttcaaatgacattttccttattataaaagtttttgccaggcgtggtggctcatgcctgtaatcccagcactttgggagtccgagacgggtggatctcgaggtcaggagtttgagaccagcctggccaacatagtgaaaccccatctttactaaaaatacaaaaaattagccaggcgtggtggcgggtgcctgtaatcccagctacttgggaggctgaagcaggagaatcatttgaacctgggaggcggaggttgcagtgagccgagatgacgccactgcactccagtctgggtgacaatacaagagactctgtctcaaaaaaaagaaatttctgcttttgtgaaaaatgtagataagcaaaaaatgagaaaataaaaataattctaaattttcagtgatcacattaatatttcgaagcattttaatatttttcttaatttatgtcttttaataaaaattatgatttgttacaaatatttcattataatttaatgaacctttaccagttataataattctgtgattgctattttatgcatagatttttttgttcatatttctgatgatttctttagaaatcattgattctaagatgatagtattacagcccttgatatataaaaccaaaataacatttttctctattttctgagagattgtatgtggctctaaagagggttggaggggtagctgctgtgttagagcatttgccgcagtactctttgtattagagatttgctgcaatactgtttttcagatgcttgctacagaattaaattaagatcgtagtataatgaaattcttctcataactaaatctattgattttggtcagtagtgttatgacaacaagacttcagtttagttgtatagtttattgttagtttccaaaccctcactgcctatggaatgtaatgacttaggtccagatataccaacacctgaaacagataggatgccatgtttatctgctctctgagctcagtgcagtaggaacagtgatgggcatgaaaccacatcagaattatttgtgtaacaattttctcttccaggatatttggtcttcataaacagaccgaaaagaaaatggtagctagacatacctaaagatgtttgtctcttgttaccactacaaagagattgattttaggacagaattttgtttttgtttttgttttgacataattttttaatactatttctaatatagggtgatggattggagttcaagagacacttcctgaagattaaagggaagctgattgatattgtgagcagccagaagatttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattctaagatgaaccaataaagacataattcttgtgacttttggacagtagatttatcagtctgtgaagcgaagccagcttcaaaacatatccccaagatttgtacttatattttcaaaagggcctggccagttatataaacctgtttttgaattataatgattaattaaaattgcaagtaggtgttttttccagtgtagttagtaaaatacttgtattttacagtgttgcataaactctagtgcttaactaactttactctaaaaattactgttgaacatcttaaatatttttctatattttctactttcatagccatattttaaccttttcaacttactggtgaccaagcttttaggtgataaagaataaaagagggaagggaagagtaaggaagctataagaaaaatagatctgattctttgttcctttacctgttagacttacaaaaagtttgtttttctaataaaatttgtatcaactttggggcatattaggttgaggccttggctcctgcctgtagtcccagctacttaggaggctgagagaggaggatcgcgtgaacctggaagtttgaggctgtagtgagctatgattgcaccagtgcactccagcttggatgacagagtaagaccctacctctaataaaaatttttaaaattgtaaaacattataaaattaatcagttattttaatctgaagccaagaacatgtagaatgttatgattagagtttatcacatattaatgtatactggcaaattgtgttactggagtatacccataggaggaataaattcaaacctgttttatttatttgaacctatttacggtatgcttaagaattgaatcagtataaattctcaaatatgggagaaattttgttcttgagaattatctgagtcattaatatttttcaaaaacagctctcactgacttgaacctcttctgtaagctctaaccttttacctgctttacatttccacttgaatgtctagtaggcatctcttgaccaaaaacagcttttgattcctgttctccaacctgttcctctcctagttttctccatctcagaaatgttacttcctctgcaaagtctttccctgacttatctaaaataataacctcctctgtttgctgtgggaatttgtatagaatggtgggaaaatttcaagtttcatatttggattagctctgacatttatttatctgaacactggtaattgcctcagtaaagacactgataataagtaccttttagagttattttaatctttaatgctttaatgtgtaggaagagtatagtgtcctgttttgcacagaaaggcattctgtaaataataagttgccttaattttcctgtaatgttcattatattgttgtgggaaggtatttactcctattattaaaaataaaaatgtgtaaaatttactacctgaa

SEQ ID NO: 1632 - DNA, 47786 bp, Homo sapiens
ggttagtgatgaggctagtgatgaggctgtgtgcttctgagctgggcatccgaaggcatccttggggaagctgagggcacgaggaggggctgccagactccgggagctgctgcctggctgggattcctacacaatgcgttgcctggctccacgccctgctgggtcctacctgtcagagccccaaggtaaaaaggccgggaaagcatcttaatttagcgtgcagtctcagctggtcctgccattccagataaacagagaaaccattctgaattggggatgggggtgaggatgggaacaggagtctgtgtcctgctggggcaggccattggaagatgtgaaagagttgtctatttccttccaccggagggagacttcaggtcagccaggtgtctggagtatgaaccatgtatcagcaccgaaaggttctagaagtcagactttcgggcagtgtgtcactaactctcagcatgctggcctggctcggcccacagcaaggtcttctcgcctccctttgggtaaatactgaggggtgcctctgcaggacgggacctctgccagactccactccatacccagagaagcagggaaaccaaaattggagtcagccttgaggtgtagctgttgagccctcagcagctggggagagctggcggatgctgccctccccccagtttcctaatggtgttgtttaaaaagggtcaggggacgggggaacagatggtgggaagagcacagtgcagacacctggcaccggctctgaaggcagcatggcagctacaccgttggctgggaagggtgtgcccctgaagaagtcgtttacattctcgagtcaattttcctggagtgtacaatggacctgtgggaaagcctgtatgaaagggtaatgatgagggacctagcacagtgtccaatattttataggaactggaattgagctcataggagctcaattttattggcattgctgttgttggatggttaaaggggtggtatcccttttctcagactcccctgaaatgtatggtttgctttgaacccagagactgatgacaggtctgccggtgtggttgggtgcagccttaagttgctacgggaaagtgttggagggggagaagtcagaggtaaccttgccccctccctcaattccagatgaggaaattcaggcctgaaaagggaaagtgaccacctcaaagtctcatgccttggaggacccagcaggaatccaagacctctgaaaaggaccggcagggctcttgccacggctgggggtgtggtcatggtaacacaggttttccatccatggaaggtacctgagggattttctcttcctccctagggccagcatcagaggagtgaatagctcagttagctcatctcaggggccatgtgccctcggaggtggtttgccactttcacggttggactgagttggagagaaacagagacccacccaggggtggggacaagctccctgcaactcaggacttgcagatcacttgcccaagtggctccctagctcctggctcctggcccggggcctgggactctccccgaagtggggctggccactgtgaggaaccgactggaggcagggacctcttggatgccccaggcagttgggatgccacttctgataaagcacgtggtggccacagtaggtgcttggttgctccacagcctggcccgagctcagcgctgcagaaagaaagtgaaagggaaaaagaactgcggggaggcggggaggtaggatgaccagcggacgagctgccacagacttgccgcggccccagagctggcgggagggagaggccaccagcagcgcgcgcgggagcccggggaacagcggtaggtgaccaaagtctcctctgtaacccctaaggtcgggctgagaatcgaggctccgagactgtcagctacttgctcaaggtcacacagcaagtctgggaggatggggggatggaatatgcaaaatgtagggccgggaaacacctcgtttccagcatccccgcaacgactctgcgcgggaaccaggagccgggaacccggagcttggcttgctgtgcccagagctccggggccgtgggcgggtggcaggaaagcctggcggcagcttctgcagagaagccggagcgcagactgggagcgcggagcagacacactcccccggccacccttggccgactccgcgcgcccgggatcctgcagaggtgcgcgcccttcttgtacgccagactttggaccagggccgccgttccctgagcttcactttccctgttgggtcatattccatctctaactctggaatcttgggtattgggctctccaggcggggggccctgctcagggaggcagtagggagccaaacctttaaccagaggatgggataagtcctcaactctcgttgaacatcttggcgaaggtgtgtgttgttgggaggggtgggggagggatccccccggactgaaccgatctcttgatctctcacttctctacctcgctttggggccctgagtcacaccctctaaggagagaggctaaagcgccccggaaagccagcgtgcgaatgccggggtgggagtgggagattggatctccctggggtccaggaaagccggaatcggagccaccatgcttagcttagtctggaactcttaaaagccgcggtcctcctgagtcccacagcccctctccaccctaggtggcacaggagaggtggcaaaagcctagaagttcaaggcatggctccctccccagccgcagcctggagtgtctaactttggcaggaagtcttccgtttctgctccccactccagagaaaaaataaataaatacttctccggagtgagattaaggaaacaggtacttcttcctcttggagaaagaggagccaaaggaacttgactccaacaaatgatcaccttgcaaacccccggctcccttaggggatgacctggtctccaacaatctcagagcgtttggaggcagggtctttggagatgactgagtggggaatcccaggctccccacacatgaacatcacctgggatgatcaacctgttcaggatgtaggttcccgggctcacccccaggcccggttggctaggcctggggtgaggctgagatcctgcaggttaaaccatctatcccaggtgactccaatgttcgtttgtggggcaaaagtccctcaagtcagagacactgggaggcgctgatgtggtctcatctctttactctctccctgttacaaaacctctatcagaaaaggagtaccaggaggtgttttgttttgttttgcttaacgccacatagcaagcagtttgcagacgcaggatttgaaccctggtctactgagagcccagcccagtgcagcaagcagatgtgaacctccacaaatgcagggcaggtcccaggcagtcagagagaaacctgttgatacccagtctgtctgatggctggggcttggtttcatgtcctaagacccagcctcagataccttgagaagagcagaatcagaaattaacccaaggaaactctggattagttccaggcaatcagggaagtggctggagggaggtaggaaacttctggacttagcctcagatttgccttgagtcacactgacaagtgacttcccctctctgaggttcatctgtaaaatggataaaacatgagagcttgcttgatgatgtctgatgtgtacagaaaaagcactttagaaaaccaccaaagaatattcatgcattgggaataattattatagatcctaaagggattgtttagaaagatcagagaggggccgggagcagtggttcacacctgtaatcctagcactttgggaggccgaggcgggtggattgcttgaggccaggagttcaagaccagcctgggcaacctggagaaaccccaactctactaaaacacttttttgtgttttagccgggcatggtggtgcacacctgtaatctcaactacttgggaggctgaggcacgagaatcacttgaacccaagaggcggagtttacccgagaggtggaggttacccgagagctgagattgcaccactgcacgccagcctgggcaacagagcaagactgtctcaggaaaaaaaaaagagagagaaaaaagtcagagaggaaagcataggcagatgggaggtttccaaagaccaagacacacacagtcaaaagacagttcagaaaggggcattagttaccaccgattctcataggaaggacatagatagttttcagattccttcaatccttctgacatcaaggacaaagtctctgattttccctgatgtttgacagtgccctaatgcttgctaagatttctttttaacaaagtggtaaagaagctgagattattttagtaacattgtttctttttcaaccacaagtgatactgttggtttggttttgcttttccgtttatacatggaaaaaaaagttttctttttgtaaaatcatggtaaaatacatataacataaaatttaccattttaaccactttcaaatgtacatttcagtggcattaaatatttcaaactgttgtgcaacctccgctaccatccatctccagaactttttcatcctcccaaactgaaactctacccaataagcaataactccccactgccccttccacccagctcgtggtaactccaacttcctgtctctatgttttgggctactctagacaccgcctataaatagaattacgtgatatttgtctttttgtgcctggcttctttcacttagcataatgtcttccaggttcatccatgtcgtgccatgtgtaattcctttctatggcggaatagtattctaatatgtggatatcccatattttgttcatccattcatttgttgatagacacttgggttgttcctacctcttgactattgtgaataatcttgctaggtacatgggtggacaaatatctgtctgactccccgctttcaactctagaaagctttcttttaaaatcggtctatttaagtttctttaaaaagttaatttaagaaaaatactaaggtaaattgtagaacaggtgatatgtcaatatgaccccaaaaattgtaaagatggaagacgaatgcctgcagtttgggaaaccggatgagaggaaagacctggaagctattgtaaaatctatgctgagggtctggtgactactagaccaagggcatggcagcagagggcagctgaaagacttcaggaaggaaagatataagaattaagaaaggggcctggtgcagtggctcatgcctgtaattccatcaccttgggaggtcaaggcaggatgatggcttgagaccaggagttcaagaccagcctgggcaacagagcaagacctttttttaggaaaaaaatatataaattaataaaaataaatttttgaaaatacagattccaggccgggcatggtggctcacacctgtaaccccagcactttgggaggctgaggccggtggatcacctgggatcaggagttcgagaccagcctgggcaacatggtgaaacaccgtctctcctaaaaatacaaaattagccgggtgtagtggtgcatgcctgtaatcccagctactcggtaggctggtggaggagaatcgcctgaacccaggaggcggagattgcggtgagccgagatcacaccattgcactccagcctgggcaacaagagtgaaactccgtctcaaaaaaaatgaaagaaaatacagattcctgggcccggctgcagactccctgaatagaatcactgggggtgaggcccaggacgctgtgtttttaacacccttcccaggtaattctcactcacagccaagcctgccgatggctggactccgtagtcagatctcagcaagcaggactggctcgtggttcatcttggggtctccagcacccagcagagtgctggcggggggactgtgttaagtagagccggatgggtcaggactggagtgtggggcctggctttgctaactgcagtcacaagatcctcatcactccaccccctaccccagcaccagggtcaggttcccttccaggaaaaacttgttggactcctttccaggtcattgactgcagttaggagtggcatgcagaagggaggctatctggagctgggacagaccaggcaagcggggaagggaactcttatcccaaccctgcattctggacagggaccgaaggtctcctggctgcagctcatacagctcatcttcattctcatcctgggaccaccaggcccctcacccacaataactttaccctttactggcaaatgcacaagctggagatgatggcccattcgagttttaagattttccaagttgttatgaggtcagtgtcctcaatcgggacccagagaagataggtggcttgcctgaactttcagagggggcatctgtggtgtcttttgtggggtcctgtaggatttccacgtccctcttggaggaaaaatagaagtaagttgtctcaggtcagattgtctgggaagccaagtaggagatggagatttgcatataggaggtttactggggacattcacaggagggaacacccgaaggaaaagggaagaaagcagggttgggaagcagcaggagttgaggtgcaatgcagtcacaacagaggtcttagccaatcccatagggagcactcaagctgggacagcaaggaagctagaccttcacatccctcatctacctccgtcctcccatacaggcatagcctcccccatgatgaacactcagcaccagactgatacatttgttataatcaatgaacctacattgatgcatcattattacccaaggtccatggtttgtttacatgagggtttactcttggtgttgtacattctgtgggtttggacagatacatgatgtaatgtatatgacattatagtatcacacagactcatttcacttgtgactgagcttgtccttctttctttaacctgcctccaactgctgagaagccctttggctagggattgcagccaattttaatttgttttccactttcctgctctgaagttactttgtttgccagaggctggttggttcaaacccaaagggcagggagctgcaatggaaatccattcaacggtgctggaattgggatggcaaaaaggagcagcaggcaggtgtcagcagggagcagctctttgcatcccacagttcccagggagcttaccattctttcattcattcattcatcctttcatttatgagacaaagtctcactctgttgcccaggttggagtgcagtggcacagtcattgctcactgcagcctcaagctcctgagctcaagccatcctcctgcctcagcctcccaagtagccgagactacaagggcactccaccacacccagctaatttttgtatcttttatttctgaagagatggggtttcactatgttgcccaggctggtctcaaactcctggcctcaagtcatcctccctcctcagcctcccaaagtgctgggattacaggtgtgatctcagacagcttacctcttaatcacctttccatctgagctggcagcagagctgggaaagtgcacccaacaccccagatgctgcaactttagtgcttcctgctccttctctgtgtggaactggcctgtttgggtacccagggccagtcccctccaagaccctctgtagaaaaagaccctactgtacacctcaattccattgcaggacaggacataattgaatcctgcctctccctgccccagtcacccatccctcccaagccattatcttgggacctgcaagggcctccaagccaagggtggcaaatccaaataccaaaggggccataatgatgtaaaatgtgtccaggcagaaggcaatagggagtagtggggcctctggtaacaattgtgtgtactctatatagagacattgtgatggtgatttagacacacacacacttatattggcttgggaaacaaaacaaataggcctatcgactggattcaacttttgattttgcagccaagcccctgtggcacagctgaggagcttgcaggtcagaaaggggatttagagccaaccaatagcaatatctccagacctctcctgacacgaagctcatctgacctcctgcccccattacacacatacacatgcacacacatgcatgcaggcacatgcacgcacgtcttctagtctccctgccttgaggacaaatgatcagatcctgcaactgtttccaggcccataagcccctgagcattgcagtgttgctacatgccttagtttcctctccgtctcctgtgacctcctcgtgccactccaggaagtgaaagtcttgagtgagaccagtagtttctcttaagtcctctctctgtctcgttctcctgggatatctacacttggtttgcaaacagcaggctggagagtgaggggcttcttcctctacatccagctcctcccccatcctgctccaagtccagcatgttcctatctcttccccaggaccctgggctcttgggcacaaatcaagccatcaccagacagcctgtggggtggcaagagcagaggtttgtttctttgtgaacatctataggtaccaggctctgtgcaggccctattgttggtgagccatagaggtaccaacctcaccccatgaatcctcctttgtttcttttcttttcaacccctgggcctttaaaccttcgattaactgcccagtgcagcccaggtcatggtacactatgatctttggttcacatgagggttttctcttcattaatgtccctatttcccatactgggtgcccattctaatgcatttcaggtgtatctttctgtttgtatgtgctcttataaaacatgttttgccttttttttttttttttagatggagtctcactctgtcacccaggctgagttttctatttttagtagagatggggttttaccaccttggccaggctggtctcaaactcctgacctcaggtgatccacccgcctcggcctcccaaagtgctggaattacaggtgcgagtcaccacgcctggccacagtttcttacttttgcattctgtactatgtttttaggatctacttgccttgcttctgatgcatttgatctttgcttctaatcacggacattgttctctatggagtgcaggggttacttttcacctgtccacacccccagtgatggacacctaggtgacctccaactctctgtcaccacaaataacacagcagtaaccatcctcagatgggttctcctggggagttgtgggaacatttcttcaggatatatagacccaagagctgaattgccaggtggtaggatctacatatccttagatattctacatgatgccaggtcgttctccagagcggccccatccatctacattcccacaaacccgtgtaaccaacacttggcatttcccagatgtctaacttttgccagttgtacagtatcaagtgtcactttgctgttttatttttggagtttacatcttagtaccacttactcgctaagtcactttaggtaagtcacaacaacccagtgacataagcactgtgccaacaaaatgcagtcgattctgtgactcagagaggttgagtaacatttgcaaagtcacacagcaagtgtggaactaagatttgaacccagagcctgcacccttaaccactatgctattattatgttttgtctctctcctaaaatatcatctgggtctacattgcaagcctctttggcagggactgtgtggtaaacctctttggggccagtaaggaactgagctcagtgactttcttacggggtgctcagtgaatcattgttttacagctttagaggggaaaagtgagagatgtttcttagagtttatctggaggactacagggtgcatgagcaaaagcggaactcatttgagctactacccccacaaagaagctgtttggggtctggtcatggtagataggcattcctaggcccctggcttcccaacaccatttggcccccggaagcagcttgtcatgaggttggggagcaggttggtgttggggggggccttgggggaaaggaaaaggagaagactgccaggcaacgaggaatcagaatctcaaaaagactcaattgaaggggctccaacactcgttgaaacggaggctcagagggctaaggtaatgtactcaggatcaaaggcagagcagaaactcaaaccatgtctctaggcacacagttcagaggtcttcccattattcctcaggaggagaagttcatggtcaagagtagggaagtattccttctcaagctttttttttttttgtctgagacagagtcttgctctgtcaccgaggctggagtgcagtggcgtgatctcggctcactgcaacctccgcctcccaggttcaagcaattttcctgcctcagcctcccaagtagctgggattataggcacccaccaccacgcccagctcatttttgtatttttgcagagacggggtttcaccatgctggtcaggctggtcttgaactcctgacctcaagtaatccgccagcctcggcctctcaaagtgctaggattataggcgtgagccaccacccctggcctccttctcatgctctttaatcacagttcagagcagtgctggaggcttttaggggtagcaaaagagccttcttctccctttcagtgcctccttagaccctcaaagatagactccccgcctctgggaagaaaacatctaatgaactggacgtaatctcagcgcctgcgtctgtaaaatggctataataacaacaatctcccagagttgccgttaacagttgaaacagaatagtaaatgcaaggcatctagcacagccccagacacagagaaatctcccctggtcactctcacagaggtaagaagcacattaataataaaaatggtcatcacgcatattgtactcaccatgcagaagttgtgctgccttaagctactgttcattgagcacttactggtcgccagtcccctttctaagggctccatgcaacttaactcccctaatcctatgagttgccaattattatcccccactttacagataaggaaactgaggctccaagtggtttaaaaaatgaacttacccagattgtagtgcgttggtaggtagggataacctgaaagttgggaaatttcaccccaaagctcaccatctgagctccattcatctcccaccagctgagatggaacgttatgctgttcccagaagagatgcatgcactgatcttcagatagtttaagtctgagttagaacattgtggcgacacctgatttccctcgggggagagagaggtgaattgttatttcagacacctgtttagtgtctacacttagcctttcaaatcctgcatgcagtgtgaagtggggatgaaaataaaccccaaaaaggacttttgatggcaaaaagatcaggaatattttctcgagttggatgtggaaggtggtggcccagggggaagcacagtttcaaagaggaccttctaaaaatactgcccatttaccaaaaagacacagaccgcgcctctgccctgcccccacatggctcctcaaaaggagaaattgtcttgccacccacgccttccctcgccggggtgctggggggccaacagcaattcaaaaaggctatagagtgggctgagactttggagatgggtagtttggttcaaatctcagcccactaatccctctgagcctgtctcttcatctgaaaaacaggaatacaaatagctgatgtgtaagttagaccaaatggggtaatgcctacgagtcatgtcatttggtacctggcacttgctggacactgtgaattctagttctatatcattgccacggatgaagagaggctgccatgcgcagaaacatgctgagagctgggagaaggtgagctagagggatacagtccctgccctcagggagagctgaagggctctctctcctgccacgggatgatcagggccatcttttccctccatcccgctctggcaatgtggtttggagaaacagtccaatgaaggggcctttgaagcacttcctaagcatctatagacataggaaacttggctctggggatagaggaaggtcccatgccaagattcaagtagatcttggtgtgactgggaggcagctgtggcgttgtggggaaacctagagtcttgggcctgaatttcagctttgacaccctctaatgtaatgggcttcctttgactgtaggcttcccacatagctggcaccccacacagaactcccttggccttctgatgatcctgcaggacaatcttttttgttttttgttttttgttttttttttgagatggtatctcactttgtcgcccaggctggagtgcagtggcgcagtcttggttcactgcagcctctgcctcccaggttcaagcgattctcctgcctcagcctcccaagtagctgggattacagaagcacgccaccatgcctggctaattttgtatttttagtagagacgggatttcaccatgttgcccgggctggtctcaaactcctgacctcaagtgatctgcctgcctcggcctcccacagtggtgggctgcaaggcaatcttcattctccagaactaatattgggaaaactgatgttcagagaggtcaagtgacttggctaaggcatcacagccagaattcagatgcaagctcctaaaccacatgaccttggacaagccatttcactgaggcgtgtgaacctcctctaagctcaaatgggcataacactctaccctgccttttccccagagctttttgggaactcagatggtgtggaggatggaggcagaagtccactgtgagctgcaaatccttgatcacccaagaggaagtgcttaaggtgcaggcttcagtcttagggaagcaggaagtggggcgctgaaatgtgtattgggggcttctgggagggggtttcttcttgtccaggttgagccaatgacgcagatcttaggccctctggtgactttttgcccaggcaacttctcagtggtggtgatggggagcgtggccagaccatccaagctgccctgctggctgtgggggccttttttttttttctgagacacagtctggctctatcacccaggctggagtgcagtggtgcaatctcagttcactgcagccttgacacctccccaggctcaagctatcctcccacctcagcctcctgagtagctggttctacagatgcacatcaccacgcccagctaagttttgtgttatttgtagagatagggcttcaccatgttgcccaggctggtctcaaactcctggactgaggtgatactcctgccttggactcccaaagtgctggaatttctacagatgtgagccaccatgcccggcctatggggcccttcttgttcctatgaagtctgcagggtccccttatgcaaaagaacagaaagctcggcttcacaaagtttgacctcggaagaaatggaagggaaagggtccctttgtcactctcacaaacgtaagaagcaaactaataatgatggccatcacacatattatactcaccatgtagaagctgtgctgccttaaacttctgttcattcagcacttactgattgccagtcccattgctaagggctccgcgtgacttaactcccctaatccttgtgagttgccaattattattcgcattttatagatatggaaactgaggctccaagtggtttaaaaaatgaacttgcccaggttacagtgtgttggtaggtaggggtagtctcaaagttggtaaattttacgccaaagctcacgatacttgccttctttcccttctcaatttatttctctgactgtgtgcttaaccacacagcagtgtcatccagagtttgaagcagagctcatcaataagtgggggtgggctaaatgtctccaggctcctccctgcggtccctcccaccatcccccatctgtgataccacctgtgtctctatgcttgagcccagacaggacaagggtgatcatttcattgggaacattttgactggggggaaagagcaccagcctgggagtcttggcagggggagtgggggagaaggggcaggggcagccaccgacaggctatgaggtcttgtgcaagtcacgtccttcccggggtctcagtcttgtcatctgcagagtgaaggaaagaggtcaagcttgaaggtccctggcagacccaatgccctgtgagaaaactgagtttgggtaacttattattttatagatatggaattatcttatagaaatgttatagatatggaatcattttatagatatggcccaaagtccaaagtcacacaactcattcacggagttgctaggatcagtctggagctcttgtcacgagatcacactgcctcaaagaggaggcagattgctgcaatgtaggttcttaataaagagcatgggtggaatgggaggcgggcatcaggcaggagctggggcaaaggtgtcttttctcactgctctgagagaacagattttgtgcctgtgtccctgaccaaggggctgggagaggtggagcatctcacccccaaccatctcccagctttggccctgctccaggaaaagggcggtggccccatctttcagttctgcttcctctagtcatggttggctgggatctcgctgcaagccggttatgtttgggttcctgcagcccccgctcaaccgtcatgaacaagtgggcccagccagtgccccagcttggactggaaagatcattctctgtgacatccgggggtctgtgctgagcctctccccaggcagtgaaagctgtggatgcgtgaaagaaaatgggtctctgggccgggtgtggtggctcacacctgtaatcccagcactttgggaggccaaggcgggtggatcacctgaggtcgggagttcgaaaccagcctgaccaacatggtgaaaccccatctttactaaaaataaaaaaattagccaggcatggtggcgggtgcctgtaatgccagctacttgggaggttgaagcaggagaattgcttgaatccgggaggcagaggttgcagtgagccaagattgcaccactgcactccagcctgggcgacagagtgagactctgtctcaaaaaaaaaaagaaaaagaaaatgagtctcaggaatggggtggcaagttgagtgtgtgttttctcatgagcttactcttcaatgtattctcttctgggcccagaacagggcagtaggagcctccctctggtcttccagcttcagggccagctctcctcttacctcctccaggaagctccctctgtttctttccagccttcatctgcatgtcatgtgtggtgggttgaaaggtggccccccaaaagatatgtccatgtcaaatccctggaacctgtcagtgtgactttatttgggaaaagggtctttgcagatagaattaagttaaggggctgggtgcagtggctcatgcctgtaatcccagcactttgggaagctgagattggaggatcacctgaggtcaggagttcaagaccagcgtggccaacatggcaaaaccccatttctactaaaaatacaaaaattagctggtcatggtggtgagcacctgtaatcccagctactcaggagactggggcaggagaatcgcttgaactgggaggtggaggttgcagtgagccgatacagcgccactgcattccagcctgggcaacagagcaagcctctgtctcaaaagaaggcaaaaaaagaattaaagatcttgaaatgacatcatcctggattatctaggtgggtcctaaatccaatgacaagtgtctttataagagaaagagacttgctacatgaggagtaggtgatgtggccactaaagctgagtttagagtgatgcagccacaagaccacaagtcaaggatcaccagtagttcccagcagctagaggaggcaaggaagcattctcccctcgagcctccagaggcagcgtggccctgctgacaccttggcttcaacttctggcctccagaaccatgagagaataaagtgctgttgttctgagctacctggatgctggtaccttgtttcagcagccctgggaaatgaatataccatggaaacatggacctgaaccacggatcctggcaggagccttagagccacacagatgagccttcagcttggctttccccagcaagagctacatgatcttgaggaagctgcttgtcttctctgggtctcaagttcttcatctgccaatggagacaataatgcttacttcctaggttttaacagctttattgagatgtaattcacatatacaatttgcccacttaaaaagtacagttcatgcctgtaatcccaacactttgggaggccgaggagacaggcggatcacttgaggtcaggagtttgagaacagcctggccaaaatggtgaaacactgtctctactaaaaatgcaaaaattagccgggtgtggtggtgggtgcctgtaatcccagctgctcaggaggctgaggcagaagaatggcttgaacctgggaggcagacgttgcagtgagccaagattgcacccctgcactccagcctgggtgacagagactccgtcttaaaaaaaaaaaaaaaaaaaaaaaaaaaaaagtagagttcagtgttcttttgggaatactcagagagttgtgtgaccatctcccatccccacagtcaattttagcacatttcatcaccccctaaagaaactccagacccatcagcagttgttccccatttccttccaaaatccctctctgccaagccctaggcaaccactaatatgctttctttcttaaaaaaaaattaatagagataggcttttgctatgttgcccaggctggtcttgaacacctgggctcaagcgattctcctgtctcagcctcccaaagtgctgggatttcaggcatgagccaccacgccccacccctcctactttatgtctccatggatttgcctgttttggtcatttcaaataaatagaatcatacaatatgtgaccctttgtgtccggcttcttcacttagcattttttttaaggttcatccatgttccagcatgtatcagtgctttctccctttaatggtggaatactttattgtatagataagcaacattttgtttatccatttattttttggtggatatttgggctgtttttatattttggctattttgaattatccttctgtgaacattcgtgtataggtttttgtgtggatatatctggtttttcttgttttcttttgttttattaatacataatatgatacatatttatggggtatatgtgaatatttattacatgcatagaaggtataatgatcatgtcaggatatttgaggtatccacatttgggattgtttaaagattaaatgaaatagtgttaaaagtatttaatatgcccttcaacaaatgatgaggaaatcttagaatctgctcagactccttcagtttacatattaggaaactgaggcacagaaaggagcagagacttgctcaagtccacccaaagcagtagagcattgtggttaaatgcaggacttcagtcagactgtctgggttcaaatcctggttccacttggacatgggtttccttacataaatcacttcacctctctgagcctcagttttctcatatgcaaagtgaggataataataataccttccttacatggttactgatatgagtattaaatgtgccagctcatgtgcctggcgtataggaggtgctttataaaccttagctgttaccactcatggcattgccaaatgtgggacgggtctcctgactctctggtgtgagattgatggaatccacactttccagttcccttttctacctcctgggtatcttctcatatggttgtaagttccttggaggaagggaatgtggcttgctctctccaccacgctgagcatataagaggtgctgaatgagcgcttttattcactcctctcatccccagccctcaccagctgggagttgttgtaggtgtcaattttctgcctctttccaacaccctgtgaggtgactgagcattgtcttccctcccaggcagctcacagtgtgccaccatggagttggggcccctagaaggtggctacctggagcttcttaacagcgatgctgaccccctgtgcctctaccacttctatgaccagatggacctggctggagaagaagagattgagctctactcaggtgggccctcctccctctggtctcttccggtatcccccacccctcagcttgctgtagagacggcaatcaggggaaattctggtccctgccctcccgtcagcaccacggacagctcccacgtctgtgggacgctctctgcagatggggatgatctcccagccctgccccgcctctccctcgttccccaccagccctctttccagaaatttccttcttcatccaagggacttttcctcccagaacccgacacagacaccatcaactgcgaccagttcagcaggctgttgtgtgacatggaaggtgatgaagagaccagggaggcttatgccaatatcggtgaggaagcacctgagcccagaaaaggacaatcaagggcaagagttctttgctgccacttgtcaatatcacccattcatcatgagccacgtcagtcccctcccacagaaatcattgcaagggggatgcggagcaatggctggaggaacggagactccagggaagagaggggagatggaggccagtgggggaaataggccccttcactaatgaccaccaagaaaacaaaatctcatgtttacatcctccacctccatttctatacgcatttctgcttcttgctcttctgtccatcctttctacaaagcccataccatacacccctttcccttttcctcccagctccttagccaagctactctagtatttgtaataactagcatttactggatactcatagtatgctcattgctgtccatacattatcatctggaatccttacaacaacaaaggaaatacatattattagtttctgtcttttacaaatgaggaaattgaggtttagagaggtgaaacgacctacccaagtttgcattagagatagtaatgtacagatctgaaattctaacctaggtctttctcgtttcaaagtctccatttttaaccacaaaaaaagaaagtgtctggggttggaagatttgctaaggcttaagcagagaagctaatttgtagccttaagaagagctacagctttcagacaagggcaggactcttggggagaggtggtggtggtgttgctgctagtggtttgttttttgggggagagacgtgggatagagaatctcttctcaccagcatcaccaccacctcatacagagcctatgttgaaatagaaaaaagtggcctttttctggaggatgcagcccctaccaggaagtaactgcttggctagcaaagtgcaagccggagtcctgcccccattttccttgttggcttgggcacctgtgtgcagtgaacaacctgcaaaactcttcttagtggtcttcttcctgccaacccaggaacagcagcattcagcagttctgtgcttgatccaaatgtggccaatttttccccagagcacagtgtattgaaaatcataccaaggaagaaaatggaggggactagtaattgttcatgtttcagaaattacagaactgagagcttgactgcttccttcccttcctggggatttacatgggggaagcagaagtgattggggctgaggacattcacatttcctcacaactggaggcagtcattaaggatttgggcatgtcataggatttgggtgtttttctccccccttagtggcatctccacaggcagcgaaagctgtctaagcaaataggtgaggcagtgcgttagtccattttttgttgcttaaaacaacatacctgacactgagtaatttataaagaaaaaaaatatttcttacagttatggaggctgagaagtccaaggttaggggctgcatctggtgagggccttcttactggtgaggactctctgcagagtcccaaggcagtgtggggcatcacgaggcaagaggtttcggtgtgatagtctctcttcctcttctcataaaaccactagtcttactcccacgacaacccattaacttattaacctgtttatccactaatccatgaacggattaacccattcatcaaggaaaagccccagtcacctcttaaaggccccacctctcaatactgccacataggggattacatttatacatgagttttggagaagacaaacattcacgtcataacaggcagcttcacccaagtctgctcctcaagtctgtgggttttctctctgcttctggaaggtgaagcccaggcctgggcaagtattcttttgcagcatcctgaaatatgaccttagcttctaaatgtgtaaaatggagataataatcacacccaccatcacgggatggttgtaagactgaataagttacaatgtgtaaagcatttagaaaaggaatttgcacagagtaagcattcagtagatgttaggtactaccccacaaccaccgttatcattattatcaccatcattattatcatcttcattttcatcaccttcattatggccatcattccattcctcagctcagaagccttctatggctccccattgcttataaaatcaagtcctaactttccccagcatgaaacttctaccaccgtcacctatctctcagggtttcctaaacatactctgaacaagtttcctcactctgccactgtgacccagaaagctatctgttctccttctcccagactctgcctcatctttcaaggcctggttccaggatcccttcctccaggaagccttccctgattgccctattccaccatacaccttttttctcggacttcatgtcatggtgcctatattccaagggctctgagccatgtacccctttatatagttaccactatttactgagtgcctactgtataccagctactgtgttggatgctctagatgtagaacctctaattatcaccatcgattcctgggtagtaggcattatttattcatcttacacagatgagaaaatggaggcccacagtggttaaataagtagcccaagattgcacagctagtagggctagtggaaagtagaggtggaatttgaactcaaatcctgcagtaactctaccattctgccttgctcttctttgtagcagtagataagttttcatggatacatacctcatccttttgattagattaagggcccctggagtgtcagtgttcattcatttgtttgatcattcattcattcaacaaacatttcttgagtccccactgtgtgccaggcccagaggttccccagcccaaggcctggcacacagtgggccttcagttagaccttgttgattgactgcgcttttccttgtctgggcagcggaactggaccagtatgtcttccaggactcccagctggagggcctgagcaaggacattttcagtaagtttgtggtgggtggggaggtcttggctcagcctgcatttcctgccttgttccctggggggtgccctaatacctgacgaccattcattgatgggcagtcagacccctctccccaaggtgggtacaatagagactcaccttgggctttcattgattgtgtgagttggtctctggtttttctcaaagtagagcacataggaccagatgaagtgatcggtgagagtatggagatgccagcagaagttgggcagaaaagtcagaaaagacgtgagtgagcccctccctgatccaacctagccttgcttgagacctggcctttccttgactccaaagcctgctgtgggtccaacttgcttccctcgctaagtcctgtctggttgggaggccctttaaaagccaacaggagccttaaaatgtacatctgattatttcatggccctgataaccctccaatggctacaaaatacatgccacaaggcctgtatggcccttcctccctctccaaacccactatgagacaccacacttcagccaccaccagcttctccactcctataacccatgtgccctttcaagcctcggggcctttgcagttgctatagtctctatctggaatgcccttcccccagttcttcccatggctgactcctttgaatctttctggtgttggctaaactgtcacctcttcctggaacccttctctgaccatccttccatgtagattagctcagttattctcaccttgtgtgtctttttccttgcagtttagcactcattaccatctggacatattttacgccttgctctcccactgtgaggacagggaccttgtctttcttgctcgtgactgtttccccagcatctagtgcagtgcctggtatgcagtagcacctcagtagatatctgttgaatgaaaacatctgtaaaatgggtgtaacagttaactgagtacttattatgggtctgaccatgtgtaagtcctgtatctatttattcagttcttaaacaggtgaatcgcacacagggtatgagattttaaaagtgcaaagaatattcagtgaaggctgggcgcagcggctcacacctgtaatcccagcagtttgggaggccaagggggacggatcacttgaggtcaggagtttgatacctgcctggccaacatggtgaaaccgcgtctctaccaaaaaatacaaaaattagccgggtgtggtggtgcacgcctgtaatcccagctactcgggaggctgaggcaggagaatcgcttgaacccaggaggtggaggttgcagtgagctaagatcacgccactgcactccagcctgggtggcagagtaagactctgtctcaaacaacaacaaccaaaagaatattcagtgaaaaaaaaatctccctcccactcctgttctgtagtccctcagttttgctcctatcttagtcaacctatgtgaccagcttcctttttgccttgtcagaaataaagcgagctcctgtatttgctttaattttccatgcaaatgaccacattttatttacactattctgcattttgctttcttcatttacttcattactccctgtctgggaggtcacgttccatattattgagggagaggacacggtcctatcttcagcagcttctttattttctttcttttcttgtttttcttctttatgttttcatttgataaatatttccccccaagattttattgtgaaagttttcggccaggcgtggtggctcacatctgtaatcccagcactttgggaggccaaggctggcagatcacctgaggtcaagagtttgagaccagcctggccaacatggtgaaaccccatctctactaaaaatacaaaaattagccaggcgtggtggcgaacacctgtaatcccagctaccagggaggctagggtgggagaatcgcttgaacctaagaagcagaggttgcagtgagccaagattgcgccagtgcactccagcctgggcaacagagctagactctgtttcaaaaaaaaaaaaaaatgttttcaagatacaataaaagtgaaagaatggtactatgaaggtccatatacccaccatgtaccattttgattctacaattaatgttgggttttattcatcttatcacatctctattcatctgtccatccctctatccatccacacacccattcattatatttttggtacatttcaatgtacatttcaaatgtaaattgcagatttacactcccctcgtgtacttcagcatcctttcttttaaggccatgcagtgtttcgttgggtagatgaaccataatttgtttaagcagtcccttgctaagggacacgtgggtttttaatctgttgctgtgagtgcttgatactcactcactgatttctggcatactcctgcaatgtaggaaccaccacccccatttcatagatgtgagatcaaaggttcagagaagctgcattgcaaaggcacacagctaggaagcggttcaaaagcaggttcctttgttttgttttgttttgttttttggctcaaacccatgttgtgtccccatttgtgactcggcctcttctgctgctacactgcctggtatggtttgagatggggtttgggttcaagccaaggagctggggttggaatgttagagcgaggggaggaaaatggacccccaagaccactacccagccttgaagttaaggccgtatagcctgctagagtcctgagccccttctggcttgggacatcctctccctggggcagctgatcacatgttttctctgcagccttcccagaggagcttccggcagacctgaagcactggaagccaggtgtgcagggcaggtgggctggggttgggaagggtggatgccttggggaggggatggaagagattgaactcctggcccaagtctgatggggatggtgcatggtgcagcccctgcccttctttgggtagaggctgagagcttggggtcccttagagtcctctaaggggctcacgactgtttgtggaaggtggtaggggcttggagctaacagattgttcataggttctattctgccccagctctccgtgtggaggccctagggtcctgctcagcatagctctcagagccaagtcacaaggagaggactgggggactgcctggcacagagcagttgctgatcaacacagctgcagccagggctgagaagatgacaagcatttcctctgtcaggagagacatccatgccactccagggccctccccatcccaggaaggcccctccaagcacccagtctctaacacagcccacttcctcacagctgagccccccactgtggtgactggcagtctcctagtgagaccagtgagcgactgctccaccctgccctgcctgccactgcctgcgctgttcaaccaggagccagcctccggccagatgcgcctggagaaaaccgaccagattcccagtatgttagggggcttggagagagtgggctttctccctcttgggaggtggataaggagttgacactaaggcagggactgtcaggaactggacctcacctctccccaaccctatcagtgtcactcacctctgccccagccagttttatccttggggcccccgtcagctcaatccctggcagagaacatgcctcagaaggaaacacatccgtgcgagcatcaggagggaatctccaccaattagagcattcacctgccagccttattcgttcatcagctcttcatggagccccttctctgtgccaactgctctgctaggtgctaagaattccatcagggcaggacagaaacagctactgctcttagggaaattagggccctttaggggggtcagacattaatcaaataagcaaaagcagaatcgcaaacacaggtgctatgcaagatcccacctcactgcctttgtctcttgcagtgcctttctccagttcctcgttgagctgcctgaatctccctgagggacccatccagtttgtccccaccatctccactctgccccatgggctctggcaaatctctgaggctggaacaggggtctccagtatattcatctaccatggtgagtgcggggcctggctccccgaccacctctccctcctacctgactgctccctgacctcatcctccccatactccatgcacttggcagtggtgccctagcaccttctcatgatcctccctccccagcacaactttctctgtccctatttcccaaaaatcaaagcagaagagcagagattcctgaggtggtctgggtgcatgaccaagagtggttgtgtggccttccatatgttgctttccccttctgacccttagtttttccttattttttttaaatgtttttgtttttaaattgcaacatcaatacatgctcactaataagctaatgacaagtgatgtttacaagaattcactgtctctctcactcttttagtatactgatgtgaatagtttggtgtgcatccttgcatagctttctctgatttgtcttgtttcctaatcagtaaaatggtccctactgacccaccacactgaggggttgtgacttgtctcagggaaggtgtgtttgggctgtcagggatgagaccaggaggatgcttccactcaagtccagagcatccattcctggttgcaagacagtttcagtataacgcactggtatctcagaagcagagaagcagttcctgatatctaggaaaatgagcactgaccacacagcaggaagagtgcaatagtagtacctgccctaagttccttatgagctaattgcacccatttcacagattggaaaagcaaggttccaggagctagatgtaactccagagctctttcttcagctctgtcctgaaatatcttcctttggaagttctactctcttctctccagacttcctgagctccacagcccagtttggagtaggggtgacccaagtgcatttctggaatcaatacctggttattctcacaccactctccacccccaatgtaggtgaggtgccccaggccagccaagtaccccctcccagtggattcactgtccacggcctcccaacatctccagaccggccaggctccaccagccccttcgctccatcagccactgacctgcccagcatgcctgaacctgccctgacctcccgagcaaacatgacaggtaaggacccttagggcctgtgagaggtactagaagcaggatcgaggccctggggaaggaattgtctcaaataagatccacaagcaaagctgcctgtagggacaacaggtcatgtttaggggtcagtcgggacagggagggtctccagggagtggaggcatggttgtgggggaatggacagctagagaatccacatcccatccaaatacagccatcagccttcagctgcttgttacccagcagaaaagccagacaatgtggtcagatcttttgaagttgaaaaccctgatttttacatagatattgtgattttttaatttttattttattatttatttattgttgagatggagtctcactctgttgcccaggctagagtgcagtggtgcgatctcagatcactgcaacctccgccctacaggttcaagtgattctcctgcctcagcctccggagcagctggaattacaggtgtgcaccgtcacacccagccaatttttgtaatttcagtagagacaagtttaaccatgttggccaggctggtctcgaactcctgatctcaagtgatccacctgcctcgacctcccaaagtgctgggattacaggtgtgagccactgcacccagcctgatattgcgattttcttttttaaacatgagtgaaatttttaaaagtacagttggccaaagaaagacatatttgagttagatacagcctcaggccgctatcttataacctccatcttgggaaactcagcccatgaaggctgtaaggactaagtggcccagagggaggggggtccccaggggtaaccctcaccctaaatctggcacctgcttctccatctccagagcacaagacgtcccccacccaatgcccggcagctggagaggtctccaacaagcttccaaaatggcctggtgagtgatgcgggatctctctgccctgggtggtggagatggaagcccatatctggcttcacattgctcattcacttgacacttattcaaccccttctttgttggctcacacactcatttatttattcattcattcattcattcacttatttgattatgccatcatttcaccattcactccaccactccctcaaataatatttattgcccttcaataagcctgcactgggtgttaacacttcattgtcaggctgagagaatgaatgaggggcaagcgaatgatgaagtgagtgagtggatgaagtgagaagttgatgaggatgggagcaatggaaagtgggaataaaccagtgaataagagaattactaaattactaaatgcttactctcacatactggtctaagcatgttaggtatgctaaatcattaacatctcacacaatcccaatattatccccattttccagatgaggctactgaggcatggtgggatgtatagcatgctcagaattgctccagcaagtggtagaaccgggatttgaacccagacacgtgggctccactgtcttaactcttaacactccctcccatgacctccccatggtgagtgagtagtgatcaagcgaagaaaaagcttagtgagtaaatgaaggaatgagaaaagatggccatgcatggtgccttatgcctgtaatcccagcactttgggaggccaaggcaggtggatcacctgaggtcaggagttcgagaccagcctggccaacatagtgaaaccccgtctccattaaaaaatacaaaaattagccagacgtggtagtgggtgcctgtaatcccagctacttggcaggccgaggcaggagaatcgcctaaacccaggaggtggaggttgccgtgagctgagattgcgccagtgcactccagcctggggcacagggcaggatccatctcaaaaaaaaaaaagagagaaaaggtctaaaaggagtggacacttaaacaagagagacgatgagtgaaggaatgggtgtggaaatgagtgaactaatgaatgagtggtgggtgactgaatgaagcaaatgatgaagactgtatgggggccagatgtggtggctcacacctgtaatcccagcactttgggaggccaaggcggaacgattgcttgagcccaggagctcaagaccagcctgggcaaaatagtgagaacttatctccacaaaaaaacaaaaaagaaaaattagccaggcatggcagtgggcgcctgtagtcccagctactcaggaggctgaggtgggaggattgcttgagcctgtgaggttgaagctgtggtggaccatgattgtgccattgcacgccagcctgggcgacatagtgagaccccatctctacaaaaaaatcaaaaaattatctgggcatggtgtcacatgtctgtggtcccagctacttgggaggtggagtcaggaggatcgcatgagcccaggaggttgaggttgcagcgagctgtgatcacaccactgcattccagcctgggcaaaaaagccagaccctgtctcaaaacaaaacaaaacaaacaaacaaaaaaactgtgtggggaacagatgtaaatgatggtggcagtgctggccttgtggtggctggccctggccctgcctctcacatacccccaccctgacacgcccctggcctttgcagagccggtggagcagttctaccgctcactgcaggacacgtatggtgccgagcccgcaggcccggatggcatcctagtggaggtggatctggtgcaggccaggctggagaggagcagcagcaagagcctggagcgggaactggccaccccggactgggcagaacggcagctggcccaaggaggcctggctgaggtgctgttggctgccaaggagcaccggcggccgcgtgagacacgagtgattgctgtgctgggcaaagctggtcagggcaagagctattgggctggggcagtgagccgggcctgggcttgtggccggcttccccagtacgactttgtcttctctgtcccctgccattgcttgaaccgtccgggggatgcctatggcctgcaggatctgctcttctccctgggcccacagccactcgtggcggccgatgaggttttcagccacatcttgaagagacctgaccgcgttctgctcatcctagacggcttcgaggagctggaagcgcaagatggcttcctgcacagcacgtgcggaccggcaccggcggagccctgctccctccgggggctgctggccggccttttccagaagaagctgctccgaggttgcaccctcctcctcacagcccggccccggggccgcctggtccagagcctgagcaaggccgacgccctatttgagctgtccggcttctccatggagcaggcccaggcatacgtgatgcgctactttgagagctcagggatgacagagcaccaagacagagccctgacgctcctccgggaccggccacttcttctcagtcacagccacagccctactttgtgccgggcagtgtgccagctctcagaggccctgctggagcttggggaggacgccaagctgccctccacgctcacgggactctatgtcggcctgctgggccgtgcagccctcgacagcccccccggggccctggcagagctggccaagctggcctgggagctgggccgcagacatcaaagtaccctacaggaggaccagttcccatccgcagacgtgaggacctgggcgatggccaaaggcttagtccaacacccaccgcgggccgcagagtccgagctggccttccccagcttcctcctgcaatgcttcctgggggccctgtggctggctctgagtggcgaaatcaaggacaaggagctcccgcagtacctagcattgaccccaaggaagaagaggccctatgacaactggctggagggcgtgccacgctttctggctgggctgatcttccagcctcccgcccgctgcctgggagccctactcgggccatcggcggctgcctcggtggacaggaagcagaaggtgcttgcgaggtacctgaagcggctgcagccggggacactgcgggcgcggcagctgctggagctgctgcactgcgcccacgaggccgaggaggctggaatttggcagcacgtggtacaggagctccccggccgcctctcttttctgggcacccgcctcacgcctcctgatgcacatgtactgggcaaggccttggaggcggcgggccaagacttctccctggacctccgcagcactggcatttgcccctctggattggggagcctcgtgggactcagctgtgtcacccgtttcaggtggggtgaggggcttggggaagagacatccttgtgttgggcattaactgcggtcttggtgccaagcccagtgctctgtggggtctcttttagtatgcagagcagccgggtggggcagaatggattctctccatttttaagatgaggatgttgaggctcagagaggggcagccacttgccacacagcaagtgagaggcaatggcattctcccagtcaatatttgaaggcccgccatgtgccagtcactggggtatgtctagaatctgagactgacctgggctcaaatttgttttattctttccaccccctgagcacgccaccgttttcttatgctaagagtaaagccatggcctccccttggactctctgcctccattctctcctcttccactccattttgtattcagcaaccagaccaatcttctcagaacttgaatctgattgtatcccatccctgcttacaatccttcagggacactccaccactgtcaggatgaaggctaaattccttaatttggtttcattaagtcggtctgcaatctgcttgagcatttcagcttaatcgccagaggattgcttccatatttccccctaaacatactttacccaagctgtaaggtcctacataattgtgccaataatttagcagtgagcttcctggtagccgaagcaaaaagggaaagaaaaccactgtgtgagttgtgagaaagtaggaatcaataaaggctggagtggtcatggaaggctttctgggaaaggtagaggttgagctaaggaaagaaagtattttaataggtaggaggacccttcatggagctgcccttccattaaggtctagcctggtcaccgtgcctgggtctgaggccctccctccacagggctgccttgagcgacacggtggcgctgtgggagtccctgcagcagcatggggagaccaagctacttcaggcagcagaggagaagttcaccatcgagcctttcaaagccaagtccctgaaggatgtggaagacctgggaaagcttgtgcagactcagaggtgagaggagaggcggatgggaggtggttcacgccatgcaggttgaggacatgtaggacccattctcaagtttgtcatgggcatttccagtgccccctgtcctctgggacaccccatgccctctttctgggcaatggctaaccagagtctctcactgcactcgctgcccaggcggagcctctagaattgaaaactttgctgcattcaaaacctgccatcatgtgcccaagtcttagctaaagccatggagaacctctccccttctaggagttaacaaggatgccttgtgcacctagtaacagaagtgacacctactgccaccctttgaggcatttaggacaactgttgtcccaaatttatagacggcagagctaaggtccagaaggcagacaaaacttgattacagaacaagttaactgtctttcattcattccttcatcacacattgtttgagcgcctcttaagtgctgtctgggataggtactggtaagtgcctaatctgaggctcatttccatgaaagatacagtcctgagatcttttatttttatttttattatttcttaaagacagggtctcgctgtgtctaccaggctagaatacagtagtgcgatcatagcttactgtagcttcggaactcctgagctcaagcgatcctcctgcctcagcctcccaagtagctgggattataggtgcacgtcatcacaccggatgattttttaagtttttgtagacacagggatcttgctatgttgcccaggctggtcttgaactcctggcctcaagcaatcctcctgcctcagcctcccaaagtgctgggactacagtcacgaggcaccgcacccagacagatctttttttttaagagggggacaacagttgccccaaggaaagcaatccccctggggaatttggggcactggggcagccatcatgggacccatgggtaagggctcagtgacagcagtgcctgctccccctaacattgcctgttctctccaggacgagaagttcctcggaagacacagctggggagctccctgctgttcgggacctaaagaaactggagtttgcgtaagcaaaggggtggattgtcttgtgggtctgcgcaaggtttcccctgcagcattagctgggcttgtaccacctgaatggagatagatctccagaatcattcttaccctcttgcccaccactttggaaatagcttccagcagctggaaagtgaccagtgtgggcaaatgctggaggttctcagatttgaagctaatggacccgtttgctggttaacatggtcattcccatcactcattcaacagaggtattgagcacttgaatgactgaggctgctgtcctcatgagctgacagtctaatcaactcccctctggaggaggtcagggggacttcctggaggaggtgatatctgcactgaagcttcagtgaggataaggaatgagctgagtggggagaggggagtaagaaaggctttccaggaattgtaatttcgccagggatcagaaaaggcccaatgtgtccccaaccttccataggaggatgccactatgactatggagtccttttccctcctgtggccaggaactgcacaacgtcccttgtgcctgagcttgtttacttccacagccaagggatggcctccccagggagaatctttcccccattttgaaattcccaggagcttttgatgtgcagctaggatgaaaaagcaaccctacttgcctgggactatcctggtttgaaaactgaaagtcttgcatcccaagaagccccttagtcccaggcaaactgggacagttggttgctctatgtgtggccagggctgggggccacaccctaggcagtgttgctggggtgacagaaatggagacctaggcaaggctctagggagtccagttgtgtctgggtcactgaggaggggcagcccaccatacatgggccccaagaaagcacaataattattatatttagatctgtcagaatatagcttttctttctttctttcctttcttctctctttctttttctttctttcttctttctttctttctctctttctttcctctttctttcctttcccttccttttctttccttccctccctccctccttccttccttccctccctcccttcttcccccttttcttctttttctttctctctgtttctttctttctttctctctctctctcccttccttcctccctccctatctctctctttctttctttctttccttcttttctttctttcctttctctcctttctctttctttctttccattctctttctttctctttccttccctcccttccttctcttccttccttctttttcctttccttttctttccttttcttttctttcttgaggcagagtcttactctgtccctcaggctggagttcagtggcacaatcacagctcaccacagcctcaacctccctaggctcaagtgatcctcccacctcagcctccctagtagctgggactacaggcatgccccacctgactaatttttgtattttttgtagagacaggatttcaccatgttgcccagtctggtctcgagctcctgggctcaagcaatcctcccacctcagcctcccaaagtgctaggattacaggtgcgagctcccgcacctggccagaacaggcttttaaatttgcagctcaccttccatctcaattatctcaggccaccctcctctacaggcattgtcatcatctccccattgtacaaatggcaatgctgagaacaagagactttaaattgtttatccaaagtcataaaggtcaggtcagcctggccctaagctccttccacagaaaaagctaaatgaatgtttgttccttggtaggggtctagatcatctaatgattaggaaggagttgttatgcctgtggtatattcggtgctgtttttttttggagatggggtcttgctctgtcacccaggctagaatgcagtggtatgatcttggctcactgcaatctccacctctcggttcaagcaattttcctgcctcagcctcccgagtagctgggattacaggtgtacaccactacacctggctaatttttgtatttttagtagagacgggctttaaccatgttggccaggctggtcttgaactcctggcctcagatgttcctcccacctcagcctcccaaagtgctgggattacaggtgtaagccaccatgcccagcttataattcagtgcattttatatataatctcattaatctcaagagctactgtggaagacagacagtcatcatcttccccattttacagatgaggagacggaggcctggtgaggttaagtgacttgcccgtggtcccccagctggtcacccacaagctatcagctctccctgatcactgctcccctgtgccccagaaaaaagccagtgtctcttgttttgaacagagacaaggtgctaaatttgtccagaggtaaaaatgatgctgaaaaggggaaatgtctgaaaacaataactgagggccctttctggccttaaattattttcagctgaaaaagcccctagttcaagatcggaactgcgctctggggaacagcggccatggggtggaacagcctagagccgggtgatcagccacctggagaccggaagcccccgaggaggttctgaggaaggaaggaaggaaggaaaagactatttctggcattttctcaggcttctactgtgcccaggcaccctgtagacctcatctgtctgtcaaatcagggttcttagccactcacaaccctacagggacttcgtttgtacacagagtccttccccagttcagtccccactcacctgttcacccttatctcctacactcgctgggtgctctctccattccagccacagggcctccttgctggctttcaacctcctaggcatgcttctgcctccaggcctttgcaccggctgtgccctctgcctggaatacttctccccagatatctgcatggctcatgccttcacctcctctggtctttactcagtgaggccttttcttttctttctttccctgtttctttctttctttctttccctcctttctttctttctttccctttctttctttctttttccttttttctttttctttttttgaggtggagtctcgctctgtcacccaggctggagtgcagtggcacaatctcgactcactgcaacctcctcctcccaagtccaagtgattctcttgcctcagcctcccgagtagctgggactacaggcacatgtcaccacatctggctaattttttgtatttttagtagagacggggtttcaccgtgttagccaggatggtctcaatcttctgacctcgtgatccccccacctcggcctcccaaagtgctgggattacaggcgtgagccaccacacccggcctcagtgaggtcttttctgaccctcacagttaaaaataaaactctggccaggcgcagtggcttatgcctgtaatcccagcactttgggaggccgaggcaggtggatcacaaggccaggagtttgagaccagcctggccaacatagtgaaaccccatctctactaaatatacaaaacaaattagctgggcatggtggcaggtgcctgtagtcacagctacttgggaggctgaggcaggagaatcatttgaaaccgggaggcggaggttgcggtgagctgagatcacgccactgcagtccagcttggatgacagagtgagaccccatctcaaaaataaataaataaataaataaatagaactccattcccctcatggttaaaaaaaaaactccatccccctcaccactgtatatttccatatgattcattgtctcagacatcagcttgctttccgatttctttgattatctgtctatcttcccccctggaatgtcagcacccagaaggcagggattttcgtctgtttggcccacaactttcctccctgggcctggcacatagtaggcaagcggtcaatatttaacaacgaatgccttaatccaagaacccccataagattggggtgaaatatttgaggagatcaagacttaagggtgaagggatttgccaaggcctttagcagggagccaaatgccagatcctggagtcaaactctgatcctgtggccttttgctgaggccagtgttctcagacttcaggatttcagaggccgagaacatttcggaatgaattcgagtgaccgtgcgcggttactgttttttaatgtttatcaaggatgctcattcaaacaaacaaataacaacaaaatacccactgctggcaccataattttaccaaagaatgatcattctaatattgaaaaagttcaaaggacataattgcagaataaaagacagctctttatatggaatgcatttaaccatatttttaaactaaacggcccttcgttgtccttatttttctcatccccttgaagtctgctctaaatgttgatccaggctgtgtgaccctgtgtgagctatttgatcgcctagtgcctcagtttccctatatgtaaaatggagataagagcccatagctcagagtcttgaggagtaaatgagatctaggccgagggaagggcctagcatgcccctggcttataataaatgctcaacaaatggttccttttgttattaaaatgcaaaggcatattagtcaaccacctggtttaccactggcagtggtcgtcagctggcatttcaggaccccttccccaggctgcggcgggagaagggtatctgtggatgttgggaagagtaagaactggctccctacttagagacaaaagctggggagccccaagatgggagcccaacttacctctttttcttttctttttttgttttttttcttttttgagacagggtctcgctcttacccaggctggagtgcagtggtgtgatcatggctcactgcatcctccacctcctgggctcaagcgatgcttccacctcagcctcctaagaagctgagaccacaggacacaccaccacacttggctaattattgtgttttttgtagagactgagtctcactatgttgcccaagctggtcttgaactcctgggctcaagcagtcctcttaccttggcctcccaaaatgctggaattacagacatgagccactgttcccagcctcaactggcctcttatggggggctatgaaatctaccccaagcagaaaagattggggtcctacgtggaagggttgcagggacctaagaggctggggtggaagggaagaggaggggcctcagacaggacctgacttctgtgccttgtctctgccccaccctggggctgaatgaggggctgtgactgtgactggaggtcttacccttgctctttgcctcctaggctgggccctgtctcaggcccccaggctttccccaaactggtgcggatcctcacggccttttcctccctgcagcatctggagtgagtatagactctgggaccccttcctctcaacatctgggtgcagtgctgtgatcatagctcactgcagcctcgaattcctggcctcaagtagtcctcctgcctcagcctcctgagtagctgggaccacaggtgcatgctacagtgcccagcaacctctgggttttgacaaccccaaatcctgcccccaaggcacctgcagaaagaaaagccctcactttgtccctttttttctctcttccgcctactgcatcctcaatgtggctggcacatgagtgatgagatgacgccacatcagatgggaatccccagtgacaaaaaaagttgtagatcctttcgtgacctttgaaactcctttcctcacaacctcatttgctgctctcagcaattcagctggggagggattggggagcatagtcctactttacagtggaggttaaggaagttgccaagcctcaggggcttagttcctaagaagctaaacagggattcaagtccatcatgagttagactttgccctctggctgcctggttggagcccccaggtgatgaagtcctcgtctgaaaagctcaggaatgtgccggctgcctatggtgtattagagctggggggtgggaagggcaggtgccagggctgaggaggccctcactgggatgggaagggtcagatggccccaggacgctagctgatggcccccatctgattccacctgcagcctggatgcgctgagtgagaacaagatcggggacgagggtgtctcgcagctctcagccaccttcccccagctgaagtccttggaaaccctcaagtgagtgagctgggcctgcccttcctgctgaatcgggcccccaaagtccggctgactttttcaaaattaatttaaatttgtttttttagacaagggctcgctgtgtcacccaggctagaatatagtgctatgatcatacctctgcagccttgaactcctggcctcaaggaatctcctcacctccgcttcccaaagtgctgggattataggtgtgacttaccatgcccagccccagtggattcatccattcactcattcacctattcaatcagccattcatccttccattcaatgattcatccattcacttatgcagtcatttctttactccctcatccaaccgctcactcaatcatttctttacttacccaaccatttattaatttaatcaacaaatatttaaggaggacctactatgtgcaggcacctttctaggccctggagacccagctttaaacaaaacaaataaatcccctgacctcaggaatcttaaattctagtgaggagacacaatgaacaagtaaacaagtcggtaattataaagtatacagtaatgaaaataatgtttggtgacagaaaattatactggggggtgaaataggagagatagattaggatttatcaataaagcattattatcaaaacagtaaaactttttaaaaactgttctgggctctgggaagttggagatggataagatacaggaggatcaatgtgattttttttctttttttcagacaaggtctcgctctgtcacccagggtggagtgcagtggtgtaatcatggctcactgcagcctcaatctcctaggctcaagcaatcctcccatctcaaccttctgagtagctgggacaggtgcatgccaccacgtcccgctaatttttgtatttttttgtagagacgtggtttcaccacgttgcccaggctggtcttgaacttctgagctcaagccatcctcctgcctctgcctcccaaagtactgggattacaggcatgagtcactgtgcctggttcaatgggattttttttttttttttttgacacggagtctcgctctgtagcccaggctggagtgcagtggtacgatctatttattgcaaacttcacctcctgggttcaagcaattctcacacctcagcctcccaagtagctggaattacaggcatgcaccactacacccaactaatttttgtatttttagtagagacggggtttcaccaggttggccaggctggtcttgaactcctgacctcaagtgatccgcccacctcagcctcccaaagtgctgggattaccggcatgagccaccacgcccagttcaacatgattttttactgaacctagaggatatcaaaatcttcccacactccccctcacaaccaaggtcttaggatggccaaataatttaccggaatttacttagcaatttccttaattgtaggactgtgggacttctccagtaatttctagtgtcctaggtaacactgtaagctagatttcttctccttagtccttccgtccccctctttcttacccgccaccccacttaagtatttattgagcacctactatgtgcctggcagtgctctaggcacagggatacagtaatgagcaaaacagacacagccctgctccatgtgaagcccacaacccggcagaaaggattacacagccattaaacaaataatgccaacacttatttcattatagtgctgaaaagtggcgcagagggaaaagaggggatgttgtaaagtcatgggacaggtgggggcaggagggtgcactctccctcccatccacctcctcatccctgccctcccacttggccacaggacctaacagtatcctcctatttaccgagaggtagcttaagtctgtcgacagcgccattcacagcctatgacccagaactctccttgaggtcaaagtgaggcatgcaagtttggtcctgagccctccccctcactgtgtccccgcagtctgtcccagaacaacatcactgacctgggtgcctacaaactcgccgaggccctgccttcgctcgctgcatccctgctcaggctaaggtgagtggggccccggataccggtcaggtgctgagctggggggctgcagagcgcagggaacccacatcgtgctggctgcaggggacactgagaccctagaagcaatcaccacagccctgaacaaaaggattagcgggacgtggtgaaagaaactctgagcaagtcagttattcattcctagccgctgttttcttacctggaaaatgggaaccatcctaatggtctatgtaagcacttgtcacaatgccaggttctgttatgcaataaatattgctccttttcccccagggatggcgggaccaggctttttccggaacctaggggtggtggcttctggaaggctaaccacgtacgtcagcttttgccggccttgtcacttacatgccggtcagtgtttcactgccaccttctggtaggccttggcatagcacctcttgcttttgagtgacttccatccaggccctggtgtggtcccagaggtaatgagcggactgagcttggaccagagccccagtcatccaactcagcattaccagctcttcttactcgccagactgagagaaactgctctcctcttcgccagagctcttcacttactgaggacaaccagagtcagattcccaggaaagatggcatttggtcccttattatttatttatttttaatttttttaatttctgtttttgagatggagtctcgctctgtcacccaggctggagtgaagtggtgtgatctcagctcactgcaacttctgcccccccccaggttcaagctattcgcctgcctcagtgctccgagtagctgggattataggcgcccaccaccacgtccagctagtttttatatttttagtagagacagggtttcgccatgttggccaggctggtctcaaactcctgatctcaggtgatccacctgcctcggcctcccaaagtgagtactaggattacaggcgtgagccaccatgcccggccaacttatttatttatttatttatttatttatttggagatggggtctcacccaggttgtagtgcaggggtgcaatgatggctcactacagcctcgactacctggactgaagcgaacctcccacctcagccttccaagtagctgggtcctataccctcctgagccttgttaatttcttcccagcatgatcactgttttacaatattttatttatgtaggtgcttacttcttgctatgcaaagaaactcagaagcaaaaatagaatctgtctggttcataattgtgctaaaaactagagatacaagtatgaactagacagatgtcgttcttgcttttgagtttctttgcgtagtaggaattaggcacatacataaataaaatattgtaaaacagtgattcatgctgggaaggaaactaacaagccccaggagggtacaggacttctggggagatgattcttccgtgggaagctctaggggaaaaggactctaggaagaaagaacagcaggtgcaaaggccctaagtgggaaaaggggctgtgttttaagggtcagaagggccactgtggctgtgtgtagtgaatgagggacagaggctgggcaatggtggaagtaggggaggtcaggggaatccagatcacacagggaggcccttgtgggtcacaagaggtatttgcagtttttcagtgtgaatggaaaagtaggtgggcctgggaaggcgacacttgatctgatttacacttttcttttttcttttcttttctttttgagaccaagtctcactttattgcccaggctaaggtgcagtggcatgatctcagctcactgcaagcactgcctcctgggttcaagtgattctcatgcctcagcctcccaagtagctgggattacagatgcccgccaccacaccaggctatttttgtgttttcagtagagacagggcttcgccatgtggcccagactggtcttgaaatcctgggcccaagcgatccacccacctcagccttccaaagtgctgggattacgggtgtgagccaccatgcccagcctgatttaccctttaagaaacatcatatttcatggaatctaagatgccatccattgtaagaccccaatatgaggccaaaatgcaaactgtgacacgctattggttataagacacatcctgatctcaatgatattcaaatggtgacatatatgtcttggcatcgatgaaatatggtcagattactctccctgtggggtggaggaagggtctccagggttcagagattgcaaaacccccatctagtttctgcactggtaccggccgacccgtgatgtgagttgatttagcctgaatccacttggcagcagtgtaaacctgctgcatttatttatttttttctttttttttcgagacagagtttcgctcttgttgccaaggctggagtgcagtctcagttcactgcaactccgcctcccgagttcaagcaattctcctgcctcagcctctcaagtagctgggagtataggcatgtgccatcacacccggctaattttgtatttttagtagagacggggtttctccatgttggtcaggctggtctcaaactcccgaccttaggtgatccacccgcctcggcctccaaagtgttaggattacaggcgtgagccactgcacctgctgcttttatatgcagccctgcaagggagttctgaggctgaatcatggcaaagtcatggccctgaaatcatacccgcagcagcacctgacctgttaaaaggctgcttggtgtcgagtaaacagctgaagttggcatcagtgacactcatcatgctattttcactgctactaatgctggttgtgaatatgctgcagaaactggagctggtccagtgactggctttttctcttcctgcccccagtgctggtcacaccctctatgttaactcatgcgaccctcaccaatgttcctgtgatgtagtcagaaccatagctaacatttagttcattctaggcaccaaggcatgttctaaatgttatatcagcattgattcatttactcctccccacaatgactctatcatgcccattttacagatgggcaaactgagtctcagaagagttgagtagcttgcccaaggtcacataggcagtaagaggcatagctgggatttgaacttgggaagttgttctgacagtttccacacagtaaggcaagaaatgacttccttttagtcctgctgttttcctgggctcactgtttgaccacagagaagtggtctcaactctctgggtcttggtttgcctgtctttaaaatggggcagtaatcccagtaggtggtgactcccacggggctgacctccaggctgcaggggacactgagatcctagaagcaatcaccacagccctgaacaagagaactagtgggacctggggacagaaactttgagcaagtcacttattcattcctagcctctattttcatatctagaaaatgggaaccatcccaatggcctatgtaagtacttggcacaatgccaggctctgttgtgcaataaatattgattccttcccccagggatagtgggaccaggctttttctggaatctagggatggtggcttctggaaggctgaccatgcacaggcctccaatccctccccctggcctctgtttccgacagcttgtacaataactgcatctgcgacgtgggagccgagagcttggctcgtgtgcttccggacatggtgtccctccgggtgatggagtgagtgtgggagtctgggcggtgggtggctcagcccggggtgggagacactgaagtctctccctggtgtcctggaagagctggatgtgggggtggccttggtctggagctggggagtcccaagggccaggccccaaggtgagtttctcttgccagcgtccagtacaacaagttcacggctgccggggcccagcagctcgctgccagccttcggaggtgtcctcatgtggagacgctggcgtaagtccaggcaaccctggtgggtggagaacaactcactccccaggcgtgtggcccagtgtgaccccggagctcaaatcatgctcttcccttcaccaatctgcaaccctgggtgagcagacacttccccctctggcttcagcttcttcatctgtaaagtggggacagtaataatatccacccaagaggttttgtgaggcttaaactaatcaagccctacaaagctcttataacaacagtagctggcacacaaaaatgccaataaatgctatattaggctgaaccatatgaaattgctgacatccacccatttttgacctgtaaaattggcaatttcatatggttcaggtttatcttttattaagtcaccatgatgtccaatactggttactttatattctttcaaagcacttttatctccacaatcactcacctcttctaagacgcacagggtgggtcttacaagacccattttacagatgaggaaaataaagcacagagcagttaactaacctttctggggtcacacagcaagtcagctgcagaaccataaaggaatctcgggcctcctaggcttctccttttccccatgacccacaccggtcggtatcttgccaggggaaaagtccccaacgttctaggctgggtggaaggagggatttgggggcagctgtcactggggccccaggccgccctctctcctctaacctggctctgagtcccatccccccttgcaggatgtggacgcccaccatcccattcagtgtccaggaacacctgcaacaacaggattcacggatcagcctgagatgatcccagctgtgctctggacagggtaaccagggtgggcttgggaggggagagccgcagtgggttgggggcagtgtccttgtgaaggtggcattcaaaaaatgtgggcgggacacaggtggggctaggccaccacccttggacgcatgcgtcatcagagacatcccctcatctccaccctgggctcggtggagctgtcctccaggctttgcgagcttggtccctgtggtcaggcttagagatcaggggacaggaaagttggccatccacatcccacagcctcagtgcttggaagagcttcctttggggactccaagccttcccagctgctgtttcggcttggtggctgccctgatgctccgggtttgtctcagatgaacttgcttgacaagtctcctgctcctcactatgaagatcactgtcccccagccctgtgctccccgcactgtgctgcacgtccacctccattccactgcccctcccatccccccatcttgatagcacccttcccaggtgtcaagctgcccctcctagagtgtcctgcctaaaccccctctcctggctcctcccgctacagcatgttctctgaggacactaaccacgctggaccttgaactgggtacttgtggacacagctcttctccaggctgtatcccatgagcctcagcatcctggcacccggcccctgctggttcagggttggcccctgcccggctgcggaatgaaccacatcttgctctgctgacagacacaggcccggctccaggctcctttagcgcccagttgggtggatgcctggtggcagctgcggtccacccaggagccccgaggccttctctgaaggacattgcggacagccacggccaggccagagggagtgacagaggcagccccattctgcctgcccaggcccctgccaccctggggagaaagtacttctttttttttatttttagacagagtctcactgttgcccaggctggcgtgcagtggtgcgatctgggttcactgcaacctccgcctcttgggttcaagcgattcttctgcttcagcctcccgagtagctgggactacaggcacccaccatcatgtctggctaatttttcatttttagtagagacagggttttgccatgttggccaggctggtctcaaactcttgacctcaggtgatccacccacctcagcctcccaaagtgctgggattacaagcgtgagccactgcaccgggccacagagaaagtacttctccaccctgctctccgaccagacaccttgacagggcacaccgggcactcagaagacactgatgggcaacccccagcctgctaattccccagattgcaacaggctgggcttcagtggcagctgcttttgtctatgggactcaatgcactgacattgttggccaaagccaaagctaggcctggccagatgcaccagcccttagcagggaaacagctaatgggacactaatggggcggtgagaggggaacagactggaagcacagcttcatttcctgtgtcttttttcactacattataaatgtctctttaatgtcacaggcaggtccagggtttgagttcataccctgttaccattttggggtacccactgctctggttatctaatatgtaacaagccaccccaaatcatagtggcttaaaacaacactcacattta

SEQ ID NO: 1633 - DNA, 30152 bp, Homo sapiens
tgtgaatcctaaccgctgattttatttaaccgaatatatccaaaatatgatcacttccaggtcctcagtacacaaccaccacgagggaaacccagacctaggtttccggcgccgactctgaggcccgggagttttcttcttgcgtcaccccagcgtgggcaccccggcccgcccccctccacctggagcgcctctgccttgcccccagacccaccagccaggagccagaggagggaggctgaggggcggggacgaggaagaggatgtggctggtgccctgggtggccgcagccgctgtctttcacgcctttctcactccacacggtgccccgaccccagggtcccgaaagtcccaggctgttggacgtggtctgggtggggtgggagggacgacgctggcaaaggcgggctgagaggatttctttatttcgcgttcagacccaacacactcggacaccttggggccctgtgagggctaagcagggtggtggcgtcagctcccggggaggccccactccctggggaggaaatacacggcagggggccgcacccagccccccacggagggacccgtgttgctctaacagggacactgaagttgcctctgccgccccgtgaggggcctgtggcggccccagacccagcccagccaggccagaggagcctcccaggggccctcaggtggtgaggtgggggcttcccggccccggtgcccaccggcccttctagctgcctgtgctgggccaggtgtcctctgaggccggcaggagtctggcccccgctgcacctgcgcttggtggctggcaggggcggggtagggaggtcaccctcgaggccggggtccccatgtgctaggggaagacctgccttcccagccagtgtccacagggcagcaattccacgctctgaggctcagggaccaaggcagggctgggtgtggggcccagactccaagctctgggggttgggggaccaaggcagggctgggcatggggctcagggccttggaggtttttctcagctctcaacatcacagcacagggcccgtgagtcaccccagtcctctgggcctgtgtacccaagccggatgcaggccggggagtgcacgtggggctcctctgtggcgccagtgtgaagctgctctccggggcggtcgcagcctccaaaccctggtgctacgagtccgtgcctcaggcccagggaccacaggccgtctgctcatggctgaaaatgaggccaagcagctcccaagtctcgaagactccactggtgtggaggcagaggggcccttccagggcagggcagccctcggggcagcagcaggggcaagggctctgtctcacgcacacgggcacaggcacgcaggtgccggccctgccgctggctcccaagaggccgatagcccggtagggaggtcacacacacacagctgatccctggaggtaaagaaacctagacgaggagagtggaggctgggcctgcgcaaggaggcgccaaggggggagaccactgcccacaacagggtcagtcccgcgagagggtcagttccgcgcctgccgcctgcccgcccagctgcagggtgctcgccattgccactgctggggagcatggtttgggccgagaaaccagtgactccgggaggaaatgcagaagggccggggtgccagcgccagtgcccattatgggcagggctgggcctcacgtctgggccagcgagagctcctccaagcctctctttcccaggcggtacctggcgaggtccttcctggtcaccaacccgacaacctgcaggacaagtccaggccacagtgacacacgggtcggctcccgcctgcctgtggagctccctgccttgtgtgtggctggggcagcacaggcagggggccctgggggcttcagcacagcccccgagctgagcacggggctggggaggggtgcagccatggggcatgggccgactcggtgctgggtcctgtgcttccgtgtcccctgccgggagctgagagtaagcacgggcaggaggcagaggggagccctgcacggcatgcctgcacccccaccgcccccgctcacctgattgcggttgtccaccaccaccaggtgccgcaggcccagggcccggaacagcttgaacacccgtgggagcgacgcctcctgcagcaggggcacagctgtcagtgcccgcccacacagcagaggcaggcgggaccctcacccaagctggctccctgcaccccccaccacggcgtccaggcacgtcctgagcccccacgcccgtctggccagccccctcagccccttgacttcagctctaaagcctgccaggcccttcacaggagacagagtcaccgagtcctctccgctgtggccccccccggctgcccctccccgaggctctggaccccaccccctgctgttcagtcccaggccccacgcccatgcccatgccctgcacatgcctggggcaccgtgtagggggaggggttcatgaactcggagaggtccatggtgcactcccgctcgtcctgggacacgtggatggactggatgggtgggaagcgcgggtaggcgtctcggaagtccttcagcctcaggcgccgctgtaccaggcccaggttggaccgctccacaaacacctgcgggcggcagagccctgtgtcaggcacccaggcagcacccccggggcccccacccgcccaatggcccggagcctggcacgcaccttgtgctttaggagaacgatgagctgggagcgcaggatcaggccctggagccgggcaggctgcaagacaggcccgcggtcagggccacgggcccgagggtgggaggctgcgctggaatgctgtgtcgggccccgctctgaccctgttccggccagatttcccatctgggcatgggccccgtgtcggtggctacctgctcacaccagcctcgccatggcatcccacacgcacaatgccacgggacccaaggatcggcgacagggtagcggggcctgaccgcgcacagcagagagccaagggcccagggatggtggctttgctgcagggcagatgcagccccactgggtcccaataaaaaccaacctccaaacacccagtgtccacgtctaaaagacacacagcagtggccgagctgtgtgtcctgtcagggcctcctgacaaagtcacggcccccagtgccacggctctcagcccagcctgggtgccaaccccaagaccctgccaggccgcagccccccccaccagcctcagcgtccacacagccctccatggctgcacactcagcttccggcactcctggaactgccagtgcacccaaacgtgcagcttccccatcctgcaaaccttgccgtgtgcttcccaccaatggactcgacagaggtcacataggcaggaccctgtctatggggtgcccggtacctgggtgtcatcggcatgctccaccacggggaagccgttgtgattggacgccgtgtcgctcagcacgtccacaatgacgccgaccttctcacgccgcctcaggcaggtcactggtgtgctcatcacctccctgccggaggagcccggccacacatgcccgtcacacgccaccaactcccacagttacctctgcgggctggtgaggtgtgaagccgctggacaggaaacgcggggctgcctggagcccgcaagccgtgcaccctgcccctgtgcaacaagaggccgctggacaccctccccacccacaggtgtcctgggcgctgtacctggcagtgagtgagtgtgaggtgaccggggcctcccagtgcaggaagggcacactctgcagctgaatgtgcatgtcgtacaggccctgcgggcggggcgggaacacagggcttgaggagtccacacccacccctggagccccgagcctacccctgggagcccagaggccgcccccagaaaccctgagcctaccccccgggaccggctgtttggaggctcacaggggcccctcccctatggcagcacccacgctctcagggtgaggcttcgaggccctggcgcacctcaatgaagacgtcgcccacgatcttggcggtcatgagcaccagcatgatggggaagccgtaggtcacgttgctggtggcctccatcatgatgacggtcaggctcagtgtcatccgcacaatcccgcctgcgggagccatcatgaaccccagcacgtccaccctcctggctcagggtcacgtggccactgccttctctgcagcacccatcccatccacctgctcccagaccctagccccgcaaggacagccatggccccctccagaccccgtggagctccccacccatcgggcaagagctgggacatacccagctgggcagcagctcccatcagggcgtatttgccggggtccgcccagatctgtgggaggtgacacggaggaggtgtcagtgtggtggcaggcccaaacccaccaagatacacagacggaggaggccctgcccaggcccagcagccccacagccaggaacaaacctcgtggccgcgtacatacacacagaacaacctagcacagtacaccctgctgcggaggctgcatccttggcctgaaccaggcgctcagcacccgagcaacaggggagtggcaggcatggaggatgcagagggcacagtcaccacgcagcagcccaggccaactagggagcaccgtccagcatgaggagtgaaaccccggcacacacgacacagagagccccgggaacatcaggctgggccacagaacccaggcatggaggctgcagaaagcggggcacgagggtcggtgggcacagggtttccattctgggatgacggaacattctagaagtggtagtgacggccgcactgcctcgtgaacgtgagaaacgccgctgaactgccctctttaaaacgatgagttttacggtatttgaatcatgtttcaattttaaaaaccaaaccaaacccttgtgcggagggagatgggcagagcacacgggcctggggagcaggagtgggcgcttcctgccggggatgagaagcatggccgggggcttcctgccagggcctcttacaggttttcagtcttatttaagcgactgaaatgagaaacagaagacacataagagaacccagtcccagcagaggcaggcagagaaggaaggcctgcgggggctgaggtctggagggcagtgtatgccgctctggcccccggcctcacagagagcagccctggccggacatccaccccatggagtctagaaacagctctgcagcagcccacaatcacctctgcttttcatcacattctcaagaataaggacacgagcctccgccccctaccttcgcctggtccagactccacacatgggctgcgctgccacagtacacgctgccaccacagcaggacaacgcccacggcccgtgaaccacgcgaggacaacgcccacggcccgtgaaccacgtgaggtgcgacacttttgtcctgccctgggacttctgctccggcccgcgatgccgcaagacctggctcagctgcagggccccacagcctcccctccggccccactcaccgccgcccccgtgaggtaggacagggagatcccaaagagccggccccaggcagccccgatgagcagggacgggatgaagaccccggcagacaccgtgagcccgtaggtccagcaggccaggaagaagtagaccagcgtgaacaggccgagggtcagggggttgtaggagcctaggagagaagaggggctgacggggcctccacgactcccgcctccgcaggactgccctgccccgctgcccagtctcgggcctcacagtcaccttccaggagcccagcaacctgagctcccgagcccagcggtccccagaaggctccctgttctcagcctccctgggaagcagaaaggctaaaaggatcccatggggaggccacaggggaagaggctctgcggggccctgatgccagcagaagcaggagccgcgtccagcggggcggcccagctgggtctagcagcgccaggtctacactccatgggtgtgcaccgtggtgcagctcgcagcctggctccgggaagagggtgccccccacagcctggggttcctttcctggagcaggcagcactgtactgcgtgcagggcgggtgagaccgccagggacacaactgcagaggtgaaaggccggcactccaaggtcgcggtctgcgcttccgtgaaacacttgtggtcgagcgaggccaggccgtggtcttggtgtgggagtcaccaggctgggttttcttttgttttttgagagagggtctcgctgtgtcacccaggctggtatgcagtgatgtaatcacagctcattgtggcctcaaccttctgggctcaagcaatcctcccggcccagcctcccaagtacctgggactgtgggtgtactaccgtagccagataatgttgcttttttgcaaagacagagtctcgctaagttgcccaggctggtcttaacctcctaggctcaagtgatcctcctgccttggtctctccaagtgctgggattacaggagtgagtccctgctatgatccatgctagggatgaccccccagcccagggctgcaacctcagcccacaggggacactcagccagaaggcatcacccaggccctgatcccagggcctgcccagcggcactgcccacacacacctggcgggtcgtggaagaggctcaccacgctcttctccggggtgttgaagaaggccgcagccatggagttgtactcgccatctgcacaaaagagctgtggggtcgggagagagcacacgttgggaggggagatgagctggtgggctgcaggcacaaacctggtgtcgccgtgagaggccgtgtaccctgtgcctggccagcatcaggcgcgaaaccacacgatcctgccattgggtcagggccacggtcacagagggcaaggaggacacacaaggcccaagccatggtcacggagggaaaggaggacacacacggcctaggcccagcagggggccgtgtctagccctggggggtgggttagcaggaccatgggctgagacgctgtccatccctggtgccggggaaggtgggcccaggcgctcacatgagctcctagaagaggctgttggcgccccggtgccacaggcccagagcctcctgggctccagcagcacagggggtgttatccacggggctggagcagagtgtagcaaggctggtcaaccccatggccccgggcctcccacgtctctaacggttcacacctgacccgtcccatcctgcccactcccgccgtggcacccactggtctgctgggcctctaggctctccctgttctggatgtttcatgttaatggggctacgtcgcgtgacctcacgtgtggttcctctgagcgtagtgctttccagggcaaccgtgtcacagtgcagatggacgcacggacggcggtgagccgtgagcgccaggcacaggtccagttgtggacggaggtttgcatttctcctgggtccacatctatggtgcccccatagggcgcctgaggctcgccccgtcaggctgccattctgggaagaggactggggggagcctctggcccccataccaccgcccattcccctggcacctcagcagacacctggcctcctctgagatctgggtggacaggactaaccctctttgagacacgccagcccatgcgcttctggaactcggcggggtgggcagccctcctcccgtagcctaagcgagcctcctggaggccgccctgtggctgccctgcctgctggaccccgcccgggcccagcctcccacctgcagcgggtaggacatggagcccccctgcaggggctggcaatcccgcgacgagtagatcagcacgaaggcaactgtggccgtgacggcggccaccagcacggcctcaatcacctgcaggcagggccggtggatgtacctggaaccaagaatcaggctgcatggcaggcaggacggcagcgcggcccctccgcaggccccatggcaactcgagtccctgatggaggacactgggcccgtggtgctttttgtttgtttgtttttgtttttgagacggagttttgctcttgttgcccaggctggagtgcagtgctgcgatcttggctcactgcaacctccacctcccaggttcaagcaattgtcttgcctcagcctcccgagtagctgggattacaggcgcccggctctacatctggctaatttttttttgaattttttagtagagacggggtttctccatgttggtcaagctggtctagaactcccgacctcaggtgatccacccgcctcggcctcccaaagtgctgggattatagtcgtgaggcaccgcgcccggccaggcctgtgtttaatcatcaatcaggcacccaaatgtcctggggtcgtcctcttccctggggtaaagactcctcggcagcaacttctccagatgtgtgggaagtggcgctacccgtgccccggctgtacccgacagtattgaaatcagcacagaccaagaaggaagaagccggggggccccggtgtcccaggacagctgcggttgctaccaggcagagccaggcggtgaaggttgggcatgcctcgcccaggcccgatcccacgcagggcctcacttcctacccaggggccgtcctccaggagccctcgcactcctagccttgggctagtccgtcaccctccaggccccgggacacatctctgaccagctccaccggggaaaccatcaggaaggacgctgcatacacagcctttctttcggctgtggcctaggagtgtaaaccccattccaccacgtccgctttcaaagggcctgtgtggccacgcctgccaacgcgatatgcaatgcggtttctcctcacctgattcgaaacatggtcagccagtagttcaaggcattgaacactgctccaagcacaccgcctgcgaacaggggaaaggccagtcagcgacaccggaggaaaagtgcgggcctccgcccgccggctcccagatggcaggagaagctggagggtttgcagagggaaggggacggcagggggctagggggtcctggtaagatgcttcctccacatcatcacaccctgagggctgggggagctgtttctcaaaggctctgccttccttccagggcaaaggtgtccagcagagcaataaatactggtgggagcaattctatctcttacaggaaatcccatccatccctgcagccctgtggtttttgccaacagagataaacaacgggaagccacagaagcgaagctttgggctccccactccccacgtgtactgcccatggaagaatctggaggcccccgggtggccctgggatgagggcaggctccagggagccacagcctccagtcctcgtctctatggccacgtcacagctgagccaggcccgcaggccgtccctgcggtgctgggagaagcccttacccaccacgcccatggcgatgaagaccgggatctcgtggatcgtgtaggccattttctgtgcagagagagggagaaggcagaggatgtgagggaaaaggcccacagctcctttctgctgaaactcaaggaccaccatcttaagagagctgtccccacagagagccttcccgcccttccacgcaggctgcggaagtccacaggggagaaacacactgggtgttctgagcaggcctggcccctgcctggcggggtggccagcgaggctctcagagaccctgccaccctcagcacccggggcggggagggccccaagcactgggaacatagcccgtggtcccccagtttcctgcgcacagagccgccctatcgatggcacggagagtctccccagcccaggccccaggctaccctggaaactaggcctgagcccacctgccccgagagcggctgctgcacgtgcccccaggccgtgggaggccccatgcacgcagcaactgtgtgacatcccaggtgccctgctggtcacatggtgccctgacctgaggggcagcttggggtgtcttcctgcagcccctcggggccctggagcttacacaagagctctcagctccacagctatcaaccagagttttctaaaggaccaaattctcaacctgggccttaagcaaacagggtcctggaccaggatacgaggtgggcgaggtgggcgatggggcaggttacctccgagtcaaaccttccgaagttgatgaggcctgggctggacaggtcccacatgttcccgtggtaaatgctcagaacaaaattcagggtgaacgtggagatcatggaagcaaagaactgcggcagagggcaggaaaccagcgccctcagagccacgctcccagcccagggctcacggaccagcagggaccatcgcccctcctgtcagccccggggccaggagtctgcagaccccgcccaaggcagaagggaaggggctggagccaggggtgggcgcactgtgcgggcaaggagcggcccagccctctctggacttgccagtggagagcaagaggggaaggtggggcagggctgggttcccggctgtttgatcccctacccgggagccacccagggctggcaatggtgcccaggaccaagggcgaactgggcagcaaaggcaggaccgctgctttgggcaggaccaaggcctgacagacccacagggggtccagctccagccgcagctcgatgggtggccccaaggtggaccccatggtgggaaatgagagcgcagcatgcaccctgatcaggaggcagccatcagcaggaacttacgatcctccaggtcaggaactggttccagaaggacgcaccctcctccaagctgaacaggaccccacctggaaggcaggcggccggctcgggtgccagctggacacagggcaccatgcccaccaccaactccctcccccaggctccagggaacccagaccacgtcagaaagaagctaatggggtgggccccagccacacagagagggaccctgagggaggtctgagggctggacccaagtacactgccggccgcttccaaatgccccggccgtgactccaagcctctgccaccctcagcgggcactgggcctacagagaggagaccgttccttccaacacacagggcgagggcaaagcattggacccggtgcggccctcctcacccacgggggctccaaacgccgctgacactccggccgcagcccctgcggagacgaagtcccgcttctctgtgtctctgcggaagtactcgaagatctgcaacagggacagaccagggtcggggcaggttccttgagggcacggctctcagaaagggagagcaactgccaggacaggggctgtgcaggggaaggggctttcaggacaaccgagtcagcagctctgattcctgaagagcaccgtgctgcagaccacggcaagagacagcagggtcagcaccaccaccggcagcccagggaaacacgcaaacacccagccaggagctccactttccagcgcacgcaagattccaaaaacctctaccctctaacgaaaagcgcacggatggaaacccagccttgctgttctttgtcctgcgggacgctgcctgcctctaaattcacacatggccggcgcggtgcctcacgcctgtcatcccagcactttgggaggccgaggcaggcggatcacctgaggtcgggagtttgagaccagcccggccaacatggcaaaaccccatctctactaaaaatacaaaaaacttagccaggcgtggtggcgggcacctataatcccagctactcgggatgctgaggcaggagaattgcttgaacctgggaggtggaggctgcagtgagctgagattgtaccactgcactccagcctgggcaacagagagactccatctcaaaaaaaaaaaaaaaatacaatcacacacaaatgcagctcaatccccatcaacatgctggggacttttttggggaaaaagtgttccaaagtgtgtcttgacaaataaacaacaggtgggcacacttggtctcaggttctgcactcctctgagaagccgcttggagccacagaccctcccacgggaaacactgatgcacgtgtggcaggggacccaaggagggaagcagcgggccgtagggaggccttgccgggcagggactgtgcccgctggctctgggagccacccgccaggctgtcctcagatggggctggggctctcggcctgggggtgctgagggaagcccatctccctgagtggtgcccgtgcccgtgcccatggcatctggagcccacccacacaagatttcaactcaccttgaaatctcgtttcagtgacgttgaccttccctgagagatcccggcggcaatcactgaacctgagtggatcatcggcccttcctggagaccagaaggaccggtgctcagagacacgcgtgacgcggcccttcctggagaccagaaggaccgatgctcagagacacgcgtgacgcggcccttcctggagaccagaaggaccgatgctcagagacacgcgtgacgcggcccttcctggagaccagaaggaccggtgctcagagacacgcgtgacgcggcccttcctggagaccagaaggaccggtgctcagagacacgcgtgacgcggcccttcctggagaccagaaggaccggtgctcagagacacacatgggcgtggcggccctcgcgggcccggcggcctcaggctccagctggagtggccatgtgcactttgttacctttcccacggccaggcccccgaccacggacaggatcacaccggacactttgatcaccaacgtctgaaacacagggagacgcatggcctctgatgaaaaggcaggcgctgtctttggacctgagccgtaaaacagcacacacagccccgatcaggcagagtggctgggacacggggcctccgggagggggccagcacccccaggctgggtctccccatggccacagtggagctaaacagcagccaagcgtcccccgcactcactcgggggacctgccctctgtggcctcagcactgagcaggcaaggggttctttcgtttccttccttcctgaggcaaagctgggccgcccaccgcatcctacaggcacacctgcctccgccagcgtggccagcacaggggaggtgttcccgctagccccgcctagcaaggctcctcatacacccctggcactggaaggctggtcacctgcggctccacgatgccccctctcccttcggctgctccccgcccccaggggcctcatcctctccacctgagaaggtgtgtaaggtgtttatcagcctccctgccccagggcagaacccacaagggcgcagaccctaaacacaagggcgctgagtgtgtgggggaggactgtatgttaaagatgccgagcaaactcaaccctcagccaacaaaagttatagagcaacatccaagaaggttcaggccagcctggcgcgggtgacaggcgggtcgccattcccagctgctccagtaaacctgatctcccaccacagggcaggggcaccccaaggtcacctgggagctttcgccagaggggacacactggtcccgctccttggccacggggaccaggccccggaagcacccccagggggcagcggccatgctgcccacccatcctcagacgggacggggctgcggcaagtctcaggctaaggaacgatggcggcacagacagaagcaaccacagcggaactgggtcaggactcccagcacctccagaaccagatgctctgataacaccaagtgtaaatgaccatgaggcaaactgaaagcgggaaactgctacacgcccactaccacgacagcttccacggtgaatcagtcaccaccacgcagcccacagtcacagacgcgtcgcacagctgtgtcacacatgcaccacgcaagcatttctgtatgactactcatttcttacgtaatttaatatgtgcaaataccagttgttaccactttcagaaaaaaaggtgaccccttcacacccagccagcccatctgcacacagtgccaccagtacacagggtggctgaggccagttctggaaggcaggcagccaagagagctgctcctgaaccagcaaagagcgggcgcccaccctgcccagccagggccaccgcaccctcaccttgagccgcaccacgtgggggatcttcaccccgttgaggaagcacttgatctgggggattccgctgccagcagccaccggctgaaagaggggaagcacggctgagtgggtcacggccaggctgagacagatgcagcccctcagccccaggagccccaggagctgaggagagcagcagacacgtcggggcctcagggaaggggagctcagcacacaaacgtcggggccccagggaagggaagagcagcacacacgtcagggccccagggaaggggagagcagcgcacacgtcggggccccagggaaggggagctcagcacacacgtcggggcatcagggaaggggagagcagcacacgcgtcggggcctcagggaaggggagagcagcacacatgtcggggcctcagggaaggggagctcagcacacacttcggggccccagggaaggggagagcagcacacatgtcggggcctcagggaaggggagctcagcacacacttcggggccccagggaaggggagctcagcacacacttcggggccccagggaaggggagagcggcacacacgtcggggcctcagggaaggggagctcagcacacatgtcggggcctcagggaaggggagctcagcacacacttcggggccccagggaaggggagctcagcacacacttcggggccccagggaaggggagagcggcacacacgtcggggcctcagggaaggggagctcagcacacacgtcggggccccagggaaggggagctcagcacacatgtcggggcctcagggaaggggagagcagcacacacgtcggggcctcagggaaggggagagcagcacacacttcggggccccagggaaggggagctcagcacacacgtcggggcctcagggaagggaagagcagcacacacgttggggccccagggaagggtctcatgtcgttggggtagctgctctcactcttcccagcccagacacagatcaaggacgtggtggaggcggaggtggagatggaaggaggggagggcagagtgaggagatggaaggaggggcggagtggggtgagggtgcccaggcctgtgctggtaggtcaggagcagcaccccagggctctgggggtgaagaggccctggtgtgtctgctcctcctgaggttgtgagtctggaccacgtgattctaaaagtgcccgggttgtcagccaatgtgatggtgggggtgggtgagctgcaggggttcccgcccattcaccaagacccccaatccttcatggggtccgccatagctgcggcatcctgccacccacctctatgaaagccacaatcacagagcccacgagcacgaaggcggcgttcagcgtggcccacagcaacagggagaaggacagtccgcccttctctgtgaacttgtcgatatctggggctcatcaaggagggctggctgcttccccgtcatgaccacccagcccagacctcagccctgccccacagaccagcctggcagatgccaccctgctgggtggagccatgatgttcactggacatcccagagacgtctcacggcccaaccatgacagggacacagccagcctggccgggccgcctccacctgcactggaacacgctgggctcaggacttctgcccgggactcggcccaggccacgcccccctcccaagctgcagcggccgcactgggaaggatactgcccttgatgaccctgtacttgaggccagccaggttttccaccacgatgtcaatgaagcaggccacgaggcccgtgaggatcccaatgagggcgcagatgacccagcgcttgatctccaccgtccggaaggcctgcagggcgcggtcagggcgagggtcaggcagggccctggcgcagtcactctggcagcagcaggaccgcccagaccgcctgcaggccccgggattatgaagggcccagtgtgcacggtgcgctgagtcccacaaaggacagtttctggccaacatctgaggcgcacccggggcccgagggtgactcggggaggtgggtgaattcccaacaacttcacagccagcggttgttatgctgggcaccgcatctggcggccgtaagagcagccttcttggttacggtgaccgtgaccctcccactgtctctagaaaccagacgaaccacaggcctcagaggcggagtcagaggaggagggaggaggtgcgtcacctcaccccggcagaagagcagccccaggcccggccggcaccaggccccgcaccgtggggccctgcagggagcggcgtccagctcaccgtgtgattgatccgccgctcctcctccaggaacagctggttctcactgttgtcatagtccaagctctgcaggccgggacagcaagggcagcactcagcaccgaacccacgctctgggtgcgggcacaggggaccgggagtgggctggcagggggcagaggccgggtctcagggtcagggggacagaaggacgcccacctcatacttgagggacaggagcttctcgttgtgtgggatctccttggggaagggatgtggagggtccatatcctgtggcagaaaaaggcaaagagagaagcacagttgacaaggccacaaggagagaggcccctctcagctcacacacgaggccattatcatcccgacaccaaggacaaggacacagcaagagaactgcacatggggcgcggtggctgacacctacaatcccagcactttgggaggccgaggcaagtggaccagctgcggtcaggagttcgagaccagcctggacaacaagatgaaaccctgtcgctactaaaaatacaaaaattagctgggcgtggtggtgggcgcctgtaatcccagctactcaggaggctgaggcaggagaatcgcttgaacccgggatgcagaggttgcagtgagccgagattgcgccgttgcactccagcctgggtgacagagcaagactccgtctcaaagaaaaaaaaaaaaaagagaactacagaccaacacccctacaaccacggatgcaaagatctttggtaagacacaagcaaagtgattccagcaatgccaggagcaaggtgaattcagcctaggaatacaagttagtttaacatccaaaaatcaatccatgaggccgggtgcggtggctcacacctgtaatcccagcactctgggaggcagaggcaagaggatcaactgaagccaggagttcaagaccagcctgggcaacagagtaaaaccctcatctgtctttttttttttttttttttttttttttttgagatacagtcactctttttgcccaggctagagtgcagtgacgcgatctcaactcactgcaacctccgccttccaggttaaagccattctcctgcctcagcctcccaagtagctgggattacaggtgtgcaccaccacgcctggctaatttttgtatctttagtagagacggggtttcaccatgttggccaggctggtctcaaactcttggcctcaagtgatccacccagcctgggcaacacagtgagaccccaactcttaaaaaaaagccaaaaaaaaaaaaaaaaaaaaaaccaggcatggtactggcatgaagatggccacaaaagaatggaagagaattgagagagtccagaaagaaatccaaaacatgtacgatcaattgatttcccacaacagtgtcaaaacatttcaacagagaaaggtagtgttttcaacaaatggtgctggtacaactggatttccacatgcaaaaatgaagctgggccgggcgcaatggctgacagctataatcccagcactctgggaggcagaggcagaaggactgcttgaggccaggagtttgtgatcagcctgggcaacatagtaagactccatctctacaaaatattagctgagtatggtgacatgcgcctgagtcccagctacttgggagacagacaggaggcagaggctgcagtgaaccatgattgcaccactgcactccagcctgggtgacagtgagaccctgtctcaaaaaaagagagagagagagggagggtatgacgttggacccttacctcacaccacatccaaaaattaactcaaaagggatgaaagacctaaaactgtaaaattcttaggaaaaaacgggtcagtcgtcatactcttgggtgaggcaatggtttcttagatttgacaccaaaagtacaagcaacacaagaaaaaacagattagctgaacctcagcaatacaacctgtgcggggtgtgatgcacctgtggtcccagctcctcaggaagaagctgaaacgggaggattgcttgagcctgagagatggagttcagcctgggccacacagtgagacctcatctcaaagaatagtaataattaatttttttagacagggtcccgtctgtcacgcaggctgaagtacaatggtgtgatcatggctcactgcagcctcaacctcctgggttcgatcaatccacctgcctcagcgtcctgagtagctgggaccacaggcgcacaccaccacacctggctaattttcgtttttgtttttgttttttgtagagacagggtctcactgtgttgtctaggctgatctccaaatcctgggctgcagccttggtttcccaaagtgttgggattacaggtgtgaaccaccacacctgcccagaaaaaaaaaaaaaaatttgaggcaggatctcactctgtcacccaggctgaagtgcagtggcaccatctcagctcactgaaacctccacctcctgggctcaagtgatcctccaacctcagcctcccaagtagctgggactactggtgcctatcaccaggcccagctaatatttatattttttgtagagacagggtttcaccatgttgatcaggctgatcttgaactcctgagctcaatgaatccatctgcttcccaaagtactaggattacaggcacgaatcacctcccttggccaaaacttttttaattaaataaatttgagcaacaaaagacaccactgagaaagtgaacagaaaacccactgaacgggagaaaacttctataaatcatgtattggatgagagatttgcatctatgtataaagaactcctgcagctcaattataaagacaacaaacccagtttaaaaatgagcataaccaacacgcgtgtggccggccaggcacccgctccagggttgagacaggagaggactgattgctgaatctcacgtgctggctttttcccttctctcccaactcctgcccctcccaaagctgacaccagagcaaaggctttgaagtccaaaaaggcagtgccgaaggcgcccacggccacgaaacagatcttccgaaggccttgtggctccagaggcagcacaaacgtatcagaagggcagccccggaagaggcgctgctggctgtacaggacggcatctgagcacggcgccggcctcgggagcgactgcggcagagctcaaacggacgcaaggccgaagagcacccggacaggtggactgtgagatgcctcagcctctgacgtggcccagggcagagccaggtggggcctgatggggagaaggaggacgcccggggtgttgccaacatcaggatcatctcaacaggagtcccgcacagacatctacccagagacgatgagtgaacggccagcggcagcagaggactcccggcctcaccagcggctgggggaaaaaccgaggccggcgggagatgcccccgaggggaaggaagacgagcacgctgccgctgagctcaggactcccagggcagccactggcacgggaacatctaaacccctgccctctgaagtcagaggcatccggccccctctcactctcctggggctcctcactgcccccccaagatccctgtccttgccctgtcccaaagccaggtccagccccctcgctgcccatgctgtcactgctgtcctgaccggcttcctgcgccctgcactcctccgtctgagagcacttctgcccagctgcctctgctcacttggcgtcagggaccatgtccccccaaggaaatcttccctgaaccccggccctggggccccactatctccctgccgctcggcccgtgcccatccctgtcaccctctgctaagatgcagctagctctgcgggaggacggggaacacccccaactcaccgggtccaaaagttcatcatccagctccacgctgctcatatgtccgactcggaaaagcgcagaacgtggtgactaaaagcagaagagaaatcatgagggcgctcaggcgtcgcacgctctgctccgtggattctcactcccgccgccgcaccctggcctcgcctgaccctgcccgggagctcaggaatgggctaggccaggcctgcctgctgggtgggggcagcagggctgggacgggcctccctgggccctggaagcagaactgatccggctgcccctcggcctgtcagcgacacgtccagcccgagtccagggcgcaagctccctgctctagactgaaagcgaggcacctgccacccaccaggaaagaagggctggacaacacgccgcccccaatgcagtgcccgccacagcaccctgggccatcctgcccaaccctgctcccgaggccctgctcagccacctgccacctccacagagtcacctccactgcagcctctctgggtcttgagacacaaacggctccacagtgttcacgctgccctccccacaggacgcccagctgtcaggcagagctgggtggggtctcagccacctaaggctttgcggccgccccagctcagggcaggggcagggcagcgggccctgggtggcgtggtgcagatgtgacttacggagctcccaccccagtctccggctccttactagagccaaggcgctgaggccaggctaggaggagccaagacctcagcctcctttccccaaagagatcctttggagacgactccaatttccactatctcctgaatctttagcaacatctggggacatgaagggaagaagggctgccttccaggtggagggaccgcatgcgcagggcgcccgccatctgcatcagagagcccgtgcgcctgtcaggaaagtgttggcggaggagtccagcggctggtaccggccgtgggaagaccaacgaggctgccgcccgccttccctgggagcagccctcccggcccccaacgccgtcccctcctcatccccccatctctccctccaccttcctcaggctcggcctcccgcaccaggtttcagcagggcctggaagtgcttcttggtgatagaacggcaggtgatggcgccaggagcccacagggccgaggtggggacggggagacgtgcaggaacggcctgcactggggcccagttttccctcaacctccacctatccacggggatcacgattaccacacacaggcaaggacacagaagcagagaaggaaggtttgggatctgaggtcactgcgagccaggggtgggggtcctgctttctctggagtgctcacccctgaaggagacgggctccccaaaccgccatcccagaaactgccttcagaaccagaccttcccggcggggtacagtggctcatgcctgtaatcccagcactttcagaggctgaggcgggcaaatcacttgaggccaggagttcgagaccagctgggccaacatggcgaaaccccatctctactaaaaatacaaaaagtaggcgggctacttgggaggctaaggcgggagaatcgcttgaagccgggaggtggagtctgcagtgagctgagatcgcaccactgcactccagcctaggtaacagcaagactctgtctcaaaaaaaaaaaaaaaaaaaaaaaaaaaaaaagaacctgaccttccagcccactgccctccagggaccccttccccaaccatcgtcctgttaccagccaccgtcgcccttgctgtacaccccccgtgttgatgacccggtaagtggccctggcaggggaaggaacctgggcacgtgccactggcccttggcagacaccagtcagagcctcctcctctccccaggcaaagagcactctcaggccatccccatcaaaagccaggagcagaggccagacagacagacagacagactcgcaggtgtctgccgtggcatctccacgcccaggggagagtgtgggaggggctagagtgcacaggtcctgctggacacaaccctgagtcacagggcgcctgcccctcctcttcccccagccttgccacatgccagtggctctccctgagccctcagtcacaggcgaaactcacagcttgagtctcctgccacacgggctgacggtgggaggaggaaggtgccacggtccaggcatgatggaagcagtggcctggccagctgcccactccctcttgctcacactcacatcaaagcccctggactccaggtctcaccaccagaaaacagccctgggaccagcgctgggcctctgacccccacctcccaggtggacaggtgccccgatgccccaaacagagaccacggaacccaaaagacccatttcaccatgaggaaggaccccacgtccaaacaggcaccctgtgggacacaccctgcccagagggccaccctctccatcactcaagatgtcagcacttctctctaacgccactcaaggcctgccgtgcttctcaggctattccttgctggaaataacggatcattctggccggacgtggtggctcacgcctgtaatcccagcactttgggaggctcaggcaggaggatcgcttgagcccaggagttcaaagccaacctggacaacgtagtgagaccctgtctctacaaaaaatcaaaatcagcaaggcatggtggcgtgtacctgtggcccaaactactcaggaggctgaggcaagaggatcgcttgagcctgggaagtcgaggctacagtgagctatggttgcaccactgcgctccagcctgggcaacacggcaagaccctatctctaaaattaaaaaaaaaaacccaaacaaaacgaaaacagccacagtcacatgtcctgggcgccaggcctgggaggccttgaggagggccaccgtctacaccacgacagcactgtcccacagcagcaggcagagccgcacatgcattcaggccaaggtgaaggctgccggtgcagtatgtgaccagcgggccacccccaccgccgccgccttggcagatccgagaggggtgaggggtgaggggttgccccccagcagggcatcagctgcccctgcccggagtgaaaggatggggctccggcgccttgccttcccagcatctctttccttaactctgccaggactttgagaaggtggctttcgtaatggaagaacacgacgtttacttcaagttcagcaatgcattccgtgcggttactttcttttttaaatgcaagctcttataaattaaacactagatgctgttcctcaaactcctgccacacacggcaacctacacggtcccaagcgccggacactaactaaaaacagacaggctcaggaacacgtgagccaacactcccgagaggcgagactcgggccggacgggaggcgaggtcatcagggttgggagtgggtgggactagaaagatgggtctgaaaatagcctgcacccccttcctggtgcttacgcggatctacacgcattgcaccgacactctcttggttttggggctgcgctgttacggaaaggtaaacattggggggaaactcggtgaagggtacacaagccccctgtgctacctttgctgcttcctgtgaatccagagtgatttaaaagtcaaaaaagggctgggcacagtggctcacgcctgtaatcccagcgctttcggaggccaaggcgggcagatcacccgaggtcaggagttcgagaccagcctggccaacatgaagcaaccccgtctctacttaaaaaaaacgaaaaaaaaaaaaaaaaattagccgggcatggtggtgcacacctgtaatcccagctactcgggaggctaaggcaggagaactgcttgaacccgggaggtggaggttgcagtgagccgagatcctgccactgtattccagcctgggcaacagagcaagaccctgtctcaaataaataaataaaataaaacaaaataaaagtcaaaataatgtatagaggggaactacatcaaactttaaaacttctacacatcaaagaaaacaacagagcaaaaggtaacctatgaaacgagaaaatatttgcaaatgtgataaggaattaatatctgataagggattaatattcagaatacataaaaaaactcagggtcaggggaggtggctcacgtctgtcatcccagcactttgggaggctgaggcgggctgatcacttgaggtcaggagttcaagaccagcctgaccaatgtggcgaaaccccaactctcctaaaaatacaaaaattagccgggcatggtggtgggcgcctgtaatcccagctactcaggaggctgaggcaggagaatcacttgaacccaataggcagaggtcgtggtaagctgagatcacaccactgcccttcagcctgggcgacagagggagactccgtcaaaaacaaaaacaaaaataaacaaaaaaccaaaaaccaaaaacaaacataaaaaagcagcgtctgaaagtcccacttgcacgccatgttcacagcagcaccgttcacaatgaccaaaatgcggaagcacctgctgtgccgatggatgagtgagtcaaggaaatgcagcctctccccgcaatggaataattcagccataaagaggaatgaccaccgacccgtgctgcagcacgacgggccggaggacactgtgccccgtgaaataagccagtcagaaaaagacagctcccgcaggtccactcgcaagagggccctggagccgtcaggtcccctgaggcagatggcaacgagggggctgggcagcaggaggaagggagagcgttgaatgggtgcagtttcagtttggcaaggaatgggttgtgtaacactaagagcgtgctcaaccctactgactgcactcacggatgattaaacggtcattaaacaaaatgttttttagaaacaaggtcttgctatgttgcccaggctggtctctaagtcctgggctcaaataatccttccgccttggcctctcaagtagctggtatgagaggcgtgcaccaccatgcctggctcaaaatggtaaatttatggtatgtgttctttaccacagttttttttaaaacttaaagcaggattaaagaccatttgctgttctgctcggcctgtgttgcgtcctaacattcagcaggcctctgccaggaccaggctagacgctaggcacagaggatacagcagctgccccgcggggggatgggggttacagtcaaaggaaacaaggtgacacacaaaggccacagagaccaaggagaggcctttgctgtccatgcagtgtccccatggcgttaaggcagagacctaaagcaagacagacactgaacagcaatgctggagggcagggaagggcaggggacagcaggggaaccctcccaggctggcagaggacttcctggaggccagaaaagaaccaaggggcacttcctcaagtacagcagagctcaaggggccactggcgacgaccccagaccctcccccgcagccttgctgcgcccacagttctttctcaggctgcggtctgtggctccgggtgcccaggcaggacacagtcccacactaacccagacccctgccctgccaaggtcttatgtggagtgtcccaacatgagttcccagggatgtcctgcaaatacccacctcccctcactgccccctgagacccaagtgtttctggctccagccgctttccctctcagttctcaaggagttctgcttcctgccgcccacacacggccagggctggctgacctcaccctcgccctgtcccaacaccaccagatgagcagtgactggcttggtcaattcaccactacaccacacaaagcaagaccggcctgagaacaggaacagcaacccacaggcagctctgaagggcctgggctttcagcgggcacccagcctccaacaagccactccacagtctgccctgcccagggcagccacctcatagtgtttggccagctgtgcccacgctgaggtggcaacgacaccaccagccaacctgaaaatcctgcaacaaaccctaaagagcctggaggcagctaggaccagttctcatgttcactggaacagtcccgtcagcaggggatggcctgggttgatattttagctcaaaacagctctggaggccttgaacccaagggcagcttacagtaccccgtctgtggccacactggggtgcgcctgagcctaactgtgagctgtgcccaccagtcagagcagaccctcccccagaaaagcagcaccaagaaatccagtagctactcaggaagttggacaggaaagtcacaacgaacacgaatccctcttgtgttgctggttttaacacgaccgggcacgactcacgtttcttcagagcgtagtttgtgacaggcaccgtgctcagcgctatgcatgcgttaactttttcgcagacgggaaaactgggcaacagggaggctacaggccttgcaggaggccatcggcgagtccgatgctcagagcacaaacgcctggcctaagaggtggtgtcttggcctctagactccgcctctccagtctgtctgcaggggaaggctggggcccttcaggaatggggtcctagcttcccatgggctcccctagagatgagccaaattcaaagcctgttcatgtgcgcagcagggctgacctccaggctccacagcgcatcccaaacacacactccctctgtcctttccccccgtccgcctgcctgaagatcttgtgctcttcaagcccaagccttgtgactgctcctgccccaggggccctgcagaccatccgcacagggcactgggcctgtctccagcaggaaggaagcagctttatgcgcctgcgtcccaggcagccacagagcaagtgcacgataaactattttttaaattgcttgtaagcagagtatccgctgttattaaatgcaaacaaacaaataagcttacaatgacttttaagggaatagtttttttatttttatttttgagatggagttttgttcttgttgcccaggcaatggcgtgatctcggctcagtgcaacctctgcctcctgggttcaagcgattctcctgcctcagcctcctgactagctaggattacaggcgctcaccactatactcggctaatttttctatttttagtagacatggggtttcaccatgttggccaggctggtctcgaactcctgacctcaggtgatccacctgcctcggcctcccaaagtgctgggattacaggcatgagccaccgtgcacagccgggaatactttctaaggttaagagatcaacagattatttcccaaaaaatcaactcttctatttgcaaagacagacaggaaaccccaagcacattcagtcccaagagaaactcaaattcaacctccatcaaggttcctaatctttacctttcagcccttaaagttgggtttattccttctaccttgtgaacttcagatttctttaattaaaaaaattttttttaaattttttgagataggttctcaaactccagcctgggcaaaagagtgacaaactacctcggaaaaaaaaaaaaaaaagcacctcactgcagcttcaacctcctgggctcatgcgactcctctgcctcagcctcccgagccagtagctgggactacagatgcatatcaccacacctggctaattttgtttttttttttttgagacagggtttcactattttgcccaggctggtcttgaacttctgggctcaagtgatcctcccctaccttggcctcccaaagtgctaggattacaggcatgagccaccacacctggcctttcttttaaaacagaaacacacacacacacacacagaggcatacacatacacacacaggcatacacacaaataactaatcacccatggccccatcacttcaaattaaccccttcagatcacttttcatgcagactacagcacggagagcaggagggcccacttcaaagggagctgagctgctgcttcttatcagcaaaaggcagactatgaccttctttgtctggtgcgtttctaaggaattgggaaaacctaaatgtaggttctatggaaacaggctgattttcgtgtccttcctaaacttttttttttttttttttttttttgagacggagtctcgctctgcccaggctggagtgcagtagcgccatctccgctcactgtaagctccgcctcccgggttcaattgattctcctgcctcagcctcccgagtagctgggactacaggcgcccgccaccacgcctggctaattttttgtatttttagtagagacggggtttcaccatattagccaggatggtctcaatctcctgacctcatgatccacccgcctcggcctcccaaagtgctgggattacagatgtgagccaccgtgccctgccgtccttcctaatctttaagcacaagacaagtgtttaaaggactagacaagagaaaatgtaaagaataactgcaaagcagattaagacccatcaacaaaacggtccattaactcaaaagtaacacaatacggccaggcgcagtggctcacgcctgtaatcccagcactttgggaggctgaggtgcgggggatcacgtgaggtcgggagttcgaggccagcctgaccaacacggaggaaccccgtctctactaaaaatacaaaattagccgggcgcggtggcgcacgcctgtaattccagctactcaggaggctgaggcaggagagtcacttaaactcgggaggtgggggttgcagtgagccgagatcgcgccattgcactccagcctgggcaactacagtgaaactccgtctcaaaaaaaaaaaaatattaagacaatacacagacagggaaacaaatgtacccgcaacggttctccagaccttaacactgctcagacgcacgctgcagggtgacatgcggaacgcattccaacctctgacttgctgcttattgtgtttgcctgcacattgcaaattcaactcggtgcgaagggagactgagtacaaatactcgtcactcccaagatcacctgaaagtcgggactgatccccacacagaaagatggcagataaaggcgctcagtcattctcactgaaagacagtgacccggctgcaatcttaactgtttccatctcccagggggtcaaaaacgcaaacaaaattagttgctcgtgtaggatgacaatttttaaaagtcacctgaacagaaagccacttgcacccctttagggccagtctgggggacaccggagggaatgaacgtgcgccacggctgccccggcgcccctcagcgccccacattccgcggggtctggcgagctccgcctcgcccacgcagccctcccggccaccgagcccggcgcggcctccgaagactccagaccccaggcgcccccgccagcccggccccgccgaggagccccggggcgcgttcccgagtccaccgcgcctcggtcgcctccaggaccgagacacgcggcgccgccagaaggctcacgagggcgcgggctgcggggcgcacgagggctcagtttccccgcctgcgccctgcccggcctcacctggcgcgcagccccaggcccagccccgttcagcagcggcgtccccccgccgggccgcgccgtcctccgcagcagcggcgccgcctcctcgtcgtcccggtcccggccggaccaggacaccttcttagagacgttggccatggcccgccgcggagcgacaccggccgggaagcgccggctgcccccgtgtttgttctcgtgacccgcgccggcggccacgtgacgcgcgacggggccacgtgatgagcgac

SEQ ID NO: 1634 - DNA, 30152 bp, Homo sapiens; identical to SEQ ID NO: 1633

SEQ ID NO: 1635 - DNA, 136039 bp, Homo sapiens
gatgcgcatgcgcggccgatttgcacatgcgcaatactcgcgctgcctccgtggtccctgcctggctgaggtggcagcagggggcgggacgcgcagcgctatggcagagggcagcggggaagtggtcgcagtgtctgcgaccggggctgccaacggcctcaacaatggggcaggcgggacctcggcgacgacctgcaacccgctgtcgcgcaagctgcataagatcctggagacgcggctggacaacgacaaggtaaccggggctggcggggccggagtcacaggttcctgcggggctgagccgggccaggggcggcgtctgtcagggacccaccgcggtctccctcgtcccggcagcagagggaccgcgagtgaccccagacctgcgggctccgctgctctgcgggcgccgggggcggtgagaagggggagccccagcaacctccggaaaagcgaaggggtttcctgggtgttctctccacctgaaaaggtgccttcaaggctctctggatgggattggtgaacggtggtgcctcgagaagtgtcctccaaacacccctggaggcgtttggctgtgtgagctgggagagtggaggagagcacaagactggatatgaaacagatgcaaaagagcagattccaagataaggtagcgcaaatgggggtcgggagaccaagagagcagtggtagggataagggtgcatttccacggacaagtgacaacaattgcaataatttgcagcgcgaaagaactacctttgcccgtggctgaaatgaactcatatctactagtttttgttgagccaagcgctatgatttgtgggctcaggctgtatttctttagaagataaactgacagcatgctctcacaagtacctcctgaaacttaagttggactttacagctcctcacatacccagccatctcttctgtctctgtgggtcgctaggtaaattggtcatgacagtgtaacataaagaagaacatatgtcaaagttagagagttttataggtgaatatgtaggtaactgaaaataagctgtcgataacaatttgattccgatatgtaaaaaaataacattgcaatgtaatgaataagaaattagggctctggagactaccacttattagatagaaccactaaatgtgtgcatcatgatttgagtaagtcccttcactaatctcagcttctgtttaggaattaggaatcctgctgttaagtttctcatggttgttatttgaggactcagtgagagactccaggtaaagtcctttgcaaagagcctggcacttactctttcttaacaaatattaattttatcataaaatttatgaagtgtttaatgtgtctcatattgatatttattatatcatttaagactgctacttgctctgatatagataacatggccttcttttttggacagagttttgctctttttgcccaagctggagtgcaatgggcgcagtctcggctcactgcaacctctgcctcccgggttcaagcgattctcctgcctcagcctcccaagtagctgggattacaggcatgtgccaccacgcctggctaattttgtatttttattagagacggggtttctccatgttggtcaggctggtcttgaactcctgacctcaggtgatctgcccgcctcagcctcccaaagtgctgggattacaaggcgtgaaccactgcgcccggccacataaccttctttttaccatgaggaaaataaagcatggagagagtgcagctaggttgtcatataactagtaactggtggaactgtaatttgcatctgagtctgtgatttcattcgttcaacattactgattacttctttgaaccagaccttaggacatttcaaggctatagtctaaagaaactgcttcacttcatgggttttttttttctgtacagtaagtatttatagttgtaaacatatttttgcttcctctgaaatattaaattgaatttatataaatagttttactgtttttgtcaatccagccaatatttcaaaataacaaatagaaacatgaaagggtaagcctactagaatatacagtagtggaggtgtagaaatgtatatctgcagaatttagtgtacaatggggatgtcctgggcttggttctctgctctctcttccattcatgttttctctgtaagaaaaatcttgtactttcatggttttaagtagcaaaaagcatgattactctcaaatttataactctgtttctgacatctactgagctccagatttgtagaattagttgtctatactatacctccaattggatactgattgacgtcatagaacttaacatgggcggaactcttgatttttccctaaactggttccgctctcactaaagaacgtcaccatttacccagtcaagcaagaagcatatgaataattttggattcttgtcacttttttttttttttttttacatctcctgcaaatccacaaacatatcttataggttctactttgaagaatatttttggaatatcttttttttttttttgagaccaagtctcactctgtcgcccaggctggagtccaatggagagaacatggccttactgtagccttgatcttgctggctcaagcgatcctcctgccacagcctcccaggtagctgggtctacaggcacatgccaccatacctggctaattttttgatttttttatagagataggggtcttactatgttatgcaggctggtcttgaactggcatcaaactatcctcccaacttgacctcccaaactgctgggattacaggtgtaagccaccgtgccatattttggaatatctctttttcatttgtactactgccatcttggtctaagccactatcaaaccatactgggattatttttgttttttctcttacctacctcctttcttgtacccctttaccattcattttccttacaaagttggaataaacttttataaatataaatcgtattacattactcccctgcctaaaatcgtaataatttctcataacttcagtcatagtggccttccttctaccactttagggtctttgtactcattgtttgctctgtctgtggaaggctttgtccccatgactggctgttgcctacactgaggcctcagttcaaagtcacctcagagaggccttcccctttaagtttctccaagttctacttccagttattcagtttctagcctggaggattccagtacttattcttaaatagatcattccagagatagttaatgtgcacattatatatgtgtcaactaggtatacacaagtaagtatgcatgtatatattccttttaagtttttaactgttggtattacaactgtttctatgccttgatgtttcacttaacatatctcaaagcttatactacgtaagtgcataaagattttttttttgtgaatgagtatatcataatttatttaaccaatcccttttagatggacatttatattatttctagtctttgcaattcccaacaattctgcagtgaataatcttgtatatataacactatacacaagtaagtatacccttcttgtgttctggaaataagcatgcttcagtaatttgaaggtcattcaatatttttcggattggttaatgaaaataaatcatttgaaaatgatttcattacattttgtcttgagatttgaaaccatttaaaaattagttccagtaactgtcttctgttaccaattgtataggagatgttagaagctctcaaggcactttcaaccttttttgttgaaaatagtctgcggactcgaagaaatttacgtggagatattgaacgtaaaagtttagccatcaatgaagaatttgtaagcattttcaaggaagtgaaggaggtatgtaaactcttttcatttagcatatattgagaacttactattacgcctggctctgtgctaagtatttttttgaattaggttgatatgtttgctatttgtatactatgcccaaatagaaagcttagctaatttctcttgctgcatctagatctttatttgtattaatgtgatttatgaatctgtgacttccacaaatattaattcttagaaagttaacattgttctagaagattatcttaggaattttagcttttttaacaaaaaaattaacatttccctgaatggctttccaatagaaatatcccctcattgcataaacctctcttggataacaacttctctactggagattaattagaattgagttacttttactatatcctaaaatatgaaaatttcagattaagatcagtaacttcaatgtattaataatgattcatcatacttgagagtgtagtccactcaccacagagtgaaaataaattttatgttattatatctttattatgtaatattttattagctgttttaatacattgtaatactaatatatttctatgtgagttatggaagtgttgcacatggtttcaatgagtgttcaataaaaataggttgtttttgacaccttggtaggtttttattgactgaagactaatactttggaaaggatttttttaaaaaaaattacattagagatggactcttgctatgttgcctgggctggagtgtagtggctgttcccaggtatgatcatagtacactacagcatcgaactcctgggctcacgcaattctcccacctcagtttcccaagtaactgggactacaggtgcctgccaccatgcctggctcttttaaacatcatttcctactaaaaggaacaatcttaccagtatcagaaagcaaagatgctatctgagactattggatacatgtcaaaaggactttggagctaatgtgaagaggattcttctactggccaaacataagactatttgaacatcaataagagtaactgcaattgaataacactagcaataaagggatattcagttttataaagcatttgctgttttcctgcggtcatattctctaaaaggaatggactattttctttacattttttctaacactagatgttattctttttaatcatttccaattttaaatatgggatctcttgtcatgccttgaccaaaaaaataaaaaattatgtaactaaaataaggatttagctaacagaagagaatcttcttcttgctgtatatatgatgtttgatgttacttttcttcttttcaggaacttgaaagcataagcgaagatgttcaagcaatgagcaactgttgtcaagatatgacaagtcgcctacaggtattatataatggctagattttggcatagttcctgatataaacttacaaaaattattattgacaaaatgtgtagatatctaatccataatgccctgtaggaaatttgggtataaatataatccttatttttaaaaattgtagctatctttgtgtttctttggataatgatttattaatattgttcaattaactttagagcatttatattttggtctagccagtacagagctaactacgtagaattttgataaacctttcaattccgtaatattctagaaatctaggagtaatgattttttttagtaagaagccttaggaataatttcacactaaagctgtgcctgataaagacctagcttaattctgatttatgcataaccttaaaaaattctgggaaaatatgtatacttttaggtcttttaatgaaagcagtcctaaacttatagtttggtagcagaatcagcatttgacttaattaacctcattcatctaattttggaatagtacatagaacggtttcctcctaagggccaatcatgattatgtctactgccttcacattttaacagcgaatttatatctctaagtgtctcttggaacgattgacatcaacagtgattctaggaagaatcattaatgcatattctacagattaatcacaggctacttgcatcatcagtttgcaggatgagttaatttcttgtttctctaaaattttatcttttctggtcttgtctaaattttgatattcttactaatctatcagatattattggcatgtttattgtctcttagtccaatatttagatatttgttaatttgacaatatttaaataattatataatatatactaattattaatggccatttcacatttttggcatatatttactttattcctcagtggttgattttgtttgacccttctttttctttaactttatttccttttctcctcttttagcttccatgacgtaatgccttttctcaaattatactttataaggttttctatattgtacttttgtgttttttaaataacattatgctttgttatattagactactcagtttctgatctttagtgatagtatctcttattttttaatttgtatccttaattatgtttttatacttttcatcatagagagatttaaatataaaaagatcatagtatttttatttgtgctatttttcaaacagtttataaatattttaaattacaaccaaagtgtctctttctgttttgtcctttgtattttttttttttttttttgagacagagtctcgctgtatccttagtggcgtgatctcggctcatagcaacttccaccttctgagttcaaacaattctgcctcagcctcccaagtagctaggattacaggcgcctgacaccatgcctggctgatttttgtgtttttagtagacacaggatttcgccaggttgtccagggtggtctcgaactcctgacctcaagtgattcacctacctcggccttccaaagtgctgggattacagacatgagccaccatgcccggccagtcctttatattttctttgcacccacctcacatcctgttttttcttctgcagtggcatgggcctattttctttctttattcagatcaactttattgaggaataatttatgaatggtaataaactgcatccattcaaagtgttcaaattgataggcttggcatttttatatgcctgtgaaacaacaactataatcaagatacagaacatttttatcacatataaaagattgcctcatagctttctgattgaatatttaaaaatatttaatactgcctattgtttacatttgtttttgatccacatatcatttttaatagtaggaggtccatgattttgaaagttttgtttattccttaaaattttgcttaaagctaatttatttggatatagcactattggaattctaatagtatacattcataatatcaactctaatgtttttaagttattcataaagaaaagtgtttcttagagtatcctcactttccctttttcttatagaatgttgttataatgattcatttaattatttaatattttctgaaatgctttgactatggtaccttttagaaattattagaaaacatttaaaaatgtaatcagtcattttatatatgttaatatttattcctttgtggttttccttgcatatgtttaaataataaacatgcatttagatgcatatgtttattattaactcaaaaataatcatctttaacatttaagataaatggagattgaggttaatcttcattaatattattaaatattactttggaattcttaccatagtttataaatgaaaaaatcaggaaatatgcaaaaaaattagcaaattcttattatataacattgtgctaaattatcatatttcattgattaataaatggtgttgattgtaaggtgcaccctcaataacgactagcctaaaaagctagtaaaggttttttgatgttgattttgtgaagcattctttttttcagaaatattaaaatgtaaacatatctttgacttgaggggatactatattttaaaaattgcacaaggcaagactgtacaagggtggaaatggaactttagcatttaagaagtatgagcatttgaagaacttattggcagtctaataattctaaaagaatattttgggagctatcatgttgagctccattccttaaaagtcagtgaaatggctgggcgtggtggctcacacctgtaatctcagcattttgggaggctgaggcagaatgatcctttgtgaccagcctgggcaacatagcaagaccccatctctaccaaaaacttttaataagttagccaggcatggtggcacatgcctatagtcccagctattctagaggcttaggtgggaggattgcttgggcccaggaggtcaaggctgcagtgactcaagattgcaccaccatactccaggctgggtgacagagtgagaccctgcctctttaaaaaaaaaaaaaaaagataagggatatgcaaaattatctaggttcaaattgttttcttaaaaaatctatttcctgggaacatacactcaaaatagcttcatttgaggtggcaatcaggctctgttattgacagcatacctagaaagcaataagacagagaatttccctcacagtctgaaaactgagtttgtagaggattaggcctctaagaacccagaactggaggtgtctaggtctaaggcagctctagaaagaaaccgcagtagcagaagcttgactctttattgtggtattccaacatgaaaatgacccagtgtcttcaggtgtttgctctggtattttctctttaacagactgattcaccttctattttatgtgtttttctccactttactaatgacttaatttatgcatctttctggctcatttaatatttcttcaaggcacagaccttgtttctctacgtgcctcatgactacttctcttcttattgtttattgccttatttttgtaaatattccctagttcagatatttgagagagaatctcattgtcttttgtttaaagccacttcatgaatgttttctaatcttggataagatgcttttttaattgactttccacttttgatcaactctggcttagggaagggagaattgcttagaatgaaagttgattaggaacagccttgtgtcctttagatggggctagctctgatcctcaccaaaaacttatatggcaggtagtttgtatattacaactttcaaacttttacctccatcttatacatttctattgagctccacactagcatttcagtgacttagttaacaaccccatgtaaaggttgcatggtatctcagttcaacacgtccatacctgaagtcatgttcttcattcttaacttgtttttccagtgcttctgttgcactaaaaagcatcatgaactattaagttcctttgtcagtatctggatacctttttctttcttgtaagccttagcattatgtgtatattaagaactgagtgtgttcctccagtggatgagccttgaaacatctacgtatttcattttattgtgcttttgagttccatagagtgatctcatttgttttaagtctaaattgcagtaagtggtagtatttgttttctgaaatataataaaattggaatttacttatattagatatgtttataattttaggcagcaaaggaacagactcaagatttaatagtaaaaaccactaagcttcaatctgaaaggtaagtttttcttcatacaaccaccttttcaataatttggagattggagtcaaagaaaattatatataactccaaatcagaattaaagcagaataataaaaaacatggttcataaggtcctaaactattatattacccaatagtaacttaagcataaagacagtagtttaggagcaataaacttgacattgaggttgagagattattccttctttggaagagaggtgatgatgtatcgttattgtttgctgtggagttcagaaatgatgctttttaaaatgtaaatgttttcagatttttaatagttttattacttttttttcacaatcattgtcttttatttttaagctatgatatatcctctctggtataattaagagttaattgtataaattctccttgtagtttatacaataggtatactattggttgattgaatgaatgagtgagtgagtgaataaaggtgagtacagtctggatttgtgtaatgtgtggtgttcagtattgctaaaactcatagcaattatgctaaaactcattaactgcatctctcatgtgtggagtagtatagggggggagaagcattatattatgatgcagtatacttgtctcctgctcagtagttgggtacatcacttaaaccttttagtattctaggtatttcatcagtaatatggagatattaccactttaactgctgattttggggtaggtcagtatactatagtatagaccacaggttatcaaactatggccacaggccaaatccagctcaacacctgcttttgtaaatgcagctttattggaacacagctatggttgtgtttacatactgtctatggctgcttttaccctactgcagtagagtcgtgtggttacaacagagaccatatgtggcctacaaagcctaaaatatgtactatcaagatttttacagaaaaagtctgtgacttctgatccaactagtgtttttttgtagttcaggtcaagatcaatgggttgtaaattatgatttatcaatcattactactatttaaatcgatcatagctagccttaaaaaataaattagaatgaaataaaatagaaaatagtttgggtagctgggcatggtggtgcacacctgaagtcccagctattctggaggttgaggtgggaagatcatttgagcccaggagttcaaggttgcagtgggctatgatagtgccactgcactccagcctgggtgacagaaggagatcctgtctctaaaaaataaataagtaaaaatagtttgagtgaatattattttgtgaagcctttctttcagtttcagtaatggttttaaatggtttaatattatgggtcataatcaagagtttgaaaaacactgccctagaccaaaaatggcaagtacatgacccccaactccttagttttacatccactgatcttgacattcttttattttgagcccttaatccttcttaacacaattctcttcagactaagattgatgaatgggaaattataaagagtgcagaggtgtaaagttacttgtgtaaaaggatatcatgggtcttagggctacaaaggactcagagatcaactggaatgatccattgcagttaaaatggtaaccaatgtaacttacttttctgtcttataaaaacattgagaaaatgtgacaaaattagcaaaataaaatatatgtaccaatatcatctaaaaaatactatctttaatagcacaaaacaaagaaaacattttctttacacgtataggaagtacattattggatattggaacatgtaccttatcttagacctgtggctttcaaaccatagttcattgaacctcagggtttctttgcaagacgtagaaggataatggagttttggaggtcagattctctcaccctaattttagtgagagcagtttcacttttacttgtttaatatattaggattccatgtaagattttgtttgaaaaaagagtttgacagcaggaaaatataaaaatattgcacaattttaagactagttgaaaggtagaataccaaataaaatagtcttttgattttattcctcatgccagagaaaaatctttaaaaacaactaagtatcaaagctttataaaagcttaatcataatttcatgcatttaatcccctttttgtttactaactaccttctctttcactaaaaatccacttttacccgttgtgtgttttctacaagccaaaatgagagcaagttgatgttgtcctcagatttatagaattgcaaattgcctggatagaaattaaatttaggaagtctggccttaaattcccttttatcttgttgatattgtcattctgtattttatagctggataaatgatcatatcccccacattggtggttaattacttgatgttgacctataagtcagttttctagtacttttcagagcatcttcaatccaatccttttgtgtttaacatttaatcaaagactttagtgtatatatagacaacttacttggaaaattgtgaatgacacaaagtatggaatgttaagtgtaaggtatcaacagaatcaagcttttaagaaaaagtggggctgggcaagaggtgaataggatgataaagggtctcaaaaaatgatgtagggttgaaaaaaacagaattgtttatttagaagtataggactaagaaggacatgatggctgtcttcaaatatttgatgatctttcctgttttaaaaaaggctaaattttattatatattgctgctgagtttggaactgagttttaaaggagaaatttaggcaaattttgacttaacgataagcaagaattttctatcccttacaatttgaacaattcttcaaagctttttttttaaaatcactggaaatatttagtcttatgttaggtgtcattggagccatcttttatttcagttttcctttctggtcttttacattacgattcatgtatccacaccttatcacagtaaacataagagccaccaaggagcttgataaaatggcaagttttggcctccatcctcagagaatctgactgaaaaaagtaagcaactgtgtttttttgattaatgactcagtaaatcttgatttgggctcaggattcggcccttttaacaatatcccaggtatttttatgcagtggtccagagactataatttgaaacacctggccttagacaaaatattacttatatttttaattttttgtggaatgtccctctcccctaccttaattctctcatctcctaactggtaaactttgaaaaaacattttaactttttaaatgttaaactttatattttgagataattatagattcacatgcagttgtaagaaacaaggccgggcgccgtagctcacacctgtaatcccagcactttgggaggccgaggtgggcggatcacgaggtcaggagatcgagaccatcctggctaatgcggtgaaaccccatctctattaaaaatacaaaaaattagccgggcgtggtggcgggcacctgtagtcccagctactcaggaggctgaggcaggagaatggcatgaaccagggaggcagagcttgcagtgagctgagaacgcgccactgcactccagcctgggcgacagagcgagactccgtctcaaaaaaaaaaaaaaagaaaagaaaagaaacaatacagagatccaaggtagcctttaccttgtttctgccaaaggtaacattttacagaactatagtatggtaccacaactaggataatgaccttgatactatctacctgtcttattcagattttgcagttttactcgttggtgtatttatttttatacattttatcatttgtagattcctgaatgcgccaccatagtcacgatatagtacacagttccatcaccacaaatagtgtcctgttggtgggtggacagtgtgagaaaagttgcagactaagcccatgtgggagatggttgactctgcaaagcagccagctctgtgaggaaaggcagtgttaaatttctttatcagaattaagcctgtgccttcaccataaaattagattgcattttataacagttcttttgaaagaaaagtttcctagaaaaacacattccctgttagagaccttgacattaatttttctctaagttaatgctgaacacaaaaacaagcattactttaattgaaaattgtgattaaaactaagaggataacagatcaataatcctgtatgcaaagcctttttaaacttttcctgttctcagttaaatctttttgttttaatttttagtgtaataggtattacagttgtttgcaactaatcgttgatttgattgtctctgtttctcctaaactgtgagctccttgagaaaaatgacaatttcttattctcctttttgtatttgcagtgcctgctattttacagattcaataaataatttttgagtaaatgaatatggaaagcaactataatgttaggaaaggaacataaaactgaaaaataagcattgtattggagcttgtaatatggggctctaaataatgtatataggagacaatattagaacattgtgcttctgttcatgtgttctcaaaactatttaagcaaggtttatgtttattattttagtaagcctgtggaagtgttttggcctgatatgcttttgggaagtgaaaatttatgacattctggtatcccaagagctatagatatgatgtgccaagtgaacgtttgtgtgaatgtattttaggaaaattgcaaggcagaaattatgataacaggtctctgggggctggcagggagttgttttttcattttaaaatatctttttaacaagaaactttgttaaacaagcagttagctttagaaatagaaatctgtttctatatgggattatttgaataatacgatacttttattcagacaaatgtatgaatgatatgaatatttttccaactgagtgagaaggaagtcagtcgtcaggacagctgagatgctctaatagataaagcttaatgtagaattttattcacaggactgcaggttagcatttccccttaatagttcattggtagtcagacgatgggcttcactgataatcaggaaagactatatgtacatgaacatacctttgtatttttaaaatactactaaaatcactattatatttttattatctcttataaaggcccaccagccagaattctctctggactcagaaaaataatctctggagaatgtttatgtgtgtgtatttttttaagttcagtatgttaaaatggaaagaatataggacttaagacaaaaatctgaatcttaatcgaaaccttgggtaagagattattagatttttgattttgtacagttatttcttaacctcccttaacctaagtttctatgtctgaaagaaggaaggggaaaatatctatgtcatggggtttttgagataactaaattatttacgtaagttgctgaagacactgcatggcatacattaaagactgttgcccctccctagtcctccccttttattagacaaagaaatctatgtcactcatcttatttctatttttgctctgtcatctaggaagcttagagctattttgtgcttaattgcaatagctttcctcagatgtatgatttactttctcagcctttccctttatttcttactattttagtttttaatagttttaatttatttttattgcattgtaaactactttaactcaggttttgaaattggtagcataaaaatataaaactttatcttgcataaatggttttatattgcatgtaaaagtatattacagaagcgtatgtggcacattttctttcattacctaataaaaggttaggggaaaacaggggagcatcacatctcctttcttctttcttcttgtctcatttgtacatagtagcagctatccaaaaggaaatattgccagtgacatgcaggagcctgactgagataagctataacaactttatttcagtcacacatattggactggaaataaaaatttgggggtaaggcacagtatggcttatccatttcttgtgattatgatcatgctgtaagggaaatagtatgaggaaaaatttagaaataatctttggtttaagtattttaaaagttgggtttggagatggtatggatttttttaaatgaaaattttgtctgatcaaattttccccaccaatgaaaaagagcttttttttgcgtaacattttttccccaccaatacaaaagagcttttttttttcttcctttttttttgtgggcacgcttcatttaaagtggctattgctgtttatttcctgatttaactacatttatcaaccaggtagactttttctatattcttattcattctacctggaattccatttcccaaaattaatttgttgaaaactcatttgtcattttaggttccctgttgtttatgcccatcatatatttcaaaatattttacaaaacttaagaattttaggctatcatgtatgtgtatgtttgtgtcacacatgcatgtacatgttccttgagaatgtatatatgtatgtacctatatatgtttcaaagaaagtcttgcttactttaaaaaatacttcagcttataggaaatttatttcacctttgtactttacagttttattatatattttccatgttcagccaggaacctttactcagtcaccagaaaaaaaaataattagttccttctttgtactcccacaacacattattcttctagcacttattttctgccctatgatttctcaacagtgctggacgttatggtctttgactattttaactggatagcaaaggcagtgtattaatgctctttgtacccactcctttctacacagaaaacttttcaactgaatatgtctacatggttactttaacattttaaatagttacagctgacattgcctgttaatatttgagactcttactttataagagtaatagcaagtgtgcatatatacttaactaaatgttattaaggagtggaaagtatcaagctggaagaatgtattagatgccttttaagctgtattttgtacagttataataatacatgtaattgtaattcaaaaggtagatccttttttgtttattataaaaacatctttgttgagatataattcacatatcataaaattaaagtatatagtttattggttttagtatattcagagttgtgcaatcatcattatgatctgaattacaacattttcaccatcccagaaagaaaactcctgaccattagtagttatccagccttagtgaaccattaacctactttctgcctctctaaatttgcctattctgaatctttcatgcaaataagatcatacagtatgtggccctttttgactagctttttccacatagataaacacttttaagattcatccatgttactttaaccttttttatggctgaatagtattccattgtatagcaacaccacattttgttcacccgctcactagttgatagacatttgggttatttccactatttgactattgcaaataatgctggctgtaaatatttgtttacaagtttttgtgtgggcatgttttattcctcttaggtatatatttaggggtagaattgctgaatcatatatgataactctttaagtgtttgaggaactgccacactgttttccgaagaagctgcacagttttacatttccaaaagcagcatatgaggattccagtttctgtacatctttgtttttaatctgtcattttgatgatagccatgctactgggtgtgaagtactactcattgtggtttagatttgcattttcctaatgactaatgatgtcaagcatcttttttttgcttattggtatttgcatattttctttggagaaatgtctatttacgtcctttacccattttttaatttaggttatttgtgtttttatttattggttgtaaaagttctttatatgttctggatataggtttgttaacagatacattatttgcagccattttctcccattttttgggttatcttcacattcgtgatatcatttatagcacattttaaattttgatgtagctcgttttatcttttttgtcatttgtatgtgctttatttttcaatgtatttttgtattgaagttattttatctatttgttttaaaatactaagataaaaatttagaaatttatcaggttttgaaatcatggcatggtactggaaatgctgacaagaaaacaacctcattacaggattttatctctattgagttttaaccagtctttcaaaaacgtttaactttcagtttgatactttataaaaacttaaaatgaaaagtttcttctttttttctattttagaaccaaaaaaaattatagaaatactttttcttaaggattgtaaatgataagcagattctttaagatcctgtcaaacaggttatttcacttatctttccatcatatgaattaggtaaaaggaatcttttaagtgtaaaaaactgccttttctttcttaaatttttttgacataatgttaatataaatctattgtataaaatttaaggaaaactaaaatcatatataactctaccactcagatagaaccacaattaatattttggtatatttccttccagagtgagtatgtgtgtgtattgttaatattttacttttttcccttaatattttatgttcattttcctatgattttttatatcaagaggatcatttttggaagtgtcctgaaatataatgcctaaatttttctcaaaaaagattatcacaatttctacttccattctgtctattttattaaacccttatcagcattagatatcatctttaaaaactttgccaatgtagatgaaaaatattatcacaccattttattttttatttttatttttaattttttttaaattatactttaagttctagggtacatgtgtacaacgtgcaggtttgttacatatgtatacacgtgccatgttggtgtgctgcacccattaactcgtcatttacattaggtatatctccaaatgctatccctcccccctccccctaccccacgacaggccccggtatcacaccatttaatttacatatcatcgaatagtgatgaatcgacatgtttctcattttgttttgccatttatatttctttactttttttgttttggtttatatcttatgtccatttaaaaaattatttcgaaattatttggtgtaggtgaacctagaggtagaattaagatacgacagagataagttttcaagaaaaagaaaagtaccacaggattcataaatcatgttctgggctgatttgaaggaatcatgaaaattaagtagtccgtttattttaaatacttaggcagtatacgactggacatactgaaaattgatgtacatgtgtttatatacagtaattcccaaccttgtctatggttttgctttgtgtggtttccattacttatggtcaactgcagtctgaaagtaataaatggagaatttcagaaataagcaatttgtaagctttaaattatgtaccattttgagtagcatgatgaaatctcaagtggttggctcccactttggtgggacatcagtcatccctttttctaatgtgtgatgctatatacaccaccactcagtagtcacttagtagccgtctcagttatcagattgaaaaacagtacgtgtaggatttggtaccgtcagcagtttcaggcatccactggagggtcttggactatatcccccgaggataaggggggaccattgtaattacttcttaaaaataagtggggattcctatacatactttctcgcaactttttatacctataaaatgccttatggatcattttgttagtacatatagatctacctcagtttgatctattatgtatttttccatagtgtatatttcacatattattatttatttatataatatacagtgattgcacaaacataatcttaaatacgctagaagttataatttatatgttatgttaatatttatctcctatactttttacttagacattgaaagccctctaaaagttccatatgttgatgtaaagtaaggacaaggtctgtgtcataagtgccttttatcacactcgtctctggcataggccttatacattgtgagtctccaataatgttatttgaatgagtgaatattcccaaaccaaatcactggaccatctaacaataacttcctgtcagaatggttgtgaaaatttacctggaaagaatacatgtggtaaaactagagtaatatgataataaaaaatatattagaatttattgtcactacttttaaagttaccatcttgatatattaaactcttgttttagtactgtgcccattataaaaatatttttgcaccatctcttttgtagctatatatagagcctgtgtttctgtctttatctcatgattgatttttagatccacattatttggaatgaattgtaatgattaaggggtatgatcaaggtgggtagcatttgttttggttacaacaaaatgaaactataaactaaagagacaaattttcctttgtgcctaataaattgattctaaagatagatccaaaaaagctcccaaaaacattttatttcacatggttaatttgcatagtctcaaggaatttgatgaaattttataattactttaaattcttaatgataatgactggaacttttaaaaatataaaacaaaacctgttaaggtaactctttaagcttttaaaaattcatttttaatttataattgacatataatgattatatatatttatggggtacaatgtaatgtttcaaggtaattaccatatctatcactttaaacatttatcatttctttgtggtgacaatattcaaactcttcgctatcttgaaataccactgcattgttatttgctgtagtcaccctagtttgtaatagaacagtagaacttactcttcctaactgtaactttgtactcgttgaccaatctcttcctgtccccttctccccactatcttccccaacctctgataaccatgatctctcaccatacataaaaataaactctaaatggattaaagagtaaactatacgaccccaagttgtataactaccagaaaaaaaataggagaattgtttcatgaaattggactgggcaagaattttttgaataagacctcaaaagcacaggcaacaaagcaaaaataagataaatattaagataacttttagatatcaataataagatgattaagaacatgacatttaaatctgtgtatattcaattaggtgatttatcatttgaaataaacagatctttgctgccacctggaggatttttgcttgtaaatttctttattcagtaggagcattagcattcaactttgaatttaaaacctccatcccaaaggtgcaaataaaacagaggtggcagatgcattgtaccatctatacaaatagtgtttatgtttatctttgttcattcttatttgaattttgtttaattgtggaatattactattctctgaatattgctagtgaaatacttttataactttatttatatattttcagttctgagatacagaaaccaggaatgttgagtttctgttcaagtagtttgtgttcctaacttgcctgtgggtattgattcttctcagtcccataggtccttgagtgtgcctttttccgtcagctagtttagataggttgcactcatataatttaaaaggttgtttttattactatattttgtagaaaaagtggggaagaccaaagtggataagtgactagcaatttatggagaattaataaaggagttcttctataacataaaataaactaataaatttgatttttgatatgtacgtcatgtgaaaacttaaaaggcttaggaattgttttagtgactgaaaagaaattggttgaaaacaggaacatatttctctcttataaaagcatctagcaaactgcaaggtgaactatttaagtacttgtaagtggctgcaaatttgtaatgcagggaccatgcatggacttatttgttcttttgcgtaatgatcaactccatttattgtgtgcaagtatctgaaatagaacaatattagctaattttatcacctacatgtctgataaaattctaatatttgaggcagaaacaagacttttgaaaatattgagaacttttcatacctttgttttaaaaatttattatgtctgagatagaatttgttttaaagctatgcaactgtgtaagatgcttgatttttattgcttgttttgaaaattacagccaaaaattagagataagagctcaagttgcagatgccttcttatccaagttccaactgacttctgatgaaatgagtcttctccgaggtacaagagaaggacccattactgaggtatcctggctttctgttataatcatttaaagtttagtagttacagatattagagagaaattgcttttttgaagctttattttcccattaaaaaaagtttcatctgagaatatttttatgtttggaaatttaagatgtgtattttaattatatttttcaaagtaatacatgtactttttaaaaagagtcaaagttataaaaagaaaatctatgtcacctattttactcttcctcacctctaggtcttttgtcaaccattttcaatgttattaattgcttcttttgtaaattctatattctagatctatagttaaaaagaatatgctttgattatctatgttaactattttctattgattctctattgtgaaatgtgaggatttagccttctacccactctgtctcctcccccaacacagatagtacacacatatgttctctttatctccttcatacatcatagtacagttagaccacattttctattttcttttcctttttttttgagacagggtctcgctctgtcaacctggctggagtgcagtagcacgaacacagctcactgcagcctcaacctcccaggctcaagtgatcctctcatctcagcctcccaggtagctagggtatccaggcatgcaccaccactcctggctgattttttaattttaatttttagtagagataggatctcactgtgttgcccaggctggtcttaaactcctgagctcaagcgatgtgcctacctcggcctcccaaagtgctgggactataggtctgagccatagtacctacccacacatttttcattttcattacagtgacattacagtgattgcatgttctttcttttataactttgtgtctttccttgggttagaaatcacttgttttttcatctaattaattttttaagctattccattttttccaaactggctgacagaattatataacctctcaaaatgttaaataacaagaaaaagtttcgtttctttttttttccttgaagacattcaatttttccagaaaggaatcttttggtcttctcgctgggaagaactgtaaacttaagcctatcgtcatcattgtgggatcagagggcaagaagggttcttgaggtggggaagggttctcactgagtgtctctgagtaggtatcacttttactggcttggctaaaatggaaccagtcatttgggtgtagagaggtaaataggtgagagaattaatagagatattatgtattagtatgtactgccctcatgttttgaggaactttgcacatatgaaatatttgacatatcattttttctccccttggtagaaattagaaaatgagggttattattattattattattttaagttttattcatcaaagaaaaataacacatccgttatttttcgtgggtggaacactatttgtggcactctgaaacctaagcctccagtacatttaaatatcaatcaacagtttggcatctgtcacctcctatatatttaactttgcattctactcttggacgagggagcaataatgagtatacaacagatacataaaacatcatcttcagcaataagaatgccaggcttaagtaataaggtgtgtaatacacaatactttttttcatgtagtaatttttagttttgcatttctcactagactacgtacacttcttgaggacagggatttttgtctttataaattttattttcctggcaactgtcaacactatttggcacatagtagaaactgaattaatatattaatatgtcttaaaatgtgaataaataccagttacaccgtctatgaaaacttagagaaagttgagatcagtataggaaggcttccctaaaataggtgaaagagtttgtttgcccttggtagtgacctttcagttttaaataatgcaattttgcctgaagcatggacataaagtcacattcttaattttaaaggattttttcaaggcactgggaagagtaaaacagattcataatgatgtcaaagttctcttgcgtacaaatcaacaaacggcagggtgagtaactgctcactgaactaattgcattgctgcttatgtttccaaaattttaaagatattctagattgtttgtgaactatatagcattttgtgaaatagaagtttaatctttatttatctttagagaatggtgaagttatactctgacaggtttaggctaaaacagcagttgataaataagtgatggttaaaatgtgacatttatttaattgtagaaaattattgaaaaatcatcccataaaatgataaaaagttaatatgctgtaatatgtaatatgcaaacaaaataattaggtgcttagatgtatctgttgactaaagtttaaattataatcattaatttttttttagtttagaaattatggaacagatggccttacttcaagaaacggcttatgaaagactttaccgatgggctcaaagtaagtgatttcttttatgttgtctagattcatgaacatttgtagttgttttttaaaattttacttggtctttatttgatatattttgattttagtaatcaaacattttttaaaaataaaaatagtatttgtatttggtttttaaatttttacttggtctttgatgcattttgatttagtaatcaaaaatattttaaaaaagaaaaacaaacttcacatttgagcacactgttttttgtgtttgtatcatgagcaccagctatcagccaagcagtatgcttgattaagtgtgagaataaaacaatgaagacagtttctgccctagattattttaaagcagattaggtatctcttgttgtttacataactgtaaagttgtaagtggtaaactgattttctgctgttgctgtaacaaattattacaaactgagtggcttaaaacaacacatatttgttgccttacacttctgtaggtcagaaatcagatgtggttctcactatgctaaaatctaaatgttggtagacctgcatttgtttctgtaggctttaagggataatgtttccttgctcattcagttagttggcagaattcagttccttgtgtttgcagcactgaggtctgtgtttccttgctggctgtcactgagggtttttcccagtttctagaggctgcctgcattcttcggcttgcggccccttcctccatcttccaagccagcaatgtcaggtcattttctcatgttgattctaccctgcctcatcttctatctcatatctctaacttttctgccagccacttccattgtgaggcctgtgtgattaccttggacccacttgggtaatctgagaaaatctctccattttgaggtctactgccttaatttcatttacaaagtcccttttgccatgtaaggtaacatattcacagtttccagggattaggatgcagacatctttggagggccattattttgcctaccaggaatgctttatttgctttagttttgtttgaaaatgtttcaatagattttttgcagaatagcctgttaaaaccagagaagatatttaaaacaagcaagcatggaacaggagcacatattttaataggtgttaccaactgactgttggaaggggttggaattaaatttggttaaccagctactcctgtactatgctgcgcaaatggaattctctgatctggttggttaagtctttatctctaaaacctgtttgtttttctacctctctccttctttacattgtttgcttccatctggagtgttgtctgcctttctctcattgcatctcattgtatttttttcatgtatgtcttatctcactagttttctacttcctcaaaggcatggacattgactcaaatttttttgtgctcccgcaacatcttacatagtggttcccaactgtgggctctgtcttgtggagactatgaagtcattttaaggtgtcttcaattctctatgcatattttgttttcagtcagtgcatgctagaaagtatactgctagtgtgaagtccttgtgtaccaaaggttgggaatttctgagaagttctaaattctttgaatatactaggcacttgtgagcattttatagataaaattagaataataaagaaaagttggtgtagaaatttttaagagtttaaaattcaaactcttttgaaattatatcactatatattagttaaccacattaacaattttagcaaactgtttaaagattgcttcccagcgaaggaactgataatatctttttagtactcctccctgcctccctaatactgtcatgtatatggcagttattaggaaatacttgttcactggttggtttcttcaggactctatagtgttttataataataaaatacagctttggggcatacctgatagcatatgtggtcatttaaagttatataactacttaagcttaactttttagtttggttgacagcataaattcatttttgattggtgtattctctaggtttttctgaggatttttttttatggggtgtttgccatagaatttagactcctggaatgcaacagacataataaacatctaagctgaatttaacaaaagttataatgttaattatttttcaggtgaatgcagaacattgacacaagaatcatgtgacgtatctccagtattgacacaggcaatggaagccctgcaggacagacctgtcttatataagttggtgactttttcttaattaaaaatgaaagcctacttttcttttgatatcttactttaaattttagtattatcaaaagcgtatataatagtttgagtaatatttataataatttacaacaatactgttcaccttaacttgaatttgtttcatggggtatcagcttatttgaattttacatactatagaatacaatatggaaagagaaaccaaagtgtctctgtatctagactacctcttacttatatagaggttcagtgacttttcccctgtcgtctcattaactcccttagaattgtaagtaactaaaactcctgtatgaatacttccctacagagactgaagtcatatcagtactgagaaatatggttatgcagagatgaaaaaagaatatttaatatcaaggtaatctgttaataggatttaggaggagagggcccaggtctttgatcctgtaattgatgccaaacaagagctatgtggtaatgttttggataagaatttaatgcattttgtatttgttgatatgttttttattattttatattttaattttattcttttaatttttataaaataaaaggtaaatactttctttaatgcctggagtagtattagcataagctttaggtagatgtaggggttgatgatattaataattctgaaaacaggaaacgaggggactcttaccaaggtagtgcatcctgctttgaatcatccctttcagaatctgtttatactatttttagaggacctccccattactttctgattggaacactacttatcctatcatcaggtcacagaacacaaatgctgaacagctgtgtaaaataataacaccccagtgttacttactgagtactatgtgttaagcaccattttaaattctagaaacacaacgtcagtaaagcactgccctcaaactgctttattttatggaaccagagataaacaaacgcattttaattgaatacactaattgatagtctagaagtcatgtgccagatgctgtgtggctcaagtattctggtgtaggggaaagagatgagcatcagtgaaagtttcctaaggaattaggtataaagtgagttctgaaggctgaataggcattttcctagaagtaaaggaagaacagtttgcaggttgagggaacagtaatgcaaagatatacattgagagataatgcacctttgggaaattaattgtaaaagcttgcactggctattgaattaggagcaacagctggatcataatagccctgaatgttgtgcatatacataagataagttaatgtttaccattgatcagcagcttaacagtttattcctgctttaaaatttctttcccaactttttcactttaacatattgacattaattatgagtcttttagcacttaaaacatttggcgtttgattttaacagctgttgcattgtctacagattaatatttattcacaaggttaatcttttatgtattaaaaaaaaaaagcctttctgtgttttgggcacctttgtttgttttcaacagctgacttctgccatgcaaataaattttcactgagttatagttctttatcaaaacttggaaaggagcaatattaaatggctataaggtgggttcttgagtcaaatttctttgagaagtccgtgtacctttataagcttgtttccttagctgtaaaatgaggataataatagtgcctattttacagggttgatgtgaagattaagttagattgttcacttaaggcacttagtgtaatgcttggtacatcactaaattttagatattatttttattttgagaggagatgactagaaagttttcaactaaggagggatgtatctgagggctacatggcaatctgggaaaaagcttgaaagataaagaatggaactataataggcaaagaaggtttatctgtgaagggcatatgctaagaagcagggggcagtaatggcaatttggaagatttttttttttttttttttttttttgagacggagtctagctgtcgcccaggctggagtgcagtgacgcaatctcggctcactgcaggctccgccccctggggttcacgccattctcctgcctcagcctcccgagtagctgggactacaggcgcccgccacctcgcccggctaattttttgtattttttagtagagacggggtttcaccgtgttagccaggatggtctcgatctcctgacctcgtgatccacccgcctcggcctcccaaagtgctgggattacaggcgtgagccaccgcgcctggccaatttggaagattttaagacacatttagaagttgagtaggaaagtaagtttttaagaccagatgattagaacaagatgaatgctaaaaaagagaaaattggcctttcattaagtaattattttcaaagtggtagtttccttacatttagggaaaacttaataatgtatcatgttaaccaccagatggcactatatgaacttaataagtaatgtataaaagtttcactgtccattattgtgtctcaaataatgtaagtattatatacaagaaaaatgtcaattattgaaatccgtggggaaagttgccatactcagtgtttcttatgtggtgtataactggaatgctaatgcattattgacttttaataataaatcatgtacaattataaatgaagtgaaaaaatttgataatttattttctttggtaagcctttagaatataagttattttaaaatgtagtaatacatacaatgctgatttttcttccttctttatgtatttgttgtgtttcaaagaggcacttctttactattatcttttaatttgctttttgataaaaatttttcttcttttaatttgctttttgaccagaatttctttaactgtagctaaacacaatttttaaaatgagacttttaattttaacttgaggtatttgagaatatttacataatttgaacattcactctgaaaaagctccattttgatttttgattattgttggaagaatgtctgattttggtcaaagactttttcttctgtctctgggaaggatgtttcatgtctaaagatattgaaggttcacgtggcttatgctgtttttgctttaaattatatttgttctataggaggattgacattaatattaatgtttattgatattttatagtattgaacagatgaaattccagtgtttgccaggcttggtaatttaccccctatttaaaatacactggattttaagattcactggattctgttacagctgtcgtcccagtggacagtcctagaaacaaattatgctgtttatttttaatatagttagtagggtcttgggaatgaggattagctatatatacttaaaaagttaaacgtttgtgaattttatgctgtgataagcagtcataagttcattatttcagagaatcaggtgatcatttaaaagaaggcattcttcacactaaatggattaataatttaagagcatgagggaaaaaatagcaatgagcattttggttctaatttgtttaaaaaatagtaaatgcaaggcaattatgcaatttagcaaaacttagctggatattgcacttccccttttctgtagtatgtcaccacagggaatctcaaaaccatttctttttaatggaagacaaacccacaaagaaccatagtctggttaatagtaaacagtcctcaaaaaaggttcatattcctaaatatttatagctatttgccagttctacagactttctctttgatttggaaataaaccgtctttcacatgtttaccaaaatgtggatttttcatccaattaacagcatatgaaagaaagctatgtagcctaagatattaattattttgggtatcttgggaagttttggtaatttttgtttatatataggttattgacataattcttaaaatttagtatggtagaatactgtttagagatttaaaagttagtctagaatctgctgacatcaagactgctaaaatatattttgtttttctttatacttttaaaatggaaagaactttcaattgagggatggatgtcaggaatggtggtgataatggaaaacaaggctgagtcaagtcaaagaaatgggcactccagagagctccaggccatttttataaattgaatcccaaattgtcctattccccagttaaaagctttccttccctaccagttccttcaccttagaaagcctttccatgccttttcaattataataggtgacttcttaatacatgttttttaaaaaggtatttgcttgtatatgtgtttggtcagtaaatttaaggaacatctgttatgtctaatattggagtcaaaataagcttttaaagatggatagcaatttttggagcaaattttggtgatagattgtgatagtatgtgtaaagaagacttttttaatgtagaagagaaaaatgtcaattttgggattgcagaattcttttattttttctgagacagggtcttgctctgtggctcaggctggagtatagtggagcagtcactgctaactgcagcctgaacctcacgggctcaagtgatccccctacctcagccttccgagtagctgggactataggcatgcaccaccatgcctggctattttttttttttaataatgagaaagggtttcattattttgcccaggctggtctcaaactcctgggctccagtgaccaccttcctcggcctcctaaagtgctaggattgcaggtgtgaaccaccgcacccagccttggatttgcagagttctaattataatcagtttttgagaactgttatggctttacgtaaaacagtagagcatcatgttttagactgcaaatatgtatactgaaatataccgaaacctagtatagtgaatatactgaaacctaaaaagttaagtcttcccaccttggcttgattttcctacttttactaagtccattgctttatcccttattactgctgcctctgctttagtcccaaatcccagcattgtttcttaggaggggtaaaagtttttactttttgattgaattttcaatgagctgaagttatctcttaaatatttttttcttgtttgaaagcaatgttgcttgaccgaatatctaaaggagctttaagtgctttttaagtacttggttgtctcagaaattgcgtgaatagtctgatatagccactagaaacaaccccaaccattttttatataacttgtttcttctagatataccttagatgaatttggaacagccagaagaagtacagttgttcgtggatttattgatgcgctcacaagagggggccccggaggtacacctagaccaattgaaatgcattctcatgaccctttgaggtatagtaatcagacagcagaagaggagttgatgtttttccaaaggaaatcttcattaacatttagttttcattaggtatgtaggagatatgttggcttggctccatcaagctactgcttctgaaaaggaacaccttgaagctctcttaaagcatgtaactacacaaggtgggtccaccaattgtattgctaatgcctaaatatagaaaataacacaagcatctctgtttctgttcttgttgccatcttcttcacttagataaacaccttgatggtacaataagcatcctgattactctttctcttctctagattctccctcattctgctaatagactttctcttccatcacctttgtcctgtcactcaactgttcagttttatagtgaaacctagtgacctttcatatcaaacctagactcctctgtgtcacttttaagaaatttctggaatatttagcatacattttctcaaatcctctgcatgacactttaaaggtacagggtgatattatcttaattttatctgtgtgtaaacaggctgagtgacttgttttaggtctttaagctactaattctttcatttctgctacccagcctcttttttcattctcatggcactgttttaaaattttaagacaattatcatatctgttagtatgtttctgcattgctataaaggaacacctgaagattggtaacctataaagaggtttaatttgactcacggttctgcaggcagtagaggaagcatgatgccaacatctgcttctggtgaaggcctcaggaagcatagagtcatggtggaaggcaaaaggggaagagccagcatgtcacatggtgattgagggagcaagacagagagatgggagagatggggaggtgccacacacttttaagcaacgctgactattgtgaggacagcaccaagccattcatgagagatgcactcccatagcccaaacatctcccacaggcccccacctccgacattggggattacatttcaacttgaatttagaggggacaaacatccaaactacatcaccatatgtactaaatgtacttaaaatttttgtcttgatgtcaaggaagaaaaataactgtagttgagagttgctgatgtcttgtttacagaattccaaatcttcttagttgtgattacctaaagaggcctgttttagagtttgagggtttagtgtatgattttaaagtgttctatttttggtaggaagttaagagagacactgtggcttggtatcacttgactattttacatagctcagccacacatctctgtggttcacattatctgcaagatgagtcagtgttacaaattggtggtaatactaactttatagcttctaactcttcagtatcaagattagactcagcatatatgttagattggcacaaagtgtgcatcgttaggttctctttctgttattattctccttacccagtttaaataaatgtgtttccttaaagatgttttagaaaagtataaggcagtattaaggaagtaaatagactgtagttagttgaagtaggttattctacatgaatgacttcaatcttctgggcctcagtttttccatctgtgaaaatgaaggtgattacaagcagtaaatgtcaaatacccagtacagagtttgataaatagttggtgttttgaaaataccagtttttctgaaagatttcaaggtatatttttcatctttataccctcagtgtatgtgctaagcagcactgcctggaacaagatgtttgtaaaacaaatgctaatacatcttggcatcacttcattcaattaatacatttcaccctctttttttcctctgtcttataactttaatctttttcacaaagaaatatttattttattaactcaaagtcagatgaattaacaaggctttctagacacattaggtattatcacaattaatatgttaacacaattagtaatgtcccaagagatatcaaacttactaaaatattgttatggttattttaaaagtcattagtgccattaattatatgtattatatattatttgttagttttttgaacttatatgaagcaaagtataatatggaaacaaatattaattatgtagtcattaattttaggtgttgaagaaaatattcaagaagttgttgggcatatcactgaaggtgtgtgcaggcctctaaaggtaaaatattttgtttttacatatgctatatggtacctgcttaaattattaccttatttatagaaacttaagaaactgataccagctcaaatacaatctataattttttcaaattagcacactaatgtagactaataagaaacattttaaaataataattgccagttttctctctgagaaagaaaattggaaatatttgtagtttgcatatattgacctattttttacagattatatttcctgtagtaatttttcttattcaattgagaaaaaaatctattaaatttaaacagcgaatctatgaactcttaacagagagatttactaagaatattttgtttacttgattgcttcaagcatagaagagtttttgcttgtcatagcaataaataatgattaatccaaggataaaataatgtgtattggtattatcatcaatactgtttatagtgcaaggaacagaatttggaatcaaatttgagttagaattcccatattgccacttaattgtgtttacttattgcatccgcttaactcttctgcacctgaattatgctctggtgggacctgtatattaaaacacctatcatccagggttgttgtgaggatgactgtgtagatgaagtacatagtttatgacactaagtatttagcagatggtaaatacctttattttcctttattaatatttagagaatacttggcaattgttggtttacttttccttgtaaaccaacttcattgattgactttaatttcatacatagaaattgaaatccagaagtttagtaattaatttttcaagaaatgaactttaaaattaattttattttatttctaaggtttttgtttttttggtatatgcttcaggcaaggaaatctcagatgacacacttggtgacaattgattatattgacaaatttaactgttactctaacttgatctcataggacctaactgtatattcagtaaataaatggctaagtatcttgaaattattttacttatttctcccaaatgaaatatttacttgtcatagtttgatgtagacatatataacttatataaatgttgtttattttgtatactggcagttactggaaaggtagaagaagaggaggaataaaatgaaatttattttgctatgcttttatacctttttataacttcatatagttaaattaaactcctagtcactttgataagtaaattttactttatctgccttaccttccccccttccttgcttatgtaattatgtttctttttacaatttttctaatttttgtgggtacatagtaggtgtatgcttttccttttctttttaaaaagtaattttataaatactataattttagaatctaagggttataatggacttttcagtttcctgtcctggtttgagtaagaattattatattaaaaatgtttaaactaatccagccacttgtataaagactttatatactgaagtctgcctttgttttaaaatgtacttagaaattctcacttcatcttcctttaatgtacatacccagaaagatctttatggcaattgtaggacattattgtgatctgctggcaaatttaaatgtaagatgccaaaggtaaagaagacactagtaagcagacaagcatctttttgttgtaaaatgaagaaaaattccttttctgaaatggcagaaacttcaaatctttccatatgatgataatatgtattgcatccagagaatatttagcaggtgttcacaatagttacgtatcaaattagcttgatagtgatatgtaatccagcaactctcataccttcccttccttatatactgatagacagtgttacagtattttaagaattttttttctgtatgaccttatttgagtatcttatgttttcagtgagatagttgttagttgaggaaaaaaatttcgactttaattatttttttttgcaattataattctgaaattttctagtgatcaatctgctcttgtaatcccactcatacaaaatttcttcttcctaattgataagcaactaaactttttctaatgacatatgatattggatgttatggctacttttctgtccatcattattctttgtagatatgaattttttttggaataagagattttgatttttagaaacataaaaggttatagtggtaatgggagataatccttgagaaactatatatttgatttattctaccttgtttaatcttttctttgtcttagtaaagtgaaacatcataggtagtagattaaatatttgtaaatgtatgcattaagataagatctgtaaacctattgccagtttaaagaatctgtgctctaagtttaagattgcatatgttgtgtagggggtaccgtggctcatcagcatcaaccctattactttgtacatgtctttattccaaaactgtagctagaaagaccagaactaatatattaaattttttttttaagcccatgggtataaaatccttcttttatgtgaatgttttagattgctgagagattaccagctatcatttgaattttctcttttaataaaaactttagtgtagtgtatgctacagaccttagattatggtgggttctatgaaagcaggtatatgtaaaagatcaatgacatggaaaataaagctgaatattgtacacaatatagtcattggaccctcagattgaggtatacataggaacagatgtctaccctgagcagctgtctgtgatattaaggtaaaataggtttgtcatcatcttttttagtcctcccttcttcctgtgtccccttcatgaacacaaacccactctctttctcttgctctcgcttttgctctagctttctctctggccttggagaggagagccactgttctgtcttttagctcttccctaccttctctgctgtcagggtgcctgaagctcattttgctacttttaatatctctgcctttatggttgatgctgcttctcgtaatgcagttaggatttattgagtgcttatgatgtgccagggtctgttccaacatactttatatctgagccattattcccgttgctgctttccagctctgctaatgatttttccctccactgtcatcacagtgataatttccagtcagttgctgctaccaccactcctttaagtctctttgacctttttttactttttacttttcgtttctcttgtcctttgttgtttctcctgtgactgttgggttttgctgaaaatggttaccctcttatatagctctcataagacagagtgtttatttctgtgtggcaaacaaagcattcttggtgtattatttgtcagtctcctgattttccagcctttctctgttgtattttgtattgtagctgttgtattctttattgccactttccctcaaaacctttatattcatggagagagttggaaattgtttttgttttttcttcctttctccctcctttccctctttgcttttcctttctttctttctctcccctcttttctctctttcttaagggagtcagaactaagaatattttcttgatgcctcaaaattctggaaggcagctggccggatagctgagatgttgtttaaaatctgctagtaaagagctgtttgcctacaactaacattttttatattttgctgtaataattatattaaaattaagaaaatatcacttttattgatgtaatgtataatttaagtcactgttaaggccttgatttaaaaataaatcatggaaaaatatattttttaagttcaaatgccattcatgatccatggtattgtgttaattagatagtctatcacctataccaacagatcaatttcataaacatattaatgtaaaggtaaattgatttctgtaatctaagaggttttcatatgcagatataaaatctcattttagcaaatcacatttgttttatgacatatgccaaaatctaaatacagagaaagttcagtttttaaaagcatatattaaacatctgttgtgtgtatactgttctaccagatgctacagagatgtaaaataggcagaagacataatgtctatactgtatttgtattagaaactagttaggaaagcaagaagatagaatgtaagcagtagcttaaggacagatacaatatttaagtaagcatttatcagtgtagtttagattgtattcattaatgagataatataaaagaaggatcagtgagggatggaatttaattagaaaagattcatatttcctaaatcttgaggcaaatcaaattaatcttgaactagatctgatttttccctggtagtcttataatttggcaaatatgttggtgctaattcaagatttgcctagttttctattctttgattaatagacaaacgatataataatttatagactggaatttattttatttttttcttgaatatttagcaataaagcattatgttttcattgataatctgttttagggatgtaacagttgccttttcaatttcatattgaaccaaattccattatatactggtgataaatctcaaatgatctcaatgtattgacatttctggtaacaactgccttgaaccaaattctgcaaataatgggtcagatttttgtagagtatatctctgttaaaatgtttgttactttaccatcttctatgacttactactcagaaattatttaggaggcattttgtgatctctgcagtaataaaattttatctttgttatgctattcataccatatgttattaatgaaaaaaagttatacttttaagaaatgtttactttcctctcacatattttaataggttcgaattgagcaagtaatagttgctgaacctggggcagttttattatataaaatttctaatctcctcaaattttatcaccatacaatcaggtaagtagaatggcaaaatgtgcttgctaaatccaatgtgatatttctttcagttagagcacagtataagatttttttttatattgtgtatagtaattatacactaagtatagactaagcgtaactagtaggacttccacaccatgtaaatcattatatgcatattatacatgctatgccttaaggtctattatttcctttctccttttttctccaagcttaactacacgcacacacacacacacacacacacacacacacacaccccttatatagcaatataagtctataatgtaagtctttattgagtcttcctgcattggtaaaagacatccaaggcaactaaagcaactataccttatactcacaatagagcatagtgaatgaaatgttctattctggatgtaaataacctaccatgtactcacaatagggcatagtgaatgaaatgttctattctggatgtaaataacctaaattctttagcatttagtttactataagtgataaaatagagtcatagctttatcttctctacataacagcaactttatctgattaggaaccacttgtcttatataaaatgtgatctttgactccaaaatatgcattcatttttgctttacttacgtgttttggtggtatacccgtgagttttattataactctcactgtaagactgttatatatgtagttatgttaaaacaatgtctttccaagccatatttttgatagtttttgtatttttccattaaataattatttaaaagttatttgttatgcagtatgccagtatcaggaatagtaggccaactgttaaaaatctaagaaggatgtaactaacattaccaggaaaggttcagggagcactagtttacagagtaccaaaaaactgtggtaaggttatcacctaccccttagtgacagagagtagccacccagaacttaacagctagggaatggatttcacatcttactagtagattttcaaacaaaactaacaagtcatagtctacaaaactgatcagagataggatttggattagtcccttaatattttagatataaacttgttgtcatcattcccataattcaaaagcaatgaattagtttcagttgtaatattatagcatcctgtaataagagaatgataaatacttagaaaacacaagggcagctgaaagctagacatagcaaatgctgtgttataaaaagatgctggtaaaataatttttaaaattgtttatttaataatgtccatgatgggactacatgaaatttattatttaaagatattgatatcttagtttctaatgtagaaaatgctggaaataaaataattcagattctgaagatgataataggtttttttaggctctgagaattataatttttctatctttgaagatgatattgaagatgacaattaaaatctttttttattgattgcatgtactttgtctacttgttcacacatttcctcatttagtcaattaaacagttgactgtatacttgtcattcttctaggtggtaaggaaacagtaattaacaaaacagagcttaaacttacattgtagtaggggagacaagcaagtacaaaataataattttaggtagtggtaagggtactgaagaaaaagcaggaaaaaggaagtagaaagtataggcagtgatcatacatgagaagatatatgtgtgtgtgactgtttttgaggccattcgatagaggtgatatttgaatatggatgtgaataatatgaaggagttgggcatgaaaagatcatggagaagagtgtccaggacaaaaatacactctggtgctgaagctaggaaaagcttgcattttggaggactagaaagaaaaccaggaattggagtgtagtgaattggaaggagtagggggagatgaaatcagaaaggtagagagaggccagctcacacaggattttgaaggcgatagtggatatttcgattttatactgagtggataagattggggaaaatgtgagggttttgagtgacctgagcagatttgtgttataaggttactctggatattctgtgaatcatgtagtgtagtgagacaaaagggaaaataaggaagatatttagaaagcagtttgtgctcctgagaagagatgatgatgtttagactagggtgatggtcttagaaatggtaaacagtagttgattttggagataatttatgtcacagccaataggacatgtatacatactagatagagtgaggtatgaggagtcaaggatgaatttttggcttttggtttgaacagctgggtgaatggtattgtttgctgagatagggaatgctggaaaggaactggttgatgggagtggtgggtaatgaagagttccgttcagttttggccttgtcagatttgatgtatctgtgaatatacaggagattttgagtgatcaaataatacagagagaaatcagggctgaagctaaaaatgtcttagttttcagaaaacagatgacacaatgccatgggagtaggtaagatcacttaagaaatgagtatagataaagaatggttgctaaggactgagtcctgggaaactccaatattttgagtcaagaagaggagaaacgacaaaactgggaaggaatagtggtgaagttggggaagaagcaggacgcatgcaagatctcaaaaaatttacctctcatacattaaaactcctaacaaaaggaagatatagaatccaggaaacagggactcgagcatgcttggattatatatcctttcctgcaaaacttttctccctggaattaataaacacttggcttttgtacttgtttactttcctatgcccttatcactattttggatccaagctatttaagagaactcaacattgcattgtctcaccatgtagtccaacaagtaatccgcctctctcctgcccctatctgatacccttcttggagccctcattcccctccagtctagatgtgttgccctttaggcctactgcaagctgcttggctgtcacactgggatttatcttcttcactagcctgttcactggcttgttttgggtatccctgattctttggtcagctctgaatagtatttacatgagtgtaatgatgtaaatattgaatagttatttaccagaactctgtgcccatggctatattaggaagcctggggaaggtgaagtttgggtgtgttgtggtggaggaggagaactgtataagagagtttaactctcatcttctacatcagggaatttgtagataatacctaaaactgaaaaatcaagtaatgggagtataggcatgttggatagaaatatggaatgaaatgtcagaagaaacatctacaattatctgtaccagttactggaacataatgagtgttcaataaacgttagtaaattctagatctgaataactgcaaagtacagctgataactccatattaaaaaaaaaaatgaatgtaaatgtatgttgagttctctccaaatttttcattaaattgtttccatttgttttcatttaatttgcttcctctgttgcttgatgtacacttttattcagagaaatacttgttttcattgcatgtgcaggcatgtgtgggaattctatccagtttattttagtatttggcatacaatatttttaactaaaatacttattgtttctttaaaatataagtattatggctactggtttagtaatttgctagtattttgctgtttgctatatatatatgcactttactaataatttacattgttttcatgaactatgtaagaatttacctaatttattttggtttcggaattgtactgaaatattacatttgcaaatattagtatttgcttttataatacatgtggtatatgatttatcagtaaacttgctgtgttttagcttactgtttagtagtatttaatgccattatattcatctttaacaatctaaaattttttaggcatggaagatgttgttatgcctttagaaattataattccttactggattacagcatattttcataaccacatgaaacttttcccctagaaggttgttaaaatcacttttagtatgtgaattaggaggaaaaaaatgggaattgttttatatacatacttgtcttagatcttggcaaaaatgggaaacctccttgaatgggtctaagaaatagccttatacaatagcaaattgaggattatggaatgtactaatgtaattagccatttcaaaatgctatcagacttttcaattagtctaaatatactgctctgtaggcagctgtataaaaattgagaaactgatttataggtgtgttattgatatagtataacagttttaattaaaagaataactcagtatttatacaatttaaatattttatcaatagagctgttgattcagtgctcttcttaaaattaaaattaactgtcttagataattgagatatatatttactctaatagaggaaaaatagagatagggttttatatatcacaaatatctgttctgacccacggttttgctaaaagagattgtgaaatattgaaaacatagtagtttgtttttattttttcatcacctaactcaaaagaaaaacaaaaatcctgatttttaaaatatgaaactagagtatttttaattcacaggttatattttacataaaaacttttatttaaatctagatccttttaaagcattctactcagttaaggaactgttttgtttcagtttctgttttgcaacctgaaatattctttgcttttagtggtattgttggaaatagtgcaactgcattattgactaccattgaagaaatgcatttgctaagcaaaaaaatattcttcaatagcttgagtcttcatgcaagtaaattaatggacaaggtatgtttgaaaaatgtaattattaaattatgtgaatgtttcacattaaagatgttttagtgatttttgtattgattgataacttttcccattacattctgtgttcttttgagttcttcctgtcaccaacaactttcattttgagatggcttactggacctaagttgatagtctttgttcctgaaacagtataacattgagttataattggagatggcatctcaggctccaattttactaccatttttttctatcacagaagttgtataattaaagcaaacttactgtatttagctgggggctaagatgacatacagattggaaaaccagaactcttacaaaatattttttccaaacagcttatatttttacccctgttgttacagttttgtccttatgaaatgtatgctcctctgagttatataattatttatgaaaacaaacaaggaaaaacatcccacaaaaaaacaaacaacaaaatcctcaaagagtcctgtaagatctaatatcttaaattgagcagggtattttggcaggaccttaaggaatagacttacaatgatcaaatccttctttatttttgtttcattattgagaacatgagtttttcaaggatgtgtcacaatcaccatgctggctttttaattgtactactctatctaataggctagctatattaggcccagattttgtaatatggtataaaatagtcagtagcaatttagtccagaatacgtggtcaatcttcactttcctaagttcagtcttcactttcctaagccttaataggagtctacttcctgacccacatgcatgactcagattcatttggaaaagcaacatgaatttgtggagctggaatatctacctttatttttcttgccttgtgtatttctgtttgcatcaacagtttactaacaatcatttctggttatatttgttattatgagttcttatttagacagaactcttctaaaataatttatacatgatacacaaacattaaacatgaacaaatatgtgctagctgttgagagtacaaggatgaacactcaacatctgttggcctcattaaggttgcttttcctttagtggaaaatgaccaaataagtctggttattatagaattctatgatttatgaaagacatgtgcctagggtatatgctagcaccaaaggaggagtatatttagcaaacttatctgtactcctttacagagaggaagctttccatagagagatgtaatggagttgaactttgaagaacaggtaggctttagataggtgaggaaaggagtgcatagaggtcatcttaaatagaagaaagaaatagaatatgctagaacatgagtatgagttacctataaaagaatttttcatttattaaaaaatatcacttgtaaagtgatgtgttttatatatataagtggggaggctaggttggaaataggaaaattaaaggagtattgaaactgtttttattcatacatgatctaagggaaagactctgggaataggcaagaggggacagattcatgaagggtaaaggtaaaatcttcaaaacttgatgactgaatgtgggttagtgagagggagtcatctagaataattcctaggctaatcacaaatatctagaatgcagaaagagggtacaatttgggagataaagatggtatcatctaagttagataagttgagtttgaggtgcctatgagagatccctctggaattggtctaatctaaaagggagtgatacatttggatttagagagttttacatataagagatagttgaattcatgggtttggatgaagtcactaggaataattttttttatgagtagagctaccaggacacagtcttgggaaacactgacgtttaagagaaggaaaaacgtcaacagtatgatgctgagagaggatggccagagaggcaggacaaaaattaggataaggttttatcagaaaagccaagagaagacagtttctagaaggagggcatggttaataatgacagatgcttttaaagagttcaagtaggaggcttgttatctttggcaatatatatgtgataggtgacctaaatgggcaattttagtcctgtggtggagataggagccaggttgtagtacgtagaaaagttcatgggtaagcatattacccaaagctttaccaattagaaaacatatgggcctcaagactgaaaatagatgcattaggcgtttgtattaaaaaatttgaaacagagcaataaaatgaagatatatggaaaggatggaattaaatttccgtgacaaattagaaaacaaaagcagaattatttgttgaaaagataaacaaaattgacaaacttctagcaagtctaatcaagaaaaaaagaaaattagaagtttttagaaattagagacaatccacagatgagaattaaaacttagagagtaccatgtgcagttttgtgctaatcatctgaaaatcagaataagatgaatgctttttaaggtgacataaattggtaaaatgtgagtcaaaaggaagtggaaagtgtgaatatacctaaggaaggaagaaaagttattaaagaacgtgttgccaggcctagttcagattatatagagaacttcattcatccttaggaggaacagataattctccagaacatgaaaaaatatggaaagcttcccagtttgttttaggtagtataacaccgacataaaaccttttaaagatagtcagtagtggaaaccatagattagtcactttttaagttttaaaacttcaaaattcagcatttatatattaaaaccaagaatggtttattacatgaatataagaatgtttcagtgttaggaaatatactaaatgagtatataaaataaattttatattctcatatttgatcacattggggaaaatcttaatattaaaacaagtcattgatgaatacttccttaaccatataaagagagataaaactaacagccaacatcataattaatattgacacactagtggttcttctatttaagtgaagaacaagaatgcttgccaatacttttaaataataaccacggtagaaagatgagataaagaaatgaattgtaaatattttaaaggaggagacattagattatttatggatgttatgatagtctattttgaagacctaggagaatcaactaaaaagctatacaaccagaaaatgaattctagtgaagtcgttggtgaaaagatcaatatacaaatgtaattaattttcttatataccagctcatgaggtgctcaataaatactggtaacatgaatggttcagttcattttctgctggcctatattccatcactatcttgccattagctttaaatctcttgcacccttgccattttaccacattcactttgcaaaaccaccttgagttaattcaatttttcaatttttcctgagctctgctaaagaaaattacatcatacagacaggaatcactaaaaattgtctccaacatcaggaaagccccccaggaggtccagcaaatactgattgtcctttggcagccactcacatttacctcacttattttcacccatttcctcaaatctaccatactacctcctactgaaaaagtgccaactcttgctaaaactggataatggacattaaaaaaaaatctttaccaacatgacgagcaaaagcgacattttgttgtttttctcatttggatttctgtgattctagtgagaatgaacattttaagatatgtttttggctgtttgtgaattgcttgttcaagtcctttgccattttcctattgggttgtcttgttcatttctgatattctttatgcattaagaatattaactccatcatatatattacagacattttctccacgttatcatttgcctttaaaatttgcctgtagtattttctgacacatcaacttttaatttttttatagttcaatagaactttttttatagtttttttcccttgggagcattccatgcttgaaagtattcccacaagaaaaaacatttagaatttaatatataataaagatagcatctattagtggggaaatgatagattgtttaatacatttatttagatgtattttcttaggtgtttctatgttttcactttatttatttttttaagcaacagggtcttactgttgttgcccaggatcgtagctcactgcagccttgaagctcaagccatccttctgcctcagccttccaagtagctgggactataggtgcatgccaccatgcccagctaatttaaatttttttttttttctgtagagacatggtctcactatgttgcccaggcttgtctcaaactactggcctcaggtgatcctcctgcctcagcctcccaaagtgcaggaattacaggtgtgagccatcacacctggccctagccctggtttcacttttgcaacaaatttttaatctactgaagtttattattgttcagactgaaaacttagtatcttattctttcccaagtggttatccatttattttattttattcccctaatagtaagtttctatatattttattagtcatgtaaaagttaaaatgaaagttgcaacaaaacaggaaaacatacagttgactcctgaacaacatgggagttatgatgctgacccctgtgaagttgaaaaaatctgcgtgtgactttcgactctcaaaatctaactgctaattagctattgactggatgccttgctaataacataagcagtcaactcattttttgttgtatgtattatacactgtattcttacaataaagtaagctagtgaaaggaaaatgttattaagaaaatcataagggagagaaaatatatctactattcattaaatggaagtgaatcatcataaaggtctttatcctcattgtcttcacattgagtaggctgaggaggaggaagaagagagactggtcttgctgtctcagagagtagcagagggagaagacaatctatgtaaatgtggacctttgtggtttaaacatgtgttgtttaagggtcatctgtaatggatagtaaaaggcaactgaaggatgacatcttccaattaaaactttgaacagaataggatgaaaatgaggaaagaaagtaattgtaatctgaatttattaattaccaatcaatattgcagcttatatgagtttatagcagtgaatgggctctgatcattattgttgttgtttttgttgtcattattactaattgaaccctggatgtttttctcagatatgaactgggccatatttagagttatttttacattagattgcgaccgtgttatgattctctttacaactcatatgttgcttgtatctacaaccatttcaggttttttgcaagaatatcttcctttcatcaaattttaatgttccataattttatattagttatatcttttacttattctgcttcttgtaaatgatttcacttcctctaaaaacactgtagctttatgaagaaaacaatatttattgtagcatgttcttcattagcaaagcacccaagtggaaatttttgttaatagaattttaagtgaatagtataattgttggaaagaatagcttttaaaataaaggtatagccagagaggaatttttaaaaatatgattgcttttgtgcttttaaaaagacatacttgggagctaattctttatctagcgtgagaaaaaggaaattcaaggacataattttattgaaagatgtaccttttccctaacaaagcagtttgaagcacttgagtattcaagtaggcatactcccttccttatcaagctctcctgaaatattcataactgcaaatctagtgaagtttaaagagaatatgcatctatactgcaaaagacacaatgttgtgtcaatttaggctagactgacattttctaaaattatttctcactatagtaatagtgcagttctaattgcaaggatatagcctgtcttaaatgaaacccatatcaagttaatagtagtcaggattgatttgcccagtcctctggagaaaaaaaaacaaaccccaaatgattctttaaataaattgtcatttaaattctaggatatggttactgctttgaatctctttttactactcatagcatagtatgtggattagcagcttgggcatcatatgggaacttactagacatgcagatatctcaggtcctgctccagacctactgaattgaattatgcattttaataagattcccaggaggttcatgtgctcattatagtttgagaggtgctgttctggttgaatagtttgagttttacattattccttacagatgattctgccaggaaaaacaaacagaaaaccaaattttttttatctgaaatgctttaatatttaaaaaaataaaagtgtgtaaaataagttgtaatttgaaattatttcaaacatgttagtttgcagtcctaaatttatcttggacaattttattgacttaaaaacttaaattccacatattgtcaattactagaatgtatgtatttagagcaaaaggaatgtatatatttatatatatgtatatacacacacacttcttttatatatatactcctttatatatatatatactcctttatatatatatatactcctttatatatatatatatatatatatttaaatatatatagagagagaatgaggaaattagtttaaaaatatgagaactttgtgtttggttggctagtctttattttttgaaagcaaatgggcgaagggccttctaagaagctacacaacagaaaattataggaccttaaatggaagatagctgaaagaataaaactaaagttggtagtgggatgaagttgtaggaacagcttttggaatttttatggtgcaacctttttatttttctctagtaaaagtcagagcacctaaactacagaagggataaaaagtaaatagtcacaagaacaatgaggacttttgtgtatagctctacacatttaaaaaaagagaggttctaatatatggaatatgaagttttcaatagcttaaatgctttttttaaaaaaattattgattgattaattgattgggtcagagtctgtctctgtcgtccaggctggagttcagtggtgtgatctcggctcactgcaacctcctcctcctgggttcaagcgattctcctgcctcagcctcccgagtagctggggttacaggcatccgccaccatctccaactaatttttgtatttttagtagagacagggtttcaccatgttggccagactggccttgatttcctggtctcaagcaatccacccacctcagcctcccaaagtgctgatattacaggcatgagccaccatgcctggcctttaaatgcttttaaatgtgaaatttttctgtatacttcaactttgtcacttagaaaatattcaaattttgaaataagtatttaataataatgacttgatgtttagtatgtacaataatataaagaagaagaagaacaaatgagctcacttttttttttttttgagacagagtctcgctctgtcaccaggctggagtgtaatgcacaatctctctgctcactgcagcttctgcctcccgggttcaagtgattctcctgcctcagcctcctgagtagctgggactacaggcatgcaccaccacacccagctaatttttgtatttttagtagagacggggtttcaccatgttggccaggatggtctctatctcttgacctcatgatccgcccgcctcagccttccaaagtgctgggattacaggcatgagccactgcacccagccaagctttatttttaactgcagatatagtacccaagtctaaagtatacagttagttgaatgtttgtatttgcatatgctcattagctatcacccagataagatataaaacatttctagcccttcagaaggcatcctctttccccttcccagtcaatatctaaccccggtgtaaactgctgtctgactactgtctcttgttttgcctgctattaacttcatgtaaatagattcatacagtgtatacttttttggccctgacttaacatatctgtaagattcatatattttgcatgttcagtagttcattttttaattgttgtgtagtaatttcattatatatattcaccacaatttactcattctgttactgatggacatttgggatgtttctagttcttggatattgtaaataaagctattattaatagtcttatacatgtgttggtggacataagtttttatttctcttgtatgtatgcccagaaatggaatatctggattataagattgattagctttactagatattgctaagtatttttccaaagtaattgtcctagatcacttcaccagaaatgtgggagtttcagttgttccacattctctccagtacgtgatgttgttagtctttttaattttaggcattgtagaaagtgtgtggtggtatttcatttgcttgtagtttgcatttttctcaagattaatggtgatgaacaatttttcatgtttattggctgctggatgtactttcttttgaagttgtcttttaaagactgttgcagagagtccttactgggttgttacctttttcttattgacttataagagttttcaaacatgtgtttggatacaagtcctttatggaataataagcatcacagatattttctatcactttttgaactgtcttttcactctcttagtcatgtattagattaacagaaattctcaatttttaattcagtcttgtataacaagcttttatttcatgattagttccttttgtgtcctgtttaagaaatctttggctatctcaaggtcatgaggacattcttctgtatttttctctaagaagcttgattattttagcttccacatttaggccttcaatccatctcaaatttttgagtatggtatgaaggtaggggtcaagtttaatttgtgtgtgtgtgtgttgtttaaattactttattttccttgctttcaatttttcttgcctttggccttgatccgtgtcgtaatgtctggtaaaatataacaatacctaataccatgttctcatagtaggtcttcaacagatgtttgatagattgaaaaactagaagagccttagaagctaatcttctcagtcatctttgtccttagctacatatgtatttcttaggttacctgagacttttatgtttttttccagttaagttgatatttaataattggttgtcttagtaccagtagtgtagttgcaggtggtttttgtgctgcgatgcaggtatagcctttcttaaattaaagattcagtctgagtttgttggggatacttatctcgggtgagcaattgatggggctccgcattagaaaggcaatatatggctcaaggagaaatcctgggctttggagtctgatagagctgtactcaaattctaacttttccaatcattatgactttcagtaagttgtcactatgtaattgagtttttactaaatgtaaaacaaagaattacggcacagtcaacgtagattaacctgccctaggtcacatagtcactaagggtgaatatatatccaggtctgcctaattgctaagcctgtgcctacttcctggtggatgttccatacataatagttccttttaacattttccttttatttatttttaatttttataaatttatgagatactaatgcagtcatgttacatttatatattatgtaatggtgaagtctgggcttttagtgtaatcatcacctgagtactgtatattgcacccagtaggtaatttctcatcccccattcccctcccaccctcccaacctgtctgagtctccattgtctattattctactctgtgtccatgtgtacacattatttagctcccacttataagaacatgcaatatttgactttgtttatttcacctaagattatggcctgaagttccactcatgttgttgcaaaagaaatgatttcattctttttcatggctgaatagtattccatggtgtgagtgtatgtgtatatatatgtgtgtgtgtatatgtgtggtgtgtgtgtatatgtgatatgtaacacatatatgtgtgtgtccacaaatatatatgtgttatatgtacacacacaccacattttctttatccagtcatctgttgatgggcacttaggttgattccgtatcttcgctattgtgcatattttcatgtggatatacacttgatccagcaccatttattgtaaaggccatccattcccactgcagtgaagtggaaatggtcataaattacatgaccatgtatgtggatttgtttggtaattgtgtattccattgatttattttagattatttatttattccattgatttcattttatttagaatcaacttgtgcatttttaaaataaaaaagctttctgaggctttgattaaatctatagatcagttgaggagaaattaatatcttaatgataccaagatttccaatttatgaatatcatatatctctccatttacttaggtctttagtttctctcactaacctttcatagtgttcaggccttgcacatctttggttagatttattcccagatattgagtggtttttttgatgcttttgaaacttatttttctctttaaattttattttacacatatgtatttctagtatagagttgattttgatcgttgattctgtttccacatacctttaaggcagtttgtttttgagtgcaagagtaagccattgaagatttggtctcacatcttcatttttgaaagcattttaaaaatatcattgggactgctgtatggagaatggaaagtgggtatggaggagcaaatttggaagaaaggagaccacttaggagactcttagagtaagtaaacctggcaaaagtggcctactatagagtagtagcataggatgatttggatcatttgcatttggaatatattttaatggtttagagataattcagtaaattaaatgagggaaatgaagaaaagaaaaaaatcaacaaatacttttcggttgttgatctgattaattggatatcattaatgcttaaatacccccatttaatgtttgtaaaataaaaagtgataactattgttcctactcccttttgtatttcatacaaactctaagttctttagaagatttttcttttttaaatagggcagtgaagacattagctggttcttttctttttttttttgacattagcttttgtttttgacgaaagaaaaattttaactttaccatataatgctaatttctgtcttttaaaaaatattaacttataaaacagcatatctaattttacttttgtttaagattacattggagcccatgagtgggcttctattaatctataattgtttctgtaattttccatgtttatcttttttttttgagaaacaaatggtaaactcaatgatattcttaaagaagtctgccttcctcctccacctgtaacatgtaagaatcaccggtttgaaaagtttaaagcatatgagtcacaaggatataaaattagctagcaaaatttcaatgtagcaaaacatttaggaagaaaggatgcgttatgtaaacttgaagaaggcctcaaataggttgtaagatactggggccattagtgctcatagacttcaatgtggtcacgatcttaagaaacagctgttaatagcaccttatcatagattccctacagaagaatctaagagctacagcatcctctctgaaaaaattaactttatagaattcaagtaaaaatatcacctatgaaaatcaaaattaacacttcggtgtagtggttataagcgtgacctttggagtcaatgcttgggtgagagtctaagctctgccccttctaagaacagtgggacctttggaaggttatttaatctgtccctactttagtttcctcatatataaaatttgatattattccttcctcctccttctcatcagtcttactcatcttctgtaaaatgggaatgatatataccttaggctcattaggattaaatgaagatcacatgtaaaatacatggtacagtttttagattattttttcacattacaaaatactcattttgaagatagaaatataaagaaagtttaaacatgactataggtaacattcagcatttttaatatttcagtcttttaaaaatatgagtgtacacacacctgtacacatgatgtgcatacagttttgtctttgtttttgtttttgagattgagtctcgctctgtggcccaggctggagtacagtggtgcaatctcacctcactacaacctccacctcctgggttcaagcgattctccagcttcagcctcccgagtggctacgattacaggtatgcgccaccatgcccagctaatttttgtatttttagtagagacggggtttcgccatattggccaggttggtctcgaactcctgacctcaggcgatctgcccgcctcggcctcccagtgctgagactacaggcgtgagtcaccatgcccagccctgatgtgtatcttgcatttttcatttaacatattattggggcttaataaaatcttaattcttttttttggaaacatctttaatactgtacttatggatcccattcttccacgtagaagccagttttagatgaattattttagttcattttccctattaaatagcatttataatgccaaaatattccctcataatactgttggaacatgtctgttgtccagaggcttattaagaaatgacttactgtttagtcccttggtatttcaaaacaattgattaaatatgtagtggtatatgtatatgttttatgttgtaactatgctgcaggaacataaattgaatgtaagtgaccatagtcaacagtttttattgatatccattatgcttaaaacattgtgaaagatagagcagttaagaagatatgtgcctgaaataaggagtctaatctgtttgaagtagacgttctcacatgtcattttagtagccttgtactttggatttaaaaacaagcaaagatgtttgcttattgtccctaagggagtatgctttgaatataaccagttattttgtatccattcattcacatgaacctacttaggttagtggaacataaccatggtataggtatttggaagtaatgtggccatgtttgcaacaaagcttacctgcccgagcaagtacttgcatgcctgctgtagatactcagcgaagtgtcatgtggccaacgtcaggttacaactctagttaagatttttgagagtttaagatcatgacaaaaatagagggaaaagtcaaacatacagaataagaaagagggaaatctttatttgtaaggcaaaagttcacattttcttcaactttctgtcagtatgtaagatttctatgaatagctcaagtcctggcataagtagcagtgataatattaacacctctttctcccagtcacatcattctgaggatgcatctgccactcacttactgatgctgactggtttccaaggaagtggagtgtgaataaacttggattttctacacagcttaaagcttataggaatttctgtattatgattattgttttacatgaagttcataaattgtttgtttctaatggttgctactacctgttttaggctctctaaataacaaagcccacttaattctagtatttggcctccacagccttatatggagatatgaaagacatagtaaagagggtctcttccctaagggagattatggttagtataaagtaagtgcaagaatgcattggagggacttcaaaagaaatatagacttggccaggtgcggtggctcacgcctgtaatcccaggactttgggaggtcaaggcgggtggatcacgaggtcaagagatcaaaaccatcctggctaacaaggtgaaaccccgtctctactaaaaatacaaaaaaattagccgggcatggtggcaggcgcctgtagtcccagctactcgggaggccaaggcaggagaatggcatgaacctgggaggtggagcttgcagtgagccgagatcatgccactgcactccagcctaggcaacagagtgagactccatctcaaaaaaaaagaaaaagaaatatagacttgtctcttacaaagtttaaccattagaaatgaattttacaaaatgaaactaaagtgacaaaagtgagctatttctcctccttagattttctttctgttattctgctacaggattttatagtcacaaagtttgtttatctgaaaaactgccataattttcacttagctttagaagtgtggttcttaccttgttgccgatctaatggatgtgtgtaaaaacacctcatagaatggcagtttgttgaatgacttgagttcaagtagcactcacttgcaatgatttaccatcaactctaactgtggcaaagtgtgactttagccttaaatttaaactccttaaagaccttatttcaagggggaaaaaaatttcctttcaactttctcccatcagtgtgtaagttttacatcattggtcttctgttttgtttggcaattaaaaatctcttgtgttaatttttgaaagtttttttttttaagatttattgcttccaagtgcaacaaaaataaaaataaataaatgggatctaattaaactaaaatgcttctgtatagccaaagaaataaccatcagaggaaacacacaacccacagagaaaatatttgcaaactacgtatctgaaaaaggactgatatccagaatagaaggaacacaaacaaatcagcaagaaaaaaacaaataatcccatcaaaaagtgggcaaatgagatgaacagccatttctcaaaagaagatatacagatggctaacaaacatatgaaaaatgctcaacatcactaatcaaggaaatgcaaattaaaaccacagtgagacaccaccttactcttgtaagaatggccattattaaaaagtgaaaaaaaaaaccatattgatgtggatatggtgaaagggaatgcttatatactgctggtgggaatgtaaattagtacaacctctatggaaaacagtaggaagatttcttaaagaactaaaagatctaccattcaatccagcaatcccactactgggtatctacccaaaggaatagtagtcattatatcaaaaagacacttgcacacatgtgtttattgcagcacggttgcagttgtaaagatatggaaccagcctaagtgcccatcaactaatcagtcgataaagaaattgcaacaacttgaatggagcaggaggccattattctaagtgaagcaactcaggaataggaagccaaaaactgtatgttcttacttgtaagtgggagctaagctatgggtacacaaaggcacacagagtgatataatgtactatggagactcagaagggggagaggatgaggagtgagggatgaaaaattacatattgggcacgatatacactacttggatgatgggtgcactaaaatctcagacttcgccacagtacaatcatccatgtaactagaaaccacttgtacaccaaaagctgttaaaatttaaaaaaaaatttttaaagatttattgcttccaaaagacactatatactcctctctctctctctctatacacacacacacacacacaaacacacacatactatatattatagtttataacctagaagagaaaattacacattaaacatttaggttcttaatcatacaaggtttgtagttctactagagctgtactcctcatctagcttccctggaggatttattagatttttttttctgtttatgaaaggtattgggaactgacacataacgtgtttgctctggtttctatagctgtctatttctatattatagctattagaatgctagcagatctttctgatttgttctaagctaaagattccactgaaaaaaatttgagtatcttcagtttatatttcttatgtatatgcatgcacatatatggaatagctttatatttaaatttttggaattatgagtatgttgatttctattaaatgtatatttatttttaaaaacaaatggaaacacaagaaaataacactcatctacatcctgtcaccctgaattgactgttattaactgcttggtagttggttgtttcttttagggggcagagatcactctattaattttgtaaaactgatatgcatatatttatacataatttaaaccatggagaagagcacaaagatgaaaatttttaaaaaaccctcttcttggaaataacattagttaactttattataatcagtttaacaacagtctggatatcatttgaagtaggaatgataaatagaatacttttgtgaagaaaagatcatattctggaggttttttttaagttcacatttatttgaatctaatgaaagaaaaggagacaaaactgaagaaactgtggaacttgaaatatgtatctcttcacccaagaaatattttccttcaattttgtaagttttggctttatgtgttttggggcttttttgttgggtgcatatatgtttataattattttattttcttgatggattgacccttttatcattatcagaatcttttatttctagtaattttgttttaaagtctgttttgtctgatattagtatattagtgtagctaatttaatctagctttctttcagttattgtttgcaacgtatatctttttatatccttgtacatctaatttatttttgtcttaaaagtgtgtctcttgaagttggcatatagttggtacatggtgtggtttttcaaattaatctgctagtctctgctttttgattgtcatgtttaatccatttacacttaatttaattgagggtagagtaggatttatgtctgcaatttgcccttttgttttctgtatgtcttaagtgatttttttttctctgtgtccctgttacttcttttacactgagtagatactttctagtctactaatttaattcccttatttaaacatatatgtatgtgggtatagggttagttatatttcctgagtggtgccctgggaattacaattagcatcttaatttataacaacatactttgaatagtatacaaaaactttgctcctacatagctccattctcctcttcctttatgccgttattaatacagttaaatcttattacattgtatgcccatcaacatagacttataattattgcctcatgcagttttcttttaaattagagttatgaacaaaaaatacattaaaactgtcttttatagttatctttgttggagtcttgaccagtgctctatttctttatgtggatcgagttactttctagtgtccagttttccttagtatgtcttgtagggcaggtatgctagtgaagaatttttgcctttatttggagtgtcttaatttcccccttactcttgaagaatagttttgctgaatttgaaatacttggttgacagtttatttcagcctgtgactatgtcatccaatatgcagacttctggcctgcatgttttctggtaagaaatcagctattgatcttgtcaaaaatccttgttcatagtgagttatttctttttagttgctttcaggattatctgtcttttgacagtttgattatgatgtgtgttactgtaggtctcttgagtttatctttcttgggggtcagttagcttcttggatgttgattaatgttttttaaagtcaaaattggtaatctttctgtcattgtttcttcactgcctttttttctttgttctttccttctgggcttcccctttatacttatattgttaaatggtgtcttatctctgatgttctgttcattttttcaattctttttctttctatttctcagactcaataatctttaagttcctgtctttaagttcgctgattatttattccacctgctcaaatctgctgtaaggccaagcacagcagttcacacctgtaatgatagcattttgggaggctaaggcaggaggatcacttgagcccaggagtttgagaccagcctgggcaacatagcaagactaccatctctacaaaaaagaaaattagcgaggcttggtggcatgtgcctgtagtcctagctgttaatacttgggaaactgaggtgggatgatcactcgagcatgcagtgagctgtgattgcaccactgcactttatcctgagtgacagagaaagaccctgtcaaaaacaaaaaacaaaaacaaaaacaaaaccctatagttaatttttcatttcagttgtgtactttttgactccagaatttctctttggttgtattttattattcctgtctctttattgatattctttatttggtgagacattgttttcatactttagttcttcagacatgattttcttcagtctttgaacgtatctaaaatagcttgtttaaagtctttgtctagtaaatctaacatctggacttcagagaatgtttctgttgaggtgtttttctgtgcatgctgtgcatggactatattttcttgtttgcttgcatgttttatgatttttttgttcttgttgtttttatgaaggagagagtatttttggacatgcttactttgctattcctggtgatgtcacttatgtattaactttctacatgaaaccatcttataataaatgccgatatttgaaaattcttacacctttctgcctacctgccactaagatgtagtctcttacattgtcttctaagtgctatttttaaaaaatttacaaaatgttactttattaacattgtaagtattctgaaaatatttttaaagaaattcataggcacttctttttatgtatcatggtgccaccaaataaggatagtgaacttggcataccttctacttagtaagtgcaaggcatgttactcagccatgcaacaatctcatttaatatttacagagtccctctgaagctctgaaaacttaagtaacttgctgaagattacacaactagtaagtgatagatccaagatttgaacttaatgtgtttaactctagagcccaatatattaatggtaatgttatactgtttctgtgaagtgattttcaaaatgtgggacccatgggttaccttcttgagagactcctggggtgcttgttgaactgtcaattcctgaacccctaacctatacatattgaactaaaatctctgaaatttgggcctgagagtaggtgacgtttctcaattatattatagttggaatagtgctggtctatagactgcttttttcttatgatttgggctaaaaaataaaacagtaggccattttaaatccatattaaaatgtaattctacaattcaattgaacactaacttttcaaattaattttttgaattttagagtacaaggtgacatattctgagataatctgacaaagaacttttctctcactttgtgtgctgttaatatagttcaaagtaagctattgataaattataggtttctaatgtgtgagtctgtgctttataacttttacatttttttttactatgaacttacatttatacattaaaatttagtggaaaaaatataaggagtgggtaaatcatctcttgttttaggttgaactcccaccacctgatcttggaccaagttctgcactaaatcagacactcatgttgctgcgtgaagttttagcatctcacgattcttcagttgtaccattagatgctcgtcaagctgattttgtgcaggtatgttataaattcatttttaatgattgttttttgctcttctattgtacactgtgtttcaattctggaattttgtaattcatatactttgacagtctctttcttactgttaattttccatcaaatattaaaccagttatcataacttaaaaagcattgatttatgtttaatcttttcctacgtgcttctataaattggcttccttccaattagtttggcattaaatatcattaacccaagaccctatcagtgattgagaaataaagagttcattttatttttcatttgtaggttttatcatgtgtcttggatcctctcctacagatgtgtactgtatcagccagcaatttaggcacagctgacatggccactttcatggtcaattcactatatatgatgaagacaacattagctctatttgaattcactgacagacgtctggaaatgctacagtttcaggtaaatttttctataaaatgactattgactatgattgaatctttttctctatgtgatagctttaagttattggcttaactagttttaatgacctaattcctatagatcccttgatatcatctgatgaaaggacacacatgcatatacacaacacacgcacatacacaacacacacacacacacacacacacacacacacaaattcagtatttcagttttcagctttagaggaaccagaatgtgtaatgtttaaaatacttgattcataccataatatgtgatagtagattgaagctttctgattaatttgaacagttagtctgtatgtggattttagtttctgaactgtgaataatatgctatatttttcaagctgcatagttaatgcaaaatgtgttacagaggacagatatatttttatctatgtgtaaaccagtgttaggcaaaacattacaaattgctataccaaccacttgagttcttgagtcctataaagcaaatggttatcacttaagagagtatatgatgactaaaacaaagccagttgtaaaatttagtagatagttggattccagttttaagcagtgattattggtaaatatactgttttttaaaaaaacaactctgaatgttctgtgctatcacacatatatcaacagtttgacagtgggtataggaatgagttttgatatatctaaattcatattttctaatttttaattttttcttttaaaataaatgtatcagaattttccatatttgtggtttaaagtcaaataattctacagaacttgttacgaaaagccaccagtgtaccatcctctccacccccaacatctctttctcatttctccctcaaaagcacaatttctttcagtttttatagttgcttcttttggtatttatatttgtaattctaaacacttacgtgtattgctacttatagattttttttagttttttgtctaatgtattaaattagatatattctaatacattgtgaaatgaaatgaacaatgaaaatttagttatctactgccactcccccaacccccctggataagaatatggtcatacttaagagttttcccatcctcccaatgtagctatattataaattttggttagatcaatgttttgttaaattattattactatgtaaacattattggtgactgagccatgtaatgaagaatggttaatttacctttcttggataacttcttcattttctgtggaattaataacatttttatttaagaaatgtcacttttttatgtatttgtcactaattcaagcccaaatccctgccatttatctaaatcttaagatgttaagatatgtcaggtgtttatcaatttgctttattaccaattatctatgtttcttatgtgttccatagctattttacgcatggtaaaaattcttcttggtctatgtgctaaattaagcttattagtttattcaagttatctatgtccttgcttatttttgccaccattggatgtgtcaactggacttttacatgtgttttaacattctccagaaatctcttgagccagatctttattagtcctggcagcattttcagtaattgttctgtcagcagataattcaggttcccctttctccagactccagtagcaattttcccagtgccctttcagaccccactggcagtcccttgagtgggtattccaagtggacaaatcccagtgtggaagtgcttattggcctattcttgcattatgcttgtcagagtgctgtcagccaagactggccacatagaacagcctggattcggtgtgatagaggacaatacaaaggtgtggatatgtgaaggtgtggtttatcacgtttctccaaagtaacaatttaccttgttgggtaaaggagtcttgattttaggacctttactaccaataacctattatttttttcccactcttatatagcttcttccagtgtttcaagcaagaagtccaggctagtcagattctcttgtttttagtaatctagtcccttcatctggtaacttacagggattttccattgagtttatatgttttcccaggatatttttggtatgtctctttttaaaaattatttgcatcttggactttggagaaccatttcaatgtaaagattcaaacctttcttttgcttagtaaagagttctatttctttaatcatcacttttctatgtgttactttttatattttgaagcccctgtccttggttggttttatctcacggatctgccatctaatttctttttaaatctcttcactttaatctatttctttgatatttgctctgtattactttccttccatttttctttcagaccgctgatttgatgctttgcagtaactctttttcaccttcattgagtgtttacctttgcgcactttgtttttctttggtttctagtaaatccagcaagtaagggctctaattgtacttccttgggcatttatttaaaaaaaaaaaaaatgaaagtactttatgtctttcagtagtgttgcctcaggaaagaaaccatacttgttctgattattcacaagggctttcttttagcttcctcacctcttttaaatcagttctaagttttttagggggacgagcagagctattggagttgcttggaaaatggcaatcatttagatggtaacagataccatagttgacagtgtactatgtcattagcaagcaaactggtaaaatctgggggaacattctggtgaggaatagaaggaagacctctagactcaggattgtactggcacaaaaaaaaaaaaaaaaagaacaagattttttctcaccagggaatgtttcaacccatcaaggtagttctcttctgtggtttttatctccattagcattagttggaatcccccaaaatagcacaaagctggggagcccatactactcacatctgttagctgcatcttcttaggcagttcctgaacctgaaatctttagtcaagtttctactgggccctcagctcttccctacttgtcacagacctgccttatcctcaggagaatttactacctgagctgtagtgggatttcctctaggcttctccagatggtatatttgatttgttaagtcagtctagaaagttgggagcgtgaggaggacaggaggtcaggaacatcaggcccttatctcggaattcttcctaaatattttattttatactgttgttgtttactagtgttttttgtttgtgttttgtttattagcagcttttaaaagggctgagaagcaacccaaattttgtgactggaggatagtcctagaatcctccttgtttataatttttaaagtaagactttttccccctttcatagaaagacttactgtttgggggaagaaagaggctttgttacagaggtgatccctgtgcctcatcatcagtgccaatgcaaggcactgcatctactctcatcagtgtcattcttcttttaaaatgttttctttgtgttttattttagatcgaagcacatttggacacacttataaatgagcaagcctcttatgttttaactagggtaggcttgagttacatctataacactgtacagcaacataaacctgaacaggtaagtgcatagatgttccttcctaattctaagaacatgccagtttagagtatgtcttctagagctgcactctggattcttggctctaccacatattagctgtgttctcctgggaaagtgacttatttttctgtatctgtttccttacctgtggattgggggtaataatagtatctgtgtcataggattgttcttaagacataatacatgcatagttcttagatgacttcctaaaatatggtagagtgccccacagtattaacaatcctttttattaaaaatagtttttgttaaaagtaatgaaaatatacaaaaattagtattataaaatgtctaaagaatattcatactggtaagtttttcagattcctatatcactattagttaattgaatgcatagattactgtataaatagcagtcatcttctttttaatttagcaaattgttgcccattactttgagaaggtagtcacttctggggccagcatatgatcttattaaattatagaaccctagtagaaataaaggagtggtgggaaccttagaaaaccatgtaagccatctttcttaagaaagcaaagaactcattcaaacagcattaacatgaagactgtgttatggcccagaaactcttaaatgaagctcttaaaacacaacttttcaattctttctttgctgaagtggtaagcaaatttctaccagtaggaaccaattttactgcctttctgtactttctaaaagtatcaaagtgaaactgttcaagcctccatgtgtcactggcatcttccagtgcttcattgccttcattttcttgggtatgcgtaaacttgaagtatcatgatatttctgttgttaataaacttgagcacgtcttgctctctccaacaaatcatagtccctgatcttattgaggttgaagaaattacacttgagttctttggaaataagctaaatgattttccaaatttgggcagtgcactaatgaactatattcagtaagtgaaatgaaatgtatatctccttttttacatcttggatctgcttttttttttttttttttaaatagggctctttagctaatatgcccaacctagattctgtgacactgaaggctgcaatggtaagtgtataataaaacattttaatttagatttccttatggatcgatagtcttcattttttgctgtgtgataatttcattctgggtgacactttttatctcttgacatgctgtattaacgttgggtccaataataatgactgagcctgtattactttaattgaacagttctggccaagtcttacattcatagtagtgttccactatgctctgatagtctcatcattactgtttaggattactgtttactctatttttagagttttgttcctaatttaagtgagaaacaggaatgacagatatgaagaaattaggctgtatatcattataaacttattactaccttgatccttcgtttaaagttcctgacgtgaaaatcgaaattagattccactcttaaaacagtttattactctttagtttgagactcactgaatttccactttattaccttccttcttttcaggtgaagatcttgtaccttcctttttgcatgatcactactttttgtagtgtgtttctgtgtcttaaatacatatactttcctcatatgtatagtgttcatatgcatagccattcattgtatgatatttaagtcatatagctctatccctcataggaatgatcccttttggaagttttatgatagtactactagtaatagtaataataatatggaagaacaacagccattaacattagcatagcaagtgttttccctgtattaactctttaatcctcatgacaaccccattcaatccaggaagttggcctacagagcttgtgggtttaactactgtactaaactagtgatcctaagtatttaaaatactcacgtatactcactaccacaatggcctgactttcatagatagtcctgtaggaaggtttttaaattttccaacaatttttgatgccaaggctttcctatatattatcttccagaactcagtttaactgaaaacaaaaggataggctcataagatacctaacaaatgcaaagaagaaggtggagctatctatatgattattagataaagtagaatttaaaaagactaaatgagacaaataagaaacattatgtcgtgataaaagacactatatagaagcaacagttataacttctatatatgaaacaaaaacatagtagcaaaaattagaaatgcaaagaaaattcgatattaaaaagtttaaataaaaatagatgaaaatgaattttagattcattaaaagatatgtttttagaaagttatatatacacttaccatactatccagtacaattccacttcaagatatttaccccccaaaaatgaagatctatgctcacacttagatctgtaacattagttagtaccaaatatatgttcccttcctctgtttctccttctctcttgacacatatccagtctgtaatacaactcataaaatatttgaaatgccattaaaaattcttcatgttcctggtgttaattttcagaacaattaaggtgaatatgaatatacgatgtctctggagaaacaaatcttgcttgagttttgtatttaatacgtgattatatacaaccatttgttgtctccatttaggggtttctaaggcacttcaattcagcatgtccaaaactaactctgcacattccaccctaaacctaagtcctcttccaggcattattaactcagaaaattgtaagaccttctatccatttatcatttaaatagttattaaccgagtttctgctattttctaggcatcatgctaagaattgggatgaaaacagatatgatctagtaagggatgcagctactacacaaataaatgaatgaagagtacagttatgtgttatgataatatggtgaattaattcatacatatccaaaatctgggagtccatcccttcattctatcagtaaccaagtcctgatggtcctcaaatatctttacgtctttcaccttgattgcccctatagtctaaaaatgctgcagtaggtacctaaggtacctaattggtgtctttgtatctattattgcaatcttccattctgtcttcctatggccagatttagcttcttaaaacttaaatcagatttctcccttacttaaattcaatggtttactaatgcttttgaaataattaaaatccttaaataagcatgccagtcctacatgatctctacttatatgttttccttcccacctcaagtcttcatgctgtctcctctccctgaacctccccacccatcaatccacttacttaatgtatattcatctttaagatttcacttcaaatgtcctttcctgagagatgcttttgccgaatccacagactaggtccttgatttatgctttatagtaccttgttttattccttaatagcatttaacaaaatttgtaattatatatttatttatattattatctgtttaacacctctcttgctaggccataagctctgtgaagctagggactatcctttttttgctcatttttatacttccattacttaatatagtaccttttcaatggtaggtattagttgaactaatgaatgcattaatgaacaaatgaacaaatatagtaaaatcaagaaacaggtagacctgaaacctgatgactttacttcttgttaatattattacttaaaagctttgtgaggaagactaaaatgaatggtttggattcaggattttgaaagtaagtattgctaatattgactatattacagatttgacagttttagggagttttagttagaatgtttagaaaatacacaatttgaacacaacaatctagttatttagagtatggaatttttctcaaggatttaattcttaaaagagatgtttatatttgagttgtttgttagcacatatatgtactttatattttgtatttctctgtttcatttaggttcagtttgatcgttatctgtcagccccagacaacctattgataccacagctgaactttcttctaagtgccacagtgaagtaagtatttttggtcccaagtagttggtaaagattcacatatttttaaatatcaagtacatttttttggaaaaaaatttattttcaagaataaatgatttaccattgaaaatctatagttctcaacctttcttctgccttggcatgccaaaggatgagatctgaacatgtctgtacttattccatgtctatatgtcactccaaaatctctaattagtacatgattgttaaaattactttgaatataattgaagctatatagctgtaataccaaattcccttacgttaacaaacatgtcagaataatgttgaatatgttatggaaaatcaataatatattcattatgcaatgcagatgaactgatttatagactattttgaatctaaggtagtgttctgtagatataaaattactcaatatcatttatcaggaatgtattcaggacaccaaatcatacattaaaatattagaatataacaattagaagaagcggagagattatatgatctttcttgattttaagaaaaatattggcaaaattgtctataggtaagaaattaggcaacattatctacacatttttttttctttctattcaaacagcagtgcagtaagtgttttctacataacaggcactaggagttaaggcttaaaagacatttgcactgttttcacggagcttataacctaataggtcagttaaacatgcgaacaaatatttacattgaaatgtacagtaaggaaagaactattgaacaaaacatttcagatatctaaaagaatgtaatgttatagaggtgatatacttattttctgttcttgagtatagaactacagcagaaaatagagcaaagaagcagctttttaactcaccatgcagaatttggtatcaattagaattggctggaaatctatggaccactttttttttttttctcagacacagagttaggaaagttccattttaggtgagtgactagagtaaatgaatttaatttttttttgtgacctttatattgtattattctaaaagatattatactatttacataaccagaattctaaagacttaagagattaccaaagaaactgttatgctgtgactcaggttgtttgtaggtgcttcttttttttttttgagacggcgtcttgctctttctcccaggctagagtgcagtgatcttggctcagtgcaatctctgcctcccaggttcaagcgattctcctgcctcagcctcctgagtaactgggagtacaggcgcccacctccacacctggctaatttttgtatttttagtagagatggggtgtcaccatattggccaggctgttcttgaactcctgacctcgtgatccacctgcctcggcctcccaaagtgctgggattacaggtgtgagccactgcgcccggccaatgtgcttcttaaattattaaatttttaactgaatacctgtaattctttttaacttaactgtgtctcagtacgtaatattagaatgttgttagccatgtcactacatgtgaaatatactgttattcttttcataatataatgattgaagagagattttaatgtactttaaaagatgacatgtagctcagatgctgtgaagcaggggtccccaaccccgggccagggaccctggtctgtggcctgttgggagcacaaaccctactgtgaactgcgcctggaaggatctaggttatgtgctccttatgagatggaacagtttcatcccaaaaccatcccccaacttcttgtccacggaaaaattgtcttccacaaaaccagtccctgctgccaaaaccactgggagctgctgctgtaaaggaaacagatggacagatttggctctgtaacattttaaggtttttacagaaaaagataatataaactaagttgaaatataaacaataatatggaaaaatgtttgcaaaatatgtaacagataaattattcttaatatattatccttaatatatagtaagatcctataaattcatacaaattgtagaaaaacaggcactgaatatttgaacaactcacagaagtaatggaaatggcaagtaaatatatgaggaaatagtaattatcaaaaaatgcaaactgaaacaacgagaacttctgtctatcagactgctgacaataaaacatttattacatactaatggaacaggtctgagaaagtgggcattttcacacttttttgaatgagagtataaattagtacaatcttttcaaagagcagtttggcaacattccacaaaatttcaaaattatacattcttaggctcttctaaaattttatttttctttcttagtcttggtaatagtttaaaaaaactgttgaaccagcagtgggattgagtattgtgtatggatctattcgagtcgtttgcctcagaaacttgtcagatttcctaagcttaaatcatttttgaaattaaatgtttgtcttccattattgaagacaatattttagtttctcctttacttttattgtcctgttgtctaacggtaacaatgtaaactttgttattttattatcagacaaatgaacaagttttggtacttttttttaaatgtgaatttttaatttagtttttaaaattattttatgatatgtgcctaacatcctattatgaattcttactatttataatgacatttaaaattgagatatgcatattatttatataagtattaatactacaaacaagagtttgaaatttcttagtacctatttacctctgttttcattcagaaatatttttaaatgttatatgcaaagtattggaaaattaaatgtgatctgcaacataattttcaatatttgtttagacgaacagaaattatggtataaatttagctacttattttcaaatcaggattgctttgaaaatatagggcattttacatatttaagatttaacgtcaggccgggcgtggtggttcactgaatgcctgtaatcccagcactttgggaggtcgaggcaggcagatcatgaggtcaggagttcaagaccagccttgccaatatggtgaaaccctgtctctactgaaaatacaaaaattagcttggtgtggtggtgtgtgcctgtattcccagctacttaggaggctgaggcaggagaatcgcttgaacccgggaggtggaggttgcagtgagccgcagtcgcaccactgccctccagcctgggcgacagagcaagactccatctcaaaaaaaaaaaaaaaaaaaaaaaaaagatttaacattaaaggagattttcttatttttatttttttgagacagagtctggcattgtcacccaggctggagtgcagtggcataatctcagctcactacagcctccatctcctgggttcaagtgattctcctgccttagcttcctgagtagttgggactacaggtgcatgccaccactcctggctgatttttgtatttttagtagagatgggggcctcaccatgttggccaggctggtctcgaactcctgacctcaaattatacacctgccttgacctcccaaagtgctggggtgacaggcttgatagcactcccggcctaaagcaaatttttaaattgcgctcctactatctgtttttggttttttcctgttctcttctcctgaactttatctatcttcatagttgcaatacctttgggacacctataacctgtgtctccctttttcttgtcttgtcttagtttgactgactttcaaaggagattttgatttagcacttcagccttggaataagctattgaatacatttaagtagctaggaaacaaggtggtataggaaatagggaaaagaatagagaaagaaaatggttttaaagaattcttccctttggagtgaatttgaagcttcttgttctattttcaatgcaaaatctccaatattcaccttatagcaatacaaaaatagagtttggactacagaaaccacagttgtgcatatataaaatgttctcaataaatctttgcttattgagtcacagttacttccataataacttaagaaataaagagaatgcagatgcttcctaaagtgagcatatgggaaaatgggtaagttttgataactcttttattcaaggtttttcctccattatagaaataatatgctagaaataaagcatgtacctataatggagtaatttttttgagagaaattgaacacttttttttcttttaactaccttcttttattcacttgtactatcaggaatatccatatagacaaaaataaagcaagtttggggtaaaattaaaaaaaaatactaccaggaagagaactactggacagctgtgaactgaatgctttagagacctcagaaagtccaaaccttaaaagcaggattaatctccaaaggctggagaacctggaattcttatgtcaaaggaaggaaaagaaagagtatcttagctgcaggagagaaaaagagcaatttgctgttcttctgcctttttgttccattcaggccttcagctgattggatggagcccgccccattgacggtgaatcttcttcactcagtcttccaacttacatgccaatctcctgtggaaacaccctcacagacacacccggaaattatgctttatcaactaactaggtatcccttatccagtcaagttaacccttaagattaactatcagagctaatttagattcatactaattaagcttaaaatcaagcctctaaattatcaacttgatctgtaattaaattaactgccttccggaacaaaacatacatacttaaagatgacagttacagacaatcaacagtgtaacatctataatgctaagcatgtgataaaatgctattgcagtgaggaagcaggaaaatatgagccaaacctagagaaaaaaatcagtcagtaaaaacatacttacaaatgctaaagtttacagaattaacagataaggtgttttaaaaagctgttaaaaatatgttcaagaatttaaaggaaaacatgacccttagagaataggggattttacaaaattagaattctagaattcagagatgcagtatataaaatgaaaaattcactggattgtcttataggccagttgaacactccagagggaaagatcagttaacttgaagagaggacaatagaaactgaagcacagatagaaaaaaaattaaaaggctggaaaatagatggagtcttagagaattgtgagataatactaagcagtctaacctgtataattagatatcatagtgtaattgaagcagaaaaatttgaataaaaggggaattttttctaaatgttatggcaaataggaaccctcagacccaagaaattaaataccaaagtataccataatcaaattattgaaaaccagtgataaagagaaaaatttttaaagacatttgcagggaacagtggcattactgacttcttgttagaaacagcgcagaccagaacacagtagaatatcatcacctttgaaaagctaagtataaaaacgtcaactttaaatgatcgatcaaaaaaaaaagtgtctttcaaactgaaagtgaaataaatgttttgaaataaacgaaagtagagaaggtttatccccagcataatgcactgtaagaaatgggtacaaaaagaaagaattcttttttttttttttttttggagacggagtcttgctgtgtcacccaggctggagtggagcggcgcgatcttggctcactgcaacctctgcgtcctgggtgcaagccactcttctgcctcggcctcctgagtaggtgggaatatggacacctgccaatgtgcccggctaatttttgtagttttagtagagacggggtttcaccatgttggcccggctgatctcaaactcctgaccttgtgatctgcccacctcgtcctcccaaagtgctgggattacaggtgtgagccactgtgcccggccaaaaaggaagaattctttaaaatcattttctatgcttttctctattattttgagaatttttacatcattgctcatcagggatattggcctgtatttttgttgtactgtttttttttttcttaatctgtctttggttttggtatcagggttaaatactggcctcatagaatgaacgtggaagtattcccttctcatctatttcttggaatagtttgagtagaattagcattagttcttccttaattatttggtaaaattcagaagtgaagccatcagttcctggctttttctttgctgagacactttttattatggctttgatctcattacttgttattggactcttcaggttttgaatttcttcatggttcagtcttggcagattgcatgtgtctaggaatttattcatttcttctaagcttatagttgctcatagtagcctataatgagcctttgaatttctggggtattggctgtgatgtctcctttttcatctctgattttatttatttggatcttctggttcttagtctagctaaaggtttgtcaattttgtctatcttttcaaaaaatcaccttttgtttcatcactcttttgtacttttgtttcaatttcatatatttctgctctgatctttattttcttctactaattttgggtttggtttcttcttgcttttctagttctttaaaatgtatcattaggttgtttatttgaagcttttctacttttttttgtaggcacttacagctacaaagtttccttttagtactgcttttgctgtatcccattggttttggtatgttgtttccattttcagttgtttcaataaattttttaatttccttcttaatttcttcattagcccactggttattcaggaacatattgttaaatttccatgtgtttgtatactttccaaaattattattgttattgatttttagttttattccattgtggtcagagaagatacttgatataatttcatttttaaaaaaattttatggacttttattgtgtcctaacatatggtctgtccttgagaatgatctatgtgctgcagagaaaatgtttattctgcagccattggatgaaatactctacaaatattgattaggtgcatttggtctgtagtgcagattaagtccaatatttcttttttaattttctctctgggaagtctgtccagtgctcaaagtagagggttgaagcctccagctattattgttttggagtctgtctctctcattatctctaataatgcttgctttgtatatctgggtgctccaatgttgggtgcatgtatatttacaattgttatatcctcttgctgaatttacccctttatcattatatactgaacttgtttgtctctttttatgtttgccttcaaatctattttttctgatataaataagtatagctactcctatttttttgtttgtttccactggcatggagtatctttttctatctctctttttttcagtctatgtctgcttttgtagatgaagtattttttttgtaggcaacagatttttgggtcttgtttttttaatccattcaaccactctgtgactttttgttggagaccatagtccatttacattgtgttattactgataaggacttactctgccatttaaaaacttgctttcttgttgttctgtgattttcacttccttctttccttccttcttgtctcttttttagtgaaggtgattttctctggtggtatattttaaatttctttttattttttgtatatctgttgtatgttttttgacttgaggttaccatgaagcttccaaataatatcttatactgcattattttaaactgacaacaacttaacattgattgtgtaaacaaacaagccaagagaaaactaataaaaactctttaccctttaacttcattgccctgctaatatttgttttttctacttatatcttattatactgtctgtcacttgaaatgttactgtagttatttttgctaggttcatctttttattctgtctactcaagatatgagtagtttacacaccatggttacagtttacaacattctgtgtttttctgtgtacctagtattaccagtgtgtttagttccttcagatgatttcttattgctcattaatgtccttttctttcagattgaagaactctctttagcatttcttgtaggacagatgtggtgttgatgaagtcctttttttttttttttttttggtctgggaaagcctttatttgtccttcatgtttataagatcttttcactggatatggtattctaggataaaagtttttttttccttcagcactttaaatgtgtcatgccactctctcctgtcctgtaaggtttccactgaaaagtctgctgccagaattattggagctcctttgtaggttgtttcttttctcttgctgcttttacgttctttttctttggcctttgggagtttgattattaaaggtcttgaggtagccttatttggattacatctgcttagtggtctgtaaccttcttctacttgaatattgatatctttctctaggttcggaaagttctctgttatcccgtcaaataaactttctacactaatctctctctgcctcctctttaaggccaacaactcttggatttgctccttggaggctattttctagatcttgtatgtgtgcttcatttttttttttattcctttttcttttgtctcctcttactgtgtattttcaaatatcctgtcttcaagctcagtagttctttcttctgtttgattagttctgcagctaagagactctgatgcattctttagcatgtcacttgtatttttcagcttcggactttctgcctgattctttttgactatttcaagctctttgttaaagttacctgataaggttctgaattttggccaggcgcagtgtctcacgcctgtaatcccaacactttgggaggccgagacacttggattacctgaggtcaggagttcaagaccagcctaaccaacatggagaaaccctgtctctataaaaatacaaaattagccaggcatagtggtgcatgcctgtaatcccagctactcaggagactgaggcaggagaatcgcttgaacctgggaggcggaggttacggtgagccgagatcgtgccattgcactccagcttgggcaagaagagcaaaactccatttcaaaaaaacaaaaaacaagattctgaatttcttctttgtgttatcttgaatttctttgcacttcctcggcacaactattttgatttctctgtctgaaaggtcacatatgtctgtcactctagggttggtcactggtgccttgtttaatttgtttggggaagtcatgttttcctggatggtcttgatgcttgtagatgttcatcagtgtctgggcatcgaagaggtgggtgttatagtcttcatagtctgggccttgtacctgtccttcttatgaaggctttccaagtattcaaggggacttgtgaattaagtctttggtcactgcagccatatctacattagggaacacctcaagccctgtggctcttgcagactcaatgagggtactacattggtggtgttgggtgagatccaggagaacttcctggattaccaggtgtagactcttgttctcttcccttactttcccccaggcaaatagagtctccctctctgtactgagctgcctcggagctgggggagtggtgatacatgcctcttcgtggcaccaccactggtactgcgctgggtgagatccaaagcaagcatagcattgggtcttgcccaaggcccacagggatcactgcatgactactgcctatgttccctcaaggtccaagggctctgcagtccgcaagtgatgaatcagtgaggcttgtgtccttcccttcagggcagtgagtttcccttgtctccgagtgggtccagagaagctgtctgggatgcagggcctggagtcaggaaccttaggaatctattatatgtggtgttctgttctgaggtggctgagctggcatccaagatacagaacaaagtccttcccatgcttctgtctcaagcagaaggaaggagtcttacccggagctacaagctgcatcacctggggttgcgggaggagtgatgcaagtactcccgtggctgccctagctggtgtctcactaggtcacgtgcaccccaagtccactggctctaagcccagcacagcacagaagcttgcccaggaattagagcccttatggcccaaaacttgcccttcagtttatttcagatcccagagcaccttatcccatggtggtggggcttgccagaactctggttctgaccgctgggatggaggcttcccttctgactagtgctggtctaaatgctccctctgtggatgctggctgagttctgcctggtgttgctttctgctgtgacagggcagcactaaattccagtgctacgtcccacaatcactcttttttctcccttccacaagcacataaattctctctccgcgccatgctgccagtgccagggattaggggaaggatggtgtaggcaattcaagactatctttcttatcctctttagtgcctctttccttaatatgatgttaaaaccaagtactatgattgctcacctaatttttggttcttaggaaggtgattttttgtgtggatagatttggcgttcctgcttgggggacgatctctggaggcttctatttgctcatctttctcctaattgtggaattttaaacacataaaacatacgacaacaaaagtgcaaaagatgcagtgggagggaagtggaagtttggtgttttaatattgtaaggatattaagttatccatgaaatatataatattgattggaggtagactgtaaaccttcccacaaccattgaaacaaataaagttatttagcataccaatagataagaacaaatagaatttttaaaaagtaattgtatcaaaagaaggtgaaaaaggagggtaaaagaacaaatgagacaagtatgaaacaagtagcaggaagatagacttaattgcagcctaataagtaactgtactaaatgtgaaagtactacagatttgaactaaaagacaaaattgttagactggatgaaaaagcatggtacaactatctgctatctataaaaagtccattttaaatataaaggtggagatagtttaaaaggatgacaaaagatataccatgcaagcactaatcctaaagctggagtagctatattactataagaaaaattagactacagacagataataataccagagataaaacgtgacattttataataggattaatacatgaagtaaatatagtagtatatctgtgcatttaatagcagagctgcaaataacatgaaatataagcttacaggattgatgaggagtagctgtatcaagaaatacagttagatatttctgcatagtcctctcagtaattgatacaaaaaaataggaaattaacatgatgcttcatagttgaacagtactaccaatctttacctaatagaaatatttaaaatactacacacaaactatagaaaatacacattgtttttaagtacggataaaacattcatgaaactaatgtaagaatgagcaaaaaaggaaataagaaatcctaagtagatgaacgtaagaactcaaactagatgattctagttctagaaagttcctagcaagaactagaaaagtcatagcaagtttttctttataaattccaagctaaatcagtttttacaatgaatgtggataacttaagctaccctattttaacatacaagagtgtcagtttagatttcaaaaaaaagcaaaccgcagttcacctatatgccctttacaagagaccatttacaacaaagtggcatacaaagaaagaaagagttgcaatattaacaggcaaaattgaattcagggtgtaagtcaataaaaggtcaaagggaaatgttttatattgataaaagtcatgcttaagtaggtcttaggtaaaaatcctgaaagatataaaaaatcatttaaaaaaatcaaacattccattgcatcaagagaggaaacactatagccaaagcatacaaagaaaaatcttacttgaatttactacataaaccagttagagaagagtaccatgacactatgttggaatattgaaaatctacagcaaacataatacttaatgatgaaacattagaaaccttttcattacagttcaaaacaatatatgcatagttactgtcacatctgtttaccttggagcttctagccattgtaatgaattgagtcataaatattgaaaagaattaataaaacttattaattttaaatgtctgtaccaaaaacaaaaaaggcaagcaattaacaaactaatagaactaaaatagagttgttacttggccagattcaaaattaacatactaaaattagtacctcttctgtataccagaaatatctaattataacaatgaaaagtaaaagactttattataatagtcacaggattgtttcctagaaataaatttgataatatacgtggaaaattatataatgaaacttataaaaatttattgaaaattctaaaagatctgactaaataggcatactctgttcatagactgaaaaattcactagtgtaacaggttaatctgtaaataactccaactttaatcaaaattctcatggaatcatttcattaaatatgtatctaagaagtatatgagagaggactcatacttctgaacatctccataattagcactctggcccaaggtggcatcatctgtgcctggtttatcacattaacctctgaacttttccattttcacacttgccctctccaccaccatccacccaagccctgcagcctaaactgaacactcagagtgatcctttaatagattacttagttcaattctttcgatgaatttaaaagaggatattgtttagaaagactaagtaattgaatcaaggtcaaaaaatttgtaagaagtagagccatgatttgtatccaacatttctgattctagaccctattctcttcaacactagactatactgtattttattagctctttctgtgttgagattattttattatttttaaagaatgctcgtagacgtctggcatatatgatgatagatgacacttatctgaaatatgtagcttggcctcataaaaaatatgctttaatttcatttatagacacatagctgacctaggatgaaaaattgtcttgacccattgtgacatttcttatatttatatggtaatgaagaaaaatcaaaattttaactaatctgtttttcataaggatattatcgtcttttcttcttgggcttttaggcttaacgcctttttttctcctgtggcacatttgattgcactcttaactgcggtgctaaaataaaactcaattttagtgatcacagaatctgatgttgaaatagtctatttctggaaatgctgggtttatggtaatgatgaaagttgtatcatgttgttatggcaaccaaaatcctaaagtacagattaatgacaagctcactgatttttggaagtaagcagttcatttcttatctcagttcagttttaaataattatttagaatacagtaaatttctttgaacatattttaaaatgagaataatatctccatttagttacatatctagagattctcttcttcaaaggatcacagctcctcgccagcaatggaacaaagctggatagagaatgactttgacaagctgacagaagtaggcttcagaaagtcgataataacaaacttctctgagctaaaggaggatgttcgaacccattgcaaggaagctaaaaaccttgaaaaaagattagatgaatgtctaactagaattaacagtgtagagaagaccttaaatgacctgatggagctgaaaaccatggcacgagaactatgtgacgcatgcacaagcttcaatagtcgatttgatcaagtggaagaaagggtatcagtgattgaagatcaaattaatgaaatcaagaagagaagtttagagaaaaaagagtaaaaagaaacaaacaaagcctccaagaaatatgggactatgtgaaaagaccaaatctacgtttgattggtgtacctgaaagtgacagggagagtggaaccaagttggaaaacactcttcaggatgttatccaggagaacttccccaacctagcaaggcaggccaacattcaaattcaggaaatgcaaagaacaccaccaagatactcctcgagaaaagcaaccccaagacatataattgtcagattcaccaagattgaaatgaaggaaaaaatgttaagagcagccagagagaaaggtcgggttacccacaaagggaagcccatcagactaaccgcatatctgtcagcagaaactctacaagccagaagacagtggggtcaatattcaacattcttaaataaaagaattttcaacctagaatttcatatccagacaaactaagcttcataagtgaaggagaaataaaatcctttacagacaagcaaatgctgagagattttgttactaccaggcctgccttataagagctcctgaaggaagcactaaacatggaaaggaacagccggtaccagccactgcaaaaacatgccgaactgtaaagaccattgatgctgggaagaaacagcatcaactaacgggcaaaataaccagctaacatcataatgacaggatcagattcacacataacaatattaaccttaaatgtaaatgggctaaatgccccaattaaaagacacagactggcaaattggataaagagtcaagacacatcagtgtgctgtattcaggagacccatctcacatgcagagacacacataggctcaaaataaagggatggaggaagatctaccaagcaaatggaaaacaaaaaaaggcaggggttgcaatcctagtctctgatagaacagactttaaaccaacaaagatcaaaagagacaaagaaggccattacataatggtaaagggatcaattcaacaagaagagctaactatcctaaatatatatgcacccaatacaggagcacccagattcataaagcaagtccttagagacctacaaagaggcttagactcccacacaataataatgggagattttaacaccccactgtcaacattagacagatcaacgagacagaaagttaacaaggatatccaggacttgaactcacctctacagcaagcagacctaatagacatctacagaactctccaccccaaatcaacagaatatacattcttctcagcaccacatcgcacttattccaaaattgaccacatagttcgaagtaaagcactcctcagcaaatataaaagaacagaaatcacaacaaactgtctctcagaccacagtgcaatcaaactagaactcaggattaagaaactcactcaaaactgcacaactacatggaaactgaacaacctgctcctgaatgactactgggtacataacgaaatcaaggcagaaataaagatgttctctgaaactaatgagaacaaagacacaacataccagaatctctgggacacatttaaagcagtgtgtgagggaaatttatagcactaaatgcccaaaagagaaagcaggaaagatctaaaatcgacaccctaacatcacaattaaaagaactagagaagcaagagcaaacaaattgaaaagctagcagaaggcaagaaatgactaagatcagagcagaactgaaggacatagagacacaaaaaacccttaaaaaaatcaatgaatccaggagctggttttttgaaaggatcaacaaaattgatagacggctagcaagactaataaagaagaaaagagagaagaatcaaatagatgcaataaaaaatgataaagggaatatcaccactgataccacagacatacaaactaccatcagagaatactataaacacctctatgcaaataatctagaaaacctagaagaaatggataaattccttgacacatacaccctcccaagactaaaccaagaagaagttgaatctctgaatagaccaataacaggctctgaaattgaggcaataattaatagcctaccaaccaaaaaaaagtccaggaccagatggattcacaggtgaattctaccagaggtacaaagaggagctggtaccatccattctgaaacttccaatcaatagaaaaagagggaatcctccctaactcatgttatgaggccagcatcatcctgataccaaagcctggcagagacacaacaaaaaaagagaattttagaccaatatccctgatgaacatcgatgcaaaaatcctcaataaaatactggcaaactgaatccagcagcacatcaaaaaacttacccaccaagatcaaattggcttcatccctgggatgcaaggctggtttaacctatgcaaatcaataaacataacctatcatataaacagaaccagtgacaaaaaccacatgattatctcaataaacgcagaaagggccttcgacaaaattccacagcccttcatgctaaaaactctcaataaactaggtattgatggaatgtgtcttaaaataataagagctatttatgacaaacccacagccaatatcatactgaacaggcaaaaactggaagcattccctttgaaaactggcacaagacagggatgccctctctcaccactcctattcaacatagtgttggaagttctggccagggcaatcaggcaagagagagaaataaaggatatttaattaggaaaagaggaagtcaaatcatccctgtttgcagatgacatgattgcatatttagaaaaccccattttcccagcccaaaatctccttacgctgacaagcaacttcagcaaagtctcaggatacaaaatcaatgtgcaaaaatcacaagcattcctatacaccaataacagacaaacagagagccaaatcatgagtgaactcccattcacaattgctacaaagagaataaaataacctaggaatccaacttacaagggatgtgaaggacctcttcaaggagaactacaaaccactgctcaacaaaataaaagaggacacaaacaaatggaagaacatttcatgctcatagatgggaagaatcagtattgtgaaaatggccatactacccaagataatttggagattcaatgccatccccatcaaggtaccaatgactttcgaattggaaaaaaaactactttaaagttcatatggaaccaaaaaagagcccacattgccaagacaatcctaagccaaaagaacaaagctggaggcatcacgctacctgacttcaaactatactacaaggctacagtaaccaaaacatcatggtactggtatcaaaacagagatatagaccaatggaacagaacagaggcctcagaaataacaccacacatctacaaccatctgatctttgacaaacctgacaaggggtaaggattccctatttaataaatggtactgggaaaactggctagccaaatgtagaaagctgaacctggatcccttccttacaccttatacaaaaattatttcaagatggattaaagacttaaacgttagacctaaaaccataaaaaccctagaagaaaacttagccaataccattcagggcataggcatgggcaaggacttcatgacgaaaacaccaaaagcaatggcaacaaaagccaaagtaggaaaataggatctaattaaactaaagagcttctgcacagcaaaagaaactaccatcagagtgaacaggcaacctacagaatgggaaaaaatgtttgcaatctacccatctgacaaagggctaatatccagaatctacaaagaacttaaacaaatttacaagaaaaaaaaccatcaaaaagtgggcaaaggatatgaacagatacttctcaaaagaagacatttatgcagccaacagacacatgaaaaaatgctcatcatcactcactggtcatcagagaaatgcaaatcaaaaccacaatgagataccatctcacgccagttagaatagtgatcattaaaaagtcaggaaacaacggatgctggagaggatgtggagaaataggaatgctttttcactgttggtgggagtgtaaactagttcaaccattgtggaagacagtgtggcaaatcctcaaggatctagaactagttttttgacccggtgaatccattactgggtatatacccaaaggattataaatcatgctactataaagacacatgcacacgtatgtttattgaggcactattcacaatagcaaagacttggaaccaacccaaatgtccatcaatgatagactggattaagaaaatgtggcacatatacaccatagaatactatgcagccataaaaaaggatgagttcatgtcctttgtagggacatggatactgctggaaaccatcattctaagcacactgtcccaaggacagaaaaccaaacaccacgtgttctcactcataggtgggaactgaacaatgagaacacttgaacacagggcggggaacatcacaccctggggcctgtcatggggtggggagtaggggagggatagcattaggagaaatacctaatgtaaatgatgagtaaatggggtgcagcaaaccaacatggcacgtgtatacctatgtaacgaactggcatgttgtgcacatgtaccctagaacttaaagtatcattaaaaaaaaaaaaagttacttccccctttcaactggtctttttgcatatcttttggtgttgtgaaaagcaagaggacagaaacagtcctgaaagtacttcccgtcagctatggactaggctgtgattgatcaaaatagtaagtaagtaaaatcaagtgcatgcccatgctagaaccagtgttcagcatgcactgctaacaacaacaacaaaaaaattcactgttttcactgcctgtacatagggtgtttagttgataaggacattcccaactttcagaagcatatgactgaactgagatgatttgttggtcattttggatttagtcatagaatccttgaaacttttacattttggacattgattatttgttactataatgattcattattgtttgagactgtgtatttcatatgtgatattagtaattagtgaataatttgggctaagaccaggcagacaatatagacagatagatcagttgattgatagacagatacttaatatactttttaagataaaggatgaatttacatagtaattattactgtaaataaaaatatagtaaactggcaagagaataaaatggttttaacactatagaaacattcatttatatacaaataactgatacgcttttataaatcatattttgggaaacttagttccctaaaataatgtatgtgtatgtatatgtgatgtatttattcatgtaggtagtttttttaaaacaataactcattaaaatactcttaactctcagtggaataatatagcttaaaagcttaaagtaccttataaagattaaccagttcaatatttggtttatagtggagaaagcagtcttggagaggttaaattacttgttcaaggcaacaataagtggcagagcttcaactagaatgtaagccttctaacagtaatttactcgtctataccattttatctgtactgtaccatatagaactgattagaaaatacttaataaaagtgagtgtaggaacctgttgctttggtagtgataaatgaactcatatttgttcagaaatgtggaatcacactgtcagccagagttcttggtctttataatttaagtttgactcagactcgcttcagagaatctcccttttcattttatttctatcctgttggctttagcaggcagttagcaggccaggaggagcagttccttattctttgctttttttccttcctccttcattcatgtaatacatgaagatttctttttatccagcggctttgctttcttcatcttctccaccatatgcatattctttttttaaccccttccatatctcagtggctttttaagctgaggcggagattgaagacatactataccatctaacaccaaaatttaaaatgaattttaaacactcgtttagttttaactggcttgattttatttaattatctgtgtttatgtggtactgctttattttatctattgcagacttacagtggattttcagctgtattgttagttacagacattcgtgagctaatttatatagcttagaaacaaatgtgtcaagttacaactaaatttcagtaaattttaaattttttatcactgttacttgaaaatgaaatttaaatttcactactttagaagtttcaacaatactacatttacaagttaaatactacatttacaagttactctgaacttttaaaaatcatattcaatatttataattgtacattattcttattttatactttttatgagaaggaatagccttatttttgtgtactccttatatacgatcaaatatatgctgtattgagattgagtatagacttgagtatgaggcatgagtaatgaatgctttacacacttctcagaaatctatgttattgcgcttagaaaagaactaagaacactgtttctaaaatccagtatctgacttgttgcaaaagtggatatcaaatgtatgttatatctaacaaagttttaaaatactagtttctagtagtttttaatgaaaaataatttttgcattattttgttacattcattgtcaagcaaatttaattacaggaaagaccactaatcaatagatcaaaaaatatctccaggctgggcacagtggctcatgcctgtaatcccagcactttgggaggccacagtgggcggatcacctgaggtcaggattttgagaccagccttgccaacatgatgaaaccccgtctctactaaaaatacaaaaattaggcaggcatggtggtgcatgcctgtaatcccagctactcgggaggctgaggcaggagaatcacttgaaccgggaaggcagaggttgcagtgagccaagatcatgccactgcactccagcctgggtgacaaagaagtgagactgtctcgaaaaagaaaaaaaaaaaatccccaagcctcatttagttaagcagttttctaaaccagtttctaccatcatcccttccctttcagcagaaaggtagtacaaccagtagcaccagtctactctgctcagaaaatttactcagcatgtctttcttctactcactgtcattttggaagctttagcaatttttggaaaatgtcaagttactccaactcgtcaagagtttggaccccattagaacagtgtacagatgttccaagatcttaagtggacttctttccttattccatccaactattttcttttctagaccacagatgcatatatttccacagatagtcttaaaaatgtattattctatccattattatcaaaaaagaacataattcctagaaaaacaaagaatgtgttctgttgatgatgacttcatgacattgacctgtgtgacaacttaacacaatattactattactgctataactattacgttaatctagctagtcacagtcatgtactcttgactatgtgaagaaacagttttcctgaaatagccactgattcagcatttatggaaaacagtggtggctcaagagcccagaataggactctgtaaataaggaaaaagttctttttctccatcaagcattcagtgaacatgtatttattgagcatccatcatattcaaaatatactgggttttaagggacatgtgaacataaacagtgtcaagttagttgaaattttgtaggacaggtaagacatgaacaacatgtatttctgtaattctaaacaattttttaagtacattttggaaattgggttatattgcagtcatatccatttgatgcagaactaaccccttcctaatacaaagctgttgggatctgaacatcaagaaaatgtagaagctttattgtaagttaggagtggtaaaagctatatgaaaggaacagaaaaagtgccatggacattccacaaaggaagtaattatttctagctctaaagatcagacaagacttcatggataagagagaacatttttgttgaacattaagagcatttacaagtggtgaaagaggcactctaggaaaatgaagtaggagcaaaggaactgagatcagcaaaccagagcccagagaacagtcaagggttgcactggaattagaatagtgatagggaaagtgttagataatttttgaatggtagaaggaatttgggcttctctgaaaccaaaagaggctactgaagctctttgaaagccccaggtaagagagagatgtgatagaaagtatgcctcagcaagattgatctaacaacagtgcctaggatggattgaatattgaagagactgaaagagggaagaatagataggagtttgtgtgtactccaggcaagaggtcattttagaacctgagctgaagtgatacaacattgttatgccattaacagaagtaggaaactacaagaaaaggaggtgtggaagcaaagctttaaacacacatttttattttagtttttgtaaaaatcagaaaattagtaccagtgttctcatggccagtaccatgagtaccatgagaaccatgagtaccgttagtaccatcttctcatggtgatacatgaatagtatgagtagctagggatgacaggaagttaatgtcatggaactatgcagagagttgttgcacatttaatgaaccaatactgttttttctagctggataattttgtaaacatttgcaggactcattctttatgtgcttttgtagaaatgtatatttgtgagaaagctgtgatttgctgcaggcaagtgtcacattttagcttggggtgatatagagagatgaagagaaagctaggagatgtggttgttagtgtaaaagctgtaaggtgaaagagcagtttactttaagttttcctgagagataaaagtgttgataaattgaaacaattgtaagcatctttctttaatgtgttaccacttttgcaaaatcaatacattgacattgggtcacagtttttgtttcttatttagcagtcctgtatatcaggcacaaatatatagcagtccaatatatatcaggaacaaaacacagtccatgccctctgcaacctatatagtaatggagaaagatttaataaataatgaatacaaaattatattttatcccaaaattaggattaactgtgtagccatatagtgattattaaatagtgtatgtgtgatgataatgaaaatgaaatgtgttgattgaagtgtcaagctgtcttacaattcttagtaaatatatttttttcaaatgatgtgtttacattttgtttgcttatcaatagagagcagatcgtaaaacaatctacagaattagtctgcagagcctatggtgaagtgtatgcagccgtgatgaatccaatcaatgaatacaaagatccagagaacattcttcaccgatcgccgcagcaagtgcagacgcttctttcctgattatcttatttcattgtgttagcaaaatatgacctccctaaaacactgaaggttattttttattctttgaatttttactctataatttgatagttacagttttctttgtatcataagattgtaagtcccgataatttttttttttttggtctcagtaacagggaagtaagtaacatgttgacctgagctagtattgctgtgtatctactctaaatgagatgatctatttttttgctagccatctctccagctctgcagttttcactgtattcaggaagcataaagtagtatgaaaggtttgaagaatttttttttacaagactagttctaaattaacagcttataaaaaatttgtctaaatttaataattagtataaggatatgacctaataaatgtctccttacctaaagattcatttgctttcttttaatatgagtaggcatacttagtagcttttctgaacctagcctatgtctctgtccccaaaatagctgcccttaaagagttgttagcagagagaaaaataacagtgaatgtgctcctggtgtatatggcagtgaatctcctttctgttctactttagcatactatatatatttgactgtgtacattcttatgcaattttaagtatacactcagcaataattagaaaaaaaggagagagaaaagtgatttaaacagggtggattccactctgtgggagccttcgatggaactcaaggtggagctcagcctttccaatgagctctaagcatgtagatagcctgagctgtgtctaagcctggtgtttaaagatgggtatttgtcatacaatatgggtcctaaatccaaccaactacacattttatctggtgttcaaaccaaagaaacaatgatctactcaaacattggagaaaaaaactgccagaggaggagttgccaattggcagtgtgtcttatctccatgttgtaactggactctgactttagaccattacctattaggaagattaaaaatgactgtatttttaaaggaataaatcccagtgtgcctgatttgacattcttgtcagcaaaaaaaaacttaatttctagtaaatctataaaaatgggtaagtccctaaattacaaatgagaaaattgaagcacaaggaaaaaaataactagtttgaaatattttgaaaagtaataacataaaactagtatttgtagaagattatgtgttgtatataacaaattagtatttatagaatatgacctatttatctgaagtttataattgtttatacctaatacagttctttttggagtaagaatgattatataatcgttatccatttgggtataaatctgtatttttagttttttccctttgattagtatgtgttacatataaagacagaaaataaagtataaatcaagagcttaaattgtatataatttatttctacagagaaagaagattgataccttgctatgagtgaattcctttgttttatagggaaaatttattgtgctttttacctggttttttcaaataaaatattaaaatatttctagagcagcaattattgcagctgtcctgtagatatatatcctattgatgtgtttttagaaaatgcactaatggaaaaggaaatacaacatagggcaaaactgaggtaatcagtgaaagactcacaggaaaaatgtggtatatatgatcttgagagctaaggcaaaataaaacattgtaagtaataatctattaatataacacctaaatttgctattactccatagtttgcattttgaactattttcatttggcataagtataacctggaaaaggcatgtctgcccttctttcagagaggaaaggtgtttgaatggcaaaacccttatgtggttgaacttttccatttctttctctgtgccttcatttgagcaggtggatattacctgaggaaaaagatgacacaaatggactaattggctttactcgaaattcatgattacagtgttcaaatgggcactgctgtagttggaatgtttatgtttccccaaattcatgttgaaatcctcacccctcaggggatggtattaggaggtgggtcctttgagaggtgattagattgtcaggatgaagtcctcattaatggaattagtacccttactcaagaggctcaagagatccctgtcccttctaccatgtgacgttacagtgagaagacagccatcagtgaggaagtgggccctcactagacaccaaatcttttggtgccttgattttgggcttcgagcctccagaactgggagaaataaatgtctgttgtttttataagccagctagtttatggtattttggtacagcagtctaaatgaactaagacagacattcaatattgctttgtaattctactcttaacttgccatgtttccagaggacttttacacccacattctcagttaatatccttcataattcaccaagaatagaaactattagattaatcttcctcattttcctattctcaaacatcacacccatctcctctccttccttgttttgtacttgagatgttatctctctttctatgacaggatattccctccattatgctctggctcgcatctctcatcttcttattagatccttctgtctctgggttatcccttcattttgcttcagcaacaactggcctctctgtaggattattctcaatgtcataaataatgttgtaatgttcatagtatttttaaaaactctctactcagatcctaacacttccatttctctgcttcctttcctggtttagacatgctgtcgtctacttccttatttctcattctgtctttaaagtatcccaatatagtttcagtctctcactactacaccgaaactaacctgataagcttttcatcagtgctatatgttgtcagatctagcagattcttctgtatctctatttgttgaactctcagtgtcattctacacatttctgtttgaaattctatcctttccagtcttccatggcaccactttctcctaattttcctcccatttcattaacccaacccccttttgaccttcttccctggctcttttgcctctatatgatttctaaaagttggcatactctagggcttgatcctggatacttttttgttttaatccttcctttagggatttgttacttcaaccttttctatccagaataatgttagcttaaatgtctttagatatatccatatgatggagtacagcagtgagaaaatgaatggttttcaagtacataatgttgagaaagaaatcagaataatataatactaattttatagaatgtggatacatgtaaaggtgtaaggaaaatataggaaatgattaatacaatttaagattatggagagggaaacacaggatgtgttgaagttactgataatgttttattcttatgctaggttgttagtactcttaaatattctttaaaatttttcatatatgttacataaacttctgttcatatattttacaattttaaaaaatagtttagaaatttgcttggcatagggcctgggctaaagttagaactcaatatatgagagctattttttttcattagtcttatcattaaacacatttcttaagtacctactaggtagtaggctttgtgataagcatttaaaaatataaccaaattatgtgtttcccgttgaggaattccctgtcttgcacaatgatagttacatgtattgtaaataaacatcatgaaatttggtagagtgcttgtgcatgttggcaagaagaaaaaatgaactaatatcatcctttataattcagccggatgtccttggtataagaggttgagagcacagaaaacaaagtttcaaaccacaactgtacattgttcagtctgagattatcataatgattgggttctattaactatttggttaagatgtaaaattatgtaatagtgtggtgagaggaaaaatggtggattaaggaacttaaaaattttgtcccttcataaaggtagcaataaaactggccttcaaaaaatgatcaaagtcaactttttcaggactcgagaaactaatcaaaagatcacagtaacctgagttacttaaaaaaagagaaaaaaaagccaaatgttagtaataacagcaagcattttggtgtttaacttatgccgtttccataccttgctccctagttcagcagtagtgttgaaaagaacacgccacattcatggtatgggaaagagcagaatggaccttatttgcagattatccttatttgatctgtctgatagctcccaggaaaacccatttaaaaaaccggcctttatcttgcctgttatggaactcaccctctactggggtgggggtggggaatttatttaaaacatttacctgtcattgctacatgaagcaatgggtaaaagttggagcaaacaataaactaaccagaaagctttggaagaaaggttgggaatgagatgttcataaggactttgaaaagctcttacgtatttctgggaatctagaaggctctgtgcatgtttaggactgtgtgcatgttcatgaatgaacagagagaccgtaatctctcacctctgcctgaccttgaggatctgagcaagcagggaatgaaggcagaagcaaagttagaagctgcctagctgagtgtccaagacatgtcccaacagacacacagagtccttcagcaaagactgagcaattttttggtttaggcattcaaggaactcttcatctaatcattagttgacaattaagctaatgaatcggacacataagtggttacacatgacaaagaatgtagattttacagaatgagttcatgaaagtcactaaaatataatcacagctataaaaggcagcaacaacaaacggggtggggcaagagaatctaatctgatttccaacagatagcccagatattgaacttattagacaaagattttaactattttaaatatgttcaaggatttaaggaaaccaagtctgaagaactaaagtatgagaagagtgtctcaccaaatacagaatataataaagagatacaattataaaaaggaagtttttaatacatttataattttaaaagtttaaagttacactttataaaaattatgaaaaacttatttggacatgagaattagtacacagaataaataatacactataggggataaaagcaattttgagcaggcaggagaaaaaactcagaaaacttgaaggtgggtcagttgagatgttccagtttgaggaaaaggaagaaaaaaaaatgaatgaaagaaaatagcctcagaggcctgtggagcaccgtcaacaatacacaaacaataggagtctcagagaaaaagagaaagagtctgaaagaatatttgaagaaatattgtcaggatactagaaatttggtgtaaaacattacacatccaagaagttcactgagctccaagtcggatgaactaaaaatatgtacactgggacacatcacaatcaaactgttataagccaaaggctaagagggaatcttgaaaacaccaagagagaggtaattcatcacgtacaagtgatcctccataagatgaatatcctaatttctcatcagaaactgtagaaaccaaaaggcattagctggtatattcaaagagctctgggcggggcggggggcggcagtggcgggggaacatatctgtatctggcaaaactgtgaaaacataggagaaattaagacattcccagatgaacaaaaactgagaattcattgttggccaacctgccctaagtgattgctcaacggagtacttggagctgaaatgaaaggacgctagacaaaaaaatcaccaaaagacttaaagaataacaaggaaatcgaacactcagtagctattctaaatcacctagatcccatagacatcagtggaacaatccacccaacaacaacagaatacacattcctctcaaatacacagggaacactctccaagatagaccatatgttaggccacaatacaagtctcaataaattttaaaagattgaaattatacaaagtatgttttcaaccacaatgacattgtaaattaataacaaaaggaaatttttaaaatatactaacatgtggaaattaaacaagatgctcttaacccagtggaacaaggaagaaatcacgaaggaaactagaaaatactctgagatgaaagtttgtaatgaaacaccataccaaatcttatgaaatgcagcaaaaatagttctgagagaaatttatagcctaccttaaagagaaagaaataaattaacctaatcaataaccttaagaaacataaaagaagagcaaactaaacctaatgcaagaaaaaaggaaataataaagattataacagagacaaagaaaatggagactagaaaaatgatatagaagattaataaaaccaaaagttaattctctgaaaggatagaaacattgactaatctttagctgactgaacaataaaaaaaaaaagactcaaattactaaagtatgaaacgggacattactgaacttacagaaataaggataacagaattctattaataattatatgcaaaccagtggaagtggacaaatgaaaaacacaaagtaccaaaatcaactcaagaagaaatataaaatctgaatagaactatggcaacaagatggagtcagtaatcaaaaaactcccaacaagaacaaagcccagtgaattgcttccctggtgaattcactggtggtttcacatccatgtataagtggacccacgcagttcaaacccgtattgctcaaggatcggctgtgtatccaaaataaactcttgcaattcaacaataaaaagacaaccgagggctggcacagtggctcatgcctgtaatcccagcactttgggaggccgaggcaggcagatcatgaagtcaagagatcgagaccatcctgtccaacatggtgaaaccccgtctctactaaaaatacaaaaattagctgggcgtggtggcggatgcctgtagtcccagctactcgggaggctgaggcaggagaatcacttgaacctgggaggtgaaggtttcggtgagtcgagattgtgccactgcacttcggcctggcgacagagcgagatgccttctcaaaaaaaaaaaaaaaaaaaaaaaatgacgagctggacgcggtggctcatgcctgtgatcccagcactaggtgagaagattgctggaggccaggaattcaagagcagcctgagaaacatagcaagaccccatctctgcaaaataataattttggggcatcaagttcttccttgaaaaacaaaacaaaagacaactaaattttaaagtgtgccaagtatttgaataggtaaagaagatgcacagatagctaaccctaaccctaacatgaaaaaatgatcagcatcattagtcattagggaaatgcaagtcagaatcacaatgagattctactttgcacatactaaggtggctataatgttagtaattttagaagctggtatgatgtggagaaattggaactcccatatgttgctggtggggatataaagtggtacagctgatgtggaaaacagtttaacaaacagttcctcaaaagagttatgatatgacctagcaattctatgcctaggcttttacccaagataattgaaaatttatgtctaccaagacttttacatgaatattcatggcagcacttataataactgaaaattagaaataactgaaatatccatcagctaatgaatggataaacaaaatgtggtatatccatacaatgaaatattattcatttataaaaaggaatggactactgaaacatgctacaacatggatgaatcttgaaaacattattctaattagaagccaagcacaaaaggctatatataatttgattctattttaatgaaatctccagaataggcaaatccacagagacatataagtagattagcagtttccaggggacagggagaggaactgatcgggaagagacagctaacaggtactttttggagtgatagaaatgtcctggaactacacagtgatgatgattgcacagcattgaatatactaaaagccactggattgtgctctttttaaaatggtaaattttatgttatatgaattttttcttaaagtaaattgcaaatataatggaattaaaacaggcctgttctcatgtcttaattgtgatcttttgtgtttttgtgatctgatggcctcttttgaaaaccaaaaattgaggaatattttccttgaacctggtgatagtactgatatataattgtccagtcttggaatatttaccagtttttttatacactatggactttaaaataaatatgtaagtaaaatgcagagtcatataataatattgaatacttgcaggtcagttaatctttcctaatttagttaaatatgctgtttagaataataaataggcctacatatggttactttggggctataattatattaagcacaattacctatcatcttgaatttgcatacttacttcacctctgagagaatgtgctttggaagatagataatataattatgtatttttgcaggtccaaatatgaaatttctataaactagctgagaaatgaatgtaatagtaataattagattaataacagcatattagtctatcaaatccaactacccttaatgccagtgaatgttaaaagtaaaactttcttagcactgacaatttaataagtaaaaataaatggtactaagcttacaaaaattagctgaattggggaaattgttgataaggccacaagtattaacatgttatacttgcttgctttgagggtatatagcatcttttggcaaagtgttacattattgtgaatttaacagtgaaagtttaagccagtctaggatttcaaagtttataactttactaccaggaaattaatttacttaaatatgttctttgtttccatcaatgtcaacatctgaaattccactggagaagtattagctttggcctactaaaagcaaaatgacaagaagcaagaatgcaagccagcatcaaaaattggtctcctgttttgagattgccccgagtctttctgggggtatcatttatataagtctaattttcgggattcaggcaagagctggccattgttgtgctagctgggcctccagtggaatgtaaaatgataatgaagattgaactgaggtagaaaaatgaatttaccttagaaaggacaccaaagatttgattagtattccacatagttgccatacgtatttaattgcagactaggaatttttcttgctttaaactattagattcttttacagacaaagatataagcaagccaagcattaaaaagccaaaaaggtgctgctaaaaaagaaaataaaccacaaaaacagaaagaacatctcaatgtaccctgcctttattctaaatcttacaaaaaagaaaataatttctccactgaactattaataggttaatataatgaatcatacaataacaaaccataatagaatttgcattaaccaaaaaatgtgcaaacacactactatgatttaccaaaagactctctgcaagtggtaaatcattagctctagtgttgctctttgtaacctcaggtctttggggaatggtgcagaattagtattgcttccttctttctgtgtgtgataatggtgggggaaggctagtaccatctctgtcatacatcaaattcccatatgtgaataaatttatgtatttttactgcactctttttataggtttattcattcctgcaccaacaacgaatgccattattataactttatagaaagtctcaatatatggcacagtgcttcattttctttttttcatctagagtgccttagccattcttggctttctgctgttccacaaatagcaatgtaaatttgtcagtataatagagaatccacttatatttcttcaacagctattgggaatatggttgggattacttcaactctatgtatcaatttgaggagaattgatatctttataagattaatccaaatcacagcatgtcaaaatttccttattagggtagttttaatgtccttcaaaaacactgtaattttcttcatatagatctaagaaaactttggtgtttattcctaagaaatttatagttcttgttttgtaaatgatatctattcttaagttacacttaaacttatttgttgctgtatatagaaatggaattgacttctatgtacagcagttgcaaactgatattcatatgcagaaagtgaaactagacccctaatggataaaagacttaaatgtaagacctgaaagtatgaaactactagaagaaaacatatgggaaacacttcagtaccctggcctgggtgaagattttatggagaaaacctcaaaagcataggcaacaaaagcaaaaatggacaaataggattatatcaaactaaaaagattcagcacagtaaaagaaataatcaatagagtgaagagacaaccttcagaagatatttgcaaactattcatctgacaagggattaatatttagaacatacaaggacctcaaacaactgagcaacaacaacaaaaatatccaattttaaaaatgggcgaaagagccaaataaacatctctgaaaaccagacgcaagtggccaacaggtatatgaaaaaaaaaaaaatgctgaacaccgctaatcatcagggaaatgcaaaccaataccacaatgagatattatctcattttggctattatcaaaaagagaaaaaataacaaatgttgacaagaatgcacagaaatgggaatgcatatgctgttgtaaattagtccagccactatggaaaacagtatagagattcctctaaaaactaaaaatagaactaccatatgatccagcaatctcactactgggtatatatctaaagggaattatggatatgttgaagagacattttatttttactccaatgtttattgcagcactattcacaatagccaagatatggaatcaacttgtgtcctttaacagatgagtagataaagaaaatgtggcatatatacgcagtggaatactatttagccataaaaaataacaaaattatctcatttgtgccaacatggataacttggaggacattgtatatttagtgaaataagccaggcacagaaatataaatactgcatgttctcactcaggtgaaagataaaaacattgatctcatagaagtagaaagtagaataattgatactagaggcagggacatgtaaggagatgggagtggggatagtcagaggttggttaatggatacaaaagtacagctaaatagtagaaataagttctagtgttctatagcactgtagggtgactgtaattaacaacaatctattgtatattttcaagtagctagaagattttgaatgtgtcttacagaaatgataaacatttgaggtgatggacatgctgattaccctgttagatcattacacatggatacatgtatcaaaatatcacactgtaccccataaataagtacaattaaaaaataagtggaattgattttatatgttgattataatagatcgaggcaccttcataatattattttccgtgatttttctttgagttttctctatatagatctatttgagacaaaataagagttttttttttttttttctttgaagcctatgtaccctttatttctttttcttttcttttatgctggctagaacctccagcagaatgttaactaatagcaatgataatggttacttttcttaattcagatttcagtatctcaccataaagaattatacttgctctaagttttcagcagataatctttatcagagaggaagttattttgtattctcacatgctgttattaattatgaatggacgttgaattttaagtgactttcagaatctattgagatgatcacttggcttttctcctttatttgttaatgtgatgaattatatttataattttcctggcattaaatcactcttgcattcccaaaataagcctaagttgatcatattattttccctttctgtataaatcactggatttagttttgtatgtttttgtatatttagtagcaaccttgctaaatttacttattaattgtaagcgttatttgtgtattattttgtattttctaaattggcaagcacacaatctatataattagtgacagttttctttctacctttttatcgtttcttgctatgtggcactacataatgtttaaccatttacagtgttacaaagttgaatagaaatggtaattgcggtcacccttgtctttttccaaaatgtggggaaggagaggaagctttcaattgttagataggtattttgtagataagctttatcaaattaagaaagttcctttctgttcctggtgtgtcatgattattttaaataacaaataagtattgaattttatcaattttttttctgtatctatttagagatcaatacagaaaaataatagagaatccacctatatttcttcaacaactgttgggaatgtggttgggattactttgactctaagtatcaatttggggagaattgatatctgtgcctccccccttttacttacttaatatggagaatttcaaacatcagccttgcatttctgaaataaacccagtggtcataatgtactatcctttttatatatctttttattttatatgataacacttcatttaggatttttacatctttgttcatgagaaagattgccctgtaattttcctttgtttaaaggtctttgtcaggttttgataacaggataatactggcctcataaaacaaattggtacatattctctctgttatctggaagaatgtaagattgttattacttctttcttaaatgtttagaagagtttcaagtagagccaactaaacctggagatgcctttgtgggaaggtttttaattaaaaatcccattttctaaatagacgtaaaactgtttggttgttctatttcttcttgtgtcagttttggtaaattttattttgcaaggtatatgtccatttcatctaaccgtttttgtcataatgttctatcattttagttttttaaggtctgtagacctaatattggtaatttgtgttttctttctttctttttttccttggttagtcttggaagaattatgaattttatttatcctttcaaagaacctatgttttacttggttgattttttttttattgtatatttgttttctatttcatttatttttgctctatatttttccttccttttactttcttggtattttattttctcctctttttcttttcttgaaatggaagcttatattattgattttcagacctttttctgttgtaatgtattcatttaaatatatttaatgtgttcatctgtgtttccatctaagcacaggtttagctatatccataagcttttatatgtcatattttcattaccttttacttcagaagtatttgctaatttccattgtgatttattgtttgactcatagattacttagaaatatattttcaaacatatgaatgttttctggttatttttatattactgatttcaagcttaattccgctataaccagaaaatgtattcctagtatcatccttttgatatttattcatacgtactttatggtccaacatatgatttgttttagtaaattgttctttctagatttagaaatgttttctgtagtattgggtgcagtgctctgcatatggtaaaaggataaattttgttaatcttgtttaaatcatctatagcctttctgatttttaatctgcatagtgtatcagctactgagagatacttgttaaataactatgattgtggatttttctgtatttttagttttgtcagtttttgctttatatgtttttacgctatttctagatatataaattctatctattatgatttcttctttgaactatgtgttacttagaagtatgttatttgcatttttgctattaaagtttttagcaaggaaataaggcaatcaaatttgttccttaaaaaagagtcgctaagagacttccttctgccatgccctctgatatctctctctttctgtctcctattccacagtttataaaaattaactgtagacttaccaattaagccaatcacggatatatgaattactggcagttccatttgctttgatcccatggtaaattaagcaaatcctcacagcatattgaggccctattcatattgttcacttatccttctctcccagaccctggattgggtgagtgggattctgttggttctagctgatttttgaatactagcatatgactttaatctctgaaagatctagatatctcatatactagaaataatcttatttcactcactgaaatgaccttaatcccaaaatgtgttatggtactcaatcacattaacaagtttaagcaagtatgtcagattgatttccagcttttggtgttttaagataaaatgtgaatcctttttttaactgtatgttgcaactttccttctaggtggtttcttgaacaaaataaagcagttttcttactgggtagacatcctgctttaaaaattattcataatctggagcctaaacttaatgtaaaactctgagtttggtttatatccaatagcctaaggtttcatagaattttggtggtcggcaaaggaattactggaataaaaatatcacagcttctgtgctgtgtgcagatacttactgagtgtaatgaaggaattactctctaaccgagcacatattctgagcaattaggccaagtgccaaaaccattaaggctcaaatgccaagtgcctgtagggagggttctgttacaggatttagcaacccaacccttggctcacttaccagagggtggcactccaggcttcctgataactgtgccagcctggctgagactcagcagctgccatccagccacttctggcttctggaccctctccccagtactgcctctgtctccacccttctcgcccatctgcccctccatctgcctgtcagttgagcagtggctacacagttggggacaccttacatgttgagtcatgactcccagctaacacattgcattcaccttccctgttcctccaccacctaccaatacttctcccacttggcaacttgaaaggaaagggttgccaatttctgtttcataacatttcaggggcttccattcagaggcttctggagtatcctggcactcaaggaaactgggcatggaggtggagtagggagagccactcagaggattctgggcatccagtcacccctggcccattcccaaaaaaacctgggggaacaagagtagcctttgtaactccaaatttcatcaagatgagctgaaatctggttctgtcatttccccatcctaccccatcccatactccctcctaaccccatcccatactccctcctaaccccatcccaaaaccagagcagtggaatatcttaacaatttgacttttatccagaactgaggctctttatttgttagaactaagcatttggtccaagattttctaattctttctgtgggaacttgaatcagcaccccctccccaagctcccacagaagaagcagatggggatcttggcaaggtttggaagtccaggacttggacaggttgagagttctatttgccaggctgaattgcttgtaattaaaaagcttatcctcctacttttttgcgcttctgaacttatctgaagaatcaacagagtatttaatcatgcatagaaacaaatctgtgcatataagtgaaaatctgcatttaaaggcaggtgcttaccaggagagatgagtcacgtaagctggttagggtgaagttaagctctctaatgttgacttgacatgtcttgttttaaagggtgatagggtatgatcagtgttttgtgtacaggttagggctggggtatggaactctacccccttccttctctatttgtttccttcatctccttgcctaaaaagtgcctacaataagcactctgcatattttgggtcttcttagtgacacttactgacaccagattgttaacgtttatctgctttctacaacagaaaagaaaataactcattagtcttgacattttaatgtgtgagggttttgagacaaaaaataatttggctccttccggactaagttgtgctaattgccagattgtactcatgttaggaaattgagaacaaagtgaagcatgaccacttgaggctcttgggataatgagagttttaggttattgtcagaaattacggatttttttcttgaaaatattttaaaggaggtgagtaggtgacatttttcccccttcaggagttcttactgggggcattgatgattttcggagtggaagtggaggtggcaatggcaggaaacattgtagtttatgtaccacatgttagcaaagaagggcgttctctctgtgtgtgttagtggtgggagcatttactaaatctaaccaaagcctgattgtgtacagactttcagggaaggagcagaagatgttacttttatgggctcccttacagggtgataaagacttgtgcggctgcttggaagtatttcacccctgcagtcatgttcctttcactcaggccaacagcctcaactccagctctgaatctgccacgaaggcaactagacatgaaaagtcccaattttacagcttgctctggtagccatgccaaggtgagctagagacagcaaagggatagaaaagcattgctaaactggagctttgattttaaaaatggagacctgctggcaaaagatgagacttggttacatttagtcagtcccaactctgagctgtcattgcacaagagcagccacaagccgggggtttccacatgctgtccattaggaaccagggtctcttctatctaggtggcactgccaggcactctcagatcttacctgctcacattcatttatgtaacttctctttcttgcagtttaacacacatgtctgtctatctctttcacactcacacacaatgagatttagtaacccattttaatgaggcaattatattttaactctattatgtgcaattatgcactcttttaaattgcctcagctggagtgccctggtgttggtatctcactggcacttacttgctggtccctggggaccagctgggcagctgaacccggaacactgccactcctcctggcccctactgccactccacaggtggcttagcactgccacagggcgggacaattgcaatttcctggcccacccagtggagctcttgattgctgtgtgggtggcctagatctttctcatctgctttgctgtaccagcaggattgtttatccagggctcagagccccaggtagtcctctagcttggaggggccagaaaaacaaacctggataatcatagccatgcccttaatctgatgttttttctttttagtcatctaggctctaggttcctgggggtgggagtcagaagcagagactcctaatacactcatcttcatactacctttgcagtcaaggctcagtggtaacttttcataagaaagttgtaattacgtgatatctgcttcatttaaaataatatatgatactattatatatcataatatatataatatgcaggcacctatagacttcactactcaactcaataactggaatgtttcaaatactcttgcatctgcctgtgcatatgtatcccaccccccgcctaccatcagagggaagcatttgcttgaattttgccctgacctttcacttgatttttttaaggttttatcacatatgtatgtatccctattcattattttttagttttgcatattaaggtaaaattattctgtaggtagccttctgtaatgttttttccccacttaacataatgttaagattcatctctgcacctctgtggagttgtagttcatttatcttcattgctgtataatccactgtgacaagttagtcaccctcctgtcaacagaatgtctggagcttttctaaagtcttttgtttctttagcattgtgaacaatgcttccataacactcctatgtacacatactagtgttatgcatgagaatttccctaccttggagtgaaattcctaggttacagaatatgagaatgttcaagattataagagagtgccaaattgtttttcagagtggttgaaccaacttatactttctccagccaggcagttgcaatattccagattaccatgttctgtgtcccatgtgatattaagagtacatttagaaatgaattccagctgttggccgtgggacctgggaaagattacttgctctctctaagcctgttttctcatctgcaaagtaggaattataaattgcattaaggtataggtttattgtgagaactaaaataatctgtgcaaagccaggtaatctagtacagagctagatacacaatagtgtccaacaattattagaaattattattttatgttaaaactgaagagtagagggaaatagtcgaatacagtactgctatagtctgaaagtttctgtctcccctgaaattcatatgttgaaacctaacccccaaggtaatggtattaagagagcggggccttcggttggtgattaggtcatgtggctggatccctcatgaaagggttttgtgcccttataaaataggcatgagagagcttgtttgcctcttccaccacgtggaaggtcccatctttgaagcagagaacaagccctcaccagactctgaatctgctgatgcctttgatcttggacttcccagctcctagaactgtgagcaatacatttctgtttataaattacccagtcgaaggtattttgttaagcagcccgaactaactaaaacaagtagctaacatctagcagtcatgctgttgaactctttaccttatagtaccacacacaatttaaatctgtcctgcaaagaaaattagaaatcaatatcgggaagtgaaaatattctccagttcatatcacaagtggtaggcagtttggtaatttatctaattaacacccacgactactgctattgtcttacacatattagttaggttttctttttgggctgcagtggaatgccactgacctcagcactccagaagacaacacatgccacacaaagactccctcacattgacggaggtgtccttagagacagctaacagggatgctaagagcagccaacatttccacagggctttcacaaagcgcattcatgtatggcctctcattagcctcctcactgaggtcctcaaagttacatgttatttctcattcaatttttacagataaagcagcaacagtaagagacaattaagtgatttgtcttatatgacagaagcttgactgaagcccaggtcttctgtcactggatccagtatttttttccactgcctcaccctgccccctgtattatgctccatagtacgtgtttatcgtgtttattcatttttcctttcagtgctatttaatttaatccatttgattaaaaagagaaagaaatccatttgtgtctccagaggtggctatagccattagtcagaatactgaacaaagttcactgtcaaatttgcttaaagaggaatggtgcaagaattaattgtgaaaggcttatttgaaatgaaaaaggcctaagatcacgggctttcatttctcccaatcaagttttaattactgaaaagtttagtaacagctgaagcgtgtagttaccgcactctttattgccaagaggttttttcaaaaggacttccaccgcctcattgccttctcttcttgtttctacaagacctcacttgataacattaattgtctttttagttcactttcattaaagaaaatcctacattctctggggctcaagcattagctgctcctcattagctgctcctcatgtcatgtaagtagctgcagatcaggtccatgcagacacgtgtggcactgctgagcactgccaccccctcccacatcagcaggaagaaagcctgccactgcttagggtcattccatacaaggttgatgggcagggccaccaattcccaacaacttaaggcctgtcctctgcgtatcactcagcaggtaacagatccaaccatctttctggcttgtttcccgcaggtactgaaaggcatttgctgtgtttaagtcatcctgtaagatttccaagcacttcttcgtccatcgtctccacactggacaagaatagccaggtgtgtgtcccagagacacctggagggagttatagtgaggggtaactggtggctcacccgctgcccagcgctccccagggagacccggccctgctgctcagtcctgccacttggtcttcacagtaagctttgtgactgggccctggagtcagagtcaaggaagtgcattggcacagaaggatggtcctctgcaggaggacagtcttggttccatctctcatttgggctgctgccttggcaaagtacatttaactccactggccttttcttacttgcctgaggaagataatacaaatatatagtctacccacctcaccaaattgttttgagcatccctgaaagtaatgacttgaaagcttaattgtataaagtaactgaaaagcacatatgatcttatggttattaaaaatgaccacgggcccttctcatctcatccccctgcctgattcactttttcatttatccattcaacacctttttctaatgcttgccaggttcctggcgctatacttggtgctggggggaaaagcactgaacaagatacataccttccaagggtgcaaggtaggggtgagaaggctgaagcctggcacagagtagaaataaaactaccgctgtctcattcaaaaacttcctcccaaattaagtacaaaggcctcagcctcctttccaggtcttccccagcaaggccctgtcctgctggtccagttctggtgctggtcctcacagcaagcttggtgtgattagaacccagagcatgtatcggaagatatgtgttctctgaacacatcttgtgtttcatctctgctcacattgtttcctgaaatgtcttcccttgctccagttttgcttaacctcttacagtagttgtcaaacttttcctgatttcctctcctgacccactgatgactctcctacctctgagcctccagaatatattgtacctgcttcacatcataattctttgcatattttattcaataaacatctcttgagtcctatcgtgtgtcaggcatttggctcagcactaagcattctattttaagccaaacagacatgattcctgccctcagggagcttgtagtctttatttcttcagctctccattgtttgagggttgagggctggatctttctcatctttgtgttctttataggacaccagcctctgaacatcagttgaactggtcttttaaagttagaggagctgtcaataaacacctgacataggctttcctaaagttccctggcaccatggagtcacatcacgtatcatctgtttcctggcctaggggctcttctcagactcactgtgctggcctgagaactcagttcttgacctcttaaggatggtccaggtagccaagtacttgattttccttatggtctttttaggaaacagacatccttcttccaattaccttgggctctcctgcccccattgaggaactgaaggcttttacagagcctccaaatgttccagccagaggctctagttgcaaagcagttgctagctggtgaagacctgccctcctgccactgtctctggggactatcttctttcggaacatttgccattttggatcaccaatttggggccaggagctttgtatattttatgtctcctcctaacatcaaactgacaaggtagacctgggtctctgtttattagtcgagaatcggaagggctttagagatggagggacttgccccagtggcacagcaagatcaaagccatttctatccacccccactcctcttacctctccaccttccctccatcctaatgccaggaagggaaaaatagcctgtctgtcttcaaggcagccagagggaggagatgacttccaagggtgcaggtcatttgggatatttacaaacacttatttcttaggaagaggcttaggcctaaatggaagccacaataggcactttccaaatcaacttccttggtagtgtgaggggaaagatctttacatgatcttaagcactggagattgtctatttctgagactcctgacaaagagaaagataatttatgccatttttacatttttccactaacagccaaacaggcagggacaccataattctcaattattagaagctgcgtatgttttacctctgcttcaattagaacaagaggaaaacaaaagccctgaactgaagagtgaatgattttagattggcggcacccatttaataaaagagctgggccactatcacttaggagttactctatttagagagaataatcactggaatgtagaaactctgttccagcctgactccaatcaggattcttttaaagctagtagttttgaggaaataggttaattattttttattacttaagttctatccacctcacaatcagctacttattgcttaaaagtcaatgcattccttagaataagaaatgctttggatagcacatgtaaaacctatcatggtgtactctaattggtccagatggaaatggaaattacaaacctattgacatttttgcttttttttttttttacccaatcatgtctaaatactgaccaaaataaacctagaaattaatcatacaagggaatgtgaaggttggcagacgtttggttagaaatccataggagtatgtggtgtgggctgactgtacaggcttcgaaactgccccacagtcacagatcaggatggtcaaattgcaggaaatgaccggctgactgcttccctgactatgtttaaagggcaaatgagagcatgctatttataggatgctcatcaataagctccaagttcatagctgccgaaggaaaccttagtcttgactttcaaagtcttccacattattctttcccaaaccacatatcattttaaaactttatgaaggtaatacacattttgaagtcttctttttgccagtgaaaaatcatttttcccctaaatgttaggccagttgtttctggtatttacagaagaatataagatatttattaaacattgttttaaaaaacaaatatgagaactatatttagtatttgttacaactgatgctcaaaaactctttggtggtgttggatatttaaaaatttcttttcacttctgtggacttttatgctggttcttttgtaagtctttttgtttataatttacttttatcagtggtttggagcagaattttaaatatttttacatctaggaagttcacaaagttggaaaaaaatttcttttttctttttttttttgagacagagtctcgctctgtcacgcaggctggagtgcagtggtgccatctcagctcactgcaacctccacctcccgggttcaagcgattcttctgcctcagcctcccgagtagctaggattacaggtgcatgccaccatgcccaggtaatttttgtatttttagtagagacagggtttcaccatattggccaggcaggtctcaaaatcctgacctcatgatctgcccacctcatccttccaaagtgctgggattacaggtgtgagccaccgcgcctggctggaaaaaaatttcaaagtttatattttcacaccattgcaaaatcagtgtgattgtattcagataattccgagagattgcaaatttattattaatagttacattaaaagaggctataaaaatgcaaagctacaaaaatgacaatgaaatatcaacactcaggcaggggaatgggcatttccattgctcattgctctcccagccttggaggaagttctgcttttgctgggaggccgtcaggcatcatgggtgggtgtgtctgctcgggagccaggcctggcctggaggttccatttcgtttgtcatctgttacctaaggtaagttactctgggaaagtaacataacctagtttgtctcagtttcctcattggtcagatgaggctaatgatgttgtgactcaaataagttaagacaggtaaaaagtgtagaacagtggagggcacaaaatcagcattcactggatgttagctcttcttattttcattatagttatgtttctaggattagatttgagaaaaagaaaaagtatacaacagctcagttttctccacacactctacccacttggtataatgggaaaagttctagatgaagaacgaggacatctgggatccagtcctgactttgactttcactagcctttgaccttactatacatcctgggttttggtttcctcatcactaaaactgaggggggttgtacagaaggctccctgctcccattcacccctcacatcctgtgaccttgcttgagtggctcacaaagccctaataatgtagttctttttcatgtagttttacattttaatacaataccgaaacaaattaaagcatctggaatccagctacagtaaaagctggaaatatcctaaaataatctttcagagatacatctgaaattttttttttttttttgagacggagttttgctcttgttgcctaggctggagtgcaatggtgcgatctcggctcactgcgacctctgcctcccaggttcaagtgattctcctacctcagcctcccaagtagctgggattacaggcatgtgccaccacgcctggctaatttcatatttttaatagagatggggtttctccatgttggtcagtctggtctcgaactccccacctcaggtgatccacccgccttggtctcccaaagtgctgggattacagctgtgagccactgcacccggtcgaaagttttgttttaggcaaacttctgatcagcaaaaagctggaaaaacgtaactatattttaaaagataaagaaaacaactacaaaagaatagtagtatcagcactttccttccagtgtttggctttgtttctaggaactctgaggtgaaaaaaaagaggcagaggagggaggaggagtaggcagaaggggagcaagaggatacaacttgtgtgctatgtgtggttgttattttaaggaagtttattctgaccaattttatccaaagaataaatcaacaaacacccagaagcaatctgccctaagttttttatttccaatatagacctaatcagaataatcaggttttgtcaaaaaagtttccagtaaaatagctgtctctgtcttctccattgttattgttagatattagcccttctgatcttgcacagtccccttgcctggtaacgttaactaagtaaatattaatactgtacacttttcctttggaaaatgaaggagaacaaatgggaaaagatgtaacaaatgttctgcagccctgttataaatattttatgaatgaatcagagaaattgaagatgaaaaaagcccactaattcagccagtaccctgatgtctactgctgtattctttcaagcggtttgtctggtctggtctttagtgactcaggttatagggaatttaccacttctgtcgaagctgcttttgtagtggggactatctagctgctaggaaagtttgtcaaattccccttgcttttgtttagttttctcattagtctcatttgattttgtttatttaattgcttatttttagtgtctttagattcttaattgatttctacgtgtcttttctattgctttcttttttgttcattcagcttttctctctttagttgttaccaggaagaaaccaaaacagctttttggcttgtagataggtgagaagtaacaattggttccatcaccaaattaacaacaacacttgctacatcaagtgttaggctaactactttgcatacattatctaatttattaagcaccttctttttgccagacactgagaaggcaaggttaaatatgaccctgccactgttggcagggccttataatgtagtaggggagataagcattcaaatagatagtgtcaacacagcatattcagtgtgtggggctattttcagagtcatcctggagcacagaggggggtgtccactccagcagtgaagagcaaggaacgagggcagaggtcaggtggcatgggagagagataccccaggtgagttgacccataacctgattcctgtaagaataagagttaactaggttagaagggggtgtggagctggagaggatagctacttgggaaactacataaagtttaatgttattaggttgaaaaatgtgagagttgttggaagatgaggtaggccaggagaagaaaccggccaggtttgtattacttggtggaaaacttgaactttgctttggattttaagaacagaaataaggctgccatgtgaagaacacacaggaggggcagcagagagactggcatctttcctggtgagggatcaccagtgttgcaatcgcagagtcaggttagctcttcttggttggagtatctttaaggccatctggtctgactctaaatgactaggaaattactcatcatgtgccttctaactctctgagtagttatttccatttccttgatactgaaaaaagggtagtagggaatgtatgtttgctgcggccagtggggttatgtcaaataatggttacttactgacagcagtctaacagtttctgggaagactaatgtgctcctaactgcatatgtgggagagaaacaagaactacccatttactgaatatccactctgtgcaaagcccagtgccatgggcattaacattcatggtatcagcaaggtggcagcaaagagtcaatcttctgagagttaagcagtcctaatcaacacattataggaaataactatgtgcagaagttatcctgtctaagagatgagttacttatattttcctcccagcctaaaaggaatagtttataaaaaatagttaatacttgaggttgatagatttaatacatatccaatttgggtaaagtgactatggtgtattctcaggacaggaaggaccctaaaggatgctataatctgactaattataattgtaacaggcttctctgaagtaatgtgtaatggaaaggtagtgtctgcctagagcctagaaaaggcagcatagggcaaaaggccttgaccagcattaattcataacaaccaatgaaagaagggactatgtagctcatgtgcattattgatttctaagtgtctaaaaacacatcagaatttgctgcagcttagataaaacatttactgaacatgtattgccagaatgtgagcttattgataatctccttagtatcaggagaggatatagcagtaacgtgtagattctgccttcagacccccctggattggtatcttgactttgccacttagaagctgtattagttatctgtgaaaacagaacaaattattcaaacttagttatttaaaacaatattatttcacagtttctctaagtcagagattcagaagtggcatagttgggcagttttgcctcaggggctatcatggttgttgtcatctgaaggcttgactggggcaggaggggagccactgccagggtggcttatccacatggctgacacgttggtctggttttggtcctccccttgtgggcctccacacaggctgcctgagagtcttcaccacatgatgcctggcttccttgaaagtgagaaatccatgagaatgccaggtagaaggagtagtgtcttacatcctagcctaagaagcatatgccctcacttccaccatatgctttttattagaattgagtctctaagtctggttcaaatcaagggagaaggaaaattatactccactttttgaagagaggagtgtcaaaaaatttgcatgctactgtaaactgtcacactgcgtgaccttgagcaatctatttaaaagctttatgctccaattttttcaccagtaaaatagaaatgacattagtatctgctttatagagttgtaaggataaaataaatcaatgtaaagagcttaaaacagtgcagggtgtatggtaagtgctttcagtaagattagcaatgatgctgattactaattctattctaagtctgtttgacctgtgatagagctaatccagagacaagaacaaaagatgctggcatcagtcacgtgtgtctcttaaatcgatcattcctataagcaacggtgttatctccacatcatcctattgggctttgcagaacctggatactgttttgcctaggctgcagatccaggacaggcagcatgcattcttctgtgtcacaaagccttgtttttcttttctcatcagaggaagtggtctggaaaagtgccagccaggctatgtgacttctcaggttcaacatcatggagatgagaaagaccaaatggcacccagggtcctgctgaaatcagaggcataaatctcagctgcaggcatgaggagcaattcaggaacccttgaatagatcctttcagattcttaacgtggcttcattgaacgaagacctctccagggttctgtcctaaagtcacctcagaaagctgtgtctctgacatcacaggaaggggacccagggccagaaatcacttcagcatcattcacctcaatttcacctctgagaattgaggtatcatgaacaaacgttacaagaatgctcaagaatctggctaccaaatagtccatagagatattatcctagattaaataaaattaagaaacatttattaggcacctactctaggcaagtcacagtatttcttaaattggaagaaacttgctgatggatgaagaatgaatagaattttaacccatgcaggacttaaagaaaataattgctatctgctccagtcaaagtccacagtgacattccaagaacatgtgtcaggaaattgactgagaaaagagttttgaatttttgacttacaaatgcattgagttcgaactagaaaccaaaatctacttttttgcctacttttctcaagtacagccgtcacaccaacaagcttgctttcaaaaagggaaaagaagatgtttgataggatcagaatatcccaactcctgatatctgaccaaattaaatttaaatgttcagaactttgcttttgaatatataaagcaacatgatggctggcaccaaggaaggcaagaccaccagtagtctaaatgttaccctcaggcatgcatgccctggcagctgacccttccctgaaagaaatgtcccttctattcaaagacaatgtctggggtgaagtaatttattaatttattaatacaagaagtaaaaaatactatttttggcctaatatccataataatatggaagaaatgacaaaagaaaccccatgggttctcaacgtattacactttcagccaacttaatagaagacttggctttaggataaatgcttgtatgttttataaacactcctattatttagggaggtctgagggcatctggacatagaatattattttcaagttatagcacataatttttcaggcaaaacttacccttcagaatggaatatgagccatttaatttccccttgtgtttagtcatatgaaaaaatgccacacaaggacccgggcagagaaacaaagataagagctagtcttttccttgcacaaaaatctgcacgaggaaaggcgatggctctcgttactgtgcacagatgcgtggctgtgaactgcatagctttcttttcttcttggaaaatggcctcaaattagtctaggacattggatgaactgttgctaactaagtaaaaagttcattactctctgcaactctttgcatgaatgccattgagttatatcaacggttctgaattcttttttctccaagagccccatttggcctctaaatctctttcacaactcctctccccttcttaaagatgtttcctattcactgtgagactctcatccaaggaaaataaatggaggtgaagggcctgggggtggggacaaggatgcagaggggagctgttttagagaagagaaggggaggtgagagctgctacccacataatacatgggcgcttattagagggctggaggactcttttttggcaaacatcaaattaggtccaagcattcatcccaattcactggaacatgcaaaatcagttgacaggttagagaagagaggtttttaaaagttaacatttgtttttcccctgaaaatatgaaatgactgtgggctgcagaaaaaagtaggagcaaatgcggagggttttttttttttttttagtatgagaaactaaatggctggaatggaactatttcatattttagatgcaggctgtgatcgctgaataaccttcttattttgactcacagcttgacacaatgcaggctttcattgcatgaagagccacagcaaagagttttgggccactttctctttttattcattttctaagccccatccttctcccaccccaattcccccatttcctctgtctgggtttgaatagctgaagtgtgcccacaatatgtatgcactagacacattgttacctcccttttaccaaaagcacctggcagggtcaccagtcccaagtccctccatggtgcctggcttaactctttgagtgacaaacatccaaatatatttttcaaataattttaacaaatattagaaataatctaacaaatgattttaattaatactttatgggaagaaaattaaacctgttatatttggttgttttataattttctttctaatttcctctcttctcgaacccttttcccttgggttcttaacttacaatgtgaacttgttctttcccagctgaatcagtgggagatgatagcattcattgattttaaatctaaatctgaaaatatctacagactttgtggtcacagaacaagcaaccacacatattgggtaaaggggaaaacattacccattgtgcagaaaagcctaggaatcatcagatgctttgtatttctagaaacctcgctcttttcaagaggccagagggccatcagaggataactcttcagctttctgcttccagccaatatggagtaacagggactagaggtacccttctatctgaaacaaccgaaaatctgaaaaaactatgaaataatcatttcaagacactggacaacaggtagcttaagataacctaaagcagatgcagatctattttagttagaagttgtagtttgggcaatcagcaaaagagtttaatttcttccttggtggaggtgtagaatgttggacatgctgcttgtagtaacctgtgggaggcccccctcttgtccaggtcagacaggagtcctccctaaatactgtgtgccatggatcttcaagaagtgcaccagaaatgggttttgatgagtagaaaacctcaatctctcctcattttcatccagactgaggatgaaatgaaaatgagagctacacctgtccttgaacatgagcacaagctgattgtgtttggagccacagtagaagacaggagccataggaagtcaggggctgcctccccccatcacaacaggggctagcaatggccttcttaggggcagcacctagaccacggtgctcaggggggaacagcatgtctggagtctgtggctcacgtgcccataagatgccttcttcccatgggatgtgactggtgaataggttaaaaactaggactttgaatcctgatttgaaaagtaagtgtgattcttgagggagcttctagggtgctgcgaatgtcctgttccttgatctggatgatggttagacaagtatgtttattttgtgatcattcatcaagctgtatattgatgactgtgaacttttctatacatatattatagttcagcaaaaagttaaacaggcatagtggctcacattaattatgtcttttttacaattacttcattatagaagaatgtattagtaaagctcgagtattgatttcacctcatatttttaatgatgatcctagaggtcttacatattttcaaataacaaataataattcattctctttattcctgcaggtggagacaaagctatatcattcaatcctatgccctttgttaggaaatatttactttttaaatggaaataaatattgtccttgacaagagtgtggcagccattgggcaagtaggatggtattatttagaaaatgttgatgcttaacaacacaaaagcctggattttttagttaccagatgactaatatttgtttgttcatttttgttctgttttgttttgttttgtttttttcattcctaatgtcataaacacaatgccttattttaaaattgttctctctgtttgatgttaaattcttagagtcaagcactgtatcttttttattttaaaatgatggtacagttggcagtattactaatgtgcttgtgagattgaaaaggacaatacttcccagaggcctgttagactacacaccaatccaaactaaccttaagtgaccagatattcaatattataaaatacagtcactaatttggactctgaccccaaaccaacaaatgacctagaatctgtctcagtttaatctcagcacacctgaacatcatttatctataggcagctcctcaagctaagtggccatccaaatacaactgtaacacaattttcatgtagaagtccaacttgagtttaccgagggcattttccattcctcttttgttgaaggtcttctgataaacatataacctgaaggcaagtgagatcatttttcattctagcctacaggaagtggaagctaggctggaagtggccccaaacagcatggattctggggggagaaagtgtggtaagaagggaagcaagctggttgctgcaaagtttgatgcagggccggctccatctggtcacataacacggtccactccacacagcccatttaatacattaagaagggataaggagaaggctgtgcctggaaaagctgtcatcaccttcattgatgagccaagagcttctattcatggaacacttagaatatacctatttgtcagagtacagcacacctgacatcacctgcaaagaatagctcaggtgcagaacccgtcaggagaacatcctatgagggtaatggcatggcctagaatagctgtgagcaatgagtggtggattctagattagttggtaaactccagcagagacttggaggagaccaccactacctagaagaggcaggagctctgggcttcagatccgtccaactagtatttgctgaacagtgttctgcaccaggggcagtaagcattggatatagaagtcaacaagacctgaagttcacaaggagttcatagtttagaacacagtagacagttcactgagttggaatttgttagaaactgtaaataaccagagcttttagtttactgtaaaggagtgaataattcatgtggcaattgtccagatgtctacaaggagatttccagctcctgttctcttagattcaaagttaaggaaacctgttttgatgaagataatgtccttaaccaaggcccaggaacaggggagaacagtgaagtccttcaaataaagttttcaagagaatagaaagagaggaacctctgggctcccactctgaaggctggtggttcaggagctcccagagtatgggtgctgagatgagcatgcatcctggggacagtctggtagcctgaaaaaaatgtgtctgagggctaacatgttcaactcagtgtcatttggttgtgggaactcctaaatgagcaatgtattagggaagagcaagtctaacttgatgaactgccagggactaggcaggaattggagtgaaggcccagtctcaggtccttggccttgatcatggccaaccgcaatatgcttcagccttgtggctatggcatagtcaacagagaacctttttgaatgcctggaattcagctagctctacctttggaagaaggatacttgctttgcaacagcaatgaaggtcatcaaaagaggtgcatctgagtccctgctccagaaataaaactggaaaactgagaatttgttgaaattctagtaaactccttggcattctgggctatatcagggtatatagtgaggatgtcggaaaactgaaggtagtaaggcagggattaaaggggttggatttcttgttatctggccatgtgagaaattaagtattttactttgggtcttcactggtaaatactaccttctcatatttatttagtttttctagccagtcaaatttagcagttgggggttttataccaactttggtgacactaatgttaataaattctgataacccactaccatcagaccagcccttctcagattgaaaattaacttatgtctatggtcattttctagttactattcaggagttctctcgtacacacaattcatcctttaaattgttaacagtgtctacttacactcctccatcagaaacaaaaaggatcagagaatttaccctaacaggtatttctgctaatccttttatttttgaattatttaatatttttgatagggcattcagaagagacctcagctggaagattacacctcatacaacatcttgcttttctagtttatcttgtatttaaactaaatccttcagatgagaaattgaagcagaaggaccactcccaaatcaaaacggagagagtaggggttaagagtacttggaggatggaggattttccactttgctcagctttggggagtgaaggaaatgatatatcaaagtagggacagaactcaatgccctgggatacaaatgtgatgtacagagagtaggatgatctctataaggtacagtcaggatagagcccagcagtgcctcaaccgtatacatccctggctcaggaaatcctgcactccaacagcaggaaacataggagcactctgaaatcctagggcttaaaactcctcactggtggagaagggttagcaggctagcaaaggaagctatatgaaccctagtgagaagagaggaggaaatcagtgacccaaaacaaccaggcttgggaggccaggctaaagggagaaatttccctctccaggagattacaggaagctggtccagacctctgcggcagcatgaatagccagaggaaggaatggggaggcagataaagagggcagctgaacactggctcggccccttttaatccagctgacagtgagtggaaggagaatagtggatgcccggacaagggcatgtggttctaggtgatcgtgggatcctgcagagtttgttgtcaatgggcagggagtggagaggagatgcacagttgttaggactggacagtttggaaatcacatttcaagaaaatgacaaccccagtagggtaagtgatattgaaacaaggtttgcagagagaaaatggtactcacttatatttgcacttttaagattcaactttacaaaggtggcatttcagacaaatatgaaattgataatcattttttatagggctcccaggaagagccactctgtgatgtgaattctatctagccctgctgatttgaggtctctggattccagaggggacacttggatttgacccacagcaaccctattaactcattgctgaaatgaagcaaaacttttacttgttggttgactgattgattcgtgtaagccccctcagattctagcatgcatgagaagaggaagaagcctgatcaaactgtctcccatccataatacaataactatacattattaagaaagatttgcatctgaaatgctcaagacaactgagacacttaatactattaatcacattatgagccccaagagattgcttactggaagggattttgagaaatttacagatgggaaatggaaggcaccacaagtctgctggttctctgcccattttttttctcaaaggtaggaaatgtccctcttcattgtgagattggctcatcatgctgtgaactataatgagcagactgggtcaagggtcaggggagtggagtgaaaaagagagtgtgggtggtcactgcacaaaaagccagttccaggcaagatggtcaaatttagtttcagcaaagtgttcttgcactgcctgccaagaagatggggttaattggtaggaaagtgtgggaggaaactgatgttagtggaacatttaactgcatgctttagcatttaactggattctgtatcaagtgatgtgtgtgtgcgtgtggtgtgtgtggtgtgtgtgtgtattaactcaccctacaaccctaagaaatgagaattagtttcaccattttacagatgagaaacagattaactaatcttgcctggctgcatagagttactaagaggcatagtgaggctcagaacaaataactgactgagtcctatgtgtttgctgttttaatatgattcaccttatttgttaagtgttaactatatatatatttatgcacatacacacatatacatatatacacatacaacacacacacacaatcagttctctatttgtgcaggttctgcattcacagattcaaccaacagttagttgaaaatatttgggaaaaaaacaacaatacgacattaaaacattttttaaaatacagcataacaactaagcacattgtattaggtattgtaagtaatctagagattatttaaagtattcgggaagatgtgtgtaggttatatagaaatactataccattttatatcagtgacttgggcatctgtggattttggtatctgtggggatcctggaaccaatcccccatggatagtgagggaaaactgtatatatttcattttattttcattttaaaaagttgcagttggcagacagaaggcaactatgcttccttgctatggaatttcagccacttaggatagaggtgtggagcaattacattttggcatggaattttctcgaaatgccatgcttagagcttttcctgtgtgacaactgttaccactataaaataataaacggtaagcagagtgcttaattgccctttccatcttcacacgtactccaccacatggtaatcagtatatggtcctggatgaatatttatttcagccctccctgtgaatatgcaggaatgtgaggtattcaaagcaggaaactgcaccatcagcaacattgtctttgattgttggcatttgctcacaggcgtccacccaacggcccatgatcatcttgtaaccagtgcaggaccttgtgcttctggagccattccagttgtgggaggtgatgtctcggaaaactctgccttggggactggctatagaaatgtggccagatggctttgtcatcttcccctgtctactctgtgactcttcatctggtggaaatgctgtgagggatgaaccaaatggaaactcagatttactcttcagaataatgcggatcataatacgcacacacacagcatgtagagttgctgtgtggcttaaataagtaaatgtatgcaaagcactaaaatggtgtctgtctaagtgtaaacaccaattgtgttggctattatcactattgttgttcttatctcaaatatgtgttactttctaaataactttagtgttcatagattgttaaaagacaagatgacctgaagaaaagtaagccctaaaaatccattattaacttttttctccaccactcttttcttctaaacttcactattctttgtgttttcacaaaagttgcttacttcacctggcagagatagcattacgcaggggatgattaaaatatactcacttgtacttgttggttttaaattttattatttatgaataggtaatagcatgtacactgtaaaaatctcaaaaggcaaaaaaggatatacagtaaacattaagttcctcttaccctggaccttagccatcaagttctcttccccataggcaatccctgttgcctaatttccaattcccctgcatactttaaagatcatctgtgcatctgcactcagaccactcacacgtctaaaacaaatgatagcacactacacacaaagttctgttcctttttatgctcaatgatatgttttgcatcatatttcactgccgtataaataatgctgcctcgatttttaaaataactgaacagtaatacacagtatgaatttactccaatttataatccaatccttagttaatggatattttgattttgttgttaagaatcatgcagcaatgatgtacctgttagacatgagttattaatttctcttcgaagaatcaatatgtcactacgttcaattctttgccttctacttttaaacttcacttcctcataaagcaaccttttgcgatcatctgctccaccctgactcattccaatcacctgctccaccctgactcattctgatcacctgctctgcccagactcattcccatcacctgctccaccctgacttattccaattacctgctccaccctgtctcattctccaccctgactcattccataaccatttttcccaccaaaccagtcaccccctcaccctctttaaattagctaatcggaattagtttagcttgtgtggtctaacctagccaatagatgaatgacacagcagcaggagccacgttcgtcagggataagaacaccttccccttccttgtccaggggtgtactcaccattgctccatctgtgagggcgcacccttctatagaagtaaattgccttgctgagaagaaaaaaagaaaattttatatttgagtgctatttattttgtggcaccaaaactatttataacatacctgatctttattttaaatttttgtttatttaaatattaaatatattatccacctggtattaatttgtttaaataaatgtgaggtagggttccattgctattttttaaccaggtaggttatattgactaaccttcactttgaaagtgatttgaaatacacttttcatttattaaattctcccttgtgtttaggcagtaaggcataatatttgagagtgtgggctctgcagtccagctatctgggtttgaagtttatctcctttatttgcgagtggtacaaacttgaacaaattatgtaatttgtttttctcaattccctcatgcactaagtgaggataaaaatagcaataacaccatgagattgctgataacaaaatgcaaggtaaaaattgtgtaaggcttaaaattgtgtagcctggtatacaagaggctctaaataacataagctattattgcttttctacttattattatttctggcttttgtagtctttttcccattgttgatctttctactattcacaaagcatgagtctagtatctgtagatttataaactaattaatgtaacttttcaatatgttttaatatctcatagatactgttcttcctcattacttttctattttataaatttctatttcatctgcttcataaattttgcattctcataaactaagaatcatctcctgtagttaaaaaatattgtttgtatttttgttgggagtagagtgaattaaaatatattgacttaaggagaactgacatctttataatattgaatcttcctgtttgagattggactttatgtccatattttaaagtctttgtttatgaccctaagtataattttaacgtttttatattaggcttatttctagatactttttgttaatatatcatctaactggttgttcttcatatatataatgactatgaattttttctcagtcttttttctgaattctcacatcatttgtgttatatttttaagttgattctcttgagtttttcaggtaaacaattatatcacctataaaaataatgttgccaccttaaattaagaaaatgtttttctattgtctaattgcatggactgttgcctcaggaacagtataagattgcttacaaaagccttgctttcttgttccagattttaaaaacaaggctttcaatgacaatctcgctagcaagaagctggtatacttacatacatacatacaaacagacagacacccactttctatatgtatatctagatagatttagatagacatatatgtgtgattcctgttaagatgaatctatttttggtatttaagattttaaaaatctagaatgggtattattatattgtattgaagctcttaagcatctatggaaatgaaagtatgattcttctctttcgactaattaatatgtgatccatagtattttagtaacagatttcctaatatcgaatgatctaggcattgattctagcagattatgtctatgggtattttatttaagattttgcatcagtattaataaatgaccatggtctatgggtttgcttttttgtgtgctatgtttgcagagtgtttgtagtttacaagagatttttgcaaacttctatttatgacaatatggtagattatatatctgaaaaaaaaaccttctcattacagaacatatacaaaactgctgaataaaacgaggcaaccaacattttaaatatatggttaataaggtttt

SEQ ID NO: 1636 - DNA, 97002 bp, Homo sapiens
gatgcgcatgcgcggccgatttgcacatgcgcaatactcgcgctgcctccgtggtccctgcctggctgaggtggcagcagggggcgggacgcgcagcgctatggcagagggcagcggggaagtggtcgcagtgtctgcgaccggggctgccaacggcctcaacaatggggcaggcgggacctcggcgacgacctgcaacccgctgtcgcgcaagctgcataagatcctggagacgcggctggacaacgacaaggtaaccggggctggcggggccggagtcacaggttcctgcggggctgagccgggccaggggcggcgtctgtcagggacccaccgcggtctccctcgtcccggcagcagagggaccgcgagtgaccccagacctgcgggctccgctgctctgcgggcgccgggggcggtgagaagggggagccccagcaacctccggaaaagcgaaggggtttcctgggtgttctctccacctgaaaaggtgccttcaaggctctctggatgggattggtgaacggtggtgcctcgagaagtgtcctccaaacacccctggaggcgtttggctgtgtgagctgggagagtggaggagagcacaagactggatatgaaacagatgcaaaagagcagattccaagataaggtagcgcaaatgggggtcgggagaccaagagagcagtggtagggataagggtgcatttccacggacaagtgacaacaattgcaataatttgcagcgcgaaagaactacctttgcccgtggctgaaatgaactcatatctactagtttttgttgagccaagcgctatgatttgtgggctcaggctgtatttctttagaagataaactgacagcatgctctcacaagtacctcctgaaacttaagttggactttacagctcctcacatacccagccatctcttctgtctctgtgggtcgctaggtaaattggtcatgacagtgtaacataaagaagaacatatgtcaaagttagagagttttataggtgaatatgtaggtaactgaaaataagctgtcgataacaatttgattccgatatgtaaaaaaataacattgcaatgtaatgaataagaaattagggctctggagactaccacttattagatagaaccactaaatgtgtgcatcatgatttgagtaagtcccttcactaatctcagcttctgtttaggaattaggaatcctgctgttaagtttctcatggttgttatttgaggactcagtgagagactccaggtaaagtcctttgcaaagagcctggcacttactctttcttaacaaatattaattttatcataaaatttatgaagtgtttaatgtgtctcatattgatatttattatatcatttaagactgctacttgctctgatatagataacatggccttcttttttggacagagttttgctctttttgcccaagctggagtgcaatgggcgcagtctcggctcactgcaacctctgcctcccgggttcaagcgattctcctgcctcagcctcccaagtagctgggattacaggcatgtgccaccacgcctggctaattttgtatttttattagagacggggtttctccatgttggtcaggctggtcttgaactcctgacctcaggtgatctgcccgcctcagcctcccaaagtgctgggattacaaggcgtgaaccactgcgcccggccacataaccttctttttaccatgaggaaaataaagcatggagagagtgcagctaggttgtcatataactagtaactggtggaactgtaatttgcatctgagtctgtgatttcattcgttcaacattactgattacttctttgaaccagaccttaggacatttcaaggctatagtctaaagaaactgcttcacttcatgggttttttttttctgtacagtaagtatttatagttgtaaacatatttttgcttcctctgaaatattaaattgaatttatataaatagttttactgtttttgtcaatccagccaatatttcaaaataacaaatagaaacatgaaagggtaagcctactagaatatacagtagtggaggtgtagaaatgtatatctgcagaatttagtgtacaatggggatgtcctgggcttggttctctgctctctcttccattcatgttttctctgtaagaaaaatcttgtactttcatggttttaagtagcaaaaagcatgattactctcaaatttataactctgtttctgacatctactgagctccagatttgtagaattagttgtctatactatacctccaattggatactgattgacgtcatagaacttaacatgggcggaactcttgatttttccctaaactggttccgctctcactaaagaacgtcaccatttacccagtcaagcaagaagcatatgaataattttggattcttgtcacttttttttttttttttttacatctcctgcaaatccacaaacatatcttataggttctactttgaagaatatttttggaatatcttttttttttttttgagaccaagtctcactctgtcgcccaggctggagtccaatggagagaacatggccttactgtagccttgatcttgctggctcaagcgatcctcctgccacagcctcccaggtagctgggtctacaggcacatgccaccatacctggctaattttttgatttttttatagagataggggtcttactatgttatgcaggctggtcttgaactggcatcaaactatcctcccaacttgacctcccaaactgctgggattacaggtgtaagccaccgtgccatattttggaatatctctttttcatttgtactactgccatcttggtctaagccactatcaaaccatactgggattatttttgttttttctcttacctacctcctttcttgtacccctttaccattcattttccttacaaagttggaataaacttttataaatataaatcgtattacattactcccctgcctaaaatcgtaataatttctcataacttcagtcatagtggccttccttctaccactttagggtctttgtactcattgtttgctctgtctgtggaaggctttgtccccatgactggctgttgcctacactgaggcctcagttcaaagtcacctcagagaggccttcccctttaagtttctccaagttctacttccagttattcagtttctagcctggaggattccagtacttattcttaaatagatcattccagagatagttaatgtgcacattatatatgtgtcaactaggtatacacaagtaagtatgcatgtatatattccttttaagtttttaactgttggtattacaactgtttctatgccttgatgtttcacttaacatatctcaaagcttatactacgtaagtgcataaagattttttttttgtgaatgagtatatcataatttatttaaccaatcccttttagatggacatttatattatttctagtctttgcaattcccaacaattctgcagtgaataatcttgtatatataacactatacacaagtaagtatacccttcttgtgttctggaaataagcatgcttcagtaatttgaaggtcattcaatatttttcggattggttaatgaaaataaatcatttgaaaatgatttcattacattttgtcttgagatttgaaaccatttaaaaattagttccagtaactgtcttctgttaccaattgtataggagatgttagaagctctcaaggcactttcaaccttttttgttgaaaatagtctgcggactcgaagaaatttacgtggagatattgaacgtaaaagtttagccatcaatgaagaatttgtaagcattttcaaggaagtgaaggaggtatgtaaactcttttcatttagcatatattgagaacttactattacgcctggctctgtgctaagtatttttttgaattaggttgatatgtttgctatttgtatactatgcccaaatagaaagcttagctaatttctcttgctgcatctagatctttatttgtattaatgtgatttatgaatctgtgacttccacaaatattaattcttagaaagttaacattgttctagaagattatcttaggaattttagcttttttaacaaaaaaattaacatttccctgaatggctttccaatagaaatatcccctcattgcataaacctctcttggataacaacttctctactggagattaattagaattgagttacttttactatatcctaaaatatgaaaatttcagattaagatcagtaacttcaatgtattaataatgattcatcatacttgagagtgtagtccactcaccacagagtgaaaataaattttatgttattatatctttattatgtaatattttattagctgttttaatacattgtaatactaatatatttctatgtgagttatggaagtgttgcacatggtttcaatgagtgttcaataaaaataggttgtttttgacaccttggtaggtttttattgactgaagactaatactttggaaaggatttttttaaaaaaaattacattagagatggactcttgctatgttgcctgggctggagtgtagtggctgttcccaggtatgatcatagtacactacagcatcgaactcctgggctcacgcaattctcccacctcagtttcccaagtaactgggactacaggtgcctgccaccatgcctggctcttttaaacatcatttcctactaaaaggaacaatcttaccagtatcagaaagcaaagatgctatctgagactattggatacatgtcaaaaggactttggagctaatgtgaagaggattcttctactggccaaacataagactatttgaacatcaataagagtaactgcaattgaataacactagcaataaagggatattcagttttataaagcatttgctgttttcctgcggtcatattctctaaaaggaatggactattttctttacattttttctaacactagatgttattctttttaatcatttccaattttaaatatgggatctcttgtcatgccttgaccaaaaaaataaaaaattatgtaactaaaataaggatttagctaacagaagagaatcttcttcttgctgtatatatgatgtttgatgttacttttcttcttttcaggaacttgaaagcataagcgaagatgttcaagcaatgagcaactgttgtcaagatatgacaagtcgcctacaggtattatataatggctagattttggcatagttcctgatataaacttacaaaaattattattgacaaaatgtgtagatatctaatccataatgccctgtaggaaatttgggtataaatataatccttatttttaaaaattgtagctatctttgtgtttctttggataatgatttattaatattgttcaattaactttagagcatttatattttggtctagccagtacagagctaactacgtagaattttgataaacctttcaattccgtaatattctagaaatctaggagtaatgattttttttagtaagaagccttaggaataatttcacactaaagctgtgcctgataaagacctagcttaattctgatttatgcataaccttaaaaaattctgggaaaatatgtatacttttaggtcttttaatgaaagcagtcctaaacttatagtttggtagcagaatcagcatttgacttaattaacctcattcatctaattttggaatagtacatagaacggtttcctcctaagggccaatcatgattatgtctactgccttcacattttaacagcgaatttatatctctaagtgtctcttggaacgattgacatcaacagtgattctaggaagaatcattaatgcatattctacagattaatcacaggctacttgcatcatcagtttgcaggatgagttaatttcttgtttctctaaaattttatcttttctggtcttgtctaaattttgatattcttactaatctatcagatattattggcatgtttattgtctcttagtccaatatttagatatttgttaatttgacaatatttaaataattatataatatatactaattattaatggccatttcacatttttggcatatatttactttattcctcagtggttgattttgtttgacccttctttttctttaactttatttccttttctcctcttttagcttccatgacgtaatgccttttctcaaattatactttataaggttttctatattgtacttttgtgttttttaaataacattatgctttgttatattagactactcagtttctgatctttagtgatagtatctcttattttttaatttgtatccttaattatgtttttatacttttcatcatagagagatttaaatataaaaagatcatagtatttttatttgtgctatttttcaaacagtttataaatattttaaattacaaccaaagtgtctctttctgttttgtcctttgtattttttttttttttttttgagacagagtctcgctgtatccttagtggcgtgatctcggctcatagcaacttccaccttctgagttcaaacaattctgcctcagcctcccaagtagctaggattacaggcgcctgacaccatgcctggctgatttttgtgtttttagtagacacaggatttcgccaggttgtccagggtggtctcgaactcctgacctcaagtgattcacctacctcggccttccaaagtgctgggattacagacatgagccaccatgcccggccagtcctttatattttctttgcacccacctcacatcctgttttttcttctgcagtggcatgggcctattttctttctttattcagatcaactttattgaggaataatttatgaatggtaataaactgcatccattcaaagtgttcaaattgataggcttggcatttttatatgcctgtgaaacaacaactataatcaagatacagaacatttttatcacatataaaagattgcctcatagctttctgattgaatatttaaaaatatttaatactgcctattgtttacatttgtttttgatccacatatcatttttaatagtaggaggtccatgattttgaaagttttgtttattccttaaaattttgcttaaagctaatttatttggatatagcactattggaattctaatagtatacattcataatatcaactctaatgtttttaagttattcataaagaaaagtgtttcttagagtatcctcactttccctttttcttatagaatgttgttataatgattcatttaattatttaatattttctgaaatgctttgactatggtaccttttagaaattattagaaaacatttaaaaatgtaatcagtcattttatatatgttaatatttattcctttgtggttttccttgcatatgtttaaataataaacatgcatttagatgcatatgtttattattaactcaaaaataatcatctttaacatttaagataaatggagattgaggttaatcttcattaatattattaaatattactttggaattcttaccatagtttataaatgaaaaaatcaggaaatatgcaaaaaaattagcaaattcttattatataacattgtgctaaattatcatatttcattgattaataaatggtgttgattgtaaggtgcaccctcaataacgactagcctaaaaagctagtaaaggttttttgatgttgattttgtgaagcattctttttttcagaaatattaaaatgtaaacatatctttgacttgaggggatactatattttaaaaattgcacaaggcaagactgtacaagggtggaaatggaactttagcatttaagaagtatgagcatttgaagaacttattggcagtctaataattctaaaagaatattttgggagctatcatgttgagctccattccttaaaagtcagtgaaatggctgggcgtggtggctcacacctgtaatctcagcattttgggaggctgaggcagaatgatcctttgtgaccagcctgggcaacatagcaagaccccatctctaccaaaaacttttaataagttagccaggcatggtggcacatgcctatagtcccagctattctagaggcttaggtgggaggattgcttgggcccaggaggtcaaggctgcagtgactcaagattgcaccaccatactccaggctgggtgacagagtgagaccctgcctctttaaaaaaaaaaaaaaaagataagggatatgcaaaattatctaggttcaaattgttttcttaaaaaatctatttcctgggaacatacactcaaaatagcttcatttgaggtggcaatcaggctctgttattgacagcatacctagaaagcaataagacagagaatttccctcacagtctgaaaactgagtttgtagaggattaggcctctaagaacccagaactggaggtgtctaggtctaaggcagctctagaaagaaaccgcagtagcagaagcttgactctttattgtggtattccaacatgaaaatgacccagtgtcttcaggtgtttgctctggtattttctctttaacagactgattcaccttctattttatgtgtttttctccactttactaatgacttaatttatgcatctttctggctcatttaatatttcttcaaggcacagaccttgtttctctacgtgcctcatgactacttctcttcttattgtttattgccttatttttgtaaatattccctagttcagatatttgagagagaatctcattgtcttttgtttaaagccacttcatgaatgttttctaatcttggataagatgcttttttaattgactttccacttttgatcaactctggcttagggaagggagaattgcttagaatgaaagttgattaggaacagccttgtgtcctttagatggggctagctctgatcctcaccaaaaacttatatggcaggtagtttgtatattacaactttcaaacttttacctccatcttatacatttctattgagctccacactagcatttcagtgacttagttaacaaccccatgtaaaggttgcatggtatctcagttcaacacgtccatacctgaagtcatgttcttcattcttaacttgtttttccagtgcttctgttgcactaaaaagcatcatgaactattaagttcctttgtcagtatctggatacctttttctttcttgtaagccttagcattatgtgtatattaagaactgagtgtgttcctccagtggatgagccttgaaacatctacgtatttcattttattgtgcttttgagttccatagagtgatctcatttgttttaagtctaaattgcagtaagtggtagtatttgttttctgaaatataataaaattggaatttacttatattagatatgtttataattttaggcagcaaaggaacagactcaagatttaatagtaaaaaccactaagcttcaatctgaaaggtaagtttttcttcatacaaccaccttttcaataatttggagattggagtcaaagaaaattatatataactccaaatcagaattaaagcagaataataaaaaacatggttcataaggtcctaaactattatattacccaatagtaacttaagcataaagacagtagtttaggagcaataaacttgacattgaggttgagagattattccttctttggaagagaggtgatgatgtatcgttattgtttgctgtggagttcagaaatgatgctttttaaaatgtaaatgttttcagatttttaatagttttattacttttttttcacaatcattgtcttttatttttaagctatgatatatcctctctggtataattaagagttaattgtataaattctccttgtagtttatacaataggtatactattggttgattgaatgaatgagtgagtgagtgaataaaggtgagtacagtctggatttgtgtaatgtgtggtgttcagtattgctaaaactcatagcaattatgctaaaactcattaactgcatctctcatgtgtggagtagtatagggggggagaagcattatattatgatgcagtatacttgtctcctgctcagtagttgggtacatcacttaaaccttttagtattctaggtatttcatcagtaatatggagatattaccactttaactgctgattttggggtaggtcagtatactatagtatagaccacaggttatcaaactatggccacaggccaaatccagctcaacacctgcttttgtaaatgcagctttattggaacacagctatggttgtgtttacatactgtctatggctgcttttaccctactgcagtagagtcgtgtggttacaacagagaccatatgtggcctacaaagcctaaaatatgtactatcaagatttttacagaaaaagtctgtgacttctgatccaactagtgtttttttgtagttcaggtcaagatcaatgggttgtaaattatgatttatcaatcattactactatttaaatcgatcatagctagccttaaaaaataaattagaatgaaataaaatagaaaatagtttgggtagctgggcatggtggtgcacacctgaagtcccagctattctggaggttgaggtgggaagatcatttgagcccaggagttcaaggttgcagtgggctatgatagtgccactgcactccagcctgggtgacagaaggagatcctgtctctaaaaaataaataagtaaaaatagtttgagtgaatattattttgtgaagcctttctttcagtttcagtaatggttttaaatggtttaatattatgggtcataatcaagagtttgaaaaacactgccctagaccaaaaatggcaagtacatgacccccaactccttagttttacatccactgatcttgacattcttttattttgagcccttaatccttcttaacacaattctcttcagactaagattgatgaatgggaaattataaagagtgcagaggtgtaaagttacttgtgtaaaaggatatcatgggtcttagggctacaaaggactcagagatcaactggaatgatccattgcagttaaaatggtaaccaatgtaacttacttttctgtcttataaaaacattgagaaaatgtgacaaaattagcaaaataaaatatatgtaccaatatcatctaaaaaatactatctttaatagcacaaaacaaagaaaacattttctttacacgtataggaagtacattattggatattggaacatgtaccttatcttagacctgtggctttcaaaccatagttcattgaacctcagggtttctttgcaagacgtagaaggataatggagttttggaggtcagattctctcaccctaattttagtgagagcagtttcacttttacttgtttaatatattaggattccatgtaagattttgtttgaaaaaagagtttgacagcaggaaaatataaaaatattgcacaattttaagactagttgaaaggtagaataccaaataaaatagtcttttgattttattcctcatgccagagaaaaatctttaaaaacaactaagtatcaaagctttataaaagcttaatcataatttcatgcatttaatcccctttttgtttactaactaccttctctttcactaaaaatccacttttacccgttgtgtgttttctacaagccaaaatgagagcaagttgatgttgtcctcagatttatagaattgcaaattgcctggatagaaattaaatttaggaagtctggccttaaattcccttttatcttgttgatattgtcattctgtattttatagctggataaatgatcatatcccccacattggtggttaattacttgatgttgacctataagtcagttttctagtacttttcagagcatcttcaatccaatccttttgtgtttaacatttaatcaaagactttagtgtatatatagacaacttacttggaaaattgtgaatgacacaaagtatggaatgttaagtgtaaggtatcaacagaatcaagcttttaagaaaaagtggggctgggcaagaggtgaataggatgataaagggtctcaaaaaatgatgtagggttgaaaaaaacagaattgtttatttagaagtataggactaagaaggacatgatggctgtcttcaaatatttgatgatctttcctgttttaaaaaaggctaaattttattatatattgctgctgagtttggaactgagttttaaaggagaaatttaggcaaattttgacttaacgataagcaagaattttctatcccttacaatttgaacaattcttcaaagctttttttttaaaatcactggaaatatttagtcttatgttaggtgtcattggagccatcttttatttcagttttcctttctggtcttttacattacgattcatgtatccacaccttatcacagtaaacataagagccaccaaggagcttgataaaatggcaagttttggcctccatcctcagagaatctgactgaaaaaagtaagcaactgtgtttttttgattaatgactcagtaaatcttgatttgggctcaggattcggcccttttaacaatatcccaggtatttttatgcagtggtccagagactataatttgaaacacctggccttagacaaaatattacttatatttttaattttttgtggaatgtccctctcccctaccttaattctctcatctcctaactggtaaactttgaaaaaacattttaactttttaaatgttaaactttatattttgagataattatagattcacatgcagttgtaagaaacaaggccgggcgccgtagctcacacctgtaatcccagcactttgggaggccgaggtgggcggatcacgaggtcaggagatcgagaccatcctggctaatgcggtgaaaccccatctctattaaaaatacaaaaaattagccgggcgtggtggcgggcacctgtagtcccagctactcaggaggctgaggcaggagaatggcatgaaccagggaggcagagcttgcagtgagctgagaacgcgccactgcactccagcctgggcgacagagcgagactccgtctcaaaaaaaaaaaaaaagaaaagaaaagaaacaatacagagatccaaggtagcctttaccttgtttctgccaaaggtaacattttacagaactatagtatggtaccacaactaggataatgaccttgatactatctacctgtcttattcagattttgcagttttactcgttggtgtatttatttttatacattttatcatttgtagattcctgaatgcgccaccatagtcacgatatagtacacagttccatcaccacaaatagtgtcctgttggtgggtggacagtgtgagaaaagttgcagactaagcccatgtgggagatggttgactctgcaaagcagccagctctgtgaggaaaggcagtgttaaatttctttatcagaattaagcctgtgccttcaccataaaattagattgcattttataacagttcttttgaaagaaaagtttcctagaaaaacacattccctgttagagaccttgacattaatttttctctaagttaatgctgaacacaaaaacaagcattactttaattgaaaattgtgattaaaactaagaggataacagatcaataatcctgtatgcaaagcctttttaaacttttcctgttctcagttaaatctttttgttttaatttttagtgtaataggtattacagttgtttgcaactaatcgttgatttgattgtctctgtttctcctaaactgtgagctccttgagaaaaatgacaatttcttattctcctttttgtatttgcagtgcctgctattttacagattcaataaataatttttgagtaaatgaatatggaaagcaactataatgttaggaaaggaacataaaactgaaaaataagcattgtattggagcttgtaatatggggctctaaataatgtatataggagacaatattagaacattgtgcttctgttcatgtgttctcaaaactatttaagcaaggtttatgtttattattttagtaagcctgtggaagtgttttggcctgatatgcttttgggaagtgaaaatttatgacattctggtatcccaagagctatagatatgatgtgccaagtgaacgtttgtgtgaatgtattttaggaaaattgcaaggcagaaattatgataacaggtctctgggggctggcagggagttgttttttcattttaaaatatctttttaacaagaaactttgttaaacaagcagttagctttagaaatagaaatctgtttctatatgggattatttgaataatacgatacttttattcagacaaatgtatgaatgatatgaatatttttccaactgagtgagaaggaagtcagtcgtcaggacagctgagatgctctaatagataaagcttaatgtagaattttattcacaggactgcaggttagcatttccccttaatagttcattggtagtcagacgatgggcttcactgataatcaggaaagactatatgtacatgaacatacctttgtatttttaaaatactactaaaatcactattatatttttattatctcttataaaggcccaccagccagaattctctctggactcagaaaaataatctctggagaatgtttatgtgtgtgtatttttttaagttcagtatgttaaaatggaaagaatataggacttaagacaaaaatctgaatcttaatcgaaaccttgggtaagagattattagatttttgattttgtacagttatttcttaacctcccttaacctaagtttctatgtctgaaagaaggaaggggaaaatatctatgtcatggggtttttgagataactaaattatttacgtaagttgctgaagacactgcatggcatacattaaagactgttgcccctccctagtcctccccttttattagacaaagaaatctatgtcactcatcttatttctatttttgctctgtcatctaggaagcttagagctattttgtgcttaattgcaatagctttcctcagatgtatgatttactttctcagcctttccctttatttcttactattttagtttttaatagttttaatttatttttattgcattgtaaactactttaactcaggttttgaaattggtagcataaaaatataaaactttatcttgcataaatggttttatattgcatgtaaaagtatattacagaagcgtatgtggcacattttctttcattacctaataaaaggttaggggaaaacaggggagcatcacatctcctttcttctttcttcttgtctcatttgtacatagtagcagctatccaaaaggaaatattgccagtgacatgcaggagcctgactgagataagctataacaactttatttcagtcacacatattggactggaaataaaaatttgggggtaaggcacagtatggcttatccatttcttgtgattatgatcatgctgtaagggaaatagtatgaggaaaaatttagaaataatctttggtttaagtattttaaaagttgggtttggagatggtatggatttttttaaatgaaaattttgtctgatcaaattttccccaccaatgaaaaagagcttttttttgcgtaacattttttccccaccaatacaaaagagcttttttttttcttcctttttttttgtgggcacgcttcatttaaagtggctattgctgtttatttcctgatttaactacatttatcaaccaggtagactttttctatattcttattcattctacctggaattccatttcccaaaattaatttgttgaaaactcatttgtcattttaggttccctgttgtttatgcccatcatatatttcaaaatattttacaaaacttaagaattttaggctatcatgtatgtgtatgtttgtgtcacacatgcatgtacatgttccttgagaatgtatatatgtatgtacctatatatgtttcaaagaaagtcttgcttactttaaaaaatacttcagcttataggaaatttatttcacctttgtactttacagttttattatatattttccatgttcagccaggaacctttactcagtcaccagaaaaaaaaataattagttccttctttgtactcccacaacacattattcttctagcacttattttctgccctatgatttctcaacagtgctggacgttatggtctttgactattttaactggatagcaaaggcagtgtattaatgctctttgtacccactcctttctacacagaaaacttttcaactgaatatgtctacatggttactttaacattttaaatagttacagctgacattgcctgttaatatttgagactcttactttataagagtaatagcaagtgtgcatatatacttaactaaatgttattaaggagtggaaagtatcaagctggaagaatgtattagatgccttttaagctgtattttgtacagttataataatacatgtaattgtaattcaaaaggtagatccttttttgtttattataaaaacatctttgttgagatataattcacatatcataaaattaaagtatatagtttattggttttagtatattcagagttgtgcaatcatcattatgatctgaattacaacattttcaccatcccagaaagaaaactcctgaccattagtagttatccagccttagtgaaccattaacctactttctgcctctctaaatttgcctattctgaatctttcatgcaaataagatcatacagtatgtggccctttttgactagctttttccacatagataaacacttttaagattcatccatgttactttaaccttttttatggctgaatagtattccattgtatagcaacaccacattttgttcacccgctcactagttgatagacatttgggttatttccactatttgactattgcaaataatgctggctgtaaatatttgtttacaagtttttgtgtgggcatgttttattcctcttaggtatatatttaggggtagaattgctgaatcatatatgataactctttaagtgtttgaggaactgccacactgttttccgaagaagctgcacagttttacatttccaaaagcagcatatgaggattccagtttctgtacatctttgtttttaatctgtcattttgatgatagccatgctactgggtgtgaagtactactcattgtggtttagatttgcattttcctaatgactaatgatgtcaagcatcttttttttgcttattggtatttgcatattttctttggagaaatgtctatttacgtcctttacccattttttaatttaggttatttgtgtttttatttattggttgtaaaagttctttatatgttctggatataggtttgttaacagatacattatttgcagccattttctcccattttttgggttatcttcacattcgtgatatcatttatagcacattttaaattttgatgtagctcgttttatcttttttgtcatttgtatgtgctttatttttcaatgtatttttgtattgaagttattttatctatttgttttaaaatactaagataaaaatttagaaatttatcaggttttgaaatcatggcatggtactggaaatgctgacaagaaaacaacctcattacaggattttatctctattgagttttaaccagtctttcaaaaacgtttaactttcagtttgatactttataaaaacttaaaatgaaaagtttcttctttttttctattttagaaccaaaaaaaattatagaaatactttttcttaaggattgtaaatgataagcagattctttaagatcctgtcaaacaggttatttcacttatctttccatcatatgaattaggtaaaaggaatcttttaagtgtaaaaaactgccttttctttcttaaatttttttgacataatgttaatataaatctattgtataaaatttaaggaaaactaaaatcatatataactctaccactcagatagaaccacaattaatattttggtatatttccttccagagtgagtatgtgtgtgtattgttaatattttacttttttcccttaatattttatgttcattttcctatgattttttatatcaagaggatcatttttggaagtgtcctgaaatataatgcctaaatttttctcaaaaaagattatcacaatttctacttccattctgtctattttattaaacccttatcagcattagatatcatctttaaaaactttgccaatgtagatgaaaaatattatcacaccattttattttttatttttatttttaattttttttaaattatactttaagttctagggtacatgtgtacaacgtgcaggtttgttacatatgtatacacgtgccatgttggtgtgctgcacccattaactcgtcatttacattaggtatatctccaaatgctatccctcccccctccccctaccccacgacaggccccggtatcacaccatttaatttacatatcatcgaatagtgatgaatcgacatgtttctcattttgttttgccatttatatttctttactttttttgttttggtttatatcttatgtccatttaaaaaattatttcgaaattatttggtgtaggtgaacctagaggtagaattaagatacgacagagataagttttcaagaaaaagaaaagtaccacaggattcataaatcatgttctgggctgatttgaaggaatcatgaaaattaagtagtccgtttattttaaatacttaggcagtatacgactggacatactgaaaattgatgtacatgtgtttatatacagtaattcccaaccttgtctatggttttgctttgtgtggtttccattacttatggtcaactgcagtctgaaagtaataaatggagaatttcagaaataagcaatttgtaagctttaaattatgtaccattttgagtagcatgatgaaatctcaagtggttggctcccactttggtgggacatcagtcatccctttttctaatgtgtgatgctatatacaccaccactcagtagtcacttagtagccgtctcagttatcagattgaaaaacagtacgtgtaggatttggtaccgtcagcagtttcaggcatccactggagggtcttggactatatcccccgaggataaggggggaccattgtaattacttcttaaaaataagtggggattcctatacatactttctcgcaactttttatacctataaaatgccttatggatcattttgttagtacatatagatctacctcagtttgatctattatgtatttttccatagtgtatatttcacatattattatttatttatataatatacagtgattgcacaaacataatcttaaatacgctagaagttataatttatatgttatgttaatatttatctcctatactttttacttagacattgaaagccctctaaaagttccatatgttgatgtaaagtaaggacaaggtctgtgtcataagtgccttttatcacactcgtctctggcataggccttatacattgtgagtctccaataatgttatttgaatgagtgaatattcccaaaccaaatcactggaccatctaacaataacttcctgtcagaatggttgtgaaaatttacctggaaagaatacatgtggtaaaactagagtaatatgataataaaaaatatattagaatttattgtcactacttttaaagttaccatcttgatatattaaactcttgttttagtactgtgcccattataaaaatatttttgcaccatctcttttgtagctatatatagagcctgtgtttctgtctttatctcatgattgatttttagatccacattatttggaatgaattgtaatgattaaggggtatgatcaaggtgggtagcatttgttttggttacaacaaaatgaaactataaactaaagagacaaattttcctttgtgcctaataaattgattctaaagatagatccaaaaaagctcccaaaaacattttatttcacatggttaatttgcatagtctcaaggaatttgatgaaattttataattactttaaattcttaatgataatgactggaacttttaaaaatataaaacaaaacctgttaaggtaactctttaagcttttaaaaattcatttttaatttataattgacatataatgattatatatatttatggggtacaatgtaatgtttcaaggtaattaccatatctatcactttaaacatttatcatttctttgtggtgacaatattcaaactcttcgctatcttgaaataccactgcattgttatttgctgtagtcaccctagtttgtaatagaacagtagaacttactcttcctaactgtaactttgtactcgttgaccaatctcttcctgtccccttctccccactatcttccccaacctctgataaccatgatctctcaccatacataaaaataaactctaaatggattaaagagtaaactatacgaccccaagttgtataactaccagaaaaaaaataggagaattgtttcatgaaattggactgggcaagaattttttgaataagacctcaaaagcacaggcaacaaagcaaaaataagataaatattaagataacttttagatatcaataataagatgattaagaacatgacatttaaatctgtgtatattcaattaggtgatttatcatttgaaataaacagatctttgctgccacctggaggatttttgcttgtaaatttctttattcagtaggagcattagcattcaactttgaatttaaaacctccatcccaaaggtgcaaataaaacagaggtggcagatgcattgtaccatctatacaaatagtgtttatgtttatctttgttcattcttatttgaattttgtttaattgtggaatattactattctctgaatattgctagtgaaatacttttataactttatttatatattttcagttctgagatacagaaaccaggaatgttgagtttctgttcaagtagtttgtgttcctaacttgcctgtgggtattgattcttctcagtcccataggtccttgagtgtgcctttttccgtcagctagtttagataggttgcactcatataatttaaaaggttgtttttattactatattttgtagaaaaagtggggaagaccaaagtggataagtgactagcaatttatggagaattaataaaggagttcttctataacataaaataaactaataaatttgatttttgatatgtacgtcatgtgaaaacttaaaaggcttaggaattgttttagtgactgaaaagaaattggttgaaaacaggaacatatttctctcttataaaagcatctagcaaactgcaaggtgaactatttaagtacttgtaagtggctgcaaatttgtaatgcagggaccatgcatggacttatttgttcttttgcgtaatgatcaactccatttattgtgtgcaagtatctgaaatagaacaatattagctaattttatcacctacatgtctgataaaattctaatatttgaggcagaaacaagacttttgaaaatattgagaacttttcatacctttgttttaaaaatttattatgtctgagatagaatttgttttaaagctatgcaactgtgtaagatgcttgatttttattgcttgttttgaaaattacagccaaaaattagagataagagctcaagttgcagatgccttcttatccaagttccaactgacttctgatgaaatgagtcttctccgaggtacaagagaaggacccattactgaggtatcctggctttctgttataatcatttaaagtttagtagttacagatattagagagaaattgcttttttgaagctttattttcccattaaaaaaagtttcatctgagaatatttttatgtttggaaatttaagatgtgtattttaattatatttttcaaagtaatacatgtactttttaaaaagagtcaaagttataaaaagaaaatctatgtcacctattttactcttcctcacctctaggtcttttgtcaaccattttcaatgttattaattgcttcttttgtaaattctatattctagatctatagttaaaaagaatatgctttgattatctatgttaactattttctattgattctctattgtgaaatgtgaggatttagccttctacccactctgtctcctcccccaacacagatagtacacacatatgttctctttatctccttcatacatcatagtacagttagaccacattttctattttcttttcctttttttttgagacagggtctcgctctgtcaacctggctggagtgcagtagcacgaacacagctcactgcagcctcaacctcccaggctcaagtgatcctctcatctcagcctcccaggtagctagggtatccaggcatgcaccaccactcctggctgattttttaattttaatttttagtagagataggatctcactgtgttgcccaggctggtcttaaactcctgagctcaagcgatgtgcctacctcggcctcccaaagtgctgggactataggtctgagccatagtacctacccacacatttttcattttcattacagtgacattacagtgattgcatgttctttcttttataactttgtgtctttccttgggttagaaatcacttgttttttcatctaattaattttttaagctattccattttttccaaactggctgacagaattatataacctctcaaaatgttaaataacaagaaaaagtttcgtttctttttttttccttgaagacattcaatttttccagaaaggaatcttttggtcttctcgctgggaagaactgtaaacttaagcctatcgtcatcattgtgggatcagagggcaagaagggttcttgaggtggggaagggttctcactgagtgtctctgagtaggtatcacttttactggcttggctaaaatggaaccagtcatttgggtgtagagaggtaaataggtgagagaattaatagagatattatgtattagtatgtactgccctcatgttttgaggaactttgcacatatgaaatatttgacatatcattttttctccccttggtagaaattagaaaatgagggttattattattattattattttaagttttattcatcaaagaaaaataacacatccgttatttttcgtgggtggaacactatttgtggcactctgaaacctaagcctccagtacatttaaatatcaatcaacagtttggcatctgtcacctcctatatatttaactttgcattctactcttggacgagggagcaataatgagtatacaacagatacataaaacatcatcttcagcaataagaatgccaggcttaagtaataaggtgtgtaatacacaatactttttttcatgtagtaatttttagttttgcatttctcactagactacgtacacttcttgaggacagggatttttgtctttataaattttattttcctggcaactgtcaacactatttggcacatagtagaaactgaattaatatattaatatgtcttaaaatgtgaataaataccagttacaccgtctatgaaaacttagagaaagttgagatcagtataggaaggcttccctaaaataggtgaaagagtttgtttgcccttggtagtgacctttcagttttaaataatgcaattttgcctgaagcatggacataaagtcacattcttaattttaaaggattttttcaaggcactgggaagagtaaaacagattcataatgatgtcaaagttctcttgcgtacaaatcaacaaacggcagggtgagtaactgctcactgaactaattgcattgctgcttatgtttccaaaattttaaagatattctagattgtttgtgaactatatagcattttgtgaaatagaagtttaatctttatttatctttagagaatggtgaagttatactctgacaggtttaggctaaaacagcagttgataaataagtgatggttaaaatgtgacatttatttaattgtagaaaattattgaaaaatcatcccataaaatgataaaaagttaatatgctgtaatatgtaatatgcaaacaaaataattaggtgcttagatgtatctgttgactaaagtttaaattataatcattaatttttttttagtttagaaattatggaacagatggccttacttcaagaaacggcttatgaaagactttaccgatgggctcaaagtaagtgatttcttttatgttgtctagattcatgaacatttgtagttgttttttaaaattttacttggtctttatttgatatattttgattttagtaatcaaacattttttaaaaataaaaatagtatttgtatttggtttttaaatttttacttggtctttgatgcattttgatttagtaatcaaaaatattttaaaaaagaaaaacaaacttcacatttgagcacactgttttttgtgtttgtatcatgagcaccagctatcagccaagcagtatgcttgattaagtgtgagaataaaacaatgaagacagtttctgccctagattattttaaagcagattaggtatctcttgttgtttacataactgtaaagttgtaagtggtaaactgattttctgctgttgctgtaacaaattattacaaactgagtggcttaaaacaacacatatttgttgccttacacttctgtaggtcagaaatcagatgtggttctcactatgctaaaatctaaatgttggtagacctgcatttgtttctgtaggctttaagggataatgtttccttgctcattcagttagttggcagaattcagttccttgtgtttgcagcactgaggtctgtgtttccttgctggctgtcactgagggtttttcccagtttctagaggctgcctgcattcttcggcttgcggccccttcctccatcttccaagccagcaatgtcaggtcattttctcatgttgattctaccctgcctcatcttctatctcatatctctaacttttctgccagccacttccattgtgaggcctgtgtgattaccttggacccacttgggtaatctgagaaaatctctccattttgaggtctactgccttaatttcatttacaaagtcccttttgccatgtaaggtaacatattcacagtttccagggattaggatgcagacatctttggagggccattattttgcctaccaggaatgctttatttgctttagttttgtttgaaaatgtttcaatagattttttgcagaatagcctgttaaaaccagagaagatatttaaaacaagcaagcatggaacaggagcacatattttaataggtgttaccaactgactgttggaaggggttggaattaaatttggttaaccagctactcctgtactatgctgcgcaaatggaattctctgatctggttggttaagtctttatctctaaaacctgtttgtttttctacctctctccttctttacattgtttgcttccatctggagtgttgtctgcctttctctcattgcatctcattgtatttttttcatgtatgtcttatctcactagttttctacttcctcaaaggcatggacattgactcaaatttttttgtgctcccgcaacatcttacatagtggttcccaactgtgggctctgtcttgtggagactatgaagtcattttaaggtgtcttcaattctctatgcatattttgttttcagtcagtgcatgctagaaagtatactgctagtgtgaagtccttgtgtaccaaaggttgggaatttctgagaagttctaaattctttgaatatactaggcacttgtgagcattttatagataaaattagaataataaagaaaagttggtgtagaaatttttaagagtttaaaattcaaactcttttgaaattatatcactatatattagttaaccacattaacaattttagcaaactgtttaaagattgcttcccagcgaaggaactgataatatctttttagtactcctccctgcctccctaatactgtcatgtatatggcagttattaggaaatacttgttcactggttggtttcttcaggactctatagtgttttataataataaaatacagctttggggcatacctgatagcatatgtggtcatttaaagttatataactacttaagcttaactttttagtttggttgacagcataaattcatttttgattggtgtattctctaggtttttctgaggatttttttttatggggtgtttgccatagaatttagactcctggaatgcaacagacataataaacatctaagctgaatttaacaaaagttataatgttaattatttttcaggtgaatgcagaacattgacacaagaatcatgtgacgtatctccagtattgacacaggcaatggaagccctgcaggacagacctgtcttatataagttggtgactttttcttaattaaaaatgaaagcctacttttcttttgatatcttactttaaattttagtattatcaaaagcgtatataatagtttgagtaatatttataataatttacaacaatactgttcaccttaacttgaatttgtttcatggggtatcagcttatttgaattttacatactatagaatacaatatggaaagagaaaccaaagtgtctctgtatctagactacctcttacttatatagaggttcagtgacttttcccctgtcgtctcattaactcccttagaattgtaagtaactaaaactcctgtatgaatacttccctacagagactgaagtcatatcagtactgagaaatatggttatgcagagatgaaaaaagaatatttaatatcaaggtaatctgttaataggatttaggaggagagggcccaggtctttgatcctgtaattgatgccaaacaagagctatgtggtaatgttttggataagaatttaatgcattttgtatttgttgatatgttttttattattttatattttaattttattcttttaatttttataaaataaaaggtaaatactttctttaatgcctggagtagtattagcataagctttaggtagatgtaggggttgatgatattaataattctgaaaacaggaaacgaggggactcttaccaaggtagtgcatcctgctttgaatcatccctttcagaatctgtttatactatttttagaggacctccccattactttctgattggaacactacttatcctatcatcaggtcacagaacacaaatgctgaacagctgtgtaaaataataacaccccagtgttacttactgagtactatgtgttaagcaccattttaaattctagaaacacaacgtcagtaaagcactgccctcaaactgctttattttatggaaccagagataaacaaacgcattttaattgaatacactaattgatagtctagaagtcatgtgccagatgctgtgtggctcaagtattctggtgtaggggaaagagatgagcatcagtgaaagtttcctaaggaattaggtataaagtgagttctgaaggctgaataggcattttcctagaagtaaaggaagaacagtttgcaggttgagggaacagtaatgcaaagatatacattgagagataatgcacctttgggaaattaattgtaaaagcttgcactggctattgaattaggagcaacagctggatcataatagccctgaatgttgtgcatatacataagataagttaatgtttaccattgatcagcagcttaacagtttattcctgctttaaaatttctttcccaactttttcactttaacatattgacattaattatgagtcttttagcacttaaaacatttggcgtttgattttaacagctgttgcattgtctacagattaatatttattcacaaggttaatcttttatgtattaaaaaaaaaaagcctttctgtgttttgggcacctttgtttgttttcaacagctgacttctgccatgcaaataaattttcactgagttatagttctttatcaaaacttggaaaggagcaatattaaatggctataaggtgggttcttgagtcaaatttctttgagaagtccgtgtacctttataagcttgtttccttagctgtaaaatgaggataataatagtgcctattttacagggttgatgtgaagattaagttagattgttcacttaaggcacttagtgtaatgcttggtacatcactaaattttagatattatttttattttgagaggagatgactagaaagttttcaactaaggagggatgtatctgagggctacatggcaatctgggaaaaagcttgaaagataaagaatggaactataataggcaaagaaggtttatctgtgaagggcatatgctaagaagcagggggcagtaatggcaatttggaagatttttttttttttttttttttttttgagacggagtctagctgtcgcccaggctggagtgcagtgacgcaatctcggctcactgcaggctccgccccctggggttcacgccattctcctgcctcagcctcccgagtagctgggactacaggcgcccgccacctcgcccggctaattttttgtattttttagtagagacggggtttcaccgtgttagccaggatggtctcgatctcctgacctcgtgatccacccgcctcggcctcccaaagtgctgggattacaggcgtgagccaccgcgcctggccaatttggaagattttaagacacatttagaagttgagtaggaaagtaagtttttaagaccagatgattagaacaagatgaatgctaaaaaagagaaaattggcctttcattaagtaattattttcaaagtggtagtttccttacatttagggaaaacttaataatgtatcatgttaaccaccagatggcactatatgaacttaataagtaatgtataaaagtttcactgtccattattgtgtctcaaataatgtaagtattatatacaagaaaaatgtcaattattgaaatccgtggggaaagttgccatactcagtgtttcttatgtggtgtataactggaatgctaatgcattattgacttttaataataaatcatgtacaattataaatgaagtgaaaaaatttgataatttattttctttggtaagcctttagaatataagttattttaaaatgtagtaatacatacaatgctgatttttcttccttctttatgtatttgttgtgtttcaaagaggcacttctttactattatcttttaatttgctttttgataaaaatttttcttcttttaatttgctttttgaccagaatttctttaactgtagctaaacacaatttttaaaatgagacttttaattttaacttgaggtatttgagaatatttacataatttgaacattcactctgaaaaagctccattttgatttttgattattgttggaagaatgtctgattttggtcaaagactttttcttctgtctctgggaaggatgtttcatgtctaaagatattgaaggttcacgtggcttatgctgtttttgctttaaattatatttgttctataggaggattgacattaatattaatgtttattgatattttatagtattgaacagatgaaattccagtgtttgccaggcttggtaatttaccccctatttaaaatacactggattttaagattcactggattctgttacagctgtcgtcccagtggacagtcctagaaacaaattatgctgtttatttttaatatagttagtagggtcttgggaatgaggattagctatatatacttaaaaagttaaacgtttgtgaattttatgctgtgataagcagtcataagttcattatttcagagaatcaggtgatcatttaaaagaaggcattcttcacactaaatggattaataatttaagagcatgagggaaaaaatagcaatgagcattttggttctaatttgtttaaaaaatagtaaatgcaaggcaattatgcaatttagcaaaacttagctggatattgcacttccccttttctgtagtatgtcaccacagggaatctcaaaaccatttctttttaatggaagacaaacccacaaagaaccatagtctggttaatagtaaacagtcctcaaaaaaggttcatattcctaaatatttatagctatttgccagttctacagactttctctttgatttggaaataaaccgtctttcacatgtttaccaaaatgtggatttttcatccaattaacagcatatgaaagaaagctatgtagcctaagatattaattattttgggtatcttgggaagttttggtaatttttgtttatatataggttattgacataattcttaaaatttagtatggtagaatactgtttagagatttaaaagttagtctagaatctgctgacatcaagactgctaaaatatattttgtttttctttatacttttaaaatggaaagaactttcaattgagggatggatgtcaggaatggtggtgataatggaaaacaaggctgagtcaagtcaaagaaatgggcactccagagagctccaggccatttttataaattgaatcccaaattgtcctattccccagttaaaagctttccttccctaccagttccttcaccttagaaagcctttccatgccttttcaattataataggtgacttcttaatacatgttttttaaaaaggtatttgcttgtatatgtgtttggtcagtaaatttaaggaacatctgttatgtctaatattggagtcaaaataagcttttaaagatggatagcaatttttggagcaaattttggtgatagattgtgatagtatgtgtaaagaagacttttttaatgtagaagagaaaaatgtcaattttgggattgcagaattcttttattttttctgagacagggtcttgctctgtggctcaggctggagtatagtggagcagtcactgctaactgcagcctgaacctcacgggctcaagtgatccccctacctcagccttccgagtagctgggactataggcatgcaccaccatgcctggctattttttttttttaataatgagaaagggtttcattattttgcccaggctggtctcaaactcctgggctccagtgaccaccttcctcggcctcctaaagtgctaggattgcaggtgtgaaccaccgcacccagccttggatttgcagagttctaattataatcagtttttgagaactgttatggctttacgtaaaacagtagagcatcatgttttagactgcaaatatgtatactgaaatataccgaaacctagtatagtgaatatactgaaacctaaaaagttaagtcttcccaccttggcttgattttcctacttttactaagtccattgctttatcccttattactgctgcctctgctttagtcccaaatcccagcattgtttcttaggaggggtaaaagtttttactttttgattgaattttcaatgagctgaagttatctcttaaatatttttttcttgtttgaaagcaatgttgcttgaccgaatatctaaaggagctttaagtgctttttaagtacttggttgtctcagaaattgcgtgaatagtctgatatagccactagaaacaaccccaaccattttttatataacttgtttcttctagatataccttagatgaatttggaacagccagaagaagtacagttgttcgtggatttattgatgcgctcacaagagggggccccggaggtacacctagaccaattgaaatgcattctcatgaccctttgaggtatagtaatcagacagcagaagaggagttgatgtttttccaaaggaaatcttcattaacatttagttttcattaggtatgtaggagatatgttggcttggctccatcaagctactgcttctgaaaaggaacaccttgaagctctcttaaagcatgtaactacacaaggtgggtccaccaattgtattgctaatgcctaaatatagaaaataacacaagcatctctgtttctgttcttgttgccatcttcttcacttagataaacaccttgatggtacaataagcatcctgattactctttctcttctctagattctccctcattctgctaatagactttctcttccatcacctttgtcctgtcactcaactgttcagttttatagtgaaacctagtgacctttcatatcaaacctagactcctctgtgtcacttttaagaaatttctggaatatttagcatacattttctcaaatcctctgcatgacactttaaaggtacagggtgatattatcttaattttatctgtgtgtaaacaggctgagtgacttgttttaggtctttaagctactaattctttcatttctgctacccagcctcttttttcattctcatggcactgttttaaaattttaagacaattatcatatctgttagtatgtttctgcattgctataaaggaacacctgaagattggtaacctataaagaggtttaatttgactcacggttctgcaggcagtagaggaagcatgatgccaacatctgcttctggtgaaggcctcaggaagcatagagtcatggtggaaggcaaaaggggaagagccagcatgtcacatggtgattgagggagcaagacagagagatgggagagatggggaggtgccacacacttttaagcaacgctgactattgtgaggacagcaccaagccattcatgagagatgcactcccatagcccaaacatctcccacaggcccccacctccgacattggggattacatttcaacttgaatttagaggggacaaacatccaaactacatcaccatatgtactaaatgtacttaaaatttttgtcttgatgtcaaggaagaaaaataactgtagttgagagttgctgatgtcttgtttacagaattccaaatcttcttagttgtgattacctaaagaggcctgttttagagtttgagggtttagtgtatgattttaaagtgttctatttttggtaggaagttaagagagacactgtggcttggtatcacttgactattttacatagctcagccacacatctctgtggttcacattatctgcaagatgagtcagtgttacaaattggtggtaatactaactttatagcttctaactcttcagtatcaagattagactcagcatatatgttagattggcacaaagtgtgcatcgttaggttctctttctgttattattctccttacccagtttaaataaatgtgtttccttaaagatgttttagaaaagtataaggcagtattaaggaagtaaatagactgtagttagttgaagtaggttattctacatgaatgacttcaatcttctgggcctcagtttttccatctgtgaaaatgaaggtgattacaagcagtaaatgtcaaatacccagtacagagtttgataaatagttggtgttttgaaaataccagtttttctgaaagatttcaaggtatatttttcatctttataccctcagtgtatgtgctaagcagcactgcctggaacaagatgtttgtaaaacaaatgctaatacatcttggcatcacttcattcaattaatacatttcaccctctttttttcctctgtcttataactttaatctttttcacaaagaaatatttattttattaactcaaagtcagatgaattaacaaggctttctagacacattaggtattatcacaattaatatgttaacacaattagtaatgtcccaagagatatcaaacttactaaaatattgttatggttattttaaaagtcattagtgccattaattatatgtattatatattatttgttagttttttgaacttatatgaagcaaagtataatatggaaacaaatattaattatgtagtcattaattttaggtgttgaagaaaatattcaagaagttgttgggcatatcactgaaggtgtgtgcaggcctctaaaggtaaaatattttgtttttacatatgctatatggtacctgcttaaattattaccttatttatagaaacttaagaaactgataccagctcaaatacaatctataattttttcaaattagcacactaatgtagactaataagaaacattttaaaataataattgccagttttctctctgagaaagaaaattggaaatatttgtagtttgcatatattgacctattttttacagattatatttcctgtagtaatttttcttattcaattgagaaaaaaatctattaaatttaaacagcgaatctatgaactcttaacagagagatttactaagaatattttgtttacttgattgcttcaagcatagaagagtttttgcttgtcatagcaataaataatgattaatccaaggataaaataatgtgtattggtattatcatcaatactgtttatagtgcaaggaacagaatttggaatcaaatttgagttagaattcccatattgccacttaattgtgtttacttattgcatccgcttaactcttctgcacctgaattatgctctggtgggacctgtatattaaaacacctatcatccagggttgttgtgaggatgactgtgtagatgaagtacatagtttatgacactaagtatttagcagatggtaaatacctttattttcctttattaatatttagagaatacttggcaattgttggtttacttttccttgtaaaccaacttcattgattgactttaatttcatacatagaaattgaaatccagaagtttagtaattaatttttcaagaaatgaactttaaaattaattttattttatttctaaggtttttgtttttttggtatatgcttcaggcaaggaaatctcagatgacacacttggtgacaattgattatattgacaaatttaactgttactctaacttgatctcataggacctaactgtatattcagtaaataaatggctaagtatcttgaaattattttacttatttctcccaaatgaaatatttacttgtcatagtttgatgtagacatatataacttatataaatgttgtttattttgtatactggcagttactggaaaggtagaagaagaggaggaataaaatgaaatttattttgctatgcttttatacctttttataacttcatatagttaaattaaactcctagtcactttgataagtaaattttactttatctgccttaccttccccccttccttgcttatgtaattatgtttctttttacaatttttctaatttttgtgggtacatagtaggtgtatgcttttccttttctttttaaaaagtaattttataaatactataattttagaatctaagggttataatggacttttcagtttcctgtcctggtttgagtaagaattattatattaaaaatgtttaaactaatccagccacttgtataaagactttatatactgaagtctgcctttgttttaaaatgtacttagaaattctcacttcatcttcctttaatgtacatacccagaaagatctttatggcaattgtaggacattattgtgatctgctggcaaatttaaatgtaagatgccaaaggtaaagaagacactagtaagcagacaagcatctttttgttgtaaaatgaagaaaaattccttttctgaaatggcagaaacttcaaatctttccatatgatgataatatgtattgcatccagagaatatttagcaggtgttcacaatagttacgtatcaaattagcttgatagtgatatgtaatccagcaactctcataccttcccttccttatatactgatagacagtgttacagtattttaagaattttttttctgtatgaccttatttgagtatcttatgttttcagtgagatagttgttagttgaggaaaaaaatttcgactttaattatttttttttgcaattataattctgaaattttctagtgatcaatctgctcttgtaatcccactcatacaaaatttcttcttcctaattgataagcaactaaactttttctaatgacatatgatattggatgttatggctacttttctgtccatcattattctttgtagatatgaattttttttggaataagagattttgatttttagaaacataaaaggttatagtggtaatgggagataatccttgagaaactatatatttgatttattctaccttgtttaatcttttctttgtcttagtaaagtgaaacatcataggtagtagattaaatatttgtaaatgtatgcattaagataagatctgtaaacctattgccagtttaaagaatctgtgctctaagtttaagattgcatatgttgtgtagggggtaccgtggctcatcagcatcaaccctattactttgtacatgtctttattccaaaactgtagctagaaagaccagaactaatatattaaattttttttttaagcccatgggtataaaatccttcttttatgtgaatgttttagattgctgagagattaccagctatcatttgaattttctcttttaataaaaactttagtgtagtgtatgctacagaccttagattatggtgggttctatgaaagcaggtatatgtaaaagatcaatgacatggaaaataaagctgaatattgtacacaatatagtcattggaccctcagattgaggtatacataggaacagatgtctaccctgagcagctgtctgtgatattaaggtaaaataggtttgtcatcatcttttttagtcctcccttcttcctgtgtccccttcatgaacacaaacccactctctttctcttgctctcgcttttgctctagctttctctctggccttggagaggagagccactgttctgtcttttagctcttccctaccttctctgctgtcagggtgcctgaagctcattttgctacttttaatatctctgcctttatggttgatgctgcttctcgtaatgcagttaggatttattgagtgcttatgatgtgccagggtctgttccaacatactttatatctgagccattattcccgttgctgctttccagctctgctaatgatttttccctccactgtcatcacagtgataatttccagtcagttgctgctaccaccactcctttaagtctctttgacctttttttactttttacttttcgtttctcttgtcctttgttgtttctcctgtgactgttgggttttgctgaaaatggttaccctcttatatagctctcataagacagagtgtttatttctgtgtggcaaacaaagcattcttggtgtattatttgtcagtctcctgattttccagcctttctctgttgtattttgtattgtagctgttgtattctttattgccactttccctcaaaacctttatattcatggagagagttggaaattgtttttgttttttcttcctttctccctcctttccctctttgcttttcctttctttctttctctcccctcttttctctctttcttaagggagtcagaactaagaatattttcttgatgcctcaaaattctggaaggcagctggccggatagctgagatgttgtttaaaatctgctagtaaagagctgtttgcctacaactaacattttttatattttgctgtaataattatattaaaattaagaaaatatcacttttattgatgtaatgtataatttaagtcactgttaaggccttgatttaaaaataaatcatggaaaaatatattttttaagttcaaatgccattcatgatccatggtattgtgttaattagatagtctatcacctataccaacagatcaatttcataaacatattaatgtaaaggtaaattgatttctgtaatctaagaggttttcatatgcagatataaaatctcattttagcaaatcacatttgttttatgacatatgccaaaatctaaatacagagaaagttcagtttttaaaagcatatattaaacatctgttgtgtgtatactgttctaccagatgctacagagatgtaaaataggcagaagacataatgtctatactgtatttgtattagaaactagttaggaaagcaagaagatagaatgtaagcagtagcttaaggacagatacaatatttaagtaagcatttatcagtgtagtttagattgtattcattaatgagataatataaaagaaggatcagtgagggatggaatttaattagaaaagattcatatttcctaaatcttgaggcaaatcaaattaatcttgaactagatctgatttttccctggtagtcttataatttggcaaatatgttggtgctaattcaagatttgcctagttttctattctttgattaatagacaaacgatataataatttatagactggaatttattttatttttttcttgaatatttagcaataaagcattatgttttcattgataatctgttttagggatgtaacagttgccttttcaatttcatattgaaccaaattccattatatactggtgataaatctcaaatgatctcaatgtattgacatttctggtaacaactgccttgaaccaaattctgcaaataatgggtcagatttttgtagagtatatctctgttaaaatgtttgttactttaccatcttctatgacttactactcagaaattatttaggaggcattttgtgatctctgcagtaataaaattttatctttgttatgctattcataccatatgttattaatgaaaaaaagttatacttttaagaaatgtttactttcctctcacatattttaataggttcgaattgagcaagtaatagttgctgaacctggggcagttttattatataaaatttctaatctcctcaaattttatcaccatacaatcaggtaagtagaatggcaaaatgtgcttgctaaatccaatgtgatatttctttcagttagagcacagtataagatttttttttatattgtgtatagtaattatacactaagtatagactaagcgtaactagtaggacttccacaccatgtaaatcattatatgcatattatacatgctatgccttaaggtctattatttcctttctccttttttctccaagcttaactacacgcacacacacacacacacacacacacacacacacaccccttatatagcaatataagtctataatgtaagtctttattgagtcttcctgcattggtaaaagacatccaaggcaactaaagcaactataccttatactcacaatagagcatagtgaatgaaatgttctattctggatgtaaataacctaccatgtactcacaatagggcatagtgaatgaaatgttctattctggatgtaaataacctaaattctttagcatttagtttactataagtgataaaatagagtcatagctttatcttctctacataacagcaactttatctgattaggaaccacttgtcttatataaaatgtgatctttgactccaaaatatgcattcatttttgctttacttacgtgttttggtggtatacccgtgagttttattataactctcactgtaagactgttatatatgtagttatgttaaaacaatgtctttccaagccatatttttgatagtttttgtatttttccattaaataattatttaaaagttatttgttatgcagtatgccagtatcaggaatagtaggccaactgttaaaaatctaagaaggatgtaactaacattaccaggaaaggttcagggagcactagtttacagagtaccaaaaaactgtggtaaggttatcacctaccccttagtgacagagagtagccacccagaacttaacagctagggaatggatttcacatcttactagtagattttcaaacaaaactaacaagtcatagtctacaaaactgatcagagataggatttggattagtcccttaatattttagatataaacttgttgtcatcattcccataattcaaaagcaatgaattagtttcagttgtaatattatagcatcctgtaataagagaatgataaatacttagaaaacacaagggcagctgaaagctagacatagcaaatgctgtgttataaaaagatgctggtaaaataatttttaaaattgtttatttaataatgtccatgatgggactacatgaaatttattatttaaagatattgatatcttagtttctaatgtagaaaatgctggaaataaaataattcagattctgaagatgataataggtttttttaggctctgagaattataatttttctatctttgaagatgatattgaagatgacaattaaaatctttttttattgattgcatgtactttgtctacttgttcacacatttcctcatttagtcaattaaacagttgactgtatacttgtcattcttctaggtggtaaggaaacagtaattaacaaaacagagcttaaacttacattgtagtaggggagacaagcaagtacaaaataataattttaggtagtggtaagggtactgaagaaaaagcaggaaaaaggaagtagaaagtataggcagtgatcatacatgagaagatatatgtgtgtgtgactgtttttgaggccattcgatagaggtgatatttgaatatggatgtgaataatatgaaggagttgggcatgaaaagatcatggagaagagtgtccaggacaaaaatacactctggtgctgaagctaggaaaagcttgcattttggaggactagaaagaaaaccaggaattggagtgtagtgaattggaaggagtagggggagatgaaatcagaaaggtagagagaggccagctcacacaggattttgaaggcgatagtggatatttcgattttatactgagtggataagattggggaaaatgtgagggttttgagtgacctgagcagatttgtgttataaggttactctggatattctgtgaatcatgtagtgtagtgagacaaaagggaaaataaggaagatatttagaaagcagtttgtgctcctgagaagagatgatgatgtttagactagggtgatggtcttagaaatggtaaacagtagttgattttggagataatttatgtcacagccaataggacatgtatacatactagatagagtgaggtatgaggagtcaaggatgaatttttggcttttggtttgaacagctgggtgaatggtattgtttgctgagatagggaatgctggaaaggaactggttgatgggagtggtgggtaatgaagagttccgttcagttttggccttgtcagatttgatgtatctgtgaatatacaggagattttgagtgatcaaataatacagagagaaatcagggctgaagctaaaaatgtcttagttttcagaaaacagatgacacaatgccatgggagtaggtaagatcacttaagaaatgagtatagataaagaatggttgctaaggactgagtcctgggaaactccaatattttgagtcaagaagaggagaaacgacaaaactgggaaggaatagtggtgaagttggggaagaagcaggacgcatgcaagatctcaaaaaatttacctctcatacattaaaactcctaacaaaaggaagatatagaatccaggaaacagggactcgagcatgcttggattatatatcctttcctgcaaaacttttctccctggaattaataaacacttggcttttgtacttgtttactttcctatgcccttatcactattttggatccaagctatttaagagaactcaacattgcattgtctcaccatgtagtccaacaagtaatccgcctctctcctgcccctatctgatacccttcttggagccctcattcccctccagtctagatgtgttgccctttaggcctactgcaagctgcttggctgtcacactgggatttatcttcttcactagcctgttcactggcttgttttgggtatccctgattctttggtcagctctgaatagtatttacatgagtgtaatgatgtaaatattgaatagttatttaccagaactctgtgcccatggctatattaggaagcctggggaaggtgaagtttgggtgtgttgtggtggaggaggagaactgtataagagagtttaactctcatcttctacatcagggaatttgtagataatacctaaaactgaaaaatcaagtaatgggagtataggcatgttggatagaaatatggaatgaaatgtcagaagaaacatctacaattatctgtaccagttactggaacataatgagtgttcaataaacgttagtaaattctagatctgaataactgcaaagtacagctgataactccatattaaaaaaaaaaatgaatgtaaatgtatgttgagttctctccaaatttttcattaaattgtttccatttgttttcatttaatttgcttcctctgttgcttgatgtacacttttattcagagaaatacttgttttcattgcatgtgcaggcatgtgtgggaattctatccagtttattttagtatttggcatacaatatttttaactaaaatacttattgtttctttaaaatataagtattatggctactggtttagtaatttgctagtattttgctgtttgctatatatatatgcactttactaataatttacattgttttcatgaactatgtaagaatttacctaatttattttggtttcggaattgtactgaaatattacatttgcaaatattagtatttgcttttataatacatgtggtatatgatttatcagtaaacttgctgtgttttagcttactgtttagtagtatttaatgccattatattcatctttaacaatctaaaattttttaggcatggaagatgttgttatgcctttagaaattataattccttactggattacagcatattttcataaccacatgaaacttttcccctagaaggttgttaaaatcacttttagtatgtgaattaggaggaaaaaaatgggaattgttttatatacatacttgtcttagatcttggcaaaaatgggaaacctccttgaatgggtctaagaaatagccttatacaatagcaaattgaggattatggaatgtactaatgtaattagccatttcaaaatgctatcagacttttcaattagtctaaatatactgctctgtaggcagctgtataaaaattgagaaactgatttataggtgtgttattgatatagtataacagttttaattaaaagaataactcagtatttatacaatttaaatattttatcaatagagctgttgattcagtgctcttcttaaaattaaaattaactgtcttagataattgagatatatatttactctaatagaggaaaaatagagatagggttttatatatcacaaatatctgttctgacccacggttttgctaaaagagattgtgaaatattgaaaacatagtagtttgtttttattttttcatcacctaactcaaaagaaaaacaaaaatcctgatttttaaaatatgaaactagagtatttttaattcacaggttatattttacataaaaacttttatttaaatctagatccttttaaagcattctactcagttaaggaactgttttgtttcagtttctgttttgcaacctgaaatattctttgcttttagtggtattgttggaaatagtgcaactgcattattgactaccattgaagaaatgcatttgctaagcaaaaaaatattcttcaatagcttgagtcttcatgcaagtaaattaatggacaaggtatgtttgaaaaatgtaattattaaattatgtgaatgtttcacattaaagatgttttagtgatttttgtattgattgataacttttcccattacattctgtgttcttttgagttcttcctgtcaccaacaactttcattttgagatggcttactggacctaagttgatagtctttgttcctgaaacagtataacattgagttataattggagatggcatctcaggctccaattttactaccatttttttctatcacagaagttgtataattaaagcaaacttactgtatttagctgggggctaagatgacatacagattggaaaaccagaactcttacaaaatattttttccaaacagcttatatttttacccctgttgttacagttttgtccttatgaaatgtatgctcctctgagttatataattatttatgaaaacaaacaaggaaaaacatcccacaaaaaaacaaacaacaaaatcctcaaagagtcctgtaagatctaatatcttaaattgagcagggtattttggcaggaccttaaggaatagacttacaatgatcaaatccttctttatttttgtttcattattgagaacatgagtttttcaaggatgtgtcacaatcaccatgctggctttttaattgtactactctatctaataggctagctatattaggcccagattttgtaatatggtataaaatagtcagtagcaatttagtccagaatacgtggtcaatcttcactttcctaagttcagtcttcactttcctaagccttaataggagtctacttcctgacccacatgcatgactcagattcatttggaaaagcaacatgaatttgtggagctggaatatctacctttatttttcttgccttgtgtatttctgtttgcatcaacagtttactaacaatcatttctggttatatttgttattatgagttcttatttagacagaactcttctaaaataatttatacatgatacacaaacattaaacatgaacaaatatgtgctagctgttgagagtacaaggatgaacactcaacatctgttggcctcattaaggttgcttttcctttagtggaaaatgaccaaataagtctggttattatagaattctatgatttatgaaagacatgtgcctagggtatatgctagcaccaaaggaggagtatatttagcaaacttatctgtactcctttacagagaggaagctttccatagagagatgtaatggagttgaactttgaagaacaggtaggctttagataggtgaggaaaggagtgcatagaggtcatcttaaatagaagaaagaaatagaatatgctagaacatgagtatgagttacctataaaagaatttttcatttattaaaaaatatcacttgtaaagtgatgtgttttatatatataagtggggaggctaggttggaaataggaaaattaaaggagtattgaaactgtttttattcatacatgatctaagggaaagactctgggaataggcaagaggggacagattcatgaagggtaaaggtaaaatcttcaaaacttgatgactgaatgtgggttagtgagagggagtcatctagaataattcctaggctaatcacaaatatctagaatgcagaaagagggtacaatttgggagataaagatggtatcatctaagttagataagttgagtttgaggtgcctatgagagatccctctggaattggtctaatctaaaagggagtgatacatttggatttagagagttttacatataagagatagttgaattcatgggtttggatgaagtcactaggaataattttttttatgagtagagctaccaggacacagtcttgggaaacactgacgtttaagagaaggaaaaacgtcaacagtatgatgctgagagaggatggccagagaggcaggacaaaaattaggataaggttttatcagaaaagccaagagaagacagtttctagaaggagggcatggttaataatgacagatgcttttaaagagttcaagtaggaggcttgttatctttggcaatatatatgtgataggtgacctaaatgggcaattttagtcctgtggtggagataggagccaggttgtagtacgtagaaaagttcatgggtaagcatattacccaaagctttaccaattagaaaacatatgggcctcaagactgaaaatagatgcattaggcgtttgtattaaaaaatttgaaacagagcaataaaatgaagatatatggaaaggatggaattaaatttccgtgacaaattagaaaacaaaagcagaattatttgttgaaaagataaacaaaattgacaaacttctagcaagtctaatcaagaaaaaaagaaaattagaagtttttagaaattagagacaatccacagatgagaattaaaacttagagagtaccatgtgcagttttgtgctaatcatctgaaaatcagaataagatgaatgctttttaaggtgacataaattggtaaaatgtgagtcaaaaggaagtggaaagtgtgaatatacctaaggaaggaagaaaagttattaaagaacgtgttgccaggcctagttcagattatatagagaacttcattcatccttaggaggaacagataattctccagaacatgaaaaaatatggaaagcttcccagtttgttttaggtagtataacaccgacataaaaccttttaaagatagtcagtagtggaaaccatagattagtcactttttaagttttaaaacttcaaaattcagcatttatatattaaaaccaagaatggtttattacatgaatataagaatgtttcagtgttaggaaatatactaaatgagtatataaaataaattttatattctcatatttgatcacattggggaaaatcttaatattaaaacaagtcattgatgaatacttccttaaccatataaagagagataaaactaacagccaacatcataattaatattgacacactagtggttcttctatttaagtgaagaacaagaatgcttgccaatacttttaaataataaccacggtagaaagatgagataaagaaatgaattgtaaatattttaaaggaggagacattagattatttatggatgttatgatagtctattttgaagacctaggagaatcaactaaaaagctatacaaccagaaaatgaattctagtgaagtcgttggtgaaaagatcaatatacaaatgtaattaattttcttatataccagctcatgaggtgctcaataaatactggtaacatgaatggttcagttcattttctgctggcctatattccatcactatcttgccattagctttaaatctcttgcacccttgccattttaccacattcactttgcaaaaccaccttgagttaattcaatttttcaatttttcctgagctctgctaaagaaaattacatcatacagacaggaatcactaaaaattgtctccaacatcaggaaagccccccaggaggtccagcaaatactgattgtcctttggcagccactcacatttacctcacttattttcacccatttcctcaaatctaccatactacctcctactgaaaaagtgccaactcttgctaaaactggataatggacattaaaaaaaaatctttaccaacatgacgagcaaaagcgacattttgttgtttttctcatttggatttctgtgattctagtgagaatgaacattttaagatatgtttttggctgtttgtgaattgcttgttcaagtcctttgccattttcctattgggttgtcttgttcatttctgatattctttatgcattaagaatattaactccatcatatatattacagacattttctccacgttatcatttgcctttaaaatttgcctgtagtattttctgacacatcaacttttaatttttttatagttcaatagaactttttttatagtttttttcccttgggagcattccatgcttgaaagtattcccacaagaaaaaacatttagaatttaatatataataaagatagcatctattagtggggaaatgatagattgtttaatacatttatttagatgtattttcttaggtgtttctatgttttcactttatttatttttttaagcaacagggtcttactgttgttgcccaggatcgtagctcactgcagccttgaagctcaagccatccttctgcctcagccttccaagtagctgggactataggtgcatgccaccatgcccagctaatttaaatttttttttttttctgtagagacatggtctcactatgttgcccaggcttgtctcaaactactggcctcaggtgatcctcctgcctcagcctcccaaagtgcaggaattacaggtgtgagccatcacacctggccctagccctggtttcacttttgcaacaaatttttaatctactgaagtttattattgttcagactgaaaacttagtatcttattctttcccaagtggttatccatttattttattttattcccctaatagtaagtttctatatattttattagtcatgtaaaagttaaaatgaaagttgcaacaaaacaggaaaacatacagttgactcctgaacaacatgggagttatgatgctgacccctgtgaagttgaaaaaatctgcgtgtgactttcgactctcaaaatctaactgctaattagctattgactggatgccttgctaataacataagcagtcaactcattttttgttgtatgtattatacactgtattcttacaataaagtaagctagtgaaaggaaaatgttattaagaaaatcataagggagagaaaatatatctactattcattaaatggaagtgaatcatcataaaggtctttatcctcattgtcttcacattgagtaggctgaggaggaggaagaagagagactggtcttgctgtctcagagagtagcagagggagaagacaatctatgtaaatgtggacctttgtggtttaaacatgtgttgtttaagggtcatctgtaatggatagtaaaaggcaactgaaggatgacatcttccaattaaaactttgaacagaataggatgaaaatgaggaaagaaagtaattgtaatctgaatttattaattaccaatcaatattgcagcttatatgagtttatagcagtgaatgggctctgatcattattgttgttgtttttgttgtcattattactaattgaaccctggatgtttttctcagatatgaactgggccatatttagagttatttttacattagattgcgaccgtgttatgattctctttacaactcatatgttgcttgtatctacaaccatttcaggttttttgcaagaatatcttcctttcatcaaattttaatgttccataattttatattagttatatcttttacttattctgcttcttgtaaatgatttcacttcctctaaaaacactgtagctttatgaagaaaacaatatttattgtagcatgttcttcattagcaaagcacccaagtggaaatttttgttaatagaattttaagtgaatagtataattgttggaaagaatagcttttaaaataaaggtatagccagagaggaatttttaaaaatatgattgcttttgtgcttttaaaaagacatacttgggagctaattctttatctagcgtgagaaaaaggaaattcaaggacataattttattgaaagatgtaccttttccctaacaaagcagtttgaagcacttgagtattcaagtaggcatactcccttccttatcaagctctcctgaaatattcataactgcaaatctagtgaagtttaaagagaatatgcatctatactgcaaaagacacaatgttgtgtcaatttaggctagactgacattttctaaaattatttctcactatagtaatagtgcagttctaattgcaaggatatagcctgtcttaaatgaaacccatatcaagttaatagtagtcaggattgatttgcccagtcctctggagaaaaaaaaacaaaccccaaatgattctttaaataaattgtcatttaaattctaggatatggttactgctttgaatctctttttactactcatagcatagtatgtggattagcagcttgggcatcatatgggaacttactagacatgcagatatctcaggtcctgctccagacctactgaattgaattatgcattttaataagattcccaggaggttcatgtgctcattatagtttgagaggtgctgttctggttgaatagtttgagttttacattattccttacagatgattctgccaggaaaaacaaacagaaaaccaaattttttttatctgaaatgctttaatatttaaaaaaataaaagtgtgtaaaataagttgtaatttgaaattatttcaaacatgttagtttgcagtcctaaatttatcttggacaattttattgacttaaaaacttaaattccacatattgtcaattactagaatgtatgtatttagagcaaaaggaatgtatatatttatatatatgtatatacacacacacttcttttatatatatactcctttatatatatatatactcctttatatatatatatactcctttatatatatatatatatatatatttaaatatatatagagagagaatgaggaaattagtttaaaaatatgagaactttgtgtttggttggctagtctttattttttgaaagcaaatgggcgaagggccttctaagaagctacacaacagaaaattataggaccttaaatggaagatagctgaaagaataaaactaaagttggtagtgggatgaagttgtaggaacagcttttggaatttttatggtgcaacctttttatttttctctagtaaaagtcagagcacctaaactacagaagggataaaaagtaaatagtcacaagaacaatgaggacttttgtgtatagctctacacatttaaaaaaagagaggttctaatatatggaatatgaagttttcaatagcttaaatgctttttttaaaaaaattattgattgattaattgattgggtcagagtctgtctctgtcgtccaggctggagttcagtggtgtgatctcggctcactgcaacctcctcctcctgggttcaagcgattctcctgcctcagcctcccgagtagctggggttacaggcatccgccaccatctccaactaatttttgtatttttagtagagacagggtttcaccatgttggccagactggccttgatttcctggtctcaagcaatccacccacctcagcctcccaaagtgctgatattacaggcatgagccaccatgcctggcctttaaatgcttttaaatgtgaaatttttctgtatacttcaactttgtcacttagaaaatattcaaattttgaaataagtatttaataataatgacttgatgtttagtatgtacaataatataaagaagaagaagaacaaatgagctcacttttttttttttttgagacagagtctcgctctgtcaccaggctggagtgtaatgcacaatctctctgctcactgcagcttctgcctcccgggttcaagtgattctcctgcctcagcctcctgagtagctgggactacaggcatgcaccaccacacccagctaatttttgtatttttagtagagacggggtttcaccatgttggccaggatggtctctatctcttgacctcatgatccgcccgcctcagccttccaaagtgctgggattacaggcatgagccactgcacccagccaagctttatttttaactgcagatatagtacccaagtctaaagtatacagttagttgaatgtttgtatttgcatatgctcattagctatcacccagataagatataaaacatttctagcccttcagaaggcatcctctttccccttcccagtcaatatctaaccccggtgtaaactgctgtctgactactgtctcttgttttgcctgctattaacttcatgtaaatagattcatacagtgtatacttttttggccctgacttaacatatctgtaagattcatatattttgcatgttcagtagttcattttttaattgttgtgtagtaatttcattatatatattcaccacaatttactcattctgttactgatggacatttgggatgtttctagttcttggatattgtaaataaagctattattaatagtcttatacatgtgttggtggacataagtttttatttctcttgtatgtatgcccagaaatggaatatctggattataagattgattagctttactagatattgctaagtatttttccaaagtaattgtcctagatcacttcaccagaaatgtgggagtttcagttgttccacattctctccagtacgtgatgttgttagtctttttaattttaggcattgtagaaagtgtgtggtggtatttcatttgcttgtagtttgcatttttctcaagattaatggtgatgaacaatttttcatgtttattggctgctggatgtactttcttttgaagttgtcttttaaagactgttgcagagagtccttactgggttgttacctttttcttattgacttataagagttttcaaacatgtgtttggatacaagtcctttatggaataataagcatcacagatattttctatcactttttgaactgtcttttcactctcttagtcatgtattagattaacagaaattctcaatttttaattcagtcttgtataacaagcttttatttcatgattagttccttttgtgtcctgtttaagaaatctttggctatctcaaggtcatgaggacattcttctgtatttttctctaagaagcttgattattttagcttccacatttaggccttcaatccatctcaaatttttgagtatggtatgaaggtaggggtcaagtttaatttgtgtgtgtgtgtgttgtttaaattactttattttccttgctttcaatttttcttgcctttggccttgatccgtgtcgtaatgtctggtaaaatataacaatacctaataccatgttctcatagtaggtcttcaacagatgtttgatagattgaaaaactagaagagccttagaagctaatcttctcagtcatctttgtccttagctacatatgtatttcttaggttacctgagacttttatgtttttttccagttaagttgatatttaataattggttgtcttagtaccagtagtgtagttgcaggtggtttttgtgctgcgatgcaggtatagcctttcttaaattaaagattcagtctgagtttgttggggatacttatctcgggtgagcaattgatggggctccgcattagaaaggcaatatatggctcaaggagaaatcctgggctttggagtctgatagagctgtactcaaattctaacttttccaatcattatgactttcagtaagttgtcactatgtaattgagtttttactaaatgtaaaacaaagaattacggcacagtcaacgtagattaacctgccctaggtcacatagtcactaagggtgaatatatatccaggtctgcctaattgctaagcctgtgcctacttcctggtggatgttccatacataatagttccttttaacattttccttttatttatttttaatttttataaatttatgagatactaatgcagtcatgttacatttatatattatgtaatggtgaagtctgggcttttagtgtaatcatcacctgagtactgtatattgcacccagtaggtaatttctcatcccccattcccctcccaccctcccaacctgtctgagtctccattgtctattattctactctgtgtccatgtgtacacattatttagctcccacttataagaacatgcaatatttgactttgtttatttcacctaagattatggcctgaagttccactcatgttgttgcaaaagaaatgatttcattctttttcatggctgaatagtattccatggtgtgagtgtatgtgtatatatatgtgtgtgtgtatatgtgtggtgtgtgtgtatatgtgatatgtaacacatatatgtgtgtgtccacaaatatatatgtgttatatgtacacacacaccacattttctttatccagtcatctgttgatgggcacttaggttgattccgtatcttcgctattgtgcatattttcatgtggatatacacttgatccagcaccatttattgtaaaggccatccattcccactgcagtgaagtggaaatggtcataaattacatgaccatgtatgtggatttgtttggtaattgtgtattccattgatttattttagattatttatttattccattgatttcattttatttagaatcaacttgtgcatttttaaaataaaaaagctttctgaggctttgattaaatctatagatcagttgaggagaaattaatatcttaatgataccaagatttccaatttatgaatatcatatatctctccatttacttaggtctttagtttctctcactaacctttcatagtgttcaggccttgcacatctttggttagatttattcccagatattgagtggtttttttgatgcttttgaaacttatttttctctttaaattttattttacacatatgtatttctagtatagagttgattttgatcgttgattctgtttccacatacctttaaggcagtttgtttttgagtgcaagagtaagccattgaagatttggtctcacatcttcatttttgaaagcattttaaaaatatcattgggactgctgtatggagaatggaaagtgggtatggaggagcaaatttggaagaaaggagaccacttaggagactcttagagtaagtaaacctggcaaaagtggcctactatagagtagtagcataggatgatttggatcatttgcatttggaatatattttaatggtttagagataattcagtaaattaaatgagggaaatgaagaaaagaaaaaaatcaacaaatacttttcggttgttgatctgattaattggatatcattaatgcttaaatacccccatttaatgtttgtaaaataaaaagtgataactattgttcctactcccttttgtatttcatacaaactctaagttctttagaagatttttcttttttaaatagggcagtgaagacattagctggttcttttctttttttttttgacattagcttttgtttttgacgaaagaaaaattttaactttaccatataatgctaatttctgtcttttaaaaaatattaacttataaaacagcatatctaattttacttttgtttaagattacattggagcccatgagtgggcttctattaatctataattgtttctgtaattttccatgtttatcttttttttttgagaaacaaatggtaaactcaatgatattcttaaagaagtctgccttcctcctccacctgtaacatgtaagaatcaccggtttgaaaagtttaaagcatatgagtcacaaggatataaaattagctagcaaaatttcaatgtagcaaaacatttaggaagaaaggatgcgttatgtaaacttgaagaaggcctcaaataggttgtaagatactggggccattagtgctcatagacttcaatgtggtcacgatcttaagaaacagctgttaatagcaccttatcatagattccctacagaagaatctaagagctacagcatcctctctgaaaaaattaactttatagaattcaagtaaaaatatcacctatgaaaatcaaaattaacacttcggtgtagtggttataagcgtgacctttggagtcaatgcttgggtgagagtctaagctctgccccttctaagaacagtgggacctttggaaggttatttaatctgtccctactttagtttcctcatatataaaatttgatattattccttcctcctccttctcatcagtcttactcatcttctgtaaaatgggaatgatatataccttaggctcattaggattaaatgaagatcacatgtaaaatacatggtacagtttttagattattttttcacattacaaaatactcattttgaagatagaaatataaagaaagtttaaacatgactataggtaacattcagcatttttaatatttcagtcttttaaaaatatgagtgtacacacacctgtacacatgatgtgcatacagttttgtctttgtttttgtttttgagattgagtctcgctctgtggcccaggctggagtacagtggtgcaatctcacctcactacaacctccacctcctgggttcaagcgattctccagcttcagcctcccgagtggctacgattacaggtatgcgccaccatgcccagctaatttttgtatttttagtagagacggggtttcgccatattggccaggttggtctcgaactcctgacctcaggcgatctgcccgcctcggcctcccagtgctgagactacaggcgtgagtcaccatgcccagccctgatgtgtatcttgcatttttcatttaacatattattggggcttaataaaatcttaattcttttttttggaaacatctttaatactgtacttatggatcccattcttccacgtagaagccagttttagatgaattattttagttcattttccctattaaatagcatttataatgccaaaatattccctcataatactgttggaacatgtctgttgtccagaggcttattaagaaatgacttactgtttagtcccttggtatttcaaaacaattgattaaatatgtagtggtatatgtatatgttttatgttgtaactatgctgcaggaacataaattgaatgtaagtgaccatagtcaacagtttttattgatatccattatgcttaaaacattgtgaaagatagagcagttaagaagatatgtgcctgaaataaggagtctaatctgtttgaagtagacgttctcacatgtcattttagtagccttgtactttggatttaaaaacaagcaaagatgtttgcttattgtccctaagggagtatgctttgaatataaccagttattttgtatccattcattcacatgaacctacttaggttagtggaacataaccatggtataggtatttggaagtaatgtggccatgtttgcaacaaagcttacctgcccgagcaagtacttgcatgcctgctgtagatactcagcgaagtgtcatgtggccaacgtcaggttacaactctagttaagatttttgagagtttaagatcatgacaaaaatagagggaaaagtcaaacatacagaataagaaagagggaaatctttatttgtaaggcaaaagttcacattttcttcaactttctgtcagtatgtaagatttctatgaatagctcaagtcctggcataagtagcagtgataatattaacacctctttctcccagtcacatcattctgaggatgcatctgccactcacttactgatgctgactggtttccaaggaagtggagtgtgaataaacttggattttctacacagcttaaagcttataggaatttctgtattatgattattgttttacatgaagttcataaattgtttgtttctaatggttgctactacctgttttaggctctctaaataacaaagcccacttaattctagtatttggcctccacagccttatatggagatatgaaagacatagtaaagagggtctcttccctaagggagattatggttagtataaagtaagtgcaagaatgcattggagggacttcaaaagaaatatagacttggccaggtgcggtggctcacgcctgtaatcccaggactttgggaggtcaaggcgggtggatcacgaggtcaagagatcaaaaccatcctggctaacaaggtgaaaccccgtctctactaaaaatacaaaaaaattagccgggcatggtggcaggcgcctgtagtcccagctactcgggaggccaaggcaggagaatggcatgaacctgggaggtggagcttgcagtgagccgagatcatgccactgcactccagcctaggcaacagagtgagactccatctcaaaaaaaaagaaaaagaaatatagacttgtctcttacaaagtttaaccattagaaatgaattttacaaaatgaaactaaagtgacaaaagtgagctatttctcctccttagattttctttctgttattctgctacaggattttatagtcacaaagtttgtttatctgaaaaactgccataattttcacttagctttagaagtgtggttcttaccttgttgccgatctaatggatgtgtgtaaaaacacctcatagaatggcagtttgttgaatgacttgagttcaagtagcactcacttgcaatgatttaccatcaactctaactgtggcaaagtgtgactttagccttaaatttaaactccttaaagaccttatttcaagggggaaaaaaatttcctttcaactttctcccatcagtgtgtaagttttacatcattggtcttctgttttgtttggcaattaaaaatctcttgtgttaatttttgaaagtttttttttttaagatttattgcttccaagtgcaacaaaaataaaaataaataaatgggatctaattaaactaaaatgcttctgtatagccaaagaaataaccatcagaggaaacacacaacccacagagaaaatatttgcaaactacgtatctgaaaaaggactgatatccagaatagaaggaacacaaacaaatcagcaagaaaaaaacaaataatcccatcaaaaagtgggcaaatgagatgaacagccatttctcaaaagaagatatacagatggctaacaaacatatgaaaaatgctcaacatcactaatcaaggaaatgcaaattaaaaccacagtgagacaccaccttactcttgtaagaatggccattattaaaaagtgaaaaaaaaaaccatattgatgtggatatggtgaaagggaatgcttatatactgctggtgggaatgtaaattagtacaacctctatggaaaacagtaggaagatttcttaaagaactaaaagatctaccattcaatccagcaatcccactactgggtatctacccaaaggaatagtagtcattatatcaaaaagacacttgcacacatgtgtttattgcagcacggttgcagttgtaaagatatggaaccagcctaagtgcccatcaactaatcagtcgataaagaaattgcaacaacttgaatggagcaggaggccattattctaagtgaagcaactcaggaataggaagccaaaaactgtatgttcttacttgtaagtgggagctaagctatgggtacacaaaggcacacagagtgatataatgtactatggagactcagaagggggagaggatgaggagtgagggatgaaaaattacatattgggcacgatatacactacttggatgatgggtgcactaaaatctcagacttcgccacagtacaatcatccatgtaactagaaaccacttgtacaccaaaagctgttaaaatttaaaaaaaaatttttaaagatttattgcttccaaaagacactatatactcctctctctctctctctatacacacacacacacacacaaacacacacatactatatattatagtttataacctagaagagaaaattacacattaaacatttaggttcttaatcatacaaggtttgtagttctactagagctgtactcctcatctagcttccctggaggatttattagatttttttttctgtttatgaaaggtattgggaactgacacataacgtgtttgctctggtttctatagctgtctatttctatattatagctattagaatgctagcagatctttctgatttgttctaagctaaagattccactgaaaaaaatttgagtatcttcagtttatatttcttatgtatatgcatgcacatatatggaatagctttatatttaaatttttggaattatgagtatgttgatttctattaaatgtatatttatttttaaaaacaaatggaaacacaagaaaataacactcatctacatcctgtcaccctgaattgactgttattaactgcttggtagttggttgtttcttttagggggcagagatcactctattaattttgtaaaactgatatgcatatatttatacataatttaaaccatggagaagagcacaaagatgaaaatttttaaaaaaccctcttcttggaaataacattagttaactttattataatcagtttaacaacagtctggatatcatttgaagtaggaatgataaatagaatacttttgtgaagaaaagatcatattctggaggttttttttaagttcacatttatttgaatctaatgaaagaaaaggagacaaaactgaagaaactgtggaacttgaaatatgtatctcttcacccaagaaatattttccttcaattttgtaagttttggctttatgtgttttggggcttttttgttgggtgcatatatgtttataattattttattttcttgatggattgacccttttatcattatcagaatcttttatttctagtaattttgttttaaagtctgttttgtctgatattagtatattagtgtagctaatttaatctagctttctttcagttattgtttgcaacgtatatctttttatatccttgtacatctaatttatttttgtcttaaaagtgtgtctcttgaagttggcatatagttggtacatggtgtggtttttcaaattaatctgctagtctctgctttttgattgtcatgtttaatccatttacacttaatttaattgagggtagagtaggatttatgtctgcaatttgcccttttgttttctgtatgtcttaagtgatttttttttctctgtgtccctgttacttcttttacactgagtagatactttctagtctactaatttaattcccttatttaaacatatatgtatgtgggtatagggttagttatatttcctgagtggtgccctgggaattacaattagcatcttaatttataacaacatactttgaatagtatacaaaaactttgctcctacatagctccattctcctcttcctttatgccgttattaatacagttaaatcttattacattgtatgcccatcaacatagacttataattattgcctcatgcagttttcttttaaattagagttatgaacaaaaaatacattaaaactgtcttttatagttatctttgttggagtcttgaccagtgctctatttctttatgtggatcgagttactttctagtgtccagttttccttagtatgtcttgtagggcaggtatgctagtgaagaatttttgcctttatttggagtgtcttaatttcccccttactcttgaagaatagttttgctgaatttgaaatacttggttgacagtttatttcagcctgtgactatgtcatccaatatgcagacttctggcctgcatgttttctggtaagaaatcagctattgatcttgtcaaaaatccttgttcatagtgagttatttctttttagttgctttcaggattatctgtcttttgacagtttgattatgatgtgtgttactgtaggtctcttgagtttatctttcttgggggtcagttagcttcttggatgttgattaatgttttttaaagtcaaaattggtaatctttctgtcattgtttcttcactgcctttttttctttgttctttccttctgggcttcccctttatacttatattgttaaatggtgtcttatctctgatgttctgttcattttttcaattctttttctttctatttctcagactcaataatctttaagttcctgtctttaagttcgctgattatttattccacctgctcaaatctgctgtaaggccaagcacagcagttcacacctgtaatgatagcattttgggaggctaaggcaggaggatcacttgagcccaggagtttgagaccagcctgggcaacatagcaagactaccatctctacaaaaaagaaaattagcgaggcttggtggcatgtgcctgtagtcctagctgttaatacttgggaaactgaggtgggatgatcactcgagcatgcagtgagctgtgattgcaccactgcactttatcctgagtgacagagaaagaccctgtcaaaaacaaaaaacaaaaacaaaaacaaaaccctatagttaatttttcatttcagttgtgtactttttgactccagaatttctctttggttgtattttattattcctgtctctttattgatattctttatttggtgagacattgttttcatactttagttcttcagacatgattttcttcagtctttgaacgtatctaaaatagcttgtttaaagtctttgtctagtaaatctaacatctggacttcagagaatgtttctgttgaggtgtttttctgtgcatgctgtgcatggactatattttcttgtttgcttgcatgttttatgatttttttgttcttgttgtttttatgaaggagagagtatttttggacatgcttactttgctattcctggtgatgtcacttatgtattaactttctacatgaaaccatcttataataaatgccgatatttgaaaattcttacacctttctgcctacctgccactaagatgtagtctcttacattgtcttctaagtgctatttttaaaaaatttacaaaatgttactttattaacattgtaagtattctgaaaatatttttaaagaaattcataggcacttctttttatgtatcatggtgccaccaaataaggatagtgaacttggcataccttctacttagtaagtgcaaggcatgttactcagccatgcaacaatctcatttaatatttacagagtccctctgaagctctgaaaacttaagtaacttgctgaagattacacaactagtaagtgatagatccaagatttgaacttaatgtgtttaactctagagcccaatatattaatggtaatgttatactgtttctgtgaagtgattttcaaaatgtgggacccatgggttaccttcttgagagactcctggggtgcttgttgaactgtcaattcctgaacccctaacctatacatattgaactaaaatctctgaaatttgggcctgagagtaggtgacgtttctcaattatattatagttggaatagtgctggtctatagactgcttttttcttatgatttgggctaaaaaataaaacagtaggccattttaaatccatattaaaatgtaattctacaattcaattgaacactaacttttcaaattaattttttgaattttagagtacaaggtgacatattctgagataatctgacaaagaacttttctctcactttgtgtgctgttaatatagttcaaagtaagctattgataaattataggtttctaatgtgtgagtctgtgctttataacttttacatttttttttactatgaacttacatttatacattaaaatttagtggaaaaaatataaggagtgggtaaatcatctcttgttttaggttgaactcccaccacctgatcttggaccaagttctgcactaaatcagacactcatgttgctgcgtgaagttttagcatctcacgattcttcagttgtaccattagatgctcgtcaagctgattttgtgcaggtatgttataaattcatttttaatgattgttttttgctcttctattgtacactgtgtttcaattctggaattttgtaattcatatactttgacagtctctttcttactgttaattttccatcaaatattaaaccagttatcataacttaaaaagcattgatttatgtttaatcttttcctacgtgcttctataaattggcttccttccaattagtttggcattaaatatcattaacccaagaccctatcagtgattgagaaataaagagttcattttatttttcatttgtaggttttatcatgtgtcttggatcctctcctacagatgtgtactgtatcagccagcaatttaggcacagctgacatggccactttcatggtcaattcactatatatgatgaagacaacattagctctatttgaattcactgacagacgtctggaaatgctacagtttcaggtaaatttttctataaaatgactattgactatgattgaatctttttctctatgtgatagctttaagttattggcttaactagttttaatgacctaattcctatagatcccttgatatcatctgatgaaaggacacacatgcatatacacaacacacgcacatacacaacacacacacacacacacacacacacacacacaaattcagtatttcagttttcagctttagaggaaccagaatgtgtaatgtttaaaatacttgattcataccataatatgtgatagtagattgaagctttctgattaatttgaacagttagtctgtatgtggattttagtttctgaactgtgaataatatgctatatttttcaagctgcatagttaatgcaaaatgtgttacagaggacagatatatttttatctatgtgtaaaccagtgttaggcaaaacattacaaattgctataccaaccacttgagttcttgagtcctataaagcaaatggttatcacttaagagagtatatgatgactaaaacaaagccagttgtaaaatttagtagatagttggattccagttttaagcagtgattattggtaaatatactgttttttaaaaaaacaactctgaatgttctgtgctatcacacatatatcaacagtttgacagtgggtataggaatgagttttgatatatctaaattcatattttctaatttttaattttttcttttaaaataaatgtatcagaattttccatatttgtggtttaaagtcaaataattctacagaacttgttacgaaaagccaccagtgtaccatcctctccacccccaacatctctttctcatttctccctcaaaagcacaatttctttcagtttttatagttgcttcttttggtatttatatttgtaattctaaacacttacgtgtattgctacttatagattttttttagttttttgtctaatgtattaaattagatatattctaatacattgtgaaatgaaatgaacaatgaaaatttagttatctactgccactcccccaacccccctggataagaatatggtcatacttaagagttttcccatcctcccaatgtagctatattataaattttggttagatcaatgttttgttaaattattattactatgtaaacattattggtgactgagccatgtaatgaagaatggttaatttacctttcttggataacttcttcattttctgtggaattaataacatttttatttaagaaatgtcacttttttatgtatttgtcactaattcaagcccaaatccctgccatttatctaaatcttaagatgttaagatatgtcaggtgtttatcaatttgctttattaccaattatctatgtttcttatgtgttccatagctattttacgcatggtaaaaattcttcttggtctatgtgctaaattaagcttattagtttattcaagttatctatgtccttgcttatttttgccaccattggatgtgtcaactggacttttacatgtgttttaacattctccagaaatctcttgagccagatctttattagtcctggcagcattttcagtaattgttctgtcagcagataattcaggttcccctttctccagactccagtagcaattttcccagtgccctttcagaccccactggcagtcccttgagtgggtattccaagtggacaaatcccagtgtggaagtgcttattggcctattcttgcattatgcttgtcagagtgctgtcagccaagactggccacatagaacagcctggattcggtgtgatagaggacaatacaaaggtgtggatatgtgaaggtgtggtttatcacgtttctccaaagtaacaatttaccttgttgggtaaaggagtcttgattttaggacctttactaccaataacctattatttttttcccactcttatatagcttcttccagtgtttcaagcaagaagtccaggctagtcagattctcttgtttttagtaatctagtcccttcatctggtaacttacagggattttccattgagtttatatgttttcccaggatatttttggtatgtctctttttaaaaattatttgcatcttggactttggagaaccatttcaatgtaaagattcaaacctttcttttgcttagtaaagagttctatttctttaatcatcacttttctatgtgttactttttatattttgaagcccctgtccttggttggttttatctcacggatctgccatctaatttctttttaaatctcttcactttaatctatttctttgatatttgctctgtattactttccttccatttttctttcagaccgctgatttgatgctttgcagtaactctttttcaccttcattgagtgtttacctttgcgcactttgtttttctttggtttctagtaaatccagcaagtaagggctctaattgtacttccttgggcatttatttaaaaaaaaaaaaaatgaaagtactttatgtctttcagtagtgttgcctcaggaaagaaaccatacttgttctgattattcacaagggctttcttttagcttcctcacctcttttaaatcagttctaagttttttagggggacgagcagagctattggagttgcttggaaaatggcaatcatttagatggtaacagataccatagttgacagtgtactatgtcattagcaagcaaactggtaaaatctgggggaacattctggtgaggaatagaaggaagacctctagactcaggattgtactggcacaaaaaaaaaaaaaaaaagaacaagattttttctcaccagggaatgtttcaacccatcaaggtagttctcttctgtggtttttatctccattagcattagttggaatcccccaaaatagcacaaagctggggagcccatactactcacatctgttagctgcatcttcttaggcagttcctgaacctgaaatctttagtcaagtttctactgggccctcagctcttccctacttgtcacagacctgccttatcctcaggagaatttactacctgagctgtagtgggatttcctctaggcttctccagatggtatatttgatttgttaagtcagtctagaaagttgggagcgtgaggaggacaggaggtcaggaacatcaggcccttatctcggaattcttcctaaatattttattttatactgttgttgtttactagtgttttttgtttgtgttttgtttattagcagcttttaaaagggctgagaagcaacccaaattttgtgactggaggatagtcctagaatcctccttgtttataatttttaaagtaagactttttccccctttcatagaaagacttactgtttgggggaagaaagaggctttgttacagaggtgatccctgtgcctcatcatcagtgccaatgcaaggcactgcatctactctcatcagtgtcattcttcttttaaaatgttttctttgtgttttattttagatcgaagcacatttggacacacttataaatgagcaagcctcttatgttttaactagggtaggcttgagttacatctataacactgtacagcaacataaacctgaacaggtaagtgcatagatgttccttcctaattctaagaacatgccagtttagagtatgtcttctagagctgcactctggattcttggctctaccacatattagctgtgttctcctgggaaagtgacttatttttctgtatctgtttccttacctgtggattgggggtaataatagtatctgtgtcataggattgttcttaagacataatacatgcatagttcttagatgacttcctaaaatatggtagagtgccccacagtattaacaatcctttttattaaaaatagtttttgttaaaagtaatgaaaatatacaaaaattagtattataaaatgtctaaagaatattcatactggtaagtttttcagattcctatatcactattagttaattgaatgcatagattactgtataaatagcagtcatcttctttttaatttagcaaattgttgcccattactttgagaaggtagtcacttctggggccagcatatgatcttattaaattatagaaccctagtagaaataaaggagtggtgggaaccttagaaaaccatgtaagccatctttcttaagaaagcaaagaactcattcaaacagcattaacatgaagactgtgttatggcccagaaactcttaaatgaagctcttaaaacacaacttttcaattctttctttgctgaagtggtaagcaaatttctaccagtaggaaccaattttactgcctttctgtactttctaaaagtatcaaagtgaaactgttcaagcctccatgtgtcactggcatcttccagtgcttcattgccttcattttcttgggtatgcgtaaacttgaagtatcatgatatttctgttgttaataaacttgagcacgtcttgctctctccaacaaatcatagtccctgatcttattgaggttgaagaaattacacttgagttctttggaaataagctaaatgattttccaaatttgggcagtgcactaatgaactatattcagtaagtgaaatgaaatgtatatctccttttttacatcttggatctgcttttttttttttttttttaaatagggctctttagctaatatgcccaacctagattctgtgacactgaaggctgcaatggtaagtgtataataaaacattttaatttagatttccttatggatcgatagtcttcattttttgctgtgtgataatttcattctgggtgacactttttatctcttgacatgctgtattaacgttgggtccaataataatgactgagcctgtattactttaattgaacagttctggccaagtcttacattcatagtagtgttccactatgctctgatagtctcatcattactgtttaggattactgtttactctatttttagagttttgttcctaatttaagtgagaaacaggaatgacagatatgaagaaattaggctgtatatcattataaacttattactaccttgatccttcgtttaaagttcctgacgtgaaaatcgaaattagattccactcttaaaacagtttattactctttagtttgagactcactgaatttccactttattaccttccttcttttcaggtgaagatcttgtaccttcctttttgcatgatcactactttttgtagtgtgtttctgtgtcttaaatacatatactttcctcatatgtatagtgttcatatgcatagccattcattgtatgatatttaagtcatatagctctatccctcataggaatgatcccttttggaagttttatgatagtactactagtaatagtaataataatatggaagaacaacagccattaacattagcatagcaagtgttttccctgtattaactctttaatcctcatgacaaccccattcaatccaggaagttggcctacagagcttgtgggtttaactactgtactaaactagtgatcctaagtatttaaaatactcacgtatactcactaccacaatggcctgactttcatagatagtcctgtaggaaggtttttaaattttccaacaatttttgatgccaaggctttcctatatattatcttccagaactcagtttaactgaaaacaaaaggataggctcataagatacctaacaaatgcaaagaagaaggtggagctatctatatgattattagataaagtagaatttaaaaagactaaatgagacaaataagaaacattatgtcgtgataaaagacactatatagaagcaacagttataacttctatatatgaaacaaaaacatagtagcaaaaattagaaatgcaaagaaaattcgatattaaaaagtttaaataaaaatagatgaaaatgaattttagattcattaaaagatatgtttttagaaagttatatatacacttaccatactatccagtacaattccacttcaagatatttaccccccaaaaatgaagatctatgctcacacttagatctgtaacattagttagtaccaaatatatgttcccttcctctgtttctccttctctcttgacacatatccagtctgtaatacaactcataaaatatttgaaatgccattaaaaattcttcatgttcctggtgttaattttcagaacaattaaggtgaatatgaatatacgatgtctctggagaaacaaatcttgcttgagttttgtatttaatacgtgattatatacaaccatttgttgtctccatttaggggtttctaaggcacttcaattcagcatgtccaaaactaactctgcacattccaccctaaacctaagtcctcttccaggcattattaactcagaaaattgtaagaccttctatccatttatcatttaaatagttattaaccgagtttctgctattttctaggcatcatgctaagaattgggatgaaaacagatatgatctagtaagggatgcagctactacacaaataaatgaatgaagagtacagttatgtgttatgataatatggtgaattaattcatacatatccaaaatctgggagtccatcccttcattctatcagtaaccaagtcctgatggtcctcaaatatctttacgtctttcaccttgattgcccctatagtctaaaaatgctgcagtaggtacctaaggtacctaattggtgtctttgtatctattattgcaatcttccattctgtcttcctatggccagatttagcttcttaaaacttaaatcagatttctcccttacttaaattcaatggtttactaatgcttttgaaataattaaaatccttaaataagcatgccagtcctacatgatctctacttatatgttttccttcccacctcaagtcttcatgctgtctcctctccctgaacctccccacccatcaatccacttacttaatgtatattcatctttaagatttcacttcaaatgtcctttcctgagagatgcttttgccgaatccacagactaggtccttgatttatgctttatagtaccttgttttattccttaatagcatttaacaaaatttgtaattatatatttatttatattattatctgtttaacacctctcttgctaggccataagctctgtgaagctagggactatcctttttttgctcatttttatacttccattacttaatatagtaccttttcaatggtaggtattagttgaactaatgaatgcattaatgaacaaatgaacaaatatagtaaaatcaagaaacaggtagacctgaaacctgatgactttacttcttgttaatattattacttaaaagctttgtgaggaagactaaaatgaatggtttggattcaggattttgaaagtaagtattgctaatattgactatattacagatttgacagttttagggagttttagttagaatgtttagaaaatacacaatttgaacacaacaatctagttatttagagtatggaatttttctcaaggatttaattcttaaaagagatgtttatatttgagttgtttgttagcacatatatgtactttatattttgtatttctctgtttcatttaggttcagtttgatcgttatctgtcagccccagacaacctattgataccacagctgaactttcttctaagtgccacagtgaagtaagtatttttggtcccaagtagttggtaaagattcacatatttttaaatatcaagtacatttttttggaaaaaaatttattttcaagaataaatgatttaccattgaaaatctatagttctcaacctttcttctgccttggcatgccaaaggatgagatctgaacatgtctgtacttattccatgtctatatgtcactccaaaatctctaattagtacatgattgttaaaattactttgaatataattgaagctatatagctgtaataccaaattcccttacgttaacaaacatgtcagaataatgttgaatatgttatggaaaatcaataatatattcattatgcaatgcagatgaactgatttatagactattttgaatctaaggtagtgttctgtagatataaaattactcaatatcatttatcaggaatgtattcaggacaccaaatcatacattaaaatattagaatataacaattagaagaagcggagagattatatgatctttcttgattttaagaaaaatattggcaaaattgtctataggtaagaaattaggcaacattatctacacatttttttttctttctattcaaacagcagtgcagtaagtgttttctacataacaggcactaggagttaaggcttaaaagacatttgcactgttttcacggagcttataacctaataggtcagttaaacatgcgaacaaatatttacattgaaatgtacagtaaggaaagaactattgaacaaaacatttcagatatctaaaagaatgtaatgttatagaggtgatatacttattttctgttcttgagtatagaactacagcagaaaatagagcaaagaagcagctttttaactcaccatgcagaatttggtatcaattagaattggctggaaatctatggaccactttttttttttttctcagacacagagttaggaaagttccattttaggtgagtgactagagtaaatgaatttaatttttttttgtgacctttatattgtattattctaaaagatattatactatttacataaccagaattctaaagacttaagagattaccaaagaaactgttatgctgtgactcaggttgtttgtaggtgcttcttttttttttttgagacggcgtcttgctctttctcccaggctagagtgcagtgatcttggctcagtgcaatctctgcctcccaggttcaagcgattctcctgcctcagcctcctgagtaactgggagtacaggcgcccacctccacacctggctaatttttgtatttttagtagagatggggtgtcaccatattggccaggctgttcttgaactcctgacctcgtgatccacctgcctcggcctcccaaagtgctgggattacaggtgtgagccactgcgcccggccaatgtgcttcttaaattattaaatttttaactgaatacctgtaattctttttaacttaactgtgtctcagtacgtaatattagaatgttgttagccatgtcactacatgtgaaatatactgttattcttttcataatataatgattgaagagagattttaatgtactttaaaagatgacatgtagctcagatgctgtgaagcaggggtccccaaccccgggccagggaccctggtctgtggcctgttgggagcacaaaccctactgtgaactgcgcctggaaggatctaggttatgtgctccttatgagatggaacagtttcatcccaaaaccatcccccaacttcttgtccacggaaaaattgtcttccacaaaaccagtccctgctgccaaaaccactgggagctgctgctgtaaaggaaacagatggacagatttggctctgtaacattttaaggtttttacagaaaaagataatataaactaagttgaaatataaacaataatatggaaaaatgtttgcaaaatatgtaacagataaattattcttaatatattatccttaatatatagtaagatcctataaattcatacaaattgtagaaaaacaggcactgaatatttgaacaactcacagaagtaatggaaatggcaagtaaatatatgaggaaatagtaattatcaaaaaatgcaaactgaaacaacgagaacttctgtctatcagactgctgacaataaaacatttattacatactaatggaacaggtctgagaaagtgggcattttcacacttttttgaatgagagtataaattagtacaatcttttcaaagagcagtttggcaacattccacaaaatttcaaaattatacattcttaggctcttctaaaattttatttttctttcttagtcttggtaatagtttaaaaaaactgttgaaccagcagtgggattgagtattgtgtatggatctattcgagtcgtttgcctcagaaacttgtcagatttcctaagcttaaatcatttttgaaattaaatgtttgtcttccattattgaagacaatattttagtttctcctttacttttattgtcctgttgtctaacggtaacaatgtaaactttgttattttattatcagacaaatgaacaagttttggtacttttttttaaatgtgaatttttaatttagtttttaaaattattttatgatatgtgcctaacatcctattatgaattcttactatttataatgacatttaaaattgagatatgcatattatttatataagtattaatactacaaacaagagtttgaaatttcttagtacctatttacctctgttttcattcagaaatatttttaaatgttatatgcaaagtattggaaaattaaatgtgatctgcaacataattttcaatatttgtttagacgaacagaaattatggtataaatttagctacttattttcaaatcaggattgctttgaaaatatagggcattttacatatttaagatttaacgtcaggccgggcgtggtggttcactgaatgcctgtaatcccagcactttgggaggtcgaggcaggcagatcatgaggtcaggagttcaagaccagccttgccaatatggtgaaaccctgtctctactgaaaatacaaaaattagcttggtgtggtggtgtgtgcctgtattcccagctacttaggaggctgaggcaggagaatcgcttgaacccgggaggtggaggttgcagtgagccgcagtcgcaccactgccctccagcctgggcgacagagcaagactccatctcaaaaaaaaaaaaaaaaaaaaaaaaaagatttaacattaaaggagattttcttatttttatttttttgagacagagtctggcattgtcacccaggctggagtgcagtggcataatctcagctcactacagcctccatctcctgggttcaagtgattctcctgccttagcttcctgagtagttgggactacaggtgcatgccaccactcctggctgatttttgtatttttagtagagatgggggcctcaccatgttggccaggctggtctcgaactcctgacctcaaattatacacctgccttgacctcccaaagtgctggggtgacaggcttgatagcactcccggcctaaagcaaatttttaaattgcgctcctactatctgtttttggttttttcctgttctcttctcctgaactttatctatcttcatagttgcaatacctttgggacacctataacctgtgtctccctttttcttgtcttgtcttagtttgactgactttcaaaggagattttgatttagcacttcagccttggaataagctattgaatacatttaagtagctaggaaacaaggtggtataggaaatagggaaaagaatagagaaagaaaatggttttaaagaattcttccctttggagtgaatttgaagcttcttgttctattttcaatgcaaaatctccaatattcaccttatagcaatacaaaaatagagtttggactacagaaaccacagttgtgcatatataaaatgttctcaataaatctttgcttattgagtcacagttacttccataataacttaagaaataaagagaatgcagatgcttcctaaagtgagcatatgggaaaatgggtaagttttgataactcttttattcaaggtttttcctccattatagaaataatatgctagaaataaagcatgtacctataatggagtaatttttttgagagaaattgaacacttttttttcttttaactaccttcttttattcacttgtactatcaggaatatccatatagacaaaaataaagcaagtttggggtaaaattaaaaaaaaatactaccaggaagagaactactggacagctgtgaactgaatgctttagagacctcagaaagtccaaaccttaaaagcaggattaatctccaaaggctggagaacctggaattcttatgtcaaaggaaggaaaagaaagagtatcttagctgcaggagagaaaaagagcaatttgctgttcttctgcctttttgttccattcaggccttcagctgattggatggagcccgccccattgacggtgaatcttcttcactcagtcttccaacttacatgccaatctcctgtggaaacaccctcacagacacacccggaaattatgctttatcaactaactaggtatcccttatccagtcaagttaacccttaagattaactatcagagctaatttagattcatactaattaagcttaaaatcaagcctctaaattatcaacttgatctgtaattaaattaactgccttccggaacaaaacatacatacttaaagatgacagttacagacaatcaacagtgtaacatctataatgctaagcatgtgataaaatgctattgcagtgaggaagcaggaaaatatgagccaaacctagagaaaaaaatcagtcagtaaaaacatacttacaaatgctaaagtttacagaattaacagataaggtgttttaaaaagctgttaaaaatatgttcaagaatttaaaggaaaacatgacccttagagaataggggattttacaaaattagaattctagaattcagagatgcagtatataaaatgaaaaattcactggattgtcttataggccagttgaacactccagagggaaagatcagttaacttgaagagaggacaatagaaactgaagcacagatagaaaaaaaattaaaaggctggaaaatagatggagtcttagagaattgtgagataatactaagcagtctaacctgtataattagatatcatagtgtaattgaagcagaaaaatttgaataaaaggggaattttttctaaatgttatggcaaataggaaccctcagacccaagaaattaaataccaaagtataccataatcaaattattgaaaaccagtgataaagagaaaaatttttaaagacatttgcagggaacagtggcattactgacttcttgttagaaacagcgcagaccagaacacagtagaatatcatcacctttgaaaagctaagtataaaaacgtcaactttaaatgatcgatcaaaaaaaaaagtgtctttcaaactgaaagtgaaataaatgttttgaaataaacgaaagtagagaaggtttatccccagcataatgcactgtaagaaatgggtacaaaaagaaagaattcttttttttttttttttttggagacggagtcttgctgtgtcacccaggctggagtggagcggcgcgatcttggctcactgcaacctctgcgtcctgggtgcaagccactcttctgcctcggcctcctgagtaggtgggaatatggacacctgccaatgtgcccggctaatttttgtagttttagtagagacggggtttcaccatgttggcccggctgatctcaaactcctgaccttgtgatctgcccacctcgtcctcccaaagtgctgggattacaggtgtgagccactgtgcccggccaaaaaggaagaattctttaaaatcattttctatgcttttctctattattttgagaatttttacatcattgctcatcagggatattggcctgtatttttgttgtactgtttttttttttcttaatctgtctttggttttggtatcagggttaaatactggcctcatagaatgaacgtggaagtattcccttctcatctatttcttggaatagtttgagtagaattagcattagttcttccttaattatttggtaaaattcagaagtgaagccatcagttcctggctttttctttgctgagacactttttattatggctttgatctcattacttgttattggactcttcaggttttgaatttcttcatggttcagtcttggcagattgcatgtgtctaggaatttattcatttcttctaagcttatagttgctcatagtagcctataatgagcctttgaatttctggggtattggctgtgatgtctcctttttcatctctgattttatttatttggatcttctggttcttagtctagctaaaggtttgtcaattttgtctatcttttcaaaaaatcaccttttgtttcatcactcttttgtacttttgtttcaatttcatatatttctgctctgatctttattttcttctactaattttgggtttggtttcttcttgcttttctagttctttaaaatgtatcattaggttgtttatttgaagcttttctacttttttttgtaggcacttacagctacaaagtttccttttagtactgcttttgctgtatcccattggttttggtatgttgtttccattttcagttgtttcaataaattttttaatttccttcttaatttcttcattagcccactggttattcaggaacatattgttaaatttccatgtgtttgtatactttccaaaattattattgttattgatttttagttttattccattgtggtcagagaagatacttgatataatttcatttttaaaaaaattttatggacttttattgtgtcctaacatatggtctgtccttgagaatgatctatgtgctgcagagaaaatgtttattctgcagccattggatgaaatactctacaaatattgattaggtgcatttggtctgtagtgcagattaagtccaatatttcttttttaattttctctctgggaagtctgtccagtgctcaaagtagagggttgaagcctccagctattattgttttggagtctgtctctctcattatctctaataatgcttgctttgtatatctgggtgctccaatgttgggtgcatgtatatttacaattgttatatcctcttgctgaatttacccctttatcattatatactgaacttgtttgtctctttttatgtttgccttcaaatctattttttctgatataaataagtatagctactcctatttttttgtttgtttccactggcatggagtatctttttctatctctctttttttcagtctatgtctgcttttgtagatgaagtattttttttgtaggcaacagatttttgggtcttgtttttttaatccattcaaccactctgtgactttttgttggagaccatagtccatttacattgtgttattactgataaggacttactctgccatttaaaaacttgctttcttgttgttctgtgattttcacttccttctttccttccttcttgtctcttttttagtgaaggtgattttctctggtggtatattttaaatttctttttattttttgtatatctgttgtatgttttttgacttgaggttaccatgaagcttccaaataatatcttatactgcattattttaaactgacaacaacttaacattgattgtgtaaacaaacaagccaagagaaaactaataaaaactctttaccctttaacttcattgccctgctaatatttgttttttctacttatatcttattatactgtctgtcacttgaaatgttactgtagttatttttgctaggttcatctttttattctgtctactcaagatatgagtagtttacacaccatggttacagtttacaacattctgtgtttttctgtgtacctagtattaccagtgtgtttagttccttcagatgatttcttattgctcattaatgtccttttctttcagattgaagaactctctttagcatttcttgtaggacagatgtggtgttgatgaagtcctttttttttttttttttttggtctgggaaagcctttatttgtccttcatgtttataagatcttttcactggatatggtattctaggataaaagtttttttttccttcagcactttaaatgtgtcatgccactctctcctgtcctgtaaggtttccactgaaaagtctgctgccagaattattggagctcctttgtaggttgtttcttttctcttgctgcttttacgttctttttctttggcctttgggagtttgattattaaaggtcttgaggtagccttatttggattacatctgcttagtggtctgtaaccttcttctacttgaatattgatatctttctctaggttcggaaagttctctgttatcccgtcaaataaactttctacactaatctctctctgcctcctctttaaggccaacaactcttggatttgctccttggaggctattttctagatcttgtatgtgtgcttcatttttttttttattcctttttcttttgtctcctcttactgtgtattttcaaatatcctgtcttcaagctcagtagttctttcttctgtttgattagttctgcagctaagagactctgatgcattctttagcatgtcacttgtatttttcagcttcggactttctgcctgattctttttgactatttcaagctctttgttaaagttacctgataaggttctgaattttggccaggcgcagtgtctcacgcctgtaatcccaacactttgggaggccgagacacttggattacctgaggtcaggagttcaagaccagcctaaccaacatggagaaaccctgtctctataaaaatacaaaattagccaggcatagtggtgcatgcctgtaatcccagctactcaggagactgaggcaggagaatcgcttgaacctgggaggcggaggttacggtgagccgagatcgtgccattgcactccagcttgggcaagaagagcaaaactccatttcaaaaaaacaaaaaacaagattctgaatttcttctttgtgttatcttgaatttctttgcacttcctcggcacaactattttgatttctctgtctgaaaggtcacatatgtctgtcactctagggttggtcactggtgccttgtttaatttgtttggggaagtcatgttttcctggatggtcttgatgcttgtagatgttcatcagtgtctgggcatcgaagaggtgggtgttatagtcttcatagtctgggccttgtacctgtccttcttatgaaggctttccaagtattcaaggggacttgtgaattaagtctttggtcactgcagccatatctacattagggaacacctcaagccctgtggctcttgcagactcaatgagggtactacattggtggtgttgggtgagatccaggagaacttcctggattaccaggtgtagactcttgttctcttcccttactttcccccaggcaaatagagtctccctctctgtactgagctgcctcggagctgggggagtggtgatacatgcctcttcgtggcaccaccactggtactgcgctgggtgagatccaaagcaagcatagcattgggtcttgcccaaggcccacagggatcactgcatgactactgcctatgttccctcaaggtccaagggctctgcagtccgcaagtgatgaatcagtgaggcttgtgtccttcccttcagggcagtgagtttcccttgtctccgagtgggtccagagaagctgtctgggatgcagggcctggagtcaggaaccttaggaatctattatatgtggtgttctgttctgaggtggctgagctggcatccaagatacagaacaaagtccttcccatgcttctgtctcaagcagaaggaaggagtcttacccggagctacaagctgcatcacctggggttgcgggaggagtgatgcaagtactcccgtggctgccctagctggtgtctcactaggtcacgtgcaccccaagtccactggctctaagcccagcacagcacagaagcttgcccaggaattagagcccttatggcccaaaacttgcccttcagtttatttcagatcccagagcaccttatcccatggtggtggggcttgccagaactctggttctgaccgctgggatggaggcttcccttctgactagtgctggtctaaatgctccctctgtggatgctggctgagttctgcctggtgttgctttctgctgtgacagggcagcactaaattccagtgctacgtcccacaatcactcttttttctcccttccacaagcacataaattctctctccgcgccatgctgccagtgccagggattaggggaaggatggtgtaggcaattcaagactatctttcttatcctctttagtgcctctttccttaatatgatgttaaaaccaagtactatgattgctcacctaatttttggttcttaggaaggtgattttttgtgtggatagatttggcgttcctgcttgggggacgatctctggaggcttctatttgctcatctttctcctaattgtggaattttaaacacataaaacatacgacaacaaaagtgcaaaagatgcagtgggagggaagtggaagtttggtgttttaatattgtaaggatattaagttatccatgaaatatataatattgattggaggtagactgtaaaccttcccacaaccattgaaacaaataaagttatttagcataccaatagataagaacaaatagaatttttaaaaagtaattgtatcaaaagaaggtgaaaaaggagggtaaaagaacaaatgagacaagtatgaaacaagtagcaggaagatagacttaattgcagcctaataagtaactgtactaaatgtgaaagtactacagatttgaactaaaagacaaaattgttagactggatgaaaaagcatggtacaactatctgctatctataaaaagtccattttaaatataaaggtggagatagtttaaaaggatgacaaaagatataccatgcaagcactaatcctaaagctggagtagctatattactataagaaaaattagactacagacagataataataccagagataaaacgtgacattttataataggattaatacatgaagtaaatatagtagtatatctgtgcatttaatagcagagctgcaaataacatgaaatataagcttacaggattgatgaggagtagctgtatcaagaaatacagttagatatttctgcatagtcctctcagtaattgatacaaaaaaataggaaattaacatgatgcttcatagttgaacagtactaccaatctttacctaatagaaatatttaaaatactacacacaaactatagaaaatacacattgtttttaagtacggataaaacattcatgaaactaatgtaagaatgagcaaaaaaggaaataagaaatcctaagtagatgaacgtaagaactcaaactagatgattctagttctagaaagttcctagcaagaactagaaaagtcatagcaagtttttctttataaattccaagctaaatcagtttttacaatgaatgtggataacttaagctaccctattttaacatacaagagtgtcagtttagatttcaaaaaaaagcaaaccgcagttcacctatatgccctttacaagagaccatttacaacaaagtggcatacaaagaaagaaagagttgcaatattaacaggcaaaattgaattcagggtgtaagtcaataaaaggtcaaagggaaatgttttatattgataaaagtcatgcttaagtaggtcttaggtaaaaatcctgaaagatataaaaaatcatttaaaaaaatcaaacattccattgcatcaagagaggaaacactatagccaaagcatacaaagaaaaatcttacttgaatttactacataaaccagttagagaagagtaccatgacactatgttggaatattgaaaatctacagcaaacataatacttaatgatgaaacattagaaaccttttcattacagttcaaaacaatatatgcatagttactgtcacatctgtttaccttggagcttctagccattgtaatgaattgagtcataaatattgaaaagaattaataaaacttattaattttaaatgtctgtaccaaaaacaaaaaaggcaagcaattaacaaactaatagaactaaaatagagttgttacttggccagattcaaaattaacatactaaaattagtacctcttctgtataccagaaatatctaattataacaatgaaaagtaaaagactttattataatagtcacaggattgtttcctagaaataaatttgataatatacgtggaaaattatataatgaaacttataaaaatttattgaaaattctaaaagatctgactaaataggcatactctgttcatagactgaaaaattcactagtgtaacaggttaatctgtaaataactccaactttaatcaaaattctcatggaatcatttcattaaatatgtatctaagaagtatatgagagaggactcatacttctgaacatctccataattagcactctggcccaaggtggcatcatctgtgcctggtttatcacattaacctctgaacttttccattttcacacttgccctctccaccaccatccacccaagccctgcagcctaaactgaacactcagagtgatcctttaatagattacttagttcaattctttcgatgaatttaaaagaggatattgtttagaaagactaagtaattgaatcaaggtcaaaaaatttgtaagaagtagagccatgatttgtatccaacatttctgattctagaccctattctcttcaacactagactatactgtattttattagctctttctgtgttgagattattttattatttttaaagaatgctcgtagacgtctggcatatatgatgatagatgacacttatctgaaatatgtagcttggcctcataaaaaatatgctttaatttcatttatagacacatagctgacctaggatgaaaaattgtcttgacccattgtgacatttcttatatttatatggtaatgaagaaaaatcaaaattttaactaatctgtttttcataaggatattatcgtcttttcttcttgggcttttaggcttaacgcctttttttctcctgtggcacatttgattgcactcttaactgcggtgctaaaataaaactcaattttagtgatcacagaatctgatgttgaaatagtctatttctggaaatgctgggtttatggtaatgatgaaagttgtatcatgttgttatggcaaccaaaatcctaaagtacagattaatgacaagctcactgatttttggaagtaagcagttcatttcttatctcagttcagttttaaataattatttagaatacagtaaatttctttgaacatattttaaaatgagaataatatctccatttagttacatatctagagattctcttcttcaaaggatcacagctcctcgccagcaatggaacaaagctggatagagaatgactttgacaagctgacagaagtaggcttcagaaagtcgataataacaaacttctctgagctaaaggaggatgttcgaacccattgcaaggaagctaaaaaccttgaaaaaagattagatgaatgtctaactagaattaacagtgtagagaagaccttaaatgacctgatggagctgaaaaccatggcacgagaactatgtgacgcatgcacaagcttcaatagtcgatttgatcaagtggaagaaagggtatcagtgattgaagatcaaattaatgaaatcaagaagagaagtttagagaaaaaagagtaaaaagaaacaaacaaagcctccaagaaatatgggactatgtgaaaagaccaaatctacgtttgattggtgtacctgaaagtgacagggagagtggaaccaagttggaaaacactcttcaggatgttatccaggagaacttccccaacctagcaaggcaggccaacattcaaattcaggaaatgcaaagaacaccaccaagatactcctcgagaaaagcaaccccaagacatataattgtcagattcaccaagattgaaatgaaggaaaaaatgttaagagcagccagagagaaaggtcgggttacccacaaagggaagcccatcagactaaccgcatatctgtcagcagaaactctacaagccagaagacagtggggtcaatattcaacattcttaaataaaagaattttcaacctagaatttcatatccagacaaactaagcttcataagtgaaggagaaataaaatcctttacagacaagcaaatgctgagagattttgttactaccaggcctgccttataagagctcctgaaggaagcactaaacatggaaaggaacagccggtaccagccactgcaaaaacatgccgaactgtaaagaccattgatgctgggaagaaacagcatcaactaacgggcaaaataaccagctaacatcataatgacaggatcagattcacacataacaatattaaccttaaatgtaaatgggctaaatgccccaattaaaagacacagactggcaaattggataaagagtcaagacacatcagtgtgctgtattcaggagacccatctcacatgcagagacacacataggctcaaaataaagggatggaggaagatctaccaagcaaatggaaaacaaaaaaaggcaggggttgcaatcctagtctctgatagaacagactttaaaccaacaaagatcaaaagagacaaagaaggccattacataatggtaaagggatcaattcaacaagaagagctaactatcctaaatatatatgcacccaatacaggagcacccagattcataaagcaagtccttagagacctacaaagaggcttagactcccacacaataataatgggagattttaacaccccactgtcaacattagacagatcaacgagacagaaagttaacaaggatatccaggacttgaactcacctctacagcaagcagacctaatagacatctacagaactctccaccccaaatcaacagaatatacattcttctcagcaccacatcgcacttattccaaaattgaccacatagttcgaagtaaagcactcctcagcaaatataaaagaacagaaatcacaacaaactgtctctcagaccacagtgcaatcaaactagaactcaggattaagaaactcactcaaaactgcacaactacatggaaactgaacaacctgctcctgaatgactactgggtacataacgaaatcaaggcagaaataaagatgttctctgaaactaatgagaacaaagacacaacataccagaatctctgggacacatttaaagcagtgtgtgagggaaatttatagcactaaatgcccaaaagagaaagcaggaaagatctaaaatcgacaccctaacatcacaattaaaagaactagagaagcaagagcaaacaaattgaaaagctagcagaaggcaagaaatgactaagatcagagcagaactgaaggacatagagacacaaaaaacccttaaaaaaatcaatgaatccaggagctggttttttgaaaggatcaacaaaattgatagacggctagcaagactaataaagaagaaaagagagaagaatcaaatagatgcaataaaaaatgataaagggaatatcaccactgataccacagacatacaaactaccatcagagaatactataaacacctctatgcaaataatctagaaaacctagaagaaatggataaattccttgacacatacaccctcccaagactaaaccaagaagaagttgaatctctgaatagaccaataacaggctctgaaattgaggcaataattaatagcctaccaaccaaaaaaaagtccaggaccagatggattcacaggtgaattctaccagaggtacaaagaggagctggtaccatccattctgaaacttccaatcaatagaaaaagagggaatcctccctaactcatgttatgaggccagcatcatcctgataccaaagcctggcagagacacaacaaaaaaagagaattttagaccaatatccctgatgaacatcgatgcaaaaatcctcaataaaatactggcaaactgaatccagcagcacatcaaaaaacttacccaccaagatcaaattggcttcatccctgggatgcaaggctggtttaacctatgcaaatcaataaacataacctatcatataaacagaaccagtgacaaaaaccacatgattatctcaataaacgcagaaagggccttcgacaaaattccacagcccttcatgctaaaaactctcaataaactaggtattgatggaatgtgtcttaaaataataagagctatttatgacaaacccacagccaatatcatactgaacaggcaaaaactggaagcattccctttgaaaactggcacaagacagggatgccctctctcaccactcctattcaacatagtgttggaagttctggccagggcaatcaggcaagagagagaaataaaggatatttaattaggaaaagaggaagtcaaatcatccctgtttgcagatgacatgattgcatatttagaaaaccccattttcccagcccaaaatctccttacgctgacaagcaacttcagcaaagtctcaggatacaaaatcaatgtgcaaaaatcacaagcattcctatacaccaataacagacaaacagagagccaaatcatgagtgaactcccattcacaattgctacaaagagaataaaataacctaggaatccaacttacaagggatgtgaaggacctcttcaaggagaactacaaaccactgctcaacaaaataaaagaggacacaaacaaatggaagaacatttcatgctcatagatgggaagaatcagtattgtgaaaatggccatactacccaagataatttggagattcaatgccatccccatcaaggtaccaatgactttcgaattggaaaaaaaactactttaaagttcatatggaaccaaaaaagagcccacattgccaagacaatcctaagccaaaagaacaaagctggaggcatcacgctacctgacttcaaactatactacaaggctacagtaaccaaaacatcatggtactggtatcaaaacagagatatagaccaatggaacagaacagaggcctcagaaataacaccacacatctacaaccatctgatctttgacaaacctgacaaggggtaaggattccctatttaataaatggtactgggaaaactggctagccaaatgtagaaagctgaacctggatcccttccttacaccttatacaaaaattatttcaagatggattaaagacttaaacgttagacctaaaaccataaaaaccctagaagaaaacttagccaataccattcagggcataggcatgggcaaggacttcatgacgaaaacaccaaaagcaatggcaacaaaagccaaagtaggaaaataggatctaattaaactaaagagcttctgcacagcaaaagaaactaccatcagagtgaacaggcaacctacagaatgggaaaaaatgtttgcaatctacccatctgacaaagggctaatatccagaatctacaaagaacttaaacaaatttacaagaaaaaaaaccatcaaaaagtgggcaaaggatatgaacagatacttctcaaaagaagacatttatgcagccaacagacacatgaaaaaatgctcatcatcactcactggtcatcagagaaatgcaaatcaaaaccacaatgagataccatctcacgccagttagaatagtgatcattaaaaagtcaggaaacaacggatgctggagaggatgtggagaaataggaatgctttttcactgttggtgggagtgtaaactagttcaaccattgtggaagacagtgtggcaaatcctcaaggatctagaactagttttttgacccggtgaatccattactgggtatatacccaaaggattataaatcatgctactataaagacacatgcacacgtatgtttattgaggcactattcacaatagcaaagacttggaaccaacccaaatgtccatcaatgatagactggattaagaaaatgtggcacatatacaccatagaatactatgcagccataaaaaaggatgagttcatgtcctttgtagggacatggatactgctggaaaccatcattctaagcacactgtcccaaggacagaaaaccaaacaccacgtgttctcactcataggtgggaactgaacaatgagaacacttgaacacagggcggggaacatcacaccctggggcctgtcatggggtggggagtaggggagggatagcattaggagaaatacctaatgtaaatgatgagtaaatggggtgcagcaaaccaacatggcacgtgtatacctatgtaacgaactggcatgttgtgcacatgtaccctagaacttaaagtatcattaaaaaaaaaaaaagttacttccccctttcaactggtctttttgcatatcttttggtgttgtgaaaagcaagaggacagaaacagtcctgaaagtacttcccgtcagctatggactaggctgtgattgatcaaaatagtaagtaagtaaaatcaagtgcatgcccatgctagaaccagtgttcagcatgcactgctaacaacaacaacaaaaaaattcactgttttcactgcctgtacatagggtgtttagttgataaggacattcccaactttcagaagcatatgactgaactgagatgatttgttggtcattttggatttagtcatagaatccttgaaacttttacattttggacattgattatttgttactataatgattcattattgtttgagactgtgtatttcatatgtgatattagtaattagtgaataatttgggctaagaccaggcagacaatatagacagatagatcagttgattgatagacagatacttaatatactttttaagataaaggatgaatttacatagtaattattactgtaaataaaaatatagtaaactggcaagagaataaaatggttttaacactatagaaacattcatttatatacaaataactgatacgcttttataaatcatattttgggaaacttagttccctaaaataatgtatgtgtatgtatatgtgatgtatttattcatgtaggtagtttttttaaaacaataactcattaaaatactcttaactctcagtggaataatatagcttaaaagcttaaagtaccttataaagattaaccagttcaatatttggtttatagtggagaaagcagtcttggagaggttaaattacttgttcaaggcaacaataagtggcagagcttcaactagaatgtaagccttctaacagtaatttactcgtctataccattttatctgtactgtaccatatagaactgattagaaaatacttaataaaagtgagtgtaggaacctgttgctttggtagtgataaatgaactcatatttgttcagaaatgtggaatcacactgtcagccagagttcttggtctttataatttaagtttgactcagactcgcttcagagaatctcccttttcattttatttctatcctgttggctttagcaggcagttagcaggccaggaggagcagttccttattctttgctttttttccttcctccttcattcatgtaatacatgaagatttctttttatccagcggctttgctttcttcatcttctccaccatatgcatattctttttttaaccccttccatatctcagtggctttttaagctgaggcggagattgaagacatactataccatctaacaccaaaatttaaaatgaattttaaacactcgtttagttttaactggcttgattttatttaattatctgtgtttatgtggtactgctttattttatctattgcagacttacagtggattttcagctgtattgttagttacagacattcgtgagctaatttatatagcttagaaacaaatgtgtcaagttacaactaaatttcagtaaattttaaattttttatcactgttacttgaaaatgaaatttaaatttcactactttagaagtttcaacaatactacatttacaagttaaatactacatttacaagttactctgaacttttaaaaatcatattcaatatttataattgtacattattcttattttatactttttatgagaaggaatagccttatttttgtgtactccttatatacgatcaaatatatgctgtattgagattgagtatagacttgagtatgaggcatgagtaatgaatgctttacacacttctcagaaatctatgttattgcgcttagaaaagaactaagaacactgtttctaaaatccagtatctgacttgttgcaaaagtggatatcaaatgtatgttatatctaacaaagttttaaaatactagtttctagtagtttttaatgaaaaataatttttgcattattttgttacattcattgtcaagcaaatttaattacaggaaagaccactaatcaatagatcaaaaaatatctccaggctgggcacagtggctcatgcctgtaatcccagcactttgggaggccacagtgggcggatcacctgaggtcaggattttgagaccagccttgccaacatgatgaaaccccgtctctactaaaaatacaaaaattaggcaggcatggtggtgcatgcctgtaatcccagctactcgggaggctgaggcaggagaatcacttgaaccgggaaggcagaggttgcagtgagccaagatcatgccactgcactccagcctgggtgacaaagaagtgagactgtctcgaaaaagaaaaaaaaaaaatccccaagcctcatttagttaagcagttttctaaaccagtttctaccatcatcccttccctttcagcagaaaggtagtacaaccagtagcaccagtctactctgctcagaaaatttactcagcatgtctttcttctactcactgtcattttggaagctttagcaatttttggaaaatgtcaagttactccaactcgtcaagagtttggaccccattagaacagtgtacagatgttccaagatcttaagtggacttctttccttattccatccaactattttcttttctagaccacagatgcatatatttccacagatagtcttaaaaatgtattattctatccattattatcaaaaaagaacataattcctagaaaaacaaagaatgtgttctgttgatgatgacttcatgacattgacctgtgtgacaacttaacacaatattactattactgctataactattacgttaatctagctagtcacagtcatgtactcttgactatgtgaagaaacagttttcctgaaatagccactgattcagcatttatggaaaacagtggtggctcaagagcccagaataggactctgtaaataaggaaaaagttctttttctccatcaagcattcagtgaacatgtatttattgagcatccatcatattcaaaatatactgggttttaagggacatgtgaacataaacagtgtcaagttagttgaaattttgtaggacaggtaagacatgaacaacatgtatttctgtaattctaaacaattttttaagtacattttggaaattgggttatattgcagtcatatccatttgatgcagaactaaccccttcctaatacaaagctgttgggatctgaacatcaagaaaatgtagaagctttattgtaagttaggagtggtaaaagctatatgaaaggaacagaaaaagtgccatggacattccacaaaggaagtaattatttctagctctaaagatcagacaagacttcatggataagagagaacatttttgttgaacattaagagcatttacaagtggtgaaagaggcactctaggaaaatgaagtaggagcaaaggaactgagatcagcaaaccagagcccagagaacagtcaagggttgcactggaattagaatagtgatagggaaagtgttagataatttttgaatggtagaaggaatttgggcttctctgaaaccaaaagaggctactgaagctctttgaaagccccaggtaagagagagatgtgatagaaagtatgcctcagcaagattgatctaacaacagtgcctaggatggattgaatattgaagagactgaaagagggaagaatagataggagtttgtgtgtactccaggcaagaggtcattttagaacctgagctgaagtgatacaacattgttatgccattaacagaagtaggaaactacaagaaaaggaggtgtggaagcaaagctttaaacacacatttttattttagtttttgtaaaaatcagaaaattagtaccagtgttctcatggccagtaccatgagtaccatgagaaccatgagtaccgttagtaccatcttctcatggtgatacatgaatagtatgagtagctagggatgacaggaagttaatgtcatggaactatgcagagagttgttgcacatttaatgaaccaatactgttttttctagctggataattttgtaaacatttgcaggactcattctttatgtgcttttgtagaaatgtatatttgtgagaaagctgtgatttgctgcaggcaagtgtcacattttagcttggggtgatatagagagatgaagagaaagctaggagatgtggttgttagtgtaaaagctgtaaggtgaaagagcagtttactttaagttttcctgagagataaaagtgttgataaattgaaacaattgtaagcatctttctttaatgtgttaccacttttgcaaaatcaatacattgacattgggtcacagtttttgtttcttatttagcagtcctgtatatcaggcacaaatatatagcagtccaatatatatcaggaacaaaacacagtccatgccctctgcaacctatatagtaatggagaaagatttaataaataatgaatacaaaattatattttatcccaaaattaggattaactgtgtagccatatagtgattattaaatagtgtatgtgtgatgataatgaaaatgaaatgtgttgattgaagtgtcaagctgtcttacaattcttagtaaatatatttttttcaaatgatgtgtttacattttgtttgcttatcaatagagagcagatcgtaaaacaatctacagaattagtctgcagagcctatggtgaagtgtatgcagccgtgatgaatccaatcaatgaatacaaagatccagagaacattcttcaccgatcgccgcagcaagtgcagacgcttctttcctgattatcttatttcattgtgttagcaaaatatgacctccctaaaacactgaaggttattttttattctttgaatttttactctataatttgatagttacagttttctttgtatcataagattgtaagtcccgataatttttttttttttggtctcagtaacagggaagtaagtaacatgttgacctgagctagtattgctgtgtatctactctaaatgagatgatctatttttttgctagccatctctccagctctgcagttttcactgtattcaggaagcataaagtagtatgaaaggtttgaagaatttttttttacaagactagttctaaattaacagcttataaaaaatttgtctaaatttaataattagtataaggatatgacctaataaatgtctccttacctaaagattcatttgctttcttttaatatgagtaggcatacttagtagcttttctgaacctagcctatgtctctgtccccaaaatagctgcccttaaagagttgttagcagagagaaaaataacagtgaatgtgctcctggtgtatatggcagtgaatctcctttctgttctactttagcatactatatatatttgactgtgtacattcttatgcaattttaagtatacactcagcaataattagaaaaaaaggagagagaaaagtgatttaaacagggtggattccactctgtgggagccttcgatggaactcaaggtggagctcagcctttccaatgagctctaagcatgtagatagcctgagctgtgtctaagcctggtgtttaaagatgggtatttgtcatacaatatgggtcctaaatccaaccaactacacattttatctggtgttcaaaccaaagaaacaatgatctactcaaacattggagaaaaaaactgccagaggaggagttgccaattggcagtgtgtcttatctccatgttgtaactggactctgactttagaccattacctattaggaagattaaaaatgactgtatttttaaaggaataaatcccagtgtgcctgatttgacattcttgtcagcaaaaaaaaacttaatttctagtaaatctataaaaatgggtaagtccctaaattacaaatgagaaaattgaagcacaaggaaaaaaataactagtttgaaatattttgaaaagtaataacataaaactagtatttgtagaagattatgtgttgtatataacaaattagtatttatagaatatgacctatttatctgaagtttataattgtttatacctaatacagttctttttggagtaagaatgattatataatcgttatccatttgggtataaatctgtatttttagttttttccctttgattagtatgtgttacatataaagacagaaaataaagtataaatcaagagcttaaattgtatataatttatttctacagagaaagaagattgataccttgctatgagtgaattcctttgttttatagggaaaatttattgtgctttttacctggttttttcaaataaaatattaaaatatt

SEQ ID NO: 1637 - DNA, 97002 bp, Homo sapiens; identical to SEQ ID NO: 1636

SEQ ID NO: 1638 - DNA, 5667 bp, Homo sapiens
aaaaagaagtttagattcgcttcccggagccgggatggcagcctgcgctatggttggggaccaacgtggtgcacgggcaggggccggggagagaggcggccgcagcgggagcccgggagcgcagggcgggcctggaagagctccgccccaaggggcgcggccaccccggaggcgggcgcacggctgcttctcattcattgtcttgacaagagcatcttcagcgggcgagtccccggctcctccagctccttcctcctcttcctcctcctcctccacctccggcttttgggggatcactgtcctctctcggcagcaggtgaggctgggcctgggaggcgcgggtgggccggggcgagggccacctgtggggcggcgcgcgcgtgggagccgcgggctgcgggggcgcgcggctgtcaccgcgacccagccagcgccggggccaggtagcgggcgcagcagcccgtggggggacgctgcttggagtgggggccgccggggccccagagcgctctgcggaggcgagggctagggaccaccgcggccaagatggaggtgggtggccgggggtcagcacagtgtcgagggcccgactccccacggaattgagtctcggggagggtggggacgagggcagggtggggtgagcggggcagctgccctgggcttggagacaggaaggggttgagagcaaaacaagaaaagaccaagttcccctttccgtggtttccgggcctggtacctgtggtgggggaggaggcagggtggggcgatggcttcctgtcccccacctctggtccggggctcccctctctccagatacaggctgctcctcaagactggggctcttcacatacgctcctcaccgctctttgggcaggccgacctagcagcctcttcgggagtcctggggtggccgggggtgctggagcccccagtgagtaggcgaggctgaggctaggggcagaggctctgggcatggcaccctccaagcggcagcacaggccccttccctgagcaggaaggtgatgcggtggcacaaggtcgcccctggagttccttgctccccacccagacactgggggaaaccatcctacctggacctcagagcagtcggagtggcctctcccttcctgtgtgcagtttacatgggggtggagatggctcttaagggcacctgcttttctgagcggaggcgagaggcagaggtatggggaggaggagatacctggacctgagccagagacctgctggggaagctatcctgccgcctcactcccctcaggcagcccccacgccacttcctcctgtgtccagccccatgccagcaggcgagggaggccagctcctgtccctgcctttaggaagcgctgtgtgggtgtgagggaggtgggctctggacacggtaactaagagagaacccaccctcggagccatctgggctgatgacgcctgagtctgaaccattaggaaggacgggctctgcatccatcagccagtcagtcaacaaacatgcagtggggcaacaccacgccaggctctgttgcagaggctgagggtacagattgagagggtggctcagagtggcctggggccagggagaagggggcttgcaggttagagggaaggagaggctggggaaggcaagcaggcatcagccacagagggaagaatagggagcccctggagatgatgctgggaccttaaaagccagactgaggggtgtcctgggggaggtggggaccactggaagatcagagttgacctgaagggagaaatgctcttatgctgtgtgcccccagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaaggtgagcccctggggccctggggggagcagctcctccaccggacccatggctctgtgcaggtcctgattaggtgacggtcaccaggccttccagggcctgtgttgccatctggaaaactgagctgggccccatgagccttacacttcctccagctcctctgtgctgtggctgtgtggaaactgacgctcagaaggagccaacacaagatgggtcacaccagtgaccaggactacagacagtcctgcagacccatgatcagccctcctgagcctcagcctggggctttctccccatggaaacacagagggggttgggatggggtctgggggccctggcagcgttctcagggttgggagggactctggctctgggcctgtctgaggacctagcaactctgtcccccagctcgcaggcagggatgatgcaagaggtgctctcccccacccgcagccctgccctcccctggagcctgctgccccctccgctggctggctgctgccccgcacccccagcacactcctgtgctctttggggggtaagacaggaaggggagatgggccccaagttgttaccttaaaagggctgatggaagcaaagagaagaggaagtggttgtcggggtgagagctgggcccgcgccccacatggctgtcacacaggaagccctgctgaagcagctgtccccggaagaagccatttccaaacctctgctcctgcctggggccagttgggacaggctccctggcccctctccttttgggaggacccacccctgcagccccaccactcacactcgctctctggggagctgcctccacccccccagcccccatacacctgtcctggctccagggccagttgtgcccatggaagcctcactcggggaagctggggtgggggtgccaaccctaagggcagagacagactgagacagagaccggcgggaactctgccagggtcttgcacggcccccaacctctgccatgcgtggccagccctcctggggtttgcccaggccattttgggactggaacaagagaagaacaacccgcccccgtccccaccccaggccctggtccagctcccagggacaccacagctttcctctctgggcctctctgaaggaggtgtggggaggttggattgggtttgggaggcaaaagcacctccaaggccctgctgtgcctttagactggacgtgtggacaagaatgcgcccacggtctgtggccacacagcccctgtgctagacatcgcctggtgcccgcacaatgacaacgtcattgccagtggctccgaggactgcacagtcatggtgagtggtggtggggacccaggggctgggagaggggctctaggatgggatctgacatttggagtcctgaagactcactggcccctcctctgcaggtgtgggagatcccagatgggggcctgatgctgcccctgcgggagcccgtcgtcaccctggagggccacaccaagcgtgtgggcattgtggcctggcacaccacagcccagaacgtgctgctcagtgcaggtgctgcgggaggaggggcttgggggtggctcgtggcctgcagtggatgagggcaggaggctcatggcttctgacactgtggggaacgtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgtgagtcgccatctaccctgacctttgaccctacagcctttatccttcttatccaccatcagccaggcccttggatgctgccctccctcgcctccacctgggactggccccgtagggtatgtacgggtgcctgacctaccacctccctttccttgcaggagaaggaccgtccccacgaggggacccggcccgtgcgtgcagtgttcgtgtcggaggggaagatcctgaccacgggcttcagccgcatgagtgagcggcaggtggcgctgtgggacacagtgagtgctggggcaggaagccgagggcccccaggctgggaaccaagactggaggtttcgtccctgctctgccactcacctggcaggatggccatgggcctcagtttacccaggcgtgagatggttgttcccactggttggtcgggagggccctcacaggtcactgcccagggaagaccaccatcccagggcctgggatgttacctctcacctgtgtctacagaagcacctggaggagccgctgtccctgcaggagctggacaccagcagcggtgtcctgctgcccttctttgaccctgacaccaacatcgtctacctctgtggcaaggtggcctcgtcgggcggggtgggggtgggaggtgggcaggatgggcctggagagggccagggcagtgggcatccgctggtattgaccctccctccacacctgccacctacagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggtgactgacccccggccctgaccgcagcatgctccttgggcagtgggcagtcccaagcccacccaaccagactgtgggccccgctcaccttccccttcccacaggttctacaagctgcacgagcggaggtgtgagcccattgccatgacagtgcctcgaaaggtgatgctcccccgccccaccctgggctccaggctgggcactgactttgcggtcttgtggggggtgtcctggcataagcgctttcctcactatccctggccttgcccacagtcggacctgttccaggaggacctgtacccacccaccgcagggcccgaccctgccctcacggctgaggagtggctggggggtcgggatgctgggcccctcctcatctccctcaaggatggctacgtacccccaaagagccgggagctgagggtcaaccggggcctggacaccgggcgcaggagggcagcaccagaggccagtggcactcccagctcggtgagagggctgggaagccagggaataaaactgggagggtggggtggggctggtgtttggggcacctcaaactcacaacattgggaatctttgtgggtccgggaatggtaatcctgaggcctcagaacacaggtttcagattgataggcctgcaggtctccaggcagcaaccagctgagcgactaaagggcccaaggccagggctctagggatggggctcagcagaggctggggtaaggggagccagggaggagctgggcctaatgcagcaccgggtccccaggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggta

SEQ ID NO: 1639 - DNA, 5667 bp, Homo sapiens; identical to SEQ ID NO: 1638

SEQ ID NO: 1640 - DNA, 35596 bp, Homo sapiens
atttaagggcccgcctctcctggctcacagctgcttgctgctccagccttgccctcccagagctgccggacgctcgcgggtctcggaacgcatcccgccgcgggggcttcggccgtggcatgggcgccgcgggcctgctcggggttttcttggctctcgtcgcaccgggggtcctcggtgagctgggagggggagcacggaggtggggacgcgtcccgggcagggaaagtttctgtgccgcgatgcaaagcagggggccaaaagcgagacggtgggggcagtgctcgacgcgtgtccgcctcccgctagctttgagggaccactgcaataaaccgcctggtcctgattgtccccactggcccctccgggagctgggacctccagaattggaggctgcgccacagaggggcgctgtctggtcggcccggtgtggctggcggcgtgcgggtgctcgcggtctcctgccgggctccccgcccccaggattctgcaggtgctcatcgctctctggccggcggtcagcgctaccgctcgccacgggaaacctacccactgcatgaggcaccagctagccacgtgaggctgtttctgtacacccgaaccgcgctcttgcccagcaaaagcggcagaacctcggctcccttccctaaataagagtaagacctggttcccaagcatgggtctcagattttctgaactctaatgtgatattggtagagatcctaaacattaaccatccgtagttatttttgagacatggattaaaactattgttttcttcttgttattaacctactgtaatggtgtggacgtccgcaaaggtctcattcaccgtttattatatctttttttcctccagattggcttgattttaaagaaagattataattaagattagcgtctcttggctacaggatgggtctaagtttctaattatctccacggtaccgtgcattcctagtttataagacgtttactgtgtgcagacctcaataactgggtgacttttggcaagtcatttagctccctgatcttcagtttcttcatctgtaaaatgaaactagtgattaactggccttccacctcactgagctgccctgagcacagatgaaactaagcaaagaaagttggatgttagtcgttactactaaatatcagtaataagcctcctgtacagacttgattttatggagccagcatttaagctaacaagctgggtgtccaattgtttctatggacatccagcttattgaggtgtctggaatacagcacatattagtttattacaactttttgctttcctgacattttactgtctcctgacccttaaacctttctccagaccattatcttcatctcttttctttttctgcatattaactccctttgaacaaatgtatattcacactttttctaagagcagagtacgtccctgacttctcacctatttctaaatttcaaagaggatattatcaactgaaaatcaaattcttcaccagtcctgccaattcagggccacagcagcagcatcatgtaggtcacttaactggagccccatgaaataccaggtctacctatcagccattcaagctactgtgcttctgttgtttgtccatttctcatttttgtaccagtattcccatcctaagcattataattacctgtgtaacaacctcatctcttttaagagattttggttcttatgattggaaaggttaaagagtgacctataggtcactttccaattatgaaaacaaaaaattaagaaatatatatattttcattatttcactccattgttcaaaaatctaaaaggcctccagtggaagaaaatctggtgtcttcagcctttctagccctttggaatgggatctcaccgaagctcacaccccctgatttctccagctgcctgtcttgtatgcgctgctcatggtcttccccacctgtctcccatggctcatgctttgcccactctccactgctaacttttactgctactgcatgctctccacacatcatctcttggccagttcctgcacttgagtgtgcttaataaaatactaaagtacctttataaaatgtaggttcctggttccacctccccctccagaggttcataggtttggagttagcacaggaaagctgaggtttaacaatcactctagaagattctgcaacaagtatctatagggcacactgctataagcaaagtcaatggaagcaaatttcctttttagtgttttcctatttttccttttgtctatttgcataaacagtttcaaatttcctacacttctagattttactcaagccttcagtggccacctaactttatcctatgctgagaaaacaaaaccatgaaacaagaatgctcccattttctaatcggctacaaacctaccaacttacaaacttacctccatctagaatcagattttgttctccactgcagaaaacctgctgaggccttcccgtcacattagaataaaacccataccccttattctccagtctgaggccttctgcctctccctgaaattctctgtaccccactcactctctctgccccagccacactggccttctctttattctttgagcacaattgcactaggtattctctcttttgaaatgctcttcctacaaattattctttgcctgtctccttgacattcaaggctcagccctctgttgtgcttctctgactcttgtctgaagtatccatattccagggtactctccaatacaaaactgtgttctattttctacagaccacctatcaccatctaaaaccttcttccttatttatgtacctgtttgttgtttgttccctcactggaatacaagttccatgagtgcaagaccttaatctgccttatttcctgatttgagttcctatcaatagcctgtaatttggaattcaataaatatgaattgaaatcttggtatgtttcctcctataacaatgaaagaagtatccattctgctgacaaattcagctccttttcctgtattcatgatcatgttccataccctcttgcctttgcaaggactttacttctgcagatatctcctaccttgcatcatcaatgtacctctttctgtatgatcatccccaccagcatttaagtataccccaggaaatcctttatggaccttctcatgacccactggaactccattttcctgtccctcttcttgttcttctcagcaaaacttttcattgactacttactcaaatttcgttatctccttctccacttcagacaggcttcttccccacagtctcctgaagctgtttcttgcaatgtcgctactgacccttatgctgataaatccaatggtcatttttctatgttaatctttctcagtctttcagcaaaaactgatgacttcctttaccttgaaaccattatcattctcatcttccaaaccaagacactcttacctgttttttccatacttccctgttgtctcttagtcttttttgttctatctctaaatattagagggtcttggggctcagccctgagcctcttctttcttcatttcttcttcctaaaaaacctcaactcatcttgtctcatggctttgaatactatttatatgttgatgactcatatttattatctatagttctgtcctctctcctgagctgcaaactgcctacttggcatcttgatgtggatgcctagtgtgttagatataccaagtctgaatggaaatgattctgaacacaattccctacctcaaggccacaacacacacacacacacacacacacacacacacacacacactcctttttcaggctttccatcctcagaacagggtaattctatcaattgtgtagcccaagtcagaagtctagaagtcaggaatcctcccatttcctcagccccacatgtaaaacaacaaaaaatcttgccaattctatttctaaaatatatccactgctcaatcctttgccaagcttcatttttttttttttggccctaaactgtactctttgcttctaaaagtaagcagttcgatccactctctacccaattgccagaatattcctttaaaaatgtaagtcaggccttgtgattctcctgcttgaactctccaatgacttctattcaggataatattcacatatctgtggtctaaaaagcccttcatgatccctcctgctgagttttctgacttgatcgtggaccattctgctttgctcattgcatcccagccacacttgccttctgtctgtccctggagcataccaaatccattcctcctgttaggcctctgcctaaaatacttgtacccagcaatttgcctggctgcttccttcttccttcttgtccttcagtcacaacttaaatgttgccttttcacaggccttccttaaccatcataactgaagttgcatgccaccctgtcccttctccttccagtgcattacattgtgacatatcactctatttcatatttcatgttcagcaccttcttatttatttcctggtatctatttacagtctgtctctttctgttggattataaattctatgagggtgggaaccttgtctctgatgttcacagatacatctcctgtgcttaggactgaactttggttaatatgcataactgttgttaaactaaataacaaacagggaaagaccctaaaaaaaaaagatatttgtttgggaatagaacattgcaatgggaatatgtgtgtgattatgaattgtgtgtatattcaaggaagtaaaagaagacaaaggtttttaaaggaaaaatatgaggattacataattgttttagaataattatccttggctacaaagaccaataacaaggatgatgccagtttgaggttatacaggcagatgccggaaggatgttcttgtagggttgcagtggcttttgtgcacggttgtggtttttcagtcttttatgatagtttgggttaacaggtatacaagcatgagaaccctattttcatggccttccctggctttctgaaggtgttttttgttgtttttttttttattacattagtgactctattttgattctgacaactttcacatcatcattcaaaacttgcttatcaaataggcaggaaacccagtattaaggtatttgattatatgaattatcagtctcaataatgattttccctcctacctgctttctgactaaaatttcagttttatttttattatcctatatgtttgtttttcatccatttcaaatggatttccaagccattccaggtaaagtccctgggcccaagtaattaaatatatctctgttcatttaactcagaaactgcttcgcctgttagttttaaacatggttggaaggatatgtgtctgaatgtcaagtcaccatctttgatcttcaatccagtcatgatctcctctgagttttactcctggctacagaaagatgtgaagagggtccagtgaccctcaagaaaatttgtattacttgatggcccatggcttaaccttcccttttctgatatgatctgccttgtgacttgggattctggctttcgttactaatgaggattgatgttcccaaaggaagatagcccttaagtctccttattggaaatgagaccctcccattttttatcatccagaaagtgtgatccgtatctcctttcatcatggaaagttatgctgtgaagcacccttctgcttttgctatttctggatcttcattccatcttcgtccatgtcattgccactgattaaatcgtgtaaatttaaattggttttccagcttgtggaggataatttgatattgtccttatttacatttgataattacagattaagtcacttgactagagtcactagtacaagtagtatcaggatcatgaagtttgtcttcattgaggtcaaaccctgatattccttatagaatcttgctattttgcacagagtaagcacttggagacttttgtagttgttaatggagaaaactaaagaaactgaggaaataaatagaaggggacctatagtgatatctggctcccaataatgatgcctattcttagaaccagtctttgtgacttctccagtagtagtttggggtcacagctaaggtctggctgtgttttgggagctttgtgtgtgaccttgtgtcagttcatccatgtttatactttgactttcacccgtacctgtctcagacctgtttgaaaaaggagattataaatttgatatttaaatacactgctattctaggagggccttacaactgagtactttctttttttgcctggactaccatctgatctggaagaagagttaacttcttgttttctgcttgtcagtttagggcgttgaaacttgagctcgttctcatacatagaaaaatgacttttccagctatatccctaagtgtatcattgctatagtttcttacctatctcctagaataacttctgttccattattaataataatattgttactttaagtcacaggaatctgtgttgaaatgactgtccctttatctagttcccatcagaaagtatttactgagttctctttggtggcatattactctactagattaacagaataaaataatgaagaataatcaacatattttctcctctctaggcattaacggtttaatagctaagatagttatgtaaattcattaaagtaattttcaggatcatatgtgtactgagcttttacaagatctcttatatactttagtttcttatgctatcctgggaaagtttgtatttaaagatttttacctttttgtcccacaaattcacaaatagcgtacattagttatgtgcagtttttttgtgtataaataagacctcattgaagctgggaaaaatattaatatccgctccccctaccacccttataaaaaaaaatcaaaacatatgtaatcatccttcaaggcccttgccacatgcctttcctgttttccccagactctgacctcactgtgaaaaaacaagcaaacaaactaaaaccactaatttttacttgtaagggtgaaggagatggaacaattctgaggattttctgaaattttatgaaaaattactttctccatctctgaagtctaccctaaaaattctctgaacctctgagcttatttctgtgtatattcacccttactgcaatgatatgcattcttcattccataaaatattgccctattttagactttcattctaaagatcaaagttttcaggataattggtaacaaggcagaagcagagaagaggttttagcctctcttggtttttatgtttctgtagcctttgtctcaggtcctcaggtcagggtaagtttctgccaaggtttccttttgctaagcctaaaattcagagtaaccaatcttaagtttgctgttgagatatcttgcaaatacaaatgctttcttgggtatatcaagaggcattctttgtcacctccctagagatcttcaagtggtcagatgctcagcagttctgtaaaggtgagtaatcctgtaatagaggcatatttgggtctgtcgctgtatctggatgagataacatgttatgtttaagataaaagaccagtaaattcacatgtcatctcaagtgaagagggctcctgagtgctccatgcttccttttactcctaggggcactgggtatgagggttaagtcatgatagctggccaaacctattcatcctgtgatctttatgactttgatctatggtatccatactgtgttagggtgaggttagaagttagagacaagagatgttaatattacctcatcctcatcccattcaattcaaaaaatacttttaagtaactactagatactaagctctagaccagacagtggggcctgggagtgacataaaaatgaatctgatagtctttgcctttgagaaactcctacactagttgtaaaggccaactcttaaatatatattgtactatgaggtagttctcttatttaagaagtgctatgaggtcatagagaaataaatcataaatgctacctagaagaattagagaactataggccctctgagcagaggaaacagcatttgcaaaagcataagtgtgcaagaacatgatgtctctggaaaaaatcagtgttgttggagtataggctacatagtgaggaatggtagttgattaaatggattggagcttacttgtaaaaaaatatatgcattttttccctataaacagtggtaagtcatagtaagtttttaaatgtgcagagtggcatgaccacatttgtgttttagaaagataaatgtgcagtagtatagaaggtgtaccagcccaagggagaacaattagaaaagtaaattatgtcattcagtgatccaatgagagactactgcaatgacaaaatagttggtttggagagagatttctggagtccagtcactaaacttcagtaagtaattgaatgaagagaagagagtagaggatgagttagaggatgagttacaaaaaggaaatgatcactgtgagatttttaaggcagaagacttggtagatgatatcatagattaacagaatatgtataaaaatggaaaatgaagactataagttataactgaccacaaataaagttggcatccatgcacagaaatgcagactgtgtgcattaaacaagtagtgttctagagttgactgatccgttggaaagttttgtaaatgtaagaatttctgtgagtaaacataagcaggcctgtcagcaagtccagtcaggttgagatttaatataaaacacaaaaagtctccaaaaagtctcctgaatcccagcctcaaattctgtttgggttgatttggttttcttttgtagataaatcatgtgtgagtcatagagaactcctttaggactctgtgattacacacatgggtattgcatttgggttgacaatgacatattcttgtaataaagggtgagttggcaggagacagttcctgggtacatggataccagaacagcagttccaaccagaaaccatcactcttccaaaagagatctgagtaattgccacatactttttaaaataaataagcaaaaaggaatcacctccctgatccactccagagacactgcttcaagattaccagctagagaggatccctagaagagaaggaagttttggctgctctcttccagttttaagtctccagtgctactgaccaggagcttgaatttcatttggctttaaattgtatgagtccttaatctgtcacccctgcttgtcataaatgatattctattctctgctattctttcagtagagaaagaactaagtttttctaaaatgtaagtctagctgggagatgatcactctttatttttatttttattttaagttctggggtacatgtgcaggatgtgcagttttgttacagggtaaacgtgtgccgcgagatttcttatctctttgtctttagatatctactctttggtgactcatctgctacatgtattatctcagacaatattgtaacctgggataatgacatgccttttaatgaatgtaagtaaaacaatctctttattgcaccctatttaattcctcttgtccccttccagagggaaattgagcatctgcacaccaaagtgagtagccaggagggtttacacttggtttgagtagctctaggcacacagctatgacttacccatcttcctcatggcccccaatcctaccacacgttcctttgtttactgtcctttgattataagttatttcatagtgagtaaatgcttacatctaaaacattccaggagattacacactgccaactttattccatgcaaaaagtaagccaccctaggtcccttctataacaatttatctgtggtctggggcggggactggtgaccagctcatagcttttcggtttttatcagccagttccatatatcttttgaccttgctacttcctatttagaatcatctttgagatcaggatacagaatttcaacaaaataggtaaattgtaggctgagttgcagtttggattgcaagaatgaagagaaaattctcagaaagtataatattctctctttccccacctactccttaaaaaggtattccttgtaagtcactcccagccatcccccatgggactttgacagcagcagcagggagaggggtttgctatgaaatcatcagtgccatattggatgtaatagggaaaagctgtttgacctcttggatgagaagtcaatgcattgcaccagcaaagataatcaagttgatgtctggagctctggagcaaccctcctcttcagtgtattactcttacttgaatgctcaattatagaagttgaaaatggagttgtggaatctggattatgttcatttttttaaaatgatacatgatatttaagtgtaagcttggttttaccctgaaaggcagcaatgtaatatggtgtcaactaaacagcaaacagaatcctctactgccaaagtgcttcaggggtgagttgggctgaaacttcaggatctagaaataaaacaaggtttttctgggaaatagatatatggtacctatggaaagagcagaaggaagatagtatatgtggttgagttttctagttaaagagttttttattgttattgtttgttttgtgtttctgtttttgtttttttgagatggagtctcgctcagtcgcccaggctggagtgcaatggcgtgatcttggctcactgcaacctccacctcctgggttcaagcgattctcctgtctcagcctcccgagtagctgggattacaggcatccaacatcatgcctggctaatttttgtatttttgtagagatggggtttcaccatgttgaccaggctggtcttgaactcctgacctcaggtgatccacctgcctcagcctcccaaagtgctgggattacagacgtgaaccaccacaccctgcctagttaaagagtttaaaagtaaactttgaaagtaatatctaaatgttgcagatgtaggactttttcttcttttgtattttggggcagtgctagatctgtgttattgtaggggaaattaaaagatgcttttttaaaaaagcagatagcaccaaagtcaatgattagagattttttcatacatatatatatatataattatcacatcttatccataggtgtgctttgaacatatatatgccactcttctctgtcttctggaatgcagaccaaagatgttaaattgattcagttgagtatatattatactgcagattctatatgtataaagacaacagttctcgaaagttacccttactgaaaccaagtatagcactgatgtgatgaaacagtttggctgtatcttcttatgtcagttttcactgaagacctcctcttggagccaaagggaagttaactgaaagttctagaggttggcaattttccctttattctgagactccctcagaaaaggcgtgcataacaaagtaaatgtaaacaatatccttcatggttattaggacaagtaaatgaagaatatgaggccattattcaaaacctctgttcacttcctgtggctttttcaaagtgttccagcctcaagtcaggacaaatcacctgtactgaggctctagcatcttcagcagcaggaccaaaagtggtcatctcagcctgtacccccagttgtgtgtttgaagcagccattgaataattagtatgttccaggtattgtactttctctgttcatgtacttttagcactggattctcactataccttatgaagtagtttgcgttatactatagactaagaaactgaagcttaaagagagtaagacttgcctgaggtcacacagctattgaatgaccgtggggagttgaaactaggtccactgagctcaaatttccctaatccatggtacctccccacatgtaactatcatgccactaatatgttattttcatgtgctgaatttgccttttgtttcattattaaaattgattagactcagaacttttggatatattcttttcattattattgtttggtcaagatgatttatgttgatctgtttgctgaggatcaagaaaaaggtaagaatttaggagtttgggagtaagcagggaataaataaactatacatatttctaagtctgtttctgaaaaagttatgtgatctatatttggatattttacctacatttgaatattttctcaccatgatcagtatgcctaccaagttccttttctacttttcagggatttcttgtggctctcctccgcctatcctaaatggccggattagttattattctacccccattgctgttggtaccgtgataaggtacagttgttcaggtaccttccgcctcattggagaaaaaagtctattatgcataactaaagacaaagtggatggaacctgggataaacctgctcctaaatgtgaatatttcaataaatattcttcttgccctgagcccatagtaccaggaggatacaaaattagaggctctacaccctacagacatggtgattctgtgacatttgcctgtaaaaccaacttctccatgaacggaaacaagtctgtttggtgtcaagcaaataatatgtgggggccgacacgactaccaacctgtgtaagtggtgagtatgaaaagaaagctgggttgggaggttggggtcttgcctttctgtgcagaccacgttttgtaccctcctgaaggacaaacagtgtgaacatgtaatgatgagggtggaagaaggaaacaagggaaaaggtgaaagttatggcttcttcgtggaggcatataactgctcgttcaaaaaacatcaattgagcaaaggagtttaaagtacatggaaaaatgtaattaaacacacctaataattgagtagggtaagttttgcaaggatggggtcagagtttgttggggatgtgggaatggggtggttttcaactgtatatctgtgttactgttaaaatgagaagaacggtgggatcttatagcaaaaatacacccaatggatttgaaattaatgtataagtagctgctaacacagtctagcacaggtgatatcctgctctctgtggtctctgtaaacatgttttgaagttatccactatttccccaagtcatcttctgagccatcacatttcaaataaatgcctttgaaaatagggacctactgtaaattattcattccttctcttttggtttggtttatgttgctgctgaaatataaatctgaatttgaattccacaattacaagaaatggcaatatttgacaaaaattatactatcaaattaggtattttcttaataaagaacaatattgacaaattttaagcagattaaagagctgacaaaactgttaaattagtataaaatgggattctgtttattgattgattgattgataaatagccttggaggaaggagatcttaacgatagttacaaagggcaatggctgctgaaaacagttaagcctttgtaacaatttagacagacatatatgtatggacatggaaggatatcgtatacatgtcgctaagtagaggaagtaaggcatagaatatgtattagttgtacacacacacataatataggtgtatatatgtatcatgcataggatcccaataaactatattgccaatatctaccaggatagcccttgaaatgatagcatgctacttttggaacagagaataagcttaaggatagggtgagaatataggtgaaaattgactttttttggtaattgaaatttttcacaaggcaaatgtaattcatatagtgtaactaaaaatgaaaaataaggtactatttatggctatttgtggcataaaatggatacacttaaaccacacctgtttgatctttaaaagactaggttgaaagttaataccaactggctaccatagatcatgtgtcatttatttaaatccatatcctaagtcagcatctcgatcaagcttgtccaactcgctacccgtggacagcatgtggcccaggatggctttgaatgtggcccaacagaaattcataaactttcttaaaccattatgagattttttttttgcaatttttttagcttatcagctatcattagtgttagcgtatattatgtgtggcccaagacaatttttcttcttccaatgttgcccagggaagccaaaagattggacccccttgattctagattgtgaaggatgcatcatctgacggcttttttttcctggtatgtgtgtgtaaagttttccctctcgagtgtccagcacttcctatgatccacaatggacatcacacaagtgagaatgttggctccattgctccaggattgtctgtgacttacagctgtgaatctggttacttgcttgttggagaaaagatcattaactgtttgtcttcgggaaaatggagtgctgtcccccccacatgtgaaggtaccctaaatttacaatctattttaagaatctgggctgttctgttatttgccatgcatttctcatctttggtttgttttttagaggcacgctgtaaatctctaggacgatttcccaatgggaaggtaaaggagcctccaattctccgggttggtgtaactgcaaactttttctgtgatgaagggtgagtgtcaggattatttatgagatttaattcatttgtcttgtgtgtgcgtggtgtggactgtgaaacctgcagaagtctcctctgtgaggatctctgggcagtctggggtagggttgtgagaggtaatgctgataaaaggaacagatgcacactgattgaaatgaacttgtcttgaattgtaagtagaggctgctgttcttcagcacaaactgcctaatagttctgaatgacaaccttctgtctccaggtatcgactgcaaggcccaccttctagtcggtgtgtaattgctggacagggagttgcttggaccaaaatgccagtatgtgaaggtaggctaggcaactatggtctgacagcactgcattctcagcttaactaaaagcttttggttcagtcattaccttacagactcttactgaacacagaactcctagagatctttaaggatatgtgcttcaccaaagcatccttattttttgtttcctcaagtaaaatggggttcctaggctttccctcctctgaaagctatgcagaccttctaagtaggtagaccatatgcataaagaaaatagtgtatttggtaaaagaaatcaaaggatcagcagagtacatatactcaggaatgaagcttgagaatcaatcttctaaattatgttgctttagctgccttgactgattcattatagactcggatatcactgtcctaggatagtggtatcaagcagcatctggggcattctttgttttcaatacacctatgatcttgtcatttctttctgcaattcccctagaaattttttgcccatcacctccccctattctcaatggaagacatataggcaactcactagcaaatgtctcatatggaagcatagtcacttacacttgtgacccggacccagaggaaggagtgaacttcatccttattggagagagcactctccgttgtacagttgatagtcagaagactgggacctggagtggccctgccccacgctgtgaactttctacttctgcggttcagtgtccacatccccagatcctaagaggccgaatggtatctgggcagaaagatcgatatacctataacgacactgtgatatttgcttgcatgtttggcttcaccttgaagggcagcaagcaaatccgatgcaatgcccaaggcacatgggagccatctgcaccagtctgtgaaaagggtgagtgttccggtactcagaaaaggtgcttctgattcgtttctgaaaaattagaagaaggggttgtgggctttaggtagggccttgtccagtttatacttccctcaaatctactacatctaatcaatataaattttgtagagggcattcttatcactagccccccaccattgttttattttgtgggaatatgcttggaaaaaatgttaggaatcactaagtttctcatttctataggggaaaaaatgaggagaaaaatgcttgtttgtcttaatagtgacttcttaaaagagaagtcattcaagccctcattcctagggatatatcagaatctcccataaaaaacatacaagatgattccttatgaagggaagaggcaggagaggagttgcagaacccagtggaaagtgaacaacatctgcagcagcctctgtgcagaaaacaacaacaacaacaacaacaaaagattgggaaactgtgatctaaaattacccaaagctggtctgcaacatatgttctgtatcatacagctgacgccagagtggaattatagcatgaatatcaatttctttggctcagtttctttctgtggttgtttacttaagcagttatgttttgtttttgtcctttcatttagaatgccaggcccctcctaacatcctcaatgggcaaaaggaagatagacacatggtccgctttgaccctggaacatctataaaatatagctgtaaccctggctatgtgctggtgggagaagaatccatacagtgtacctctgagggggtgtggacaccccctgtaccccaatgcaaaggtgccaggcctcaaatgtagacattttgttaactttaagattgccttgaattaaattctcatcctagtctcttttcttagtggcagcgtgtgaagctacaggaaggcaactcttgacaaaaccccagcaccaatttgttagaccagatgtcaactcttcttgtggtgaagggtgagtgaaggctgacttagtctgacccaattccggtgtatcagcacacactgcaggctctatgtaagagtttgtatcagtacaccctgcaagctctatgtaagagtttgtctcataggtgcttgcctgtcacatggtcatggaagtgtctatcatactatttttccatgcatggaaattatgcctgtgcaatgagaagttggtgctgatgttggctacatttttgttgctattgcttcttggcctgaaagtagtgagtctgcttgggagccatggctcttgcctaacttaatggtcacctgatggcaaaatgacatacgtgactctgtctctaggtacaagttaagtgggagtgtttatcaggagtgtcaaggcacaattccttggtttatggagattcgtctttgtaaaggtgagtagcaaaaatgatataggagctgaaataatgtgagatctatacatttcctgggagatttttgttttgggacatgttatgagaattagagtattagattctgttctattgattctgccaatagttatggttgcacagttttaccatgtctttcttttgctacctttttcttcatcaataacttaaatctactttgttactgattctattttgtggtttacgattatgggaataatgacagcggtgagtatatgagccaccatcttaattttgggtataccacagtttagtggagagagtaagggataggtgtcagatctgaattcacattctgtctctactgcttactagtgtgagaccttggaccacttgtacaactcctctgaaactctagcctttcttctgtaaagttggcataagactacagactaggaggtccagagaatgtaaataaaaagtaaaaaggaccaggcacagtggctcacgcctataatcccagcacttcaggaggctgagggcggcagatcacaaggtcaggagatcaagaccatcctggctaacatggtaaaaccccatctctactaaaaatacaaaaaattagctgtgtgtggtggcatgcatctgtggtcctaactacttgggagactgaggcaggagaatcacttgaacccgggaggcggagattgcagtgagctgagatcacaccactgcactccagcctaggcaacagcgtgagactccatctcaaaaaaaaaagtaaaaagaaacgtagaaaatttaaaaaacactacagacttcaaattattcaaattaaattgtactattgctactttctggatgaggaaactgcctatcacaaagtaggtgctcattcaacaataagttttctcagctagccatataaaccatcatatcacctcagcacagagtaaccaagaaagcataattctattaccctgtgtcttttattctcctattgcctaattaaaaagaattcttcttttaattagcaatttactactgggcctaactaactcctaatgtgatgttgatcaaccacattcactttgaataaagattttctttcctatgaaatgtgtttaaattgcattttacatacttaatgagctttcacacaactcacatcatgaaaatgtacccataccgtccaggaaacaacagattcataaccagcttcatttggtggttctttgttctttggtgtctaatacaggaactcaattctacagtatcttttcatctctctagaaatcacctgcccaccaccccctgttatctacaatggggcacacaccgggagttccttagaagattttccatatggaaccacggtcacttacacatgtaaccctgggccagaaagaggagtggaattcagcctcattggagagagcaccatccgttgtacaagcaatgatcaagaaagaggcacctggagtggccctgctcccctgtgtaaactttccctccttgctgtccagtgctcacatgtccatattgcaaatggatacaagatatctggcaaggaagccccatatttctacaatgacactgtgacattcaagtgttatagtggatttactttgaagggcagtagtcagattcgttgcaaagctgataacacctgggatcctgaaataccagtttgtgaaaaaggtaaaaacccaataagggggaaaaaaggagagatttacttaattattcttgtttattatctcccacccaaaactgcatcatggaaagaggcaagaggggcacagattactttctgtttcttccatcctataatagatgttctctgtgttgtgtgtgtgcatgcaaatgcccccttggatctgggatctattcagggtagataatgagagagcctttttaaagagcaaacagcattcagtagtgaatttgagcttcatgatctttggcatcagagtttcagactgtctgtccaatgttgtacacttagtgttcttgagtagaaattcctctgtgttggtatttatgtagggagtttttctcttcaggctgccagtcacctcctgggctccaccatggtcgtcatacaggtggaaatacggtcttctttgtctctgggatgactgtagactacacttgtgaccctggctatttgcttgtgggaaacaaatccattcactgtatgccttcaggaaattggagtccttctgccccacggtgtgaaggtactttaagttccagagttgtccttctctttgatatgagacatctataaatactgtaattccatccttgcttctccagaaacatgccagcatgtgagacagagtcttcaagaacttccagctggttcacgtgtggagctagttaatacgtcctgccaagatgggtgagtatgaagtggtctattctgagaaaaggtctcaaccttgttttgtggattaacttgaccttcaacttgtcttggtggcatcctttagaggctcctcattgtcacaggcatggagaatatgaggttccaatggcctaaatagcaactctgactcttcagtcgtctcttgacatggaaagggctttgcttaactcaaaagtagtttttttacttggagtaaaaaaaagtagttttttactagaatttcaactcctctctgccaaagttcttatttagaagtccctttttgcatgcagtttgaagagatatgatattgggaacaggaaatgcattataatctgtctctctgtaggtaccagttgactggacatgcttatcagatgtgtcaagatgctgaaaatggaatttggttcaaaaagattccactttgtaaaggtaagttagaaaaaataaaagcctgacaatggtaatggaggattagagagggcaggccactgaagaattagtctactgctgcttcagcagtcttaggcgtctccctcattggaggttagataagaaaaatcttatggtgttggtcagtattgacactgagaaacaacattgtcaagtaggaactgtttttcatgcatctgctaattttgctaacaataacaaaatatatagcccatattcctaggtcatgggaacatagctgtatttctttcttccttcacactttactctattttctgaatttttatggagtatatagtactcctataatcacatttaataaagctgtttttaaaaaaagcataatccatattccaaaatttaagttattttctagttatgtgaaatatatgcagttgcatattgtcatttgtacctgaatgaagaccgctcaccttgaggtactagctgaagtagaactccctaaatctcttctgcagttattcactgtcaccctccaccagtgattgtcaatgggaagcacacaggcatgatggcagaaaactttctatatggaaatgaagtctcttatgaatgtgaccaaggattctatctcctgggagagaaaaaattgcagtgcagaagtgattctaaaggacatggatcttggagcgggccttccccacagtgcttacgatctcctcctgtgactcgctgccctaatccagaagtcaaacatgggtacaagctcaataaaacacattctgcatattcccacaatgacatagtgtatgttgactgcaatcctggcttcatcatgaatggtagtcgcgtgattaggtgtcatactgataacacatgggtgccaggtgtgccaacttgtatcaaaaaaggtaagatacttggaagggataagttatgggatgttgtacagaataaagaaaagaggttttgaatctgcacttgacattctgcctaaagaaaagcatctaagagctaaggcagttatattgttttacaagatatttgccttttcctatcttctcacttgattgtttgttttctctttcctttctcagtatattgagcaataaatagtacatgaaaggataatggctaacttccaaattgatagcatctccaaaaattgttattgttatgactttagtgtaagaaaaatgcacatacatttttggcaaatgtttggcagtaatattgctaattatttgatatttaaggctatgttgccagccagaaagagaactttgggtgttctggagaattaattggccctccaacccattgaattgtctttcttgtaattgtagttatcatttggcagccttattcctgtccatgactatctacagcagaggctgtttggcaacggttgtctttgaccagcacagtaatcttaagtgaaacccatcttcagtttaagataaatagtgagcttgcgagccacaagaccccctttgcttcccagcaaggcaccagtaacttgagctgagcagtggctgccacttttagaaggacaggggctctctgacttgtcgtatctggtggcttcacttcctagctctcgtagacatttgaaggtgtaaccatgtctgctatttaaagggaaaggaaaagaaaactgttggctgatggattaccattgtgaactgtatccattaatgtttcattatcttattttttaacacttttcttcaaatcatattggctatcagtaggaaatgcagatctccatccagtgttgctggtctgggtggaatgaatgaatgtttttggataccagttagttggcttgttgcttctggccttcctgtatcgctatcacccagagatagtgcaggctatgtgttcctctgtgctgagttaaagaccctttcttattggtgtctaagccttcatagggtgtccacctccgcctaagacccctaacgggaaccatactggtggaaacatagctcgattttctcctggaatgtcaatcctgtacagctgtgaccaaggctacctgctggtgggagaggcactccttctttgcacacatgagggaacctggagccaacctgcccctcattgtaaaggtgctttgtctattttttattcttatttttatatcaaatttgtgccaaatagatatattcagttgggtactttcaacttaaaatagccaaagaaatgaattaactgtctgattacattaaaggctttaattagattaatacaatcattaaatatctcaaaataagaaaaaatgtctcaggctgtagtctatctggtgaatgaccacttatgtagtcatttacacatagaaagttggagttatgtctgtaaattaaacaaccaaagcacagattgtatttacacactgtagttacagttatgttaagtgtgtatttgataaagtaccaataaaaagcacagcaatcttttgagaatatttactgagtgttggtgggattatgggtacatttttaataaaagtttcagaaagtcattttcattgtcataaacagtgcatatgaaatatgactagtaaattagtgtctagtattcattgaacactttttactctatgccagacactgtgcacagcacctgacatgcattatttcatttagtcttcatgagagccacatgaggttggtgccatgattatccctgttttatagatgaggtttcagtagcatggagagatttggaacttacccaaagtcacacatctaggaagtactagagccaggcttcaaatccaagatctcactgtgttaatccattctcacactgctaataaagacatatctgaaactgggtaatttataaaggaaagagatttaatggactcacagtttcacatggctggggaagcctcacaatcatggcagaaggtgaaggaggagcaaaggcacatcttacatgatggcaggcaagagagcgtgtgcaggagaactgtcctttataaaccatcagatctcatgagacttatttactatcacaaaaacaacacaggaaaccccacccccatgatccaatgacctctcaccaggtccctcccatggcgcatggggattatgggagctacaattcaacatgagatttgagtggggacacagccaaaccatatcactcacactattgatgactacactgaaaagaagaaagaaatgagaaagcacgcacatgtatgaagaattagagagtaaaactagaagcagaaaataacagtaattcagaatacttcataatattaccaattcggccctcaccatttctccaagaagccattaaaattatccatcactgtttggatagaaactgaagcaaaaaacacaaatataatctggcttaaattacccagaggttattgagatagagggctgacagtaaaagattgtgtctaggatatagtcttatcctatttcagtgcagctttccttactgagagtgaaacaggttggttttataaatctttctattaagggaaatttctgctttcttggtaaaaggccaaaatatgactgtgcttgaattagatttctttaatttcagaggtaaactgtagctcaccagcagatatggatggaatccagaaagggctggaaccaaggaaaatgtatcagtatggagctgttgtaactctggagtgtgaagatgggtatatgctggaaggcagtccccagagccagtgccaatcggatcaccaatggaaccctcccctggcggtttgcagatcccgtaagtaccaagggcttcaccgccgcttgtaactggctaacggagagaagagagtgagagtttccctcagcgtggagagtcctgggttttaaattgacataggtttgtgaccagttgtataattacagaggaacttgaagtcagtggtctattctagaaaaagcacagcttggccaggtccgtgacttctgcctgtgataccagaattttgagaggctgaggcaggaggattgcttgagcctaggagtttaaaaccagtctgggcaatgtagtgagacctggtctctaccaaaaaaaaaataataataataaccaggcatggaggtgtgcacctgtggccccagctactcgggtagctgagataggaggatcacttcagcccaggaggttgaagctgcagtgaaccatgattgcaccaccgcactctagcctgggcaacagagtaagaccctatcaaaaaaaaaaaaaaaaaaaaaagaaagaaagaaattaaataaaataaaaaagaaaaaggaaaagaaaaaacacaactttcttaggatggggaaagtgaagaaaagaaaatagaaacactaatttaaaaggaacaaaaatgtgaaacaagcaacctgaaattttgaaaggagttgctgcatagaccaccctacgtgctgaatctgagttaataagtgcttacaatttgacagggaactccagaaataggttaaataaatagttgttacagttaatatttgcattctaacctgagaaatctctgattataaagttgagtatattgtttttgtcattggtggactcccccaatctacttagagtgaaaaaaaaaggccagtgagttgctacataagaaacaagtggatataactcaaggttccaatacatcttttttatctgttgttttttgtttttgtttttgtttttgtttttgttttaaatagacacaaggtctcactatgttgcccaggttggtctcaaactcctgagctcaagtgatcttcccaccttggcctctcaaagtgctaggattacaggcatgtgccactgtgcctggccccagtacatcttttaaatcgacttggaagggagctagagtgttgatttctgggacattaccatgaaacgtggggctacattgaattatgacactatactgataatcattttcatgattttgtactatttttaggttcacttgctcctgtcctttgtggtaagtcttcttaaatacttgaagaaaagctcttataatattttttaaaaatatgtaatgctagaggtcctatatcctatctgatgatatatttaactcatagggaatgttctctttttggtgttttaaagatacttcaatgtacatgtcacattacaaaatgtcactttggcatagagttggataaattatttgaacagccagctctttcttctttttaaattgatattttagtttttattaactgttggtgtttggcttgatttggtctattgaaataggcaggcttcttctgctgtagcaaaatacatttcacagctgagagttaaatgttatgcaaaattataagaacctggtgtcctgtgcacctaatttctattcttgagatttctctcttgtcacctcagtgacaagattgttactaataaaactaaaaggaacagaaaaactcaatgaaaagttgactggaaccttgtggtcatgtgcttggtgctttagattaaaggtggactggatcaaatcagaaaaaccttaagctcaactatgattattcaggaattcagcatttatgtccaagaagagttaagtatgagtcacataacattttccccaccactagcaataggccctgcaatcagtcagaacaatgtaggtgatcgtcttctggcatttgatacttgctggatttttcttctaggtattgctgcaggtttgatacttcttaccttcttgattgtcattaccttatacgtgatatcaaaacacagagcacggtaagttcaaaggcgaatacttgattgaccaacatgcacaagtggtttcggcttcttgtctgaaactaaacacagaagcacaagttatgtgaaataaatactgcaatgtgataactaaatgaagtatctcgtgctatacaaaaggaagccctttctgtaggacttaagagatatcaaacacttagcttattttattgaatgatgtttattcagatagtatattgtaaacaaatctagagaataggaaaaaaatcccagtgggaacgactgcaaatactttggtgtattcgtatctgatctttttcgtatattttttctctctttaaactgaaattttgtcattttcatcttctgtcttgatttttttcatttagactcatgtttatgtttttatgctttaagtcatgttttcagttactaaatagcatattattctattctgtgtatttatatatgtatttatgtgttttaagttccttccaaatttactttgataatatataaagataggagtagcacctctggctaaaccttttttcatacccacttatttccttagaatagatttctagaattactaaagataagtgcatgagcatttaatatacttgataactattgtcagatgacttgccaggaagtttgttcttagtaatatttaatgtactgggatatgtcgtgtttctcaaccccttttcctgcttcattgatttgcctgttccattacaaaccactttgtgtttaattaatacctttatgttattatatctggtagggcaagaattcacactacaattttataggactttcctctctattctcttctgtttgttcctataggtgatttttagaatcatttataatttcaaaaaaaaattgtgattacatttaagtctatagataaatttgtgagaaattggcatcttttctgtaatgtcttctcattcagaaatatactaggtctttccatttgatcaagtaatcttttctctcccttagtcattttcatgattacttaatattaactatattactacgtttctatgttttggtatgttatgttttcttatccagaaattagatatatttttgcatattatttttaattatttttaaacatcttaatccattaggaatttattttatggtatggtagttgaagtaaacctacttgtactttttttccctatatattcaattttttcaaaacctattttgagtaaaccatcccttcaccattggtcatagttttctttatcagataaagcacgcctattcaattcttgtgtacactggggcttatgtcagagatatctgacataaatatgcaagatagattatattccactgatcggcctgtctctatgagccagagctactctattaataaatgtagctttttccgagatgtgttccccctcttcaaaactattttgaaattttcttctatttatttttgcagataggctatagaattatttgcaccacgactacacctcccataccctagaaaaataaaataaaatcttagatcattgataggaagtgccttaaacctatatatttatttgggaagaactgacctcttcatgatattcactatttccttccagaaataccagatgactaattattcagatgttttgttatattttagttaaaatttaatagattaccttatataagctacatagccataaaagtatcttatttttattgctttataaatagaatcatttttggttatgtcttataagtaattgcaaatgatatctaggaaagtctatctttatacagtcattaattctaatagcttttcagtgagttacccaatcatctaagtagaaaactatattttctaccaattattattattggtagaaataatttctacctcatatctaccgattatacattttcatttatttgtttttgtctcattttactgagaagaattttaaggaaaatcttcagtaatattagggaatattggcatattttaacctttatttttaatataaagcctctagtgttttatcactaaaaatgatactgcatccttttttcttttctatattacataaagtgtatttatagtcacaaaagttgtttttccctatttaaaatcactgaaaaatcttgtttcccttctttaagcatatttttatatcactataaatatttgcataaatttttaaaatacaaaagtaaatatgcttgttgtagcaaattagtttataaagatactgaatagtctcttccactgaacaactgctggtgccttcaagtccaacatattaagttgatggatgtcagcaatttgctgtagatactttcatatgttgctctatctagtatatacatgcatggcttttaaaacatttgagcagtaatgttagagaaatagaagtcatgcgaaaagaggaatgaccacgtccatccattcttttcttatacaacaatggctgagtgcctactatgccttagcactatactaggctagaatcacaaagcctagtagcatatggcctctgtcatcaaggaggtcacagcctggtaaaggaggacaagcatgtcgctaaacaagtaccataaaataacgtcgccatggtggattatatgatatttggtgaggatgcaaagcaaatggtcaatatttgggagttttaatcaggaaaagtttcagcgtggaagagatgtttcaggtgagcctcaagagagtgtagacaagaagagaaaggcattccagacagaaagagcagtttgaataaaggcccagaggcttggctttccatcatgtgttgtgagaactacataacccatttgaaatggctgggaaatagtgtgtgtgtgatggtgattgaaggcgaaagtggcatagctttaggtggagacatgccattaaagaaaaaaaaaaaaaaccctgacacgtaaatcttgtggaagctacagaatactaatatgtgcaaaggatacatttttaacaaagcataccgtcaggtgttggcctcggatgttatgtgtgcataggttcgtgagtctttgtacatgctagtgttagggcggataatccaatgaagtcttaccaactctcaggtagctccgagtggggagatgaccaagtcatgccacctaaaacatgtcaccaaaaagctccagcaaaatttctttcacgtgccaagtcccctgcatctatcatttaccctgccaccagtgccatctgatgccatggctcagttatgtaattcctagaataggctcagacatgaaggggttgcactgaaactatgtactgagggtatctacgaacctgggcagtttgttctaggctggaggcgggagggtgagggctgcctatggggttctggctgtcctgtacagttagcgtgtacttagagtgtagagtttaccagagtgtgtaccacacaaccctgctttcatgaatgacttcagaaaaaaagggtgttctatggcaaataagatttggacatactgcacactgtttttttttcttgtggagaatcacaaggaccatgagaatatttaataagaggttttttgctatcaagaggacaggatttccaggacttggtgacatgctggatgtggggagaaggaggcacatagaatggctcacatgaaggcgatgaggtggaccccctgactcactaaaagaggagaggggcaggatttgtgggggaagatgaggagttcggttctgacctggtactttgaggtactcatgatttagggcttgggagaagggtctggactcgggtgggtgacacttaaatcacaatgaaagctgtggaaccaaaaagaacagaacagataaaaattgggatgagaacagccctcagaagaacagtaatgttcaaaaggcagaaagtgaaggaagagaggcagggggaaaactagcagagagtagcgtcacagaattcaaggagaaaagggtctcaaaaaaaattagggatgtcatttgcagggccttcctcataggaagtcacaagataatttcagccaagaggcattagaaatgtaaatacatagaaaatacagtctctatctctttccttcatgctactgagtttgctatcagagcactgcatgtgtataaaaatttgcaaatttggggaatgcttacaagtgcaaataatttataatattccagtctaattattgtttattaatatgattatatcatgtactatacttaagtgcctcaactgatatgaagcaaacatacctgtttaaccagattcctagttgccattcatttatttccatttgctaacccacttcaattgattttccaataattgataaagacacttgaatggcctgaaatgcttttttaaatgagatgagtaatcatttaaaaatgaatgtctagtgacaatattaaatattttgaaaagccatctaaacacttgaaagacactatgctattcttttctagtcatctaagatattgtaacaaagcttaaatctcacattgacctaaaaattactgttttataatcttcttaacatatctcctgtacacggaactcttcaatattctagtgagtgacatgctgtcagtgtctttagcagtattctttcttccccagtaattttgtattatgttattttagagctttacatggtagtataatcacattttattgtcttttagtaattctggcaaagtggttttagaagcacaatgaaatatgtgtactttcaaagaaggaaagtaaaaacattctcttcaaactcgtttaaagcttttaagtcagactagaacattgagtcccaaaagggtaaagttatgatctaaaataagaacttatttttgcttcttttcttcaatttggaagttgtagttgttagtcattaagcgtcctggatcctagggtaaagctgcttagtgtcagcctctgacttgaacacttacaagcctagatcattcattttttatgtgcctttccaaaaaatggagttacagtgtttacacttcataggataaaaacaataaaaatgaaatcatcacagaaaaccaaacaccgtatgttctcacttgtaaatgaaagttgaacaatgagaacatgtgggcacagggagggaaacatcatacactgggacctttcacagggttgggggttaggggagggatagtattaggagaaatacctaatgtagatgacgggttgttgggtgcagcaaaccaccgtggcacatgtatacctatgtaacaaacctgcacattctgcacatgtatcccagaacttaaagtataatttaaaaaaatgaaatcatccacaaaagtacttaccatgtgttgggaattatggaaagcaaacaactgctacattgaaacatggtcaatgagtaaagatattacatttttctttcttcttctgtttagcaattattatacagatacaagccagaaagaagcttttcatttagaagcacgagaagtatattctgttgatccatacaacccagccagctgatcagaagacaaactggtggtatgtaatgaaatggaatattattaatttacatataaaatttccttcaacttgtatttatcaataagcgtagcattcacggtgtatatacatgcttcttactattgcacaagtcttcagtaatcatgcatagcaattgttcatttacctacttcattttgccaactaatgttccaattttttaatccattcatccattcaacaaatattaaactaaatagcaaaacaactaagaataaaatcaataagatgataagcattatatagagacataataaagcaggcaagggggataaagagaacagggtggtcgcaagggaagctcttactaagagaatgtcatttgagaaaaaactcaagggaagtaaagagccagggccggccttggtggctcacgcctgtaatcccagcactttgggaggctgaggcaggcagatcatttgaggtcaagagttcgagaccactctgttcaacatggtaaaaccctgtctctactaaaaatacaaaaattagccaagcgtggtggtgtgcacctgtggtcccagctactcgggaggctgaggcaggagaatcacttgagcctaggaggcggaggttgcagtgagccaagactgcgccactgtaccccagcctggacaacagagcaagactgcatctcaaaaaaaaaaaaaaaaaaaaaaaaaagccagccatgtggccatatgagggaggaggattccagaaagaacagtaggtgcaaaggccataaggcagtgtgtgccagctgtgttggcggcacagcaaggaggccagtgtggcctacagttgtagagatgaagtcacagagatgggggtgggatgtgggcgagaggatgatcgtacaaagtctgctatgtcattgtaatgggatggtgggcaggagaggatgattgtataaagtgtgctaggtcatggtaaagagattggtttttatttggaagcttttaaggagaggagcaacacattcaccttaactgctgtgttaagaacagactgtaggaagccatgggtggaagatgggagtcaatgaggaggctgctgcaatcatccaggcaagaaattgtcagtggctaccaccaggttgtaagaagaggccagattctgcatgcaattttaagacagtgacagtaggattcgtggatagtttgtatcagaatatgagaggaagagagctgtcaataatgacacgagggcttttgcctaagcaactggaaggatagaactgccattaattacatgattgagattgcaaagagcaggactggggagaaaaatcaggagttccactgtggagatgttaaatgtggatgtctaatagacttggcaagaagacagctgatgtacaagtctgtattttgggcaattggtccaggctggagataaaaatttgggctttgtcatcatgtggttgtacataacaaggagactgaataagatctccgagaagtgaaagaggctagcaaaaagaaaaggtccaagtactgagccctggatcctccaacattagaagtcatggagtgagaaggcacccactaagaagtgaaggagcagcctctgatactatccagagaagaaccttaaagtcaggcaaagaaagaattttagggaggagggagtgatcaactctgtccagtgttgctggtaggccaaaaaaatgagccctgaaaactgaccattgaaattcagtagcacaatttttttgctgttgttgtttgagacagggtctcactctgtcgcccaggctggagtgcagtggtgtgatctcagctcactgcagcctctacttcctaggttcaagtgattctcatgcctcagtctcctgagtagctgggattataggcaagcagcacaaaatttgctgctgaacttgacaagacagtttttgaagagaggaaggaggcaggagcctgactggacggagcttaagagagaatgaaaggagagaaattgcagctatcaaatacagacaactctttctaggtttttttctataaaaaggagcaaataagtaaagtgctagtaagagtaaaacataaagtcaacagaaatattttttaagattggagaaatagcagttatgccctattcctacatgatgatgggaataatttagtagaaagggaaagagtgatggcagaaagagagagaagaattgctcgaacaaggtctgggtaagctaggaggaacagattaagcagaggagctcctagctgcgtgggcttagtaacaggagggagggcagaatctgcaggtgcagatgaaggcaggttgggagctgtgatggggagtgaacgtgtggaagttctcttccgatgattcagtcttctcagtgaatagaaagcaaattattcaggtgagagtgaggctcagaaaggaggtattagagagttaagaagaaaaaggaaggcattaaatcatcaactaagaactgaagactgaattatagggagtacagaaaggccgacaggccacatgagatgtgcacctgagtttcccatgagaaagtggggatgaacatttgaaggtttactctgtccggggattatgtgacagtctttcatgccttctcttacttagccatcagtaccactttgaaaggtgggtgttctcccaagataatatcaagatgaagaaataatatccaagaaaaccttgggcaaggtctcagggtcaatcattggcaaaggtggaatgcaagctcatgcctgagtttaaactgctttctcctacataatctagaaaataaagataccagccaggagtggtggctcacgtctgtaaacccagcactttgggaggccaaggcaggcagatcacgagttcaggagatcgagaacatcttggccaacatggtgaaaccccgtctctactaaaaatacaaaaattagctgggtttgatggcacgtgcctgtaatcccagctactcgggaggctgaggcaggagaattgcttgaaccagggagttggaggttgcagtgagctgagatcacgccactgcactccagcctgctgacagagcgagactccatctcaaaataaaataaaataaaaaatataccacctctgtcctcttggaacttattttaataagataaataagacccataaatatcataggtaataatacataccataaacaaggtatagaaaatctgtgatggcagttgaggaagaaaaggtaacctgctgctggtgagtcctgacagggggaccatactagtgacctctaaatccaaaccagttgaggtacagagtacacctagctcataaatatttgttgaatgagtttatgaatgagaaagattagtactttcatttctcatttagtttaattcatgtttatatgaatgtatataaaatgtagttatttgttccagagcatgttatatgaagaaaggcctttcaatagaatgatatcttctaatagacttgatgctttgttggttataccagctgtaactggtatgtaaagagaatgttagcattatttaaacttcgagttgcaccgctgctattcatgctgcctcctaaacagaaatgatctatttcagtgtgcctcattgcttggaattcagcggaatattgattagaaagaaactgctctaatatcagcaagtctctttatatggcctcaagatcaatgaaatgatgtcataagcgatcacttcctatatgcacttattctcaagaagaacatctttatggtaaagatgggagcccagtttcactgccatatactcttcaaggactttctgaagcctcacttatgagatgcctgaagccaggccatggctataaacaattacatggctctaaaaagttttgccctttttaaggaaggcactaaaaagagctgtcctggtatctagacccatcttctttttgaaatcagcatactcaatgttactatctgcttttggttataatgtgtttttaattatctaaagtatgaagcattttctggggttatgatggctttacctttattaggaagtatggttttattttgatagtagcttcctcctctggtggtgttaatcatttcatttttacccttacttggtttgagtttctctcacattactgtatatactttgcctttccataatcactcagtgattgcaatttgcacaagtttttttaaattatgggaatcaagatttaatcctagagatttggtgtacaattcaggctttggatgtttctttagcagttttgtgataagttctagttgcttgtaaaatttcacttaataatgtgtacattagtcattcaataaattgtaattgtaaagaaaacatacaa

SEQ ID NO: 1641 - DNA, 35596 bp, Homo sapiens; identical to SEQ ID NO: 1640

SEQ ID NO: 1642 - DNA, 115460 bp, Homo sapiens
acgggggcggacctcggcgcgctcccggccgctcgctggctccggggccgcggcggctcctctgccgggtcgcgccggacgactggcttcgggcggcggccccggcggcctgtggacggacgggtgggccgaggtacaggccccacggccgccgtctcccgcttctgcccgcgcagagtccgcgccatggccgcctcgccgggctcgggcagcgccaacccgcggaagttcagtgagaagatcgcgctgcacacgcagagacaggccgaggagacgcgggccttcgagcagctcatgaccgacctcaccctgtcgcgggtgagggcccgggccggcgcgggcgggggcggccacggccgcgggcgggacccgcgcggcgggtgagaggttgcggggccaaggcgatggcggggccgggcgggggccgcgcccgggaaccggcggctgggagggggaccggagcggccgcggcctcggcgtttccccgcctggcgacacccgctagccgttcgcgatcccgggctgaggtgggagggtcgcccggccccgtgtgcgggaagatgggcaggggtgaagcccgtggaggcgggcggccgtgcgagggcggcctgagggggaggaggacgaggagccccgagaggaaatcgcaaacagctcggaggccggccgggtggcgcggcgcggcttctggtcgctccgaacatcccccaccatcgagccctgctgttctgccggcgtggaaggccgcgggcaccccagggtcccacgcgctcgtggggggagctctgtgcacaagtccatccagggcccggccctggggtggctcgggttgttggaaccacgacgggattccgtgtcgagtgtgaggctctgctccttttactccttggaggtgctttatcgggtccagtttactttgttcggcccgggatatttagtgagaactgacaagcgtcgctggtgactggagagggacctggaggaatgagtaaggcgcgagccgggacaaacacctggagaggttaggtaaccgctgagtgaggcagtggaggatggagagccaaccggagtgtccgcgcagggttgcagagaaggggggtcagcaggagtggggctggccttgaggatcctgaatgctgaccttggaggaccatcgggaggatgggggaggatctgcagattctgggggactgaggcgggggagacagtttgaaggagagctgagagcagagttgcaaaccagctgagttgcagacacattattttttggccagcgcagtgtttgggaaaaattattgaatctgttgccagaatttttaaattggaagacttccacacaaaatccaaatttccgtattatttatttattattatttatatatgttaaaaattgggagacctggtaacactaattctgaattcctacatgacagctaccgacctgctggagctgggtgatgatgaaagggagctgagctgagctccctttcaaatggagtaagaactctagtttgccaccgtccactctctgtcacagtcccccaaggggagattaggtgacagttgccatttatactcatgatggtgttttctttcagtgaagttaaggaaaaagtgaaatatttcctgtacttacatttctgttcacattgagaaaaaatatatatatagagagaaagaagctgaagatttcaagaaaatgttttcttataccctatcagcttcactcattttttacctgcctggcatccactggcatttacatctgtgaccttggttagattcagagatgaactcgataagctcagagcacgttgaaaagaatgggtgggtgaaagctgaggattagtgttggggcctgtgttgttatgtgtttttaaatacatactgtacattgtttatgtacaaatacatgcactgtatatgtctgtatacctatggcggatccaatctttcacccaattcatgaatcttctttaaaatatccctgacaggtgaggccatgagtaatgtacagactctcttttaaaagcaaaaatttttcacagatcctcactgtttacttactttcaagtaaaaaaaaagtgtttacttactttagagaccctgctatagctcagggtctcttgaatttagcaagcctaatcaactgtggcccatatgataattcagtcaccactttattctaattactacaaaattatggtgtcattttgcccttcacctggtacagggaatcatttacatattaattctgcccgtgttttcttcttggccagttaccagtaaagtaacactgcttggctccaccgtgttcataaacacatctgtaaatgataacactgaatttggctactaatgtttgcttatttaaaaatcttaagggttattttcatgaagaaatcacaaaattagaacacttctcatagagaactcttagattcccagcatgtctatgaagaatgcgtctctaaggatccaaagatcccagttggaggagtatctgcctagttcataattggtaactgggtggcagatatactgacttttcattactagcccatgacagacatgctaattcctgacttttcattactagcccatgacagacatgctaatcgatagggcagacattactgatctatctagatgctctttcccctctgagcctgtgttgggattcaagttcttctctacatgatcaaagcaatccttcagagttggccttacttacctattcacctaggcgttacttatcctattcacctagtgggtaggatagactagactgtagaggattttctctagctttagaagtccggcattatcaggaagcagtgggaaaattttgagaagggagtactaggaggaggagttgagtggtggtacctggaatggtaaagagagggaggaaagtggggtcgggcgtggtggttcacgcctgtaatcccagcactttgggaggctgaggcgggcagatcacgaggtcaagagatcgagaccatcctggccaacatggcgaaaccccgtttctactaaaagtacaaaaattagcctggcatggtggcgtgcgcctgtagttccagctactcgggaggctgaggcaggagaatcgctcgaacccaggaggtggaggttgcagtgagccgggatcgcaccgctgcactccagcctgggcgacagagcaagacttcatctcaaaaaaaaaaaaaaaaaaaaaaaaaaaaaaaaaaaaaggccgggcgcggtgggtcacgcctgtaatcccagcactttggaaggccgaggcgggcagatcacgaggtcaggagatcgagaccatcctggctaacacagtgaaaccctgtctttactaaaactacaaaaaaattagccgggcatggtggcgggcgcctgtagtcccagctactcgggaggctgcggcaggagggaggctgcggcaggagaatggcgtgaacccggaaggcggagcttgcagtgagccgagatcgcgccattgcactccagcctgggcgacagagcgagactccgcctaggaaaaaaaaaaaaaaagggaagaaagtggttgcaggtatgcctgggaagaggctgttctgttgttcatttattaatgtattcatttgtcagtatttgagtgcctactttgttgttaatggggtgtgtgtttgtgagggagaagagtgaaaacatggggctgtcctttaaagatcttactgatttgttccacaaatttacttactgagtgagtccttagtgtgtgccaggggttaggatggacactgggtatatagtaatgagcaagcaaaacacagtgtcccagtggattttaggatttaatgaggaagacattcatttaataagtaaggacacattttggtgaatatcaccaaaacagaagtaggtggagctctggacctgtatggtagggaattctcacctcttccagtggcctaaaggctcagggggagtgggggaggcattcgagggtttgtgtgttgagggagggaatatgttgcaggtacagagaacagagattcagtaaaagaggatgaggaggggatgtgagatgaggctggaggcattcatagggatcaggttgtagagacaggatttggaacttgatcttaagggcaatgggaagtcactgaaggggttaaactatgtgagatttgcttttttaaaagattcctctagctccagcgtggtgggtagaagagaggaggaggaggattttagtaggagatgtgatagtggcatttactaagatggtggcagtcgggaggcagagcggtgagcagattgatacttaggaggtggaaagggccagattttgtgaatgggtgaggaaggtgagaaagagggagggctggaaccatttcagggtgttcttcattaagtggacactggcaggagcaggtttgtgcggaaatgctgagtttgaggtgcctgtgaggcacataagtagagatggtccagcaggcagctgtttagatggttttgcagctcgagaaggaaggctgagctactgagaaaaatgggggaatttttgttatgtagccacagaagtagatttggctgcctaggaagaattgatggaacagatattgtaaactggtggcttaagttctgtattttgccctctaacatgtttttggttttggcccaaaatgtggttagttggttggttggttggttttaattagggctaacaatgaatattgggattttatagtaaaatctggactttggtttcttttgaaaaatgagataatccaacgacactcacccgacatttctggacggcaccagttgcctggagctgaatggtggctgccccattagaaaggccatggatgtggtcttcagtttgccacagtccctaccaccctctaaggtattctttgcagtgatcccagactgcttcacttagattccctgcttggcagctgtaggcatttgagtttgttacccttgtcagaaggtgaactgtgaggccaggcgcggtggctcacgcctgtaatcccagcactttgggagaccaaggcaggcggatcacctaaggtcaggagtttgagaccagcctgaccaacatggagaaaccccgtctctactaaaaatacaaaaaattagccaggcatggtggcgagtgcctgtaatcccagctactcaggagactgaggcaagagaatcgcttgaacctgggaggcggaggttgcagtgagccgagattgtgccattgcactccaacctgggcaacaagagcgaaactccgtctcaaaaaaaaaaaaaaaaaaagaaagtgaaccatgaggagggcctaggagaagccaaaggaactaaggaactacaccatttgaaagggaggtggaggagctggccaagaaggcttgaagagcaaccagaggggcaggagaaagccaggagtactcttatgaagaggagggaatgccgaccagctgagcctagtgctgctgacttggtctgacacaaaagatgtgtcctttggtctagtcatgtggaggtcatcagaggaggtcatcagtaacctcggtgagagatgctgtattctcagggtgctgggtgaaaggctaattgtgagacgttgaggagtggacgggggtggggaatggagatagggttggaaacttattccagaagtttggctgtgaagagcaacttgtgttgaggaaccagaggactaactcagcatatcaccctggagtgttgattggacttgaatatttgcgcagactcattattttcatgtgaaaataaaccaatgataagacatagatatgtcatagattagcgagctctcaggatggaggagagagagaagatggaaatattaggtttgggctaaatattgaggactttccttttgcgaggcactgtaatccctttcacatgttgttatctcacatagtcctcaaaatgagcctatggtgtgtatatctggaattttcctcatttttgtggatgagtaaactgaggcttagagaggcatggttgcagagctggtaagtggtagagccagggtttgaatctagctatcacagtgaatgtctgtatacttagctactttaatttccctcataaggatcttcagctgcttttactccctgctgtaaggtatcagtatcatttgttgaaaagacttttctttgcccattgaattgctgtggcaattttgttgcaatcagttggccatataagtgttggtttatttttagactcttttctgttccagtgatttgtatatctgtctttttgacaatagcacactgtctgtatattatagctttataataaggcttaaaacctggtaatttaagtcctctaacttagctctttttgaaaattgctctggccaggtgccatggctcatgcctgtaatcccagcactttgggaggctgaggcgggtagatagcttgagcccaggaattctagaccagcctaggtaacatggtgaaatccgtctctaaaaaaaaaaaacgaaaattagctgggcgtggtggcgcgtgcctgtatttgggaggtggaggttgcagtgagctgtgattgtgacactgcactccagcctgggcaacagagaccctgtctcaaaaaaaaaaaaaaattgctctgactattctaggtcatttgcacatccataaattttagaattatcttgtcaatgtctctgaaaggacccgctgggattttggattgtaatcgtgttggctattgtgagacttttctcaaaaaggaattaatgaggcctggatctcatttcctgtaggcattaaagaaaattccactaagatgtgtgactgtaggccaaaggtcactaactcagtaagtgaggcaggtaaggaaaatgaatggaggggccaggaatgagatgatcatggcagctgatcctgggccatcgtgaagggataatagggtacagtgaggacttggcaaacacgatctaagggggtggcctcttctcagcttcatccagcgatgccatgcaagaacatgggttcagtgttgtctgatctttcaatcaggagaagttggaaatccatatttttatgcagtgtcctgattttttcaattgaaatttaatacactgaatgggtcaacatctggtgggtaaacagaacactctaggtgaaatgtggcctatgggctgccagtctgtgacctcggccttaggctaatcattctttggttcacatgttcatcatctgtaaacatgaaggtgttgaagacagtctcaaagttctttttctagctcaatgagtctaaatttcaaaagaggaaaatgtcaaaataactcagagtttgaagaggtagctgagatcagcaataatgataatatcttaagttgaccagagctttacatttgacataccactcttgtgtctgtgtcatttaatcctcactttatcttgtgcaggaggcgtcagagttgtttgcccaaccacacgggagttgcaggttacaaagtcacatcatccgattccaggtccagtgctttttgtttttttagagtctcgctctgtcgcccaggctggagtgcaatggcgccatctcggctcacggcaagctccgcctcccgggttcatgccattctcctgcttcagcctcctgagtagttgggactgcaggcgcccaccaccatgcctggctaatttttttgtacttttagtagagacagggtttcaccgtcttagccaggatggtctcgatctcctgacctcgtgatccgcccgcctcggcctcccaaagttctgggatttacaggtatgagccactgctcctggccttttttttgagacagagtctcactgtgtcacccaggctgtagtacagtggcatgatcttggctcactgcaacctctgcttcctgggttcaagcaattcttctgcttcatcctcccaagtagctaggattgcaggcatgcaccaccacagctggctaatagttagtagagacggggtttcaccgtgttggccaggctagccgtgttcttttttaacagtctttgaaggcttcggaaataggtgctttgggagggagagcagttatgggggattgtgagacggccttcagctcagttgagggcaggtccctatctggatttataacttagtttggttgaagtgtcaaggcttttgggtaagagttgaagcctttgtgagaactctctgaaggcaggaactttagcatacattcatcttagtaagccagtgcctggcatactacctgacacacagttaagtttttgtatcagtaaatcaatggataaattgatccttcaaaaaagaaatcaaaggctttaaatcaagatggctgagaattttgtccagagaatttcaagaatagtcagatgcttctgataagtacttttagaatgttaagattgaaagctgagagactttattcctataactccactcctagatggaaaaaacaccatgtcgtcctcctcatgtttgactctgagatttgggttttgattaataggttataactgtctccctgtgcagtacatttaagaaatcaaatacagcaggtataagggaagttaaagccactgaaggatttcgtatgcctttaaaatttccaaacaagtataagtctttatcttttgagaatacatattgaaatatggagtgataccatgtctgaaatttctgtcagtgaggcactgcgggtagtggagagggtaaagatgaaagatgattgtatataagttggtaatttttaagctagaagatggatagatggggtttcattatacttgtctttatttcacatatactatttgaaatctttcataataaatgtaaaaaggaaattatcagagagcttcataggttcaacaatgcttttggtaaaccaaacttcaccttttttttttttttgagtttgtaattagtatgatcatcgagggaaagatgggacaaaggaaaagagcatggcagaaatgggcatatgggctttgaggctgacagccgtggctcagcctcctgctagccacgtggcaagtcactgaacttccgagtctgggtctccaggtctgtaacagcaggagagtacagtctcatttgcatggttgtggggaggattagggatgaagtgggccaagtgtccgagaacagcacctggcccatcctaggggcttagatctggtagtgttttattattgttagagacagagagtgatgaagggtaaaaatctgccccagggctctcgtctataaccctttcttctctatatgaattatagtgccaagggttatgtaaccatggagctaatttattattttagaaacagaactcttaaagaccagatcagaccactttgagatttacaagaactgtaaccagtttattgctttttgaaaaatgaagtaaggaagaacttacaaagaaaagcatattaaaatggtgggatgccattttatacctattgaattgacctccttccttaccccaattaatggtaatatccaatatcaatgagtttttttggtgaaacttttctcatatgtatattataaactctttgggaaagcatttcggcagtatacgttgagagccaccaaaaggcccatatccagagatttagtaatcaccctttggaaggtgttctaaggaaataattcagaagaactgttatatacccactaaaaattactctgtaatagcatagaaaaggcttatgatgagcatgctaggttgtacctatcttatgatcacagctatgcagttcttaccataaatgtaaacggaggctggaaaagagcatgaagaagggaaaacagctaatgtgttagggttgtggatagtagcttagtttttctttcagaaattcttttattgttgttaaagattatgccagtgtatccaaacatacacactcaaagaccttgcaagaggacgttactatcatggtatatgggacatttggaacatgggtaagctctttccgaaaatagagtaatcaaaacccagaaagcaccggaaaccttgagggtgtgatcacttacgtcgagaagaaattgaaacaagactttcattcttgaaccgttcccctacaaaatactatactttgatgcttctttagatctttgctgttacctctcagcgttcttaaatcactttgtttccaggttcaatttcagaagcttcagcaactgcgccttacacagtaccatggaggatccttaccaaatgtgagccagctgcggagcagtgcgtcagagtttcaggtacctccagatatgtactttcttgaagctgaatggagtgtaaaaaatagacaaagattatcactaaaaagatgagatcttgaaggataagctgggcctaggtacagttcagtcttcttttggaaagtccattaatattctctctcatagtttctacagcatacgatagtgttatttcacaaatggctgaaggcagcactggcaagtagaattataacacaagcatatgtaatttaaaatgttctagtagctacattaaagaagaagaaacacgtggggttaattttaatatctatatttttcaaaatgcagctttctcatctataattttaatattacttaaataaatgtttggctgggcatggtggctcacacctgtaatcctagcactttgggaggccaaggctggcagatcacctgaggtcaggagttcgagaccagcccggtcaacatggtgaaaccccatctctactaaaaatacaaaaattagctaggtgtggtggctcacagctgtagtcccagctacttgggaagctgaggcatgagaatcgcttgaacccaggaggcggagggtgcagtgagcagagatcataccactgccctccagcctgggcgacagagcgagactgtctcaaaaaaaaataaaaataaaaaaataaatatttaatccaatatatccaaaatatgatcattttaacatgcaatcagcataaaaaaactgagaaatctcacatacttttctgtgtactatgtctttgaaatctgttgtgtattttatactcaaagcatactttaatttggaccagccgcatttcactagtttcatgtggctggtggctaccacatggctcagtgcaggtgtaagacacagataagtagtctgtattgcatttagattactgcagtgtcctcgggtgctttcatcgttcacatcagtggaaagccttgttcaaaccaatgtggaattggtgtttcagacaatggtatatggcactattgttaagacctgaattagacctgcttagatatcccaatctgtgaaacattaggagcctgtcattctaattatgcaatttaagattcggtgttaaagttgagatataaactttaagatgaagcattaattgattgtttggatgcctgaccattttaaaagcactgtcttatttctttgtggtagaaactgggttcacttttttgatgatgtcaaataaagccaaatgtattatttaagttggggacttccatttgagagtgctgataggaactccaaatataatggtgattagaaaaagtactacatgaacatatttgtaccctattgcaccggaatcttgtcttcaatataatgacaatggactctttaccatattactgcctgtattagagatctaccttcatatatcaaactaccttatatattaacccactgggttatttagtatccaaataacataggtctctgccttatgcgggatttcatacttcaggaaatacagcattgtgcaagtttgctgtgtctgagatcccaattttgtgctactttattgtcaactttagaggaatatagaatttactatgatgttcccctccggttgcattggggaatgggataaaatgataatccttggccttcccaggattctttttttctttttttttttttgagatggagtctcactctgtcgcccaggcaggagtgcagtagtgcaatctcagctcactgcaacctccatcacctgggttcaagcattctcctgcctcagcctcctgagtagctgggattacaggcgtgcactaccacgcccagctaatttttatatttttagtagagatggggtttcaccatgttggtcaattggtcttgaactcctgacctcaagtaatccacccaccttggcctcccaaagtgctgggattacaggcatgagccaccgtgcgtagcccccaggattcttttcatactgtttttgttttgttttgttttgtttttctttgcaacagtcacaaacttacacaatacttggaagtatagtccacttaatttttttttttttttgagaccgagtctcattctgtcgcctaggctggagtgcaatagcgcgatctcagcttactgcaacttccagctcctgagttcaagagattcttctgcctcagcctcccaagtagctgggatcataggcgtgcgtcaccacgcctggctaatttttgtatttttagtagagacagtgtctcaccatgttggccaggctggtctcgaactcctgacctcaggtgatccgcccatctcgtcctcccaaagtgctgggattacaggcatgaactactgtgccctgctgacataacttttttttcacttgggaataagttcctgacctgatgccccatcaccccctaatatttcactgtgtttttcctacaagcaaagacgttgttctatataaccaaaatacagccatcaagataagaaaattaacagtgatccattattacaatctgatcttcagactgcattcaccaaatgtccccctgctgtcctctgtagcaaaaggattcagttcagaatcacatgcagttattgcctgcagtctccttcagtctggaacagcttttcagccttttatttttgacattaattcaagtactcttaacgtttgtgatcctgtcacatttgaagattacaggccagtttttttgtagatataacccctcaattggggtctgcctaatgtatctttgtgatttgattcagactatgcatctttggcaggaataacgtagaagaagtgaggctgttatggtatcacattagggacatgattttgatgtgtcctgttaatgatgatgttctcttttatcaattaaggtggtgtccaccaggcatggtggctcacacctgtaatcccagcattttgggaggctgaggcaggcagatcgcttgagctcaggagtttgagccagcctgggcaacatggagagaccctgtctctactgaaaaaaaaaaaaaaaggccagatgtggtggtgcacgcctctggtcccagctacttgggaagccgaagtgggaggattgagtgcttgagtccagagagcagagatttcagtgagctcacatggggccacagtactccagcttgggtgacagagccaaaccctgtctcaaaaaaaaaaaaaaaaaaaggtggcctgtctgtcaggcttccccatttaaagtaactcttttcccctttgtaatgaataaatattttgcgaggagatactttatcctgatcttcattaaactttcaatctatacattcattttttatctctcggtatatggttttatgattttctattttattcaatctattataatctattattttatttattcatttttgaagcaatgaaagcacagatttattgaaataaaagtatgctctacagagtaagagtgggcttgaagcgcaagctaatctattatttttattttgatcttcacattctccccaattaggctggtgggagccctcttccgaactgagaaaaattcttgaaaaactgaggagagtcccagagcacagattttttttaagtaaatgtttttgaggtattatgtaaatacaatataatttataccttttttaggtatacagctctttgccatataatcaccaccacaatgaagatgtagaatagttccattaccccaaaaggttcccttgtgtctgtttgtaagtattctccatcccccacctccagcctctggaaaccaccatctgtagttttgactcttccagtgtcctattagtggaatcaaatgtccgtagtcttttgagtttttctctcacttagcatttgagattcatctgggtggttgcgtgtgttagtttcctagggctgctgtaacaaagtaccacaaacttagtgccttaaaacaacagaaatttattttctcatgttctcatgttctgagtccagaagttggaaatcagcatggtgtcagcagcaccatgaatgctctggggaagaatccctccttgtctcttcctagcttccgtggtctgcggcagtccttaacttgtagctgcatcacttactctctgcctctgtcatcacacgactttcttcattgtttgtctgtgtctgtgtttaaatcttcctctcctttttcttataaagaactagtcattggatttagggcctaccctaattcaatatgatctcacctttgcttgattacatctgcaaagattctgttttcaaataaagtcatattcacaggttctggggcttaggacttgaagatatctcttttggtggccataatttaacccactacattgcattgatcagtagttcatttctttttattgctgagtagaattccattctatggatgtagataatttatgcattcatcagttagttgatgggcatttgggttgtttccaccttttggcaattatgaataaatattctataaacattcacatacagtttttatgtaagtagctagtagtggaattgctagatcatacagtaagtgtatattaactttagctttataagaaatcgccaagctgttctccaaagtggctctactgtttcacattcttaccagcagtgcatgagagttccagcgaccctgtatctgctctagcacttggtatttcagagtttcaaaaaaatggtggttaaaaaacagaacataaaatttaccatcttaaccattttttaaagtagtttattggtatcttctaaaaccatttttaaatgtatagttcagtggtattacatacattcatattgtgcaaccaatctccagaattttttcatctgacaaaactgaaattctatgcccattcaataagaattctccatgttcccttcccaccagcctctggcaactactgttttttctgtctctatgactttgactattctaagtgcctcatatgagggaaatcatatactatttgtcttttttgtgactggcttgtgcttagtataatgtcttcagggttcacccgtgttatagtctgtgacatgatttccttccttttcaaggctgagtaacatttcattgtatgtggatgccacattttgttccattcatccgctaatggatacttgggttgccgccacctcttggctattgtgaataatgctgctatgaacatgggtgtgcaaatatctcttcaaggctctgctttccattcttttgggtacatactcagaagtaggattgctgaatcatatgacaattgtggttttaatttttttttttttttttgagactgaatctcgctctgtcgcccaggctggagtgtagtggcgtgatctcagctcactgctgcctccgcctcccaggttcaagcagttctactgcctgagcctcctgagtagctgggtttacaggcgcgccccaccacacctggctaatttttgtttgttttttttttttacttttgagatggagtctcactctttcgcccaggctggagtgcagtggcacgatctcggctcactgcaacctccgcctcctgggttcaagcaattctcctgcctcagcctcccaagtagctgggactacaggcacctgccaccacgcccgggtaattttttttgtatttttagtagagacggggtttcactgtgttagccaggatggtctccatctcctgactttgtgatccgcccgccttggcctcccaaagtgctgggattacaggcgtgagccactgcgcctggccttgtctagtttttaaattgagttgttaattttcttaatcagttgtgagagttgtttatatattctggataccagttctttatcagatatgtattttgcaaatattttctcccagtctgtggcttgttttttcattttctcaagtctcgaagagtagaagttttaagttttgaagtctagtttatcaattgtgttattttatgatttgtgcttttgtcttatctattaataagagttcttcatctaactcaagttcccgaaggttttttttctatgtgtttctctattagttttatagctctgtcttttacacttaagtaaattatgagttaatttttttgtgtggtacagggtttgggtttgaggctcactcattttgcatagggatgttaaattgttctagaaccatttgatgaagactttcttttccctattgaatgccttggtacctttgttgaaaatcaattgaccatatacatgtgggtctatttccggactcttctgtgtcattggtttctttgtctatcattttgctaataccatcttctgtgtcattggtttctttgtctatcattttgctaataccacactgtcttgattactgtacctttataggaaggcttggaattaggtaatgagagtcgtctttgttcttttttgaagctgttttgcttattttcattcctttgcttttccataacattttagaatcagcttgttaatgtctataaaaacacctgctaggattttatttttatttttttgagacggagtctcactctgttgcccaggctggagtgcagtggcacgatctccactcactgcaagctctgccccctgggttcatgccattctcctgcctcagcttcctgagtagctgggactacaggtgcccgccaccacgcccagctaatttttctgtatttgtattagagacggggtttcactgtgttagccaggatggtctcgatctcctgacctcgtgatccacccgcctcggcctcccagagtgctgggattacaggcgtgagccacaacgcccggccaacacctgctaggattttaaacaggattgcattgaatctatagataggttggggataattgacatctttataatatggagtcttccacgaagaagacttccatgtacagaaaaacagatttttattgaagttcagttgcttataatcatttatatacaattctccttttatttttattatattgatatatttttgattgacaaaattgtatatatttatggtatacgatacgatattttcataaatgtataccttgtggaatggctaaatcagacaaacatatgcatcctctcacatcattatcatttcttttgtggtgagaatctgctctcagcaatttgcaatatatgatacattgttattaactttagcaatcatgatgtactatagatatcttgaacttgttcttcctgtctactccttttatgtttgtaaatcactttggagtttacaaaatgctttcatatctgttattttacttcatcctcttactacaacattggttggtaagtgtagtactattttaatatactaaagaccaattttctatcctaatggaggatctcaaagtgcattctttttttctaacccaatgagcccttatgcaaagaacgtagacttatcagatgagtaaacaaaagccaacttttcaggctgccttctgataatctttagcaaggggcagaccatcagtaaaggggtagctagggttatagccctcatgtctctaggcagggcctggcacacatacactgagggcagagaggaggaagtgggcattatcttcttctctgagagcgagggctagggctgtctcttctgcttagtggagggatagcatgttccagcctgtgtaacagctagggcacatgttgactgaatggcttgtcaggcagctgtagagagagggacaaagggcttctctctgtatagggctttgtaggtatagttgtagcttttcgtatccttttttttttttttttttttgtgacaaggtctcaaggtcacccagctggagcgcaatgatgtgatcttggctcactgcaacctccacctcctgggctcaagggatcctcctgtctcagccccccagggtagcagggagtacaggcgtaagccaccacacccggccagtttttgtatttttgtagagatagagtttcactatgttgcccaggctggtctcgaactcctgagctcaagcgatccacccgccgtggcctcccaaagtggtaggattacaggtgtgagccaccactcccagcctcgtatcctttatataacctaccctagtcctttcaaatcatatcactaaaaactaattgtactttttacatctctgattaactacattttaacaaaattgcatcatgtcatgtgtaactgagggcttttaagttctaatttagggaacaatctgatggtcaagggaagaaacccttataccaaggcagtttgcaaaggcctggagggccaggtccagcaaggtggttttcctggggcccactaccaatatgagtagtataatgaggcccagagttcgcatagcaagtaagtaagagaaccaggacttaaaaatcatgtctttgacttccagttccatttccatggttttcctttactgcatttcctttcaagttttcataaggttctttaaaggaaaaaaaaagattggcaaaaagatacatcagttaaacaaaagaaaacctaagtagcagtattaatctcaaaataccactactaaccacagctgacatttattgagtatgtgctatgtgccagacactgtgttaagctctctatgtagatggtaattgtcatagcattatatgacttttatgtgataaaacaacatagcaacaaattgcaaaaaggaaaaactccaagaaatgagaattcgacaatagcacaattctagatttttaattcactacgactgagccaatattcaaaataaagataataaagagttacaccattaacaaatcagaattactgtataccaaaatttattccctagagtttattctctaaaaaggtaagatacctttctagatatttctagactcattttaaaagcaatacttctttttctgattataaatgtaacacttgcttattacagaaaactggttacatcttttttcaccatttggccttttctttcagtagttttgcagtgactataaatattttttaacaaaatcagcctcatatgtatgtatagttttgtattttccttctatgtgttcaatggttttcagaaacagtatttctagtgactacatgctattctgtcacatggatatgccacagtttcactgcccccttattgtttgggttgttttcactctttgttcatggtgtgtgtgtgtgtgtgtgtatgtgtgtgtgtgtagtgtaaattgatcacatactgggccaaataaattctcagtaaattaaaaaaggagaaattgaatctgaacataattaataaaattgcaattaataattaaatttaaatttaaaaatccagctatttgaaaattttaaagcctttttaataactattagatatactatcaggcaggctgggtaccatggctcacgcctgtaatcctagcactttaggaggccgaggcgggcagattgcttgagcccaggagttggagaaagatagtgaagagctagaagaatgccttcactttgaaaatctgaggaatgccttggatccctcctgaggaaaatatgtaaatatgtatacatgctcttattcacttattttattttattctttttctttttttttttttttttgagacaggtctttctctgtcacccaggctggagtgcagaagcgtgatctcagctcactgcaacttctgcctcccaggttcaagcgattctgctgcctcagcctcctgagtagctgagactacaggcgcctgccaccatgcccggctcattttttgtatttttagtagagacagggtttcaccatgttggtcacgccagtcttaaactcctgacctcaggtgatttgcccgccctggcctcccaaagtgctgggattacaggcgtgagccaccacacctggccccattcacttcttttaaaaaagttttattagtgaaaatttcaaacagattacactcatttttgcttaaattttgatcctgtgtcaagaactcttggcctaggatgacttacatttgtaagtttgtattaaatatttaaaaattggctgagtgtggtggctcacgcctgtaatcccagcactttgggaggccgaggtgggcagatcacctgaagtcaggagttcgagaccaacctgaccaacatggagaaaccccgtctctactaaaaatacaaaattagccgggcatggtggtgcatgctgtaattccagctacttgggaggcttgaacccgggaggtggaagttgcggtgtgctgagatcgcaccattgcactccagcctgggcaacaagagtgaaactccgtctcaaaaaaaaaaaatcatttcccttattttcctttgcctgtttttttttttttgagtctataaaatgtatttgatggaaaattgtggaaaatgttttagtaacttagtacaaggttaaacaagcagatggcactgtcatggagttatttgaagtatatttgctgttgctattgtcccctttaatactcaagcagccttttagcagcctttgaaatctcatttgtcctcatgcagataatccagttctgtgtgcatatttgcatgtcagatctcgaaacctgcttttttttttgttatttcaaggtaatataaagtagcatataggtaccaccatgcataatccagaacccctttgctttccatggaagccaacctctcagggctcctgccccctcactgaggatgcaggcctgggaaaggggatcagaaacgggtttgtagggaaggatgagctctgcctgtcctgttgcccagggagcactcctaataatgccaaggagctcaattccaagcaggtgagaagcttacggaatgaaacaagagaggctgattctcattaaatattttcaggttgtgtagggcagaacaatgagatgaacaaagcaccgatctgtcctctacttcctttttctgaaaggaagaggtgaagtttcttcatgccatctggacagtgttggggttacataattagactcctcccgactgagtctccttaggtaaatcacagaattctctgactcatctagaagtgatgataatgacggttacttgatagagttgttcataaggatctaatgaatgcggaataaatgcatatctctggaaactaaagtactaagcaaaagtcagtagtatagtaatacaaatcgtgcttaggaacaattgtgaagtaggaagtttgtctttatcactttctacctctttttttctgtgcttcttactgtctccccctcaccgctgctgtccaatatgttagtcactagtcatttgtggctatttccattaattaattgtatttaattaagattaaatacaattaaaaattcagttccttggttgcattaagccacatttcaagtgctcaggaggcacatgtggctggtggccaccgaactggacagcactgccccctattttgagaagtgggagagttcttggaggaggtaggcattctaatgctgcgttctaggtcccagtttcagcaccggattaagtcctcaccttcccttaagagcccagggctttaaggtgatcttcccttccctgctcgtctttatcagccaatcagatttctatgccttggttgaagtgtttcttttagtggtaagcaaagcaccctgattaagttcatatcaaaaactttgaacctccacttaactgctctgagtacaagcatttcaaaaaaggatgcccccaaaatcagatctccgcttggtagaatttctcactgtaaaatgtggcggttcctctgaaagggtgtgtggtaaggcgcgcccttacattacattacattacacacacgcacacacacacacgcacacacacacacacacacacacaaatgtcttctaaaggaacagactgaccctgtgaaggtgttgggtgtcgtggtctcctgctccgtccctactccaagagtggtgttaactacttttctttttcactcttcattaattgattaataaataattgaattggcaaatgtttcccgagcgcctgctgtggcagcaggtctgtattaggcacaggacacatagaaacgaagaaattggcccttccacagaagtcagcagcccagttagtcctcgtttaacaccatcaactctgtgtccagtactgcggcccgagcagccggcatctggccactgcccctcggtgaagaaggctgctctgccttaagccacaaatgaccttggaatctcagagactattccaaaatggttctgtcttgagtcacagatcagagagtctccacagagatctcaaagtagcttcttgtgtcatctaatggtcttcagaaattctgtctctgtttctgtggtcagctcccagctgctcattattcctgatcacccctcatctagttcttttgtctcctggagtatgggcagtgacttgtggaaactctgcttcctttcgtactccctaggatgagctgtggtgtgataaagatgactcgggcagcaggcaaacctggtttgagtcctggttctgccactcttttaatctatgatttgggcatttcctcaactatctcagtctagttttttgtatgtgaagtggggattataatagtaattatccataggataaactgagctaaggggaggcatgaggccttgaccaagggggttttggagctggattgtgttaagggaactggggtgtaaagaaaactgattccttcccaagcatctaactaaattctgatcatgtgtagtcattcttcatagtttgtggcatagttctttgctcagaacttaaatgtgagagggaattttgttcccaaggttataatgttatatttttttcccttagccagccctactcttggtacagcatgctctctgccagccctgagacaatctgcttttatccaaatactgttagatgtaatgaggcagggcagtgaccttgggcttctgcatgagatttagaaggccacatttataaattattttagcatgaattatttccgggaaagatgttcactgattactaatatcatctattttatgttgtttcttattttctttttcagagattgacatttttctgaccttgtctgaattctttttaagagttcgtacctcctgaactacatgcactttgcaactctgatttttgtactgtgtctgtgtgtgatgtgctcactggtttgcctttgattttgacttccagcagcatgtccttctattctgcctaaggaaatagtgagaagcacagagagttagggggttacttaatagttttggaatgtgcatctgtcccgaaataggagctgtgaccaagaatatggttgtcgtatttttaatccatattcgaatcatttttcccttcctttttatctagccgtacatgttgaatagaagacttatagaatgagagagaaaagtagataactcatgaatctctaatcatctgggataaagcctttgtttgaaattatagaaggggcggggaaacgttggtcccacacactgaattaggaacatctgtacccatgagaacttgagcaagagaactggaatattgccattttcattctgcctcctacgtgctctcaattgttcatgcagtggaggggcagcaatagcatggatacttgagatctttaaaatacccctccaagtaatgttttaaaagactgaatcagattccattaatcgaaaattttcatgccagtaaagttggaagagatgggaatgtttcctgagaagtctatccatgggataaaaccaatgatctacttgaaaagaaatacgacaagtactaaagtgacaacatatactttgccttaaaatattatggcagaagctttagggcagtacagaggctgcatagtgtgatgggcaaaagggtcatactctgaatccaaatgtggcctctgccactttctagctgtgtgaccttgggcaaaccacttagcatgtctttgcctcatttttctcacctgtaaaatgggcatagttctaatgccaatatcagagttttgtggagaagaataaatgagttgttatacataacacccttagaacagtggttggcacaaggcaagcacattagaggtgtttcctctttttttttttttttgagtcagagtcttgctctgtcacccaggctggagtgcagtggcgtgatcttggctcactgcaacctccctctcctgggctcaagcagttctctgcctcagccttccgagcagctggaattacaggtgtgtgccaccaagcccagctaatttttgtatttttagtagagacggggtttcaccatgttggccaggctagtctcgatctcctgacctcaggtaatcctcccgcctcggcctcccaaagtgctgggattacaggcatgagccaccatgaccagccaaggtatttcctcttataattgttcctattgctcctgcttccactgctgtaattccttctgccatcgctgacacctctattgccacaactacagcgtaggcttgggcgtcagcctggctttgagttctagcactgctgcttacctatttaagtccaagtcccatttctatatttgtaaagtaggagtgttactagtacctacttcacaggacctggtgaggatgaaatcagataatacgtgtgaagcgcctggtgcagtaaatgcttatggttttgttgttactgcagcagctctcaaccagggatcctcccacaccagagtgttgtactccactatgggttgggttacaagttatgtttcttactaaaagtaccaatggttgggaattattttttaaaataattagagttaaatcaagggtatccccaccctgacaatattgctgttcacttctattttgagaagtgggagagtgcctggaggagacagccctgcccttctacaattggccatactctggctatatctacagctgttgggatatgcgggtgggggatgcacatgtgaaaggtgagtgctttgtgtgggggcagaaaacaaatttgagagttgctggccttagggtgctgtcatttctgctgcagaatgtaccactcgtgctcttccatgtggcagcccccctttttagttgattgcccagaccaaagcatcattatcccccaaagcccaactgttcttatcttgcctaaacatatatagatgccaggaaacatttgttctgactattaaaatcactttttattatattaagcagctactgtaacttgccctgaatttattcattaataagtatttatcgagtgcctttatgagtaagatattatctggtttatgaagaaaatgcagacactatcagtttaagaagctcataatcaagtatgatagactaggaggatatacaataactatagcacaaagacgttaactctagtgttctttttcttttttctttttcttttattttttatttttgagatggagtcttgctctgtcacccaggctggagtgcagtggcatgatcttggctaaccgcaacctctgcctcccaagttcaagtgattctcctgcttcagcatcctgagtagctgggattataggcatgcaccaccatgcccagttaatttttgtatttttaatagagacggggtgtcaccatgttggcaggctggtccgaaactcctgacctcaagtgatctgcctgccttggcctccccaaagtgctgggatttcaggtgtgagccaccatgcctggcctctttttcttttttagcttccatttttaaacctttacgttcaggaaaatacattgcatttgtttatagcttgttccttaattctttgtttttcattataaaagtaatatgtgctcattgtgtaaaatttggaaaatatgtaaacattaaaaaggaacagaaaaaatgagccatttttcatcaactagagattaccattttaatgttaagtttatttttcatgtatctttatacaggtgatatcagtcttcatatttatattatttttttctttttcaaccattatataataattatttccctatgtcattaaaatactttataagtataattttaatagctaaataatatttcatcatatatgacttataatttacaagcatttccccaacggacattttagttgattctgatttttttaatgaataatatggtaataaacacttttatgtatgagtcatccatatttctgatcatagatttccacaagtagaattctgaaaccaaagggtagaaatatcgccaccgttgttaatagatgtggtttcattactttttggcaatgatatttaccttagcaaaacttctgacactgatggatttggatatttattaccttaaggataggagatccttagctttttcagatctgacgttccaagtgtatgttgactgttcaagaatgactccaaagttcatgacataaagtagtttgcatatttactgaagcacaaaatttaatcacacgggcctagaggctggtgagtgaccaaggctgcctagcaaatgtttcattggggcttcatggatctctgtgtaatacgtcttatatattgacttaaaaacttaatttgtttgaaaatggacagcttttgtgaaaatcaaaagggccattaatttatggtatacaattatgcacagaaaatctacagccgtcagagaaatatgactcaagaaaatactgagagttgatatagatactttcatattaaaatagaaggtttacaacggtctactacttttcaatgactactttctaattgcttaatagtatgtattgacttgtcatttctagaaaataaatctaatttcatttttagtgccaaccattggaattattctctttataatcaccacatggctatatatatatatatatatatatatatatatatatatatatctttataatacaatatgaaaaataaatacattaatcaaattatcagaccgagcttctacagatgtttgccccttacttgctttaattttaaaagttctctttggcaggaatgtcttatactctagctagggaagaaaatgtgtagaaaacaattttaatcagtgtctgggagtctgagaacaaacttagcaaatttagcttagaacaatcgcaagtttagcttagcatctttccttaaccttgtacttctaggtaggaccgcctacactgccagcaccccctcacagtctaggagcagcttctctctcccccacattttgagctgttccccttgaggttgctttctcgccctttgctgacagggaggtggtggtagctgcatttgtctcccatctggtccccagaacgtttcttgcttttgttttacagtcttgtgacaaactagcacgcccccttcctatctcagggcctggcttccccagcccccaactaaggtctcagacacgtacaaatggtgcccctctttgaggggctcgtacatctgcacatctggacctttcacatagtgatctgttaaaggcatagaatcagcctgtaatatgctgagatcaccctggtaatatggtggagtacagacagagccgggtctgtctggtttctggctctgtagccttttcccctgggtctcctggggccacttgaacctgactagccagcctctcacccatctctaggacccagcctgaactgaggcagagggactgaggctgcctcacactctgtaatttggcctcaagtcaccattgctggccttgtgcctcagctctgataactggactcttgtctggctcctgcgtgccagaatcccatggtaacctgcctcgtttccctgtgccttgtttttatcagcctgcctcccagggattgaaatcgtgccctgaaacacagtgaccaatgcactttcctgatgtcaaccaccccacttgcctttctgattggattccagagtaccttaaatttctcgttgttctgcagtgcctgtagtcaggaaacctctgttctggacacttttctctgtaaatgacaacttagttcttccagttacttgtgccaaaaccttggagtcacccataactccttgcattgtctcacatcccacagctaagccttcagcaaattcttggttctgttttaaaaatgtatctagaatctgactaccctggtcggacccgttatcattttgtccctggattcttgcaagagcctcctgactgggcttctggcagaggagtcctgtcttctttcagtatattctcaacactgccacctgactgatccttttaaaatatgagccagattatctcactccccacagtcctccagcggcttcccgtttctctcagggtaaaggcaaagtgcaaagtgcaggcagtccctgtagggcccccatcatctctgctcttagctgcttaccacacatctctccaacaccctcctcactcactccatgccagccacactggcctttttctctgttccttgaaccttgcttaggatttctctaccaggaatgctttttttccagatatgtgaatggcttacttcctcacttccctcagctcctcactcaaatatcacctgtcagggaggccttgcctctctaaaatctaaattccctccaccgtctttcctgcttgatttttctcctcagcacttatcacgatccagtatactatatatatatatacatatacacatttatttttttttgagactgagtcttgctctgtcgcccaggctggcgtgcagtggcgtgatctcggctcactgcaacctccacctcccgggttcaagccattctcctgcctcagcctcctgagtagctgggactacagacgtgtgctaccacgcccggctaatttttgtatttttagtagagacaggatttcaccatgttggccaggatggtctcgatctcctggcctcaagtgatccgcccgccttggcttcccaaagtgctgggattgcaggtgtgagccaccgcgcctgtcctactatgtatttttatttatttatctcttttatattctgtctcctccaagccccctgggagcaagggtgctttggttcactgctgtatttccaaagtctagagcagtacctggccagggtatgagttccataaatatttcttgaatgaatgaatcaaatagttgagtattagcactattctgagaattttgtatgtattatctcattgaattcttacagtaaccttatgtgatggtacttttatgactcccattttacagatgagaaaactgagtcttaagaggttaggcgacttgcccaaaaggacctgagccaccacacaagtattccactagagcagcaagttagaataaacacagactttattattatccagatttatgttcaagttgcagctctgtcaattactggttgaattaaaacctctctaaactttaatatccttacttatgaaataattattctacctcccaggttattggaagaattagatgagatcatgggtgcattattttcatgtatattttcctgattgctggaaaagttgaaattttttcattttgtggttgtttgtttgtttgtttgtttttcgaggcaaggtctcactctgtcagtcaggctggtgtgcaatagtgtgatcttggctcactgcaacctctgcttcccgggctcaagtgatcctcccacctcagccccccaagtagctggcaccaccggcgcatgccaccacactcggctaatttttgttacccggctcatttttatgtttttggtagagatggggttttgccttgatggccacgttggtctcgaactcctgggtgcaagtgatccatccgccttggcctcccaaagtgttgggattacaggcgtgagccaccatgtctggcctttttcatgtatttaccggccattctggtttcctcttctgtgaatttcctgttcataaccttttctcagttttttttcttatcaaattgtaggagttcttcgaatgttagagatacatgttgtcttatatgttataaatagctttcctcataccatcatttgttgtttgatgatgttttttggaaccttcttttattcatctagttagcgctccaggtttggtggttgatcaaatacttgagaatagggatttattcattcagctagtatttgttgagggctggaactctgtgggatgtccattcagtcaggacacctctaaatcctgacttccagtttacgtcactgatgatggctctcatccttggttctaccagattcttgaaagagaatgtgttttctcagagccaagtagacccaaacatttcccagactttggccacataatcagaaatttcaaaagagttctggaatttgtgggcttagctccaagttaccaggcatccgttgtcttccctgtgggcagaattcgcttttagcttactccaccctcctcagctacgcagcatgattggggcagacgatgaatacttcagatatcccctgtggggttaactccagaggcagcctcagaaactagacacataattcatatggtcaaaacctggcaggctcttctgaaatcgtgtgacttcctatcaggccaccagctctgcagatcctcaaaggtctggctgtcagaacaatagggaatgagagcagcgcccagatgctgcctgctggagctgcaggtcctgtttgagtctgaacaataaaagtcctggaatgaattaccaaggctcctgattgcaccctgcaggttcaggtttagtttgtggagatgtctcacataagaactgtcttgtaagccgcttggggggttcaacaaaattggtcaacaaaatttaataccatacaagcccttttcttgatcaagcaatttagtaagtctctgtcataagtctctatgacctgccatccaatatgtcaaaataaacaaaattttcatgttgatggtcacaagtgcagtccctagagtggggatctggtgaccacttccaccactaactagcactggatcgtagacaagatcgttagtctctctgtgtctcagctcactcatctgcaagatgtggctactaatagtacctaagatagagctattgggaggattaagttaggtaatgcatgtaaatccttagaataatgcccagcacagttgttgttcaatacatattgcaaagttcctagtataaactccctgttgcagccttctaatttgacttcaatagattgttggtaccatttgcctctttctttgcaggtatcctacctaggcctagagaactaagcttttgctgttcattatatgaagcttcttaaatgtcatacaggctagttgcatcctactaattcttcacagactagataaaaatacttttgctgaagtcttaatcggcctgtcctgaagtcaaccaggctgtatgttagtgccttgactcagtgcagctttcaagagaggcagaaagaatacccacagagaaggcacatgtgggcggtggcagtgtaggaccaggaaagaagctaggtctctatattccctcgcattttgaatctgtgttaaattcaatcatattagtatgaagcaatcctcttacctatctccttaatccagcctctgactgccagctcacaaaagagggagaagaggcactacatttaaagtagtgattatctctaactagaattttaagtccctacatgttttggctgtagaaccagccaaagttttgttccaattccctacaaaatttcacaatagtcaggagttagaattggtccctatgttatgaaacagctagtttttatactttaaacttaaaatgaagctttagttgtttattattactgtggatattttccaagagacagaataacatctgtggaagattctacacaggccttgatgccagacattgtaattatttccctgctcaaaggcaatagtcagtgcctcaaggaactccctggctataagcagttggctgcctcgacaacagatagctaatgtcttagctcttttctgtctctaccgccagcctcttggggatgtgacttgagaaagctctcccctccccattttctcctgtaacctctttggaggaagtcaccagggtaaccactttcttttatgctagttttcttgagtgcaagggaaaacacttccccacagacatatgacagaagtttaagagtggtgaggagaagaacacgaacagttactgagtacctgagctatgctttgtgtacctgatatcattgagttcccacatcaaccttctgagataggcattatcatccccattttactgatgcttaaacagtaacatgcccaaggtcacacaagtggcaagtgacagtcaggactcaaacccaggtttatctttctcgggcctttgctcttattttgcaaattaagcaagtgtagacacacaaaaccaatttgtttttacctaggaaacgtgttttatgctttgtttttctcagtctggatagatgccgttttctagtcccctggaaccatcgtatgcccagtttagtaccacttttgtttggtttctcgtcttagaatatattctgcttattcactcccccggccacctgagaaatctttttactacttttagtccaaatcaaactttccttcccttgactacctaggaagtctctccttgggtgagtcttaactcgcctgaactgagagtctcaccctggaacttggttaagaaaggccagagttgggaggcaacagcctggatggaagaggggggtcagttgacactggagggggcaagccagaccagccgcaagcaggagccaaaaggtcagaaagccagtgagaatggggtgggccaacaggagcagaccaggccacacaggctgtgactcccccttgcagtggctgctgggcactggccatgcctgtgcttgtctctctcagtatctcttactctgccatcttgtcattcatgaaattgctcaagagacgctttctaccagtccgtgcctgcttagtctccgagaagttttgggggttcatttagaattaattaatttagaactagcatttaaaagttaaacgggctgggcatgatggctcatgcttgtgatcccagcactttgggggactgaggcgggtggatcacttgaggtcagaagtttgagaccagcctggcaaacattgagaaaccctgtctctactaaaaatacaaaaattagccagatggagtggtcaatgccggtaatcccagctactcgggaggctgaggcaggagagtcacttgaaccgaggaggcggaagttgcagtgagtagagatcactccactgcactctagcctgggcaacagagtgagactctgtatcaaaaaataaataaataaataaaataaaaataaaagttttaaaacagcttataaacttgagttaaaatataactcaagtgaagcagagagaagaatattaaaggggaaacatttaatgaggagcaaagcatagccttgaccgagcttctgctaagagcggatggctctcacttggcacagacatctttctgtattgcactacttgccctggcagaggcatcagaactgttagaaccacaatggactgtgcagcacttttcatgcaacactccccctttaaggttagccaaccgagagcaagaaaaaataggtaataagctcaacattactcagctagtaagtggctggtacaggaatcaagttctgcttacttagtctgaaggttttcagccacttcataccatttgatcaacatatttgccctttgtttttgaatgaaatagaaaaaataatttccttctttccttctttcttcccgccttccttcctttttttcaaacaaaattactgccatttatattagtgtttctaccacttctatcatgaccactgctggcaaaaatgtactgaacttttgctgtgcatcaggcaatatggctaactaaggctttgcatacatcatttactctttctagtaaccccagagtaggtactattactgtctctatttacagggaagactgtggaggccaagaaggattaaacaatttccctgcatcacacagccaaaaatggtaaagccagatttgaagtccaggctctttgattctggagttcatgctagtaactaccagctctccgtctggcagtgttttgttcttttgttgaattactaaaacagaactattttctctgaatgcagaagttgaaacctgttgaggaaattcaaccagagtatttcttgaagaaaaaagaaaccatttcctgatttctttatttgttaaccctatgacatcattagggttggtagtagctgctcctttgccttcacacacaagaaaaaagtgtgcaaatagttcttaggaactactgaagctgttcagaggaccagaagctagaccctcctctattattttctctgccctacgtctggcctttttagcttgtggaacttatcatccccgccatccagtaaaggctacaaaggccccgagactagtccctgcagttactactgatgttcttttcttgcttctcatctgcttttactaccagttctgtcttgcccatggtcaaaccattatctctaaaactccaccttctaagctacctctgacccttcgaatttgccatggttagaaaaatcaggaaaataggaaacctaaccagcaaagaaacatctgggagtgtatttgttgtcactgtaagcaatgacacatagattaaaacaataagataccataggcaggaatggatagagtatggactcaagagtaaggcagcttgggttcaaagcctgtctctacccattacaagccttgtgttcaacaatttaaccaaccttccttccttccttccttccttccttccttccttccttccttccttccttcctttcatggagtttcgctctttttgcccaggctggagtgcaatgatgcgatcttggctcaccgcaacctctgcctcccgggttcaagcgattctcctgccacagcctcccgagtaggtgggattacagacatgcgtgaccacgctggctaattttgtatttttagtttttagtagagacggggtttctccatgttggtcaggctggtcttgaactcccgacctcatgtgatccacccacctcagcctcccaaagtactgggattacaggtgtgagccaccgtgcctggccaatgtaagctttctaagtctcggtttcttaatctgtaaggtggggataataatagtagcacttcacagtgtcgtgaggattaaacgagataatgtatacgaagcatctaacactgtacctagagcatataaatgccaataaaggctaattatcaaagtcataacttagcctttttacccattaaattaggacaaatttttgagtgatattcagtgttggtgagtgggtaatgcaatgtgctcttgtatacaggcacaccttgttttattgtggtttgctttttctgctttacagatactgtgctttttacaagttgaaggtttgtggcaaacctgcatggagcaagtctattggtgccatttttcaatggcatgtggctcacttcatgtctctgttgcatttcagtaaatcttgcaacatttcaaactttttcattattatatctgttatggtgatctgtaatcggtgatctttggtattactgttgtaattgttttggggtcccgtgaacatcacccacataagttggtgaacttaatcaagagaaatgttgtgtgtcttctgactgctccattgatcagccattcctgtgtctctccccctccttgggcctccctcttccctgagataacaatattgaaattaggcctctaagtgttcaagtgaaagaaagagttgcatgtctttcactttaaataaaaagctgcaaatgattgaggttagtgaggaaagcatgttgaaagccaaggtaggacaaattcttgaaggaaattaagtgctattctgatgaacacacaaatgataagaaagtgaaacagccttatttgctcataaggagaaagtttaagtggtctggatagatcaaactagccaccacattcccttaagccaaaggctaatctagagcaaagcctaactctcttctgttctatgaagactgagagagctgaggaagctacaaaagaaaagtttgaagctagcagaggttggttcatgaggtttaaggaaagaagccatctcacccaggcgcagtttctcatgcctgtaatcccagcattttgggaggctgaggtgggtggatcgcttgaggtcaggagtttgagaccatcctggccaatattgtgaaaccccgtctctactaaaaatacaaaaattagccgggcatggtggcgtgtgcctgtagtcgtagctacttggaaggctgaggcaggagaattgcttgaacccaggaggcggaggttgcagtgagccgagatcatgccactgcgctccagcctgggtgacagaccaagactctgtctattaaaaaaaaaaaagaggaagaagaagccaactccataacataaaagtacaggatgaagcaagaattgctgctatagaagctgcagcaagttatccagaagatctggctgaggtcattgctgaatgtggctgcactcagccacagattttctttcctcctttcttttttttttttttttgagacagagtcttgctctgtcgcccaggctggagtgcaatgacacaatctcagctcactgcaacatccacctcccaagttcaagcaattctcttgcttcagcctcccgagtagctgggattataggtgcccgccaccacacctggctaatttttgtatttttagcagagacagggtttcactatgttggtcaggctggtctcgaactcctgacctcaggtaactcacccttcttggcctcctgaagtgctgggattgcaggtgtgagccaccgtgcccagcctgcattttcaacatagatgaaacagtctcttttggaagcagatgccatctaggactttaattcctggcttcaaagctccaaaggacacttcgattctgttgttagagactaatgcagctggtgacttgaagtggtttcaaaatcaacgcttattaccattcctaaaatcctagggcccttaagaattatgttaaatataccctgcctgtgcagtatgagtggaataacaaagccaggatgacggtacatgtgtttgcagcatggtttactgtacattttaagcccactgttgagacctactgctcagaaaaaaaagattcctttcaaaatattgctgctcaattcagtgctttttcttggttgataaaaaacaaacaactaaaatattactcctggctgggcttggtggctcacatctataatcccagcactttgggaggccgaggcaggtggatcacctgaggtcagcagttcaagaacagcctggccaacatggtgaaaccctgtctccactaaaaatagaaaaaattagccgggcatggtggcgcatgcctgtaatcccagctactcgggaagctgaggcaggagaattgcttgaacccgggaggcagaggttgcagtgagccaaaattgtgccattgtactccagccagggcaacaagagtgaaactccgtctcaaaaaataaataaataaataaataaataaaatatcactcctcgttgacagtgcacctaatcatccaggagctctgatggaaatgtagaagattagtgtttttatgccttctaacacaacatctgttctgcagcccatggatcaagaagtaatttcaactttcaagtcttattatttaagaaatacatttcataaggctatatatagctgtcatagatagtgattccgctgatggatcatggcacaaagcatactgaaaaccttctggaaagggttcactcttttagatgccattaagaacattcatggttcataggaagaggtcacaaccttatcaacatgagcaagagtttagatgaagttgcttctaaccctattggatgactttgaggggttcaagacttcagtggaagaagtaactgcagatgtgattgaaatagccagagatctagaattagaagtggagcctgaagatgtgactgaattgctgcaatctcataaaacttgaatggatgaggaattgcttcttgtggatgagcaaagaaagtggtttctagagatggaatctactcctggtgaagatgttgtgaccattgttaaaatgacaaaggattttaaaataccacataagtttattaaatcagaagtagagttcgagaggattgactccaattttttttttttaaatagtctcgctctgtcacccatgctggagtgcagtggtgcaatctcagcctactgcaacctctgcctcatgggttcaagcgattctcctgcctcagcctcccgagtagctaggattacaggcacatgctaccatgcctggctaatttttgtatttttagtagagatggggtttcatcatattggccaggctggtcttgaactcctggccttaagtgttccacctgccttggcctcttaaagtgctgggattacagacctattgactccaattttgaaacaagttctattgtgggtaaaagtgttacccagcagcatcacatggtacagagaaatcttttgtgaaaggaagttgatacagccaacttcgttgttgtcatattttaagaaatttccacagccaccccaacgttcagcaaccaccactgatcaatcagtggccttcaacatcgaggcaagaccctctactaggaaaaagattacaactcactgaaggctcaaatgatccttagcattttttagcaataaagtatttttaaattaaagtgtatatatttttcatgcataatgctattgcacacttaatagactacagtatggtgtaaacaagtataacgaaactttttttttttttttaaagagacagagtttctcccggtcacccaggcgagagtgcagtggtgcaatcatagctcactgtagccttgaactcctgggctcaagcagtcttcccattccagcctcctgagtagctggaactacaggcatatgccaccatgcccagctaataattttcatttgaaaaatttttttgtagagatagagtttttctttttggcccaggctggtctcaaactcctggctttaagccgtcttcctgccttggcctcccaaagtgctaggattataggcatgagccaccatacatggcctgtaaacaaaacctttttttttttttttttcttgagatggaattttgctcttgttgcccaggccgaagtgcagtggtgtgatcttgactccctgcagcctctgcctccctggttcaaacgattctcctgccacagcctcccaagtagctgagatcacaggcatgcgccaccacacctggctaattttgtatttttagtagagatggggtttcaccatgttggccaggctggtctcaaactcctgagacatatacctgttgtaaattggtatacgtcttttttgctttttgttttagaaacaggatcttgctctgtcacccaggctggagtgcataggtgtgatcatagctcactgcaacctcaaatttcaagattcaagcaatcctcccatcttagcttctgaagtagctgggattgtaggttcaccccgccatgcctggctaattttttattttttgtagagacagagtctcactatattgcctaggctgacatcttttcaaaaacagttttggaatatatataaaggatgttaagatagtaatattatttgacagattctactttggggacactatcctaagaaagtaatttaatatctgaaaagaaaacctgtagcctgataatgttgtaatattatttattatagtgagtaattgatttcagtaaaatatgatctatcagctcagtgcagtttgaaattatgaatgtaaagacttcagctacatgaaaaaatatattactatgttgaacaaaatacttaaaaaggaatacaattatatggactgatggttataggagtatatgaagttttcacacagttgctaggacataacttgtttgtctttagtgtctttttgacattgccaaaagcttctgacactacttttttaaaaatgtggcttaaaaaattgtcaagtaatgagcaaaacagagactctacttctgtgccttagtctcattgccagttgccagcctctgatttcaggtgggtgtgagggatggagggacaatgagggatgaggcagggctcggagatggtctaagaagtcacttgtatctcatgtgggtttcttctctcaaattcttgagtttctctttatagaccctcattagaaaagtcggttatgtgggcatcagtatgagcccttactcttgactccaccactgttagggacatcctcagtgaaatccctgacaatttcttcagtaatacatatgttatataacactcctttataatgatttttttggggaaagaatagtaattctttagatgctaacccagccggctgtaaacaaatcatggttctttaaaaaccatggctcacacctgtaatcccagcactttgggaggctgaggcaggtgaattacctgaggtccggataacagtaatgcatcctcataagagttcaagccagtaattaatgaaatacaaagccaaagtccccagaaatgagagatggtttgtgatgagagaggatctggggtgtctgtggtctgttacacacattacttgatgataaaaacagtgatctttactttggcttacaaaaggctcgtgcttcagcagagtgcagcaaaatgttccctgaccaaaacgactgtgtctgaagggcacagcttgggggaatacagctatgaaaaaaactacacgaggaacaaaaacattggatgaaaatagtggttgtatttggaaggtagaattataatcctccccttttctacgttcctaaattgtccataatgtggttatatttttttaataataaaagtccaatttaacaaatatttattggacactgcgtgtcagacacaatgcttgatgctggagatacaatgacccagacaggcacagtcactgcttggcggaacttcagtccagtgggagaggcagatgattttacaagtcattgtgacaccatgtgacaaacccacaatagaggagttcagagagtggctggattgtgtccgagtggtgcctaacccaaacgggttgggaggaggtcccaggaaaggcttcctggaggaagaggtgactaagctgggacctgagggctatataactgaagattggagtgaggagtgttctaagcaaaagaagctgcatttggcaaagcttggaggaactgaaagtttggtgacactggagcatagattgagcatgagaagggagtggtgagagatgaggctggagcttgaagtaggaaccagatcacaaaggactttgctttcttattaaggaatttggattttgtcctaaggcggtgtaaagctattggaaggatattcatttgcttgcctgcttgctcacttatttattcttccaaatttgttgtagaaactcaaataatatggaagcatgaaacatgaaaagtaaaagtctccccttctctacttcacaccctccccccagttctaatccccatggtacctattgctaagtgtttcatctgcaccctttctgcagttttctgggaagtatatgcaagcgtgtgtgtgtatatacatattttctttctacacaaatggaatcatgctatactgaataactcccatcttaaaagcaaaacttgactgggtgcagtggctcacacctgtaatcccagcactttgggaggccgaggcaggtggattacctgaggtcaggagttcaagaccagcctggccaacatggtgaaatcccatctctactgaaaatacaaaaattagctgggcatggtggtgtgtgcctgtaatcccagctacttgggaggctgaggcaggagaattgcctgagcccaagaggcggaggttgcagtgagccaagattgcgccatcgtactccagcgtggctgacagagcgagattctttctcaaaaaaaaaaaaaaaaaaaaggcagaacttgatacaccttaggtatctttctatgtcagtacctaaagatatatattctttctaatgacagcagcacagccatttatgtagctatcccatcatttatataaccagtctcttattgagagacaattagattatgtctagtttttcactattacagaggaaaactgcagggaacattcttgttatgatatcgtgttggatatttacataagggtatttgtgagatatgttcctagaagtaaaatagctgggtaagaagggttgtacatttaaaattaaggtagatattaccgtattattccctgttaaggtgatatcaatttctactctcaccaacatatgagtgtctgttctttcatatactcttccccactggatatatcctttttttgatttctattttttgagatggagtctcactctgtcacccaggctggagtgcagtagtgcaatcttggcttactgtaacttccacctcccgggttcaagcagttctcctgcctcagcctcctgagtagctgggattacagctgtgcgtcaccatacccagctaatttttgtatttttagtagagacggggtttcaccatgttggccaggctggtcttaaactcctgacctcaggtgatctgcccaccttggcctcccaaagtgctgggattacaggcgtgagccaccatgccccgccaatatatccattttttaaaaaaactgtggttaaaaaacacataacttaaaacttaacatcttgatttatttttaagtttacagttcattagtgttaagtatattcacattgttgtgtaaaacagatctccagaactttttcatcttgcaaagcagaaactctgtacctattaacaactccccatgccacctcccactagctcctgaatcaccattctactttctgtttctatgaatttaactattctaggtgtctcgtacaagttaaattacacactatttgtctttttgtaccagcttatttcacttagcataatgggtagaaacaagtcacaggtgttgcctctactcaagggcggggattccacaaaggcgtgaacaccaggaggtggacatcattgtgggataccttggagtctgtctaccgtaatcttccttgtatattccaaatattttctccatctagtagtttttgtttgggagttttatgctctaatttgtatgagttaaatgtgttggtctttctgtgactgctgtgttacaatttctagtatgtttagagtggccttaatcatgccaagatttcttaaacattcacccgtttttcatccatattgtattctaatgctattattactttggaatttattttgatgtgagatttgagagagggttcccattttttttttcctctgtagctaatctattgtctcaattcttgaataatttcttttttacatagcttgttctgttttttactgttttttttcccattgatatggctacctattcctctgtccatttccacatcagtatattattgtaactttgtaatatgttctttgattttacttttagttatgtttttaggcagatacatatgaacatacattcatgtggtctaagattaaagataagcaaaaagtgcagtgaacagtatcctctccatctctgtcctagccacccagttcactccccacaggtgcaaccactgttgtcacgtttatttattccttcaggaatattttatgtatgtatcagcaaatgtgaatatatagtccacctcatgccacacttttctctgaagatagttgaccatacacatgtctgtaccttgcttgaatgaagttaagtgaataaagttaagtgaataatacatcttggagatcttcccatgtcagttcacaaagtacacctttatctgttttaaaaattagtacacagtattcttttatatgactttgtcataatttattcagctagttccctattaatgaacatttaagtaatttacagattttaaaaaaatatataaacttattggccgggcgtggtggctcacacctgtaatcccagcactttgggaggccgaggttggtagatcacgaggtcaagagatcgagagcatcctggtcaacatggtgaaaccctgtctctactaaaaatacaaaaaattagctgggtgtggtggtgcgcacctgtagtcccagctactcaggaggctgaggcaggaggatagcttgaacctgagaggcggaggttgcagtgagccgagatcgcgccactgtactctagcctggtgacagagcgagactctgtctcaaaacaaaacaaaacaaaaaaactatgcttcaatgaacaacattatgcacatacagtttcatacatatacaggtatagctgcaagaaaaatgactagaagtgaagttgctggggcacaagcatatgcatgtgtagttttagtagatattgtcagttcaccctccctagaagttgtacattcctctctgctgtatatgaaagtgcctgtttgcccacatcctccccaactcagtgttttgtcaaactgtttgatctctgttagtctacatagtagaaaaattatgtttctgtttagttttaatttgtgcatttttcttatgagtaacgtgtgttttttcctgtttatgaaccatttgtattatgtttaccgtgaacaatctgttcatatcttttgcctttaattcttttgtgtggttgatctttttcttactgatttttaggagtttttatatattagaaaaactagccatttatctgtgatatgagatgtaaatattttccacatttgccacttgtcatttgactttctttatactgaaattttttttctaacagacattacaattttttcatgtatcaaaagttaatgttggctggatgcagtggctcactcctgtaatcccagcactttgggaggctgaggtgggtggatcacctgaggtcagcagttcgagaccagcctggccaactgagtgaaacccccgtctctgctaaaaatataaaaattagatgggcgttgtggcaggtgcctgcaattccagctactcaagaggctgaggcgggaaaatcgcttgaacccgggaggcggaggttgcagtgagccaagattgtgccattgcactctagactgggctagaaggatgaaactccgtctcaaaaaaaagaaaagttaatgcctttttggttgctcccaggttttttgttatagttagaaagttatcttcttttgtttttgctaacactttatacctttattttcaaatataaaatctttgatccatcatgtgcttatgccagtgtaaggtatgcagtgtgaatctggcttattttttttccactttgctagctagttgtctcaacactatttatgaataatcatcttttctccgatagtttaaatgctacttccatcataaactaaattctcatagtttgattggattttgagacttcctattctcttttattaatctgcgtgtctattcatacaccagaatcacactattttaattaatgattatagcttcatattatattttagaaacctggtaagattaattcactttcatgctgcttttcggtgatttttctaggctattcttgcatgtttatttttccagatgaactttatttatttatttattctctttacaccagtgttactgccaaccaaatgaactttaaaatcggcttgttgaggtctttttaaaaaatgcttttattattgggttttatgcagctaaggatatgatcagatttgtgttttaggaagattattctgactgcagggtagaactaggttggaggaaacaagattagagacaaaaagaccaatgacaagattgttgcagtaatccaggggagaatggatagatgaggagttgaggatagtattgggttcaagaggtgtttagaaagtcaaaatggccaggtgcactggcctgcatctgtagtcccagctactcaggaggctgaggtgggaggaccacttgagcccaggaaattgaggccagcctaggcaacacaatgagactccatctctaaaatataaataaataatacaatacaataaataaaaataaatagatggtcaaaatgaccagacttggtgatgactgagatgtgcagggatgaggaggaagcactcaaggatgaccccaaactttctgggttaggccgtcgagtggcgccattcccagcgatttgaaacacacgagataggggctggtttaggaggaagatggcaaattcacttctaaatatattgagtttgaggtgcctgcaggtagtcctagaagagtgtggtccagtgggctgttgaatgtataagtctgaagctctggagagacatctgggctagagagatggagtgatatgacagagccctgaggaaccccagcactaaaggatggtcaggaagttcaggagtgtgcgaagaagactggaaagaaacactcagagaggtaggagaaaaatgggacggcatggagccccaggagccaggagaagaatgttttcaatagagcaaactgtcagtaatttccagtgttccaagaggtcaggagctgaaaatgcccatttggatttagtagcgtgcaaagtctgtggttatcttgggaaatttcggtggagcagagggatgggggctgaggtctgtgggagttgaggaagtggagttgaggcaactccttcatcacaaagcttggctgtgaagaggagagacaccgggacaccggggcaaggaggaggaataggatgatgcagcaagttagcgacttttgtgtctcctccttccccagctttacgtgggagaggctgggccatttgtttgttttttgttttgttttgttttgttttgtttttttgagatagaatattgccctcttgctcaggctgccatgcagtggctcacactggctctcctcttcccagctgtggcacatcccagcggcagttaatcttgccactttcaatctccccattaccattataagtgctgggattacaggcaggagccaccaggcccagcctttggcccacatttaaatgcagatggaaagagctaatagaggagaggaggaagcagtctgtgatcctgttctttgaggaccaagtaatactgagaaggatataaggggttggagaagttggccaaatcagtctggcagagagtaagtcaattatagtgttggtatatgttccctgacagttttgacttttaattttgttgagctgtctaatatttttgcttggctattttgagaaggagcctctaagaaattggattcaggtttagaaatttagttgaagattaagtttaaaaagtaaggtacagacagtgtatcagtaagttaccatttgtgtaaaaagggaggagatatctgcactcccatgtttattgcagcactatttacaatatggaatcaacctaactgtccatcaacagatgaatggataaagaaaacaggttatgtatacacaatggaatatcatccagccataaaaaagagtgaaatcctatcatttacagcaacactgatggaactggaggccatttatgttaagtgaaataagagaaagacaaatatcgcatgttctcactcatatgtcggagctaaaaaagtagataccacaatgacacacagttagattggtggctaccagaggccaggaaagggagagggggatgaaggaagaaaagggatatttatttatttatttttaaatttttgagatggagtctcgctctgctgcccagactggagtgcagtggcacgatctgggctcactgcaacctccatctcccggattcagcagttctcctgtctcagcctcccgagtagctagtagcttggattacaggcgtgcgccaccaggtccagctaattttttgtatttttagtagagatgaggtttcaccatgctggtcaagctggtctggaactcctgacctcaggtgatccacctgcctcggcctcccaaagtgctgggattacaggcatgagccaccgcacctggccaaatgtatttattaccactgaactgtacatttaaaaatggtaaagatgggctgggcacagtggctcagccctgtaatcccagcactttggaaggctgaggtgggcagatcatctgaggttaggagttcgagaccagcctggccaacatagcaaaaccccgtctctactaaaaatacaaaaattagcgaggcgtggtggcatacacctgtaatcccagctactaactactcgggaggctgagacaggagaattgctcgaacccgggagacagagggtatagtaagctgagatcgcaacattgcacttcaggctgggcaacagagcgagactccatctcaaaaaaaaaagaaggtaaagatggtaaattataaatgcatgtatagagttatattatacacatatgtttaataaagagcagcagtaatatgtattcttatttgctgtacatgcataatcagtatttcaaaggactcacaagaagcaaaaaatctggtatcgattgtgaggtgggaactgggtcgaaggggagcgagaattgaggatgccttgtcactctccactgttatatagggtatttgttgagaatgccaatatattacttatttaaataacgtgatgtaaactgtttagttatctttaaaagtaatgattacaacagggcctgaattttcttatttactaatgattctaagcatctgtaatctgtctgttctgtgtctaagaagctaaatcttgctgtgtgcctgtgaggtgtggatctttgcctgtacagttggtcctccattatctcattatctgagggttggttttgcatatgtagattcaaccaattacagatcaaaaatattagaaaaaaaattgcatccttactaaacatgttttttctttgtcattatcccctaaacaatacagtatgacaactatttacatagtatttgctttgtattaggtattataaataatttggaggtgatttatagtatatggaaggatgtttgtaggttacatacaagtactgtgcccttttatatcagggatttgagtatgcatagattttggtgtctgtagggggccctggaaccaatccccctgcgtactgagggacagctgtgctccactcttccccactggggaccgacagccttggggaagtggacagtcctggttcttgggtcaaggaagaggaccatggcctggaacatcctggccctatccactatagcttgaccgagtgggctctaaggctggtttatagggaaggaaagaggaaatggggtagtaattattgtgtcataggcaaaagcctcacactggctgtccccttcccctgggaaaaaattctttagcatttctctgtaaatttcattgtgattttagagcatgtgtctgaatgattacatggagtaaacgtatttcactttttttttttttttttttttttttgagacagagccttgttctgttacccaggctggagtgcaatggcacaatcttggctcactgcaacctctgcctcctgggtttaagcaattctcctacatcagcctccccagtagctgggagcacaggcacccgccaccatgcccagctaatttttgtattttcagtagagacagggttttaccatgtttgccaggctggtcttgaactcctgacctcaggtgatccacccgcctcggcctcccaaagtgctgggattacaggcatgagccacctgcccagacacgtattttacttttaatctctagttttatattacatgctgattgcacatccccactcaggaacatcagaagaaatacaaaaagaggaaatatttcaaaactttgaaatcccacaaaaataatcacattcactaataaatatttctccttatttattttttagggtaccaggtaaggagactctccagtttagttaggactatgcctaatctgagttcccataaatcctcaaatgaactatatatgttattcttctggagactgaggaagctggttaatcactgttcccttgtctgggttctcaaaggttcagcactgaagccgggagccaggagaggatagcattatgacctttactcctcagtaactcctaaggctcacagagtggttagttttccctcccctgtctgtaggcaaaagtggggacttgcagataggaagaataggcttccttagtgtcagtcccgctggtttttcttcttcttcttttttttttttttcctgagacgagtcttgctcgctctgtcacccagactggagtgcagtggcgtgatcttggctcactgcacctctgcctcctgggttcaagcgattctcctgccttagattccagagtagttgggattacaggcacgtgcatgaccacacccagctaatttttatatttttagtagagatggggttcgtcatctggccaggctggtctcaaactcctgaccccaggtgatccacccgtctcagcctcccaaagtgctgtgattataggcgtgagccactgcacccggcccactggtttttctgtttgtttgacaaaaggaatgccagaccaactcagtctccaaacaagcgcccagatccagttatggctttaactgagattaaatggagaatctggtttcagggaccagttcttccatttttggtagcttggttcgttatggagactaaagttcttaccatgatgaattaaaaaaaaaaatttatttttgtatttttctgctgtttaaaccatgatgaatttttagcaacctctcatctgggcagattctcccaagagatagtgaatgcttaggaacactttacagctcagcctaagggagaacatatcagaagcatggctggatgagaaaggagtggcctgcctgggaaagtactccgttcccatcttcagaggggtctggtggcggctagatggcctttggtgaggatgctgtctggttgcattggctggcccggaagatcattccaaactctgtggcttatgagtccagacagaacaggacaaggacactgtgtgtgtcttttcatgagctagtggccagatgaggaaaagtaccctatgctcttttaaataaaaaacaggatgtaagtttttttaaaaattcaatatgctttatttagaattaccatgtgctttatctaactaaatattccagagcattttattctttccagacatgttttctcttatactttcctagttcctttgtgacatcgtatgcttattttgtcctttaaagttatcaacagtgtgaaaaaaagttgttttgttggctggctgtatggtagaaaacacagccttcatctctttttttggcatatatgtagaagttattgagttaaaactgaaaaggcacctttaatttatgacagtatcataactttaattaaaaaatcaaacttgttatttggaaatgtaaaatcttccccaaagtagaataaagaacccccatagactcatcaccagattcaatatttttcaacattttgccactcttgtttcatctgtcccctcccctttgttttttctcttttaattccaaattacaatctcttctaaactcagtgaagtgtcctaccaagttgaatcacagcggtggatctggtgtgattcagaatgcagtgggggtgaaaggagggagtcggcaggctgacaggtgcctgtcttttacatatatttcctacggcaggaagaggttggtgtgggatgaacagaggctcaggcactttgtctcctttcctgcttggcctgaagtgcctacctgacccttgtggcctccaagggtgcctttggccagttgccttaccagccactaggccggactcctgccactgctcaagtcttagttgatcaaaagccagttcttcccttctgcagttcctttctatcaccataagaagcaaatcagcttcctctggaggagataaatgggcaaacctgatttacccagaacatatttctctagtcattgtcttattagcattaaagttaaaaggagaactacactcaacggaaggcctccctcaccacccaaagatatcacaccaggtggggaggtggggatgggaacaggcagtttaaaacttctacttctgtggaggcttgggtggcgctctgtggaaagacagtaaagtgcctttagaggcttgggtctgcattcaccctgctatgccatccctgagaacttgaagctgaaattcttcattttatcgtggaaatttgtagctgtacagaaaagtaggagtagaataagaagctcccatatagccctcaccagtttttaataacgatcaacactttgcatttaaactttttgattatgcagcctagtagtaaaaagagttttatatccccaatttgggtatgttctttgttttttaaattatgtacatataacactgtattgttaatattaagtatacaaaaaaatagaaagctaagtggaaacagaacttctaatgttttccccataccctatgccatcctgtaaatcccctgggggtacacattcctctttggagccaaatcatttagaaacattatgtaattcagcaaacacgtgttggagcccactgtgtggctgacgctgtgcaaatgctggagggaagatgctgggggaggtctcactgcttacagcctgctccatcagggtcagggaatgaacatgatccatcttctccaggtgagaagctctgcctgagacatagaccttattctctgccttttcttgagcaggatcccccagcatgaactctgggcgtgttttatgcattgtcgttatttcttcttctttttttttagagatggggtctcattatgttgcccaggctggcctcctattcttgagctcaagcgatcctcccacctcggcctcccaaagtgctgggattacacgtgtgagccaccaccacacccagccattatttcttattttgagaaattattttgcctggccctctgtgatcattttgattggtctgattttgactttacctgctaaaaacaaaacaaccccaaaactgttttatctctatcattttctggagtcaccttttaacttagtttatctgttaactttacttcccttttatctttcatttaaaaatacagactaggaaggggcaacacaagggccacagacatggtgataggccaggtcctaaatcagcaggttgggtgctggtgccttctctggtctgttctgctcttcatctcttcttttcatgcctcacagcaagacttatttggtcctttggagaagattggatccccagatcagctggtcaaaaaaggcatagcctccaggttaaaaacaaacaaaaaacccatctaggtggttcaagggctctgaaagtctaatcacttctgcgagactggaatagactagccccaaagatagtgtagtgctggcaggctgctgggggaaaagccttccaaaacccagaacagctgggagcctcacaggagttttgtgaactgaagcccctgcctgctggcatacctaagcactgcagagggcaaaggaagagtgttgggggctgctgtcagagaggctggctgggtgctggcaggtctgacgctggagatttgttatacattttgaacttctcttgaagtttctcttttcttttttttttgaatgatgttataatagggtatttaaccaagtatgacatccttttttattccgcttagtttgtaaggtagacttaaatgatccatttaaccccaaggcagtgtgaattaatagcagcccctttgttgtggacaggccttcacgactcccccacttgtcatgagaatcaaaggaggtgctggcagtgcctagaatgatctccagctgggttcccaagagaggcacagttgttcctttgttatttagacttgtcctttttaaaagaggggggctataacatcttccattagcttcagtctgcatataaataaagagccctgcaagcttcaggaacctgccttacttcctaaacttgataaatttccactcttcaccaacgctttttttttttttttttgagatggagtttctttcctgttgcccaggctggagtgcagtggcacgatctcagctccctacaccctccacctcctggattcaaacaattctcctgcctcagcctccccagtagctgggattacaggcatgtaccaccatgcttggctaatcttgtatttttagtagacatggggtttcaccatgttggtcaggctggtctcgaactcctgacctcaggtgatcctcccgcctcagcctcccaaagtactgggattataggcatgagccaccgtgcccggcccccagcagaatttttaaaaaagagttgtggtctcattatgtcgtccagggtggacaccaacagaaatttatttagtactggtggccaatctgtcgcacatttgtcaagaactaaagaagtaaactaaagaagaaccaagcagcatcatgggcaagctggaggcccagtagagctaagtgatgagtttaaggatgccgttagagccaagcattaacggcagatagggtagatagacactaccctatctagtgtctctactaccagctacgtttccaaccagtctcctctcctacccaagctctgttggaaacagatacaaacccaagtatacagaggaattaagaagggttggggtagcattttaattctatcagaggaagcattatcgtcaatgaatagctttgtgacttttagctaaccgtttacataaatattaagttagatacttactccaaatgagactactggagccaacgtcaatttgtaggtgtgccgtttgtattgcatcatagtcaggtgtcttagcaagactgttaacctgtaattgaatcttaaatcttcagtggatttagaagaatgtaatacaatttatctggagaatttctttttcatttttcttttttgaaacaacaaggtctcgctctgtgccccaggctggagtgcggtggtatgatcatagctcactgcagcctccacctcctgtgctcaagggatcttcccacctcagcctcccaagtagctgggactacaggtgtgtgccactgtggctagctagtttttaaattcttagcagagacaaggtctggctatgctgcccaggctggtctcgaactcctgggctcaagcagtcctcccaccatgagctcccaaagtactgggattacaggcatgagccatggtgcccagtctggaaaattccttaatatttttttttttaacttctgtatatatcagtacaaatctgtgtaaaatctcaaaaagaattgattttatgtaggctatatagcaaaggaggcaaagcggtgaggtaaagagaatactgaatgaggctcgggatcctgagttttagtttttaggctgctacaaactagctctgcaatcttgagaaaaatcacttcagctctctgtaccttggtttcccatctgtagaaggaaagagcagaattccactccctcttgcttttacttgtgttgctttctctgctaagccagcaactccagttcccttcctttgcctatccccaccttattttcacctactgcaagctggaaaatgagatgcctcagtttgttagacctgggtggggtgtgatgcagaactggaggggttcctttctaactgctgtcctctggggttcttatccatttttgttatttaggggctttctttgctttctggctcaccactgagatggttgaaattgccacataaatgacccctggctcaagctagcacattgtcctcatagcataaaataatggtgacatcacattccggtgcagtcctctgtaatattgaagcttcatgcaagtacccattcccagtgttgacgatggtattccaggaaaatatgtgttgctcttgcaggagttttatcactttttttcttgatcacgagtcatcatgaggtctgtcattgaagctactaagagttgtcttatgtagaattgcttctgtttgagaatatcgattaggcacccctttgtacagatgctgaggttgtggtattctggatcaatactttttcaaagtattaaccatttatatgcttaatcctggttttctgcatgtttttaatatattttttaaaacttggtagaacttcttttttttttttttttttttttgagatggagtctcgctttgtcgtccaggctggaatgcagtggcacaatctcagctcactgcaacctctgccccctgggttcgagcaattcttctgccttagcctcccggtagctgggactacggactctcactaccatgcccagctaatttttgtgtttttagtagagacggggtttctgttggccatggctggtcttgaactcctgacctcatgatcacccaccttggcctcccaaagtgctgggattataggtgtgagccaccgtgcctggccctgtagaacttcttacatggaaggatgtatttggtcataccattagcatttagaaacccatatttcacttcaaggtatttggaaattacatttctcctgtttttaataactgtataaaaatacaactataagctaggatttattttgctacttagctgcagaagaaaaatgtatgtcttgattgttcacacataaagaatatactgtaccatatatgcttttgataatgataatcttcctagttgataataaacaacaactctccaattcttggacttcagctcatttcctaacttagcgtgggcttatgtaggaatctgcttatggtttaccagtcaagtaagatctggggtttctaattaaccacaaacataatgatatgccaacagtacagtacatctacccaaacagttaatgcaaatgtaggtcacattgatagatcaatagtgtctaaattagaggaagtaatttcccccctaggtgacgaaatctagttgcaacttttcagccattcatcccaggctgcagctttcagatgctatgtgataggtaggtgtgcacctacacgtaactgatatctcatctaactgagctctaggtcccttggggaagtactccgggagtatggtactgtctgccgttagctctaaacttctacctggaaatccacaactctgcttcttttggaagattcacacgtcctgtttcattacagaaagagttctgccgttagcattagccatgtcactcccctccccggtctatctagcactggatcccagacactgatgtggagaaccatttctgtatggaggcacagaagccttctcttcctcatttgatgtctaggtcccatgttctgaaacagtagagtgcttttcagatcctgagcctaaggccctccttaaaacacatagagtcctatttacaggttcgtttctttcttgcttgctttctgtatttatttactagagacaaggtctcccctctgtcacccagtctggagtgtagtggcaggatctcagttcactgcaacctctgcctcccaggctcaagtgatcctcctgcctcagcctcccaagtagctgggactacaagcgtgaaccaccacacctgacaaatttttgtattttttgtaaagatggggttttgccatattgccaaggctggtctcaaacttgtgagctcaaatgatccacccacatcagcctcccaaagtgctgggattacaggcctgagccactatgcctggctcccatttgcagattcttttgacttacacctcccttgttcttcaagaaaatggggccaggcacaatggctcatgcctgtgatcccagcactttgggaggccgaggggggtggatcacttgaggccaggagatcgagatcagcctgggcaacatggcaaaaccatctctactaaacataaaaataaaaaaattaaaaaattagccaggcatggtagcacatgcctgtaatcctagctactcaagaggctgaggcaggagaattgctcgaacttgggaggcagaggttacagtgagctgagatcacgccactgcactgcagcctgggtgacagagtgcgactctgtctcaaaaaaaaaaaaaagtaagaaaaatgggactctctatttcattcagtctctctctgtcatcactaccatattagccagctttgctttagtaacaatccaaaaactcagactctcaacaaacatttatttttcactcatattacttgtccgtggtgctggaataccttctacgtctctcctctgtgtatcttctccatctgcaactgaggctgaaggagcatcccctacttaagacatgatagtctcatggcagaaggaaaagagtatgagagtttctgtttgaacaatatgaacatcacatttgctcataagccattggccaaagcaagtcacatgggccagtcaactttttttagccattcatcccaggctgcagctgggtgacgtcagaggtgacttggaatggcaacagatggtgcctgagctgtaggaccgttggggagcaccgtgggaggctcagaatgctggggcagtccctaatagtgatgctgctgctcctgaccacgaaaggactctgcaggtcagccccacctttgacaagatgcttcccagggttccaccatgcagacactcatcctcctttccaatgtccgggtatccctgggacaagcagctcttatgtatgtaacatcattttgtcttctcaacaagcctgtggaagttattatcatttccactttttagataaggaagatgaagtaacttgttaataagtggaacatctgaacttgaactgtttctttgactccgaatcatatgtgtttttggggttttgttgttgtcgtcgtcgttatttttatttttattttttttctgagacagagtcttactctgtcacccaggctggagtgcagtggcgcgatctcagctcactgcaacctccgcctcccgggttcaagcgattctcctgcctcagcctcctgagtagctaggattacaggcatgcaccaccatgcccagctaatttttctatttttagtagagatggggtttcaccgtgttgaccaggctggtcttgaactcctgacctcatgatccacctgcgtaggcctcccaaagtgctgggattacaggcgtgagccatggcgcccagcctgttgttatttttaagagacagggtcttgttctgtcacccaggctggagtacagtggctcaatcatagttcactgtagcctgacattcctggggtcaagggatcctgagcctcaacctcggcctcctgagtagctagcactacaggtgcacatcaccacaccagctaatttaacaaaaatttttgtagagacagggtctcacactgtgttgtccaggctggactcaaactcctggcctcaagtgaccctcccctttggcctcccgcaatgctaggattataggcgtgagccactacaaccagcccaaatgatatattctttgaatggcaacgtgcaatgtttaaaatactggccgggtgcagttgctcacccctgtaatcctagtactttgggaggccgaggcatgtggatcacttgaggtcaggagttcaagaccagtgtggccaacatggtgaaacccagtctctactaaaaatacaaaaattggccgggtgtcgtggcttgtgcctgtaatcccagctactcaggaaactaaggcaggagaatcgcttgaacccaggaggcagaggttgcagtgagccaagattgcaccacactccatcctgggcaacagagagagactccatctcaaaaaataaaaaaattaagtaaataggctgggtgcagtggctcatgcctgtaatcccagtactttgggaggctgaggcgggcggattgcctgaggtcaggagttcgagaccagtctggccaacatggtgaatccccatctctactaaaaatacaaaaaaattagccgggagtggtggcatgttcctgtaatcccagctactggggaggctgaggcaggggaattgcttgaaccaaggaagtggaggctgcagtgagccaagatcataccacttcactccagcctgggtgacacagcaaaactccgtctcaaaaaaataataataaaataaataaaagaaaatactgtatgtactctgcagatataaccatgtaagaacttacatggataaaacttgaaaaggagtagaaaaagtgaagtgcttggccttttgagtggcacgtagtatttctttgtcacccaggctggagtgcagtggcatgatcttggctcactgcaacctctgccacctgagttcaagtgattctagtgccaccatgcctaatttttgtatttttagtagaggcagggttttgccatgttgcccaggcagatctcaaattcttgacctcagacgatccacctgcctcggcctcccaaagtgctgggattacaggtctgagccactgcacccggcccagacttagctccttcagtttctggcttccctaactgaacagccactctaattcatttgatgaggaagatctttgagaagtaattgagaaggttaagccaaatatagtttggagtaagatcagatactgcaggggcagagagttgagattaggccacagtgaagaagagaagaaaatatcaaatgtaagcagagattaacaccccacaactgaataccagcagtaatacaggatttgggccagcagcagggttaatgcaaaagaggcagctgttaaatcgaaaataagagcttttgttttgttttttgttttagagacaaggtcttgctctgttgctcaggctggagtgcggtggtgtgatcatagttcactgcagcctcgaacacctgggttcaagtgatcctcctgcctcagcctccccagtagctaggactacaggtgggcaccaccacgccccactatttttttttttttaatttttttttgtagaagtgagggcttgcagtgttacccaggctggtcttgaactcctggcctcaagtggtcctcccacctcatgctcccaaagtgctgggactgcaggcatgtaccaccatgcctagctaatttgtttgtttgtagagctaatttttctttcttttgtagagacagggtctcactatgtttcccaggctggtctcaaactcctggcctcaagcaattctcccacctccgcctcccaaagtgctgggactctagacaggagccactgcacccagctagaaaatttaataggaagtctaaaagacatttcaggaactctctgcttttgggaacgccttctaaagacccttctccccaccttgtggactggccttcaggagcccagtttggcagtaattgtgcagtggctcaggcatgtaatcccaacactttgggaggccaaggtgggtagataacttgaggtcaggagttcaagaccagtctggccaaaatggcgagaccttgtctctacaaaaaaataaaaatgtagccagcatgttggcatgcactgtagtcccagctactcaggaggctgagcctgggaagtggaggttgcattgagccaagattgtgccactgcactccagcctgggcaacagagtgagaccctgtctcaaaaaaaagagatcctgtgtcctcattgcatcttgccaagaagcacctgatgtcagtttgtcccattatttttcaggtatttcaatatattattctctagaatagagtattccattgtctgagataaatctagcttccctatatcatagtggctatttttcttccagcccagaagtttttccttggtaagataactttattttgtgagtttatagatttggattataaaaatagatcggaactgttagactaatttggcccagagattttatgagtccacttgggagaaataggagtaattctcaaaaccaaaatgagaaaatccatgtttaacaaagaaaaattagtttttagctgaaggaagtcccctataaaaacattgcgtcacaggattcctttcacagtaagctaccaattttatatgtgactcaattgacgtaaaactctgttttaaatgaatagtatgtgaggtgatggatatgttaataacttgatttcatcattttgctatgtatacatatatcaaaacatcatgttgtacagtgtaaatatatacaatttttctttgtcagtaacaccttaatgctggaggggatgggagaagaaaatctgttttctatatttcacaagcacatctattgcacaatgtatacacattgcctcattatgtgagatttattggcccagcctaggatttggcttttgacaaccaaaaaggttgccctttgtgataccagtctcaaaaatgttaagaacgtaccccaagcatctctttaaaaaggattttggatttattgaccatgaatttatctacaatctgtttctgctttcatttgtatcatttagggactgatgatttgtatgttttccacttgtatttacatagcattccttttttcctctttaactcaggggttacacactctgaatgtctaaaatgatgagtcagtgaaatggtttgtgtgtaaggattcatagtaagagagtgggtgtcccatctacagggagcagccatgctcaacttgagcctgagatgagtgcggctcattgtggccaagatattttgatttatgggtgggtgcggtggctcacatgcctgtaatcccagcactttgggaggctgaggtgggctgatcacctgaggtcaggagtttgagaccagcctggccaacatggtgcaaccccgtctctactaaaaatacaaaaattagctgggcgtggtggcgcacatctgtaatcccagctacttgggaggctgaggcaggagaatcacttgaacctgggaggcggaggttgcagtgagctgagatcacgccattgcactccagcctgggcaacagagcaagactccatctcaaaaaacaaacaaacaaaaaaaattctgacttttccctagaatcctcaagtctgaattttcaaacattatgaattcaatcaaaaattttaaaagacactgtgcagaacaaataggtgcctcgtggcttgccagtttctttctttaatatacctcttttacatttcaaagtgtcctttctagttttctgggatttagtatatgagttcaccgtcttctgattctcctcccccaattgcatgacaacttttattattctttcagctttcctcttaacacactacagattatttgtcattattttatggttattataaagaaatagttccatatactactttatttaccttgacccaaggcccactaatgtataataagtaaaactgtaaaatcggtcctttcatctcctgttgttatcagttgttcttgagggtgagtgtcaatttcatggttggaggccaactcttcttcccttctctctgcagccgtcatttcaccaagctgataatgttcggggaacccgccatcacgggctggtggagaggccatccaggaaccgcttccaccccctccaccgaaggtctggggacaagccagggcgacaaatatccttttttactcttcaaagggagtgtgcattctgaaatgtttgaaaagttttcaggatttatcttccctgcaattctcctttggcctcagaatcttcatttatctgatgaaaggaggcaatacaaataaatgagttggaaactagaaacatctctgcagtcaacatttggaaacatcattgtaggtgtttatgaaagcatcaataaagttcagtttaatgaaataacaacaaaaacaacctgtaattcggtcccattgcagggtgttctgagcattttctccagaaattggccacgttagagttaaacctgactttgaatcaggttagagagccttagtctctttagcaaaaatggacatagagatatgtgatttatttgtacttcttttgatctgctgacctgcttttggaacttacagacaaaatttcatattattttctatttgtgatgtttcaaactcagtaagtgataactaaaataaacctagaatataggaaaatctcatgcagtgatgtacagtcacaccaaactctgctgttaagtagaaataaaggaaaggaaatggtgaattcacctgacagtttcatttaatcagtcctgtttacagggcggcagtggtgggtgcagctgtgtgaccagcattgtgccgaaggctttggggaacagaactgagctggattttttgggagaggacacagaagtgtgccaggagggcccgtgctctcacttcattcttctcagtactcgggcgcaggggtggaggaaggagaagaaaggcggggtgggtctcgctgcggagagctgaattcctggcagtgatggtagagttggcttcacaagcctagaaaccaggaagtgggggcagggcactcatgtttactgagcacctacccatgccaggcgctgtgctgggtaatttatgtgtcacttagtcctcaaaaactcactgagtcgttaatttttttaaccctcattttctgatgaggaaactgagtgtgtggtgaagtaacccaggattcagaccaggccccgctgatggcccagcctgtgctctcccctccctatgccacctgcgaccattcgcagtgatgaggaccttgtacaagggagccaggagttgtgggggcactctagggaaaccccaacttttcttgccttcaagcttcttgcagtttttagtctatttggaggcaaggataatgaccccagggaatgtttttctctcccctttctcccgcccccaggaacacaccacatttggtccacagaaggactgacttctgattttgtatattatgtggctgttatcaaggaaagtaaagatgataaatgatcttgagaatctattctggaatgtgtgataactttgacattgaatgaaaaaggcaaaaggaaatggaggcaattcatcagcaaatttgtacatgtcaggatggagtggtacatcaaaccgttgtccaaattgccaagaatattcaggcaaaagacttggagtgtttctttgattgatttaacaatgtattttttttggctgggcatggtggctcacgcctgtaatcccagcactttgggaggccgaggtgggcagatcacgaggtcaggagattgagaccatcctggctaacgtggtgaaaccccgtctctactaaaattacaaaaaattagccaggctcggtggtgggcacctatagtcccaggctgaggcaggagaatggtgtgaacccgggaggtggagcttgcggtgaaccgagatcgcgccactgcactccagcctgggcaacagagcgagactccgtctcaaaaaaaaaaaaaaaaaaccaatgtatattttttcagttctcagttccctctttttcctgtcagtgctctcatttctatatattagattaaacattatgctatatatacgtgtgtgtatgtatatgtggctatctcagatacttttgaagtacggtctaaatgtataagcatgcatatagttttactaaccaaaatagagaagggaattgaagaaaaaagaggagaatgtttattcacttataaaaattatttgttaagtatgtgctagtggtcagacaccgttttagacattttaattcactgtaacagtaaacagcatggtccctgacctcaagttgcccagggttcagtgggagaggctactcagcaaacaagcagccacggcaggtatggcgtctgcagggaggcagctcaggggctgtgggagcacgtcggaggtgcagcttgaactagtctggggaaacgaagaaggcatcctgggggaacatctgaggcttgaaggataagaagtaagaggataaagtgttcattcagcagatctttacagagccccgtctctgtgccaggcactgttctaagcactggggacccagtgatgaataagggaggcatacttcctgctttcttgagttcacagtcctgtgggagatgacagcaaacaggcaataagaaaggaaaatggttttagatggtaatgagtgagatttaagagagtaaagcagttgggaggtatgttccaggcagagggaagagaatgtggtgcaaagtcctacccagaaggggagatgacttcttgtgttcaggggaccctatctcttatgatagggtataatctggcactgtatggatcaacttgagagcataagcaaagctagtcaactcctaaaggaaggagaaacaaaaaccaagttaatatgcagagaaattaaagttattagacagtatgagtcagattcactgatcatgagccatgtctctgtggtctcctaagctcctaaattgggttcctgggactggacatcggttgatgcaaagaaagttctttagcccagtctcttttgaggaatcaagggtccgtgaaatgggatgattttattttggtgttaatctattccacttggaggaggagggctgtgattccgtctttgctttcacgacctgcattctgttggttgtgaaataatctgcttaaaattgtggccttgaacatttgtctatgactttttaaatgaagtttcttcatttgaaagtataaaacactagtttgaatctttgttagaacaaaaggaaaaaatcagaattattatagctgtttcttggcttgggtgttatttaagacacactggcttagacaagggttttaagggttcactcctatgatagggtgatctcaaataaaacgaacattgtttaacaaatactctggcctcctctcagagtgggcagccacagcacgcagagctctgccacaggagattccttctggagtgggctttgcccttggcatgggtggccacacaagaccaaggcacagctgcagctgggccctggcctagccccacacaggcggaggagaggcactgccagggcttgctcctggctgggggcctgggctcgggcacttggaagagaagctcttctgcccttctgcagatgtgcagtctgtagcagcccttcttactctcactcatcaaggttggcagacgtgccgtgtcccaaacaccattgctaaacttctgaactattaacataaatttatagcaaataaaatattttctcagccttgtggatgacacgctcagaaggaaacacgaaatgccttccttgaaaggaagtcaagagttcaccagcgtgaagggtcgtgaagagatgcctaagacctactagagttaggaatgattctcctctctgggctgggccttgctttgattcttttcatcataatgagatgaaaatgttaggacattggtttataggacactgtttctttgagatgcatggcctattacatttgagaaacaccatactctgtatcacctcttggagcctgaccgtatatatcagggctctgaaaagtcctgcagttaataaacttcttatctttaacccagaatttcaaaacttaagtgatcacaaaatccaactgttacctaacacccgtcttatcttgaaggacaaggaaacattggtctttagaattttaagggggaaatattctgacttcacaataccacatgcaacctgtttgcctctcatttgctgagggaaacaggatgttcttataaatgcaaggactcaaaaagatgccactcatatcctcccttacagtttcactttaagatgtcttctagtgggacatagttagaggtaaagggacaaaaagaagtagaatgacaataaacacatggctgagcaatcaggaaggagccaaattgtggccagttttatatattaaatctgaccctgaaacttgtcttggtaggtgggttctgttaaccagactccgagcccacttaccccaccagctacatggaaggtctcaggcctgccccacaaactgtgtccctggcagaacacagagttccagagcaggagagaaatgactggcttccaggctgccccgacaaggcagttcctgagccctgcccaggtacactgaccgcacagggacgggaagccaagagaagggaaccctgggcctgctcacccagccgcaggtcaagcagcacaaagaaagggccagggcgggtcttgttttcagcttctgtggctcagtaaccccacccactggtaaactggccaactgatgtcctctcttatcagaagaagaagagctgctccccttcctttggtgaagagtaagaactgttccctctaacactccacaggttgagaggaacagcagtccctgtgttgatggattgaggcagtaactcgaggaggaagattttcctgcacagaactgcagaggcttggggagagagagaacacactgggatgactctgagatcctaacatgagtgtcttggtggacggtggcctcactaaatgagatggactataagaagaggaacagattaaggggacagtgattggttggatttttggtagaatttgagctgtcttgggtacttttggcagagaacttgagtaggcagttggaagtatgcacttggagttcacaaaagaactgttgggagctggaggtgtcgatttatgagttactggactgtgggtgacagtggggccgagggaaggatgcgattggccaaggcgagcatggaggacaggggctctctaccaggaagacgggcactggccctgaggctcttaggaagcgcctcctaaagctcctgtgcccggaggctcccgccaccccctccacctgctcacactctgcctggtgcccagggatcctgagagcatcctttgcctctcagagcaatgcaggcaggtgtggcctgaggctgcgaggccacaggaccccagggaacatcaggacggaaggcaaaggggcggaaaggagtgcacagagggataagaaaagatccatgtgagtgtggggatttttttttttaactttaatttttgtttccatccattgcagccacctcttctttgtttatctttttcatcatccctcctccctgccttccttttttaatgtggaaatcttccttgagccaaaggcttcactaagcttaactaaggaagcaatggaggaggcgctgatgtggttgttaaaagccctgtgacctgtgctgcccttccgctggcacgctggcacctggcagggatgccagaaatgtttcttgagtaaatggtaaattcaagtttataaataagagtgtttcctttgtctcgaggttgttacttagggcatgtcagtgttgtggagtagtttaaagccacctgaatgaagttttctgaagttttccaaagaacaaataaacttcttctagattttccttgcattaagtataagtgtataacatgagtggttctcttgggttttcaaatatccactaaattagatgagagtgaaaattaagagagctcagaggtcacatctttcaacttttgatgcctcaacctaattatattaaaaatttccaggaatttactatattttcatgttgttaatatcaggaaggttaaaatgctaacttacacctcaacattgaaatcaccagcgtttgatgattacgtgactattacaccactgcattctaatttgtattatcagtactatgagatcagagatactgagtttaaagatggcagtgtactgagaaaaatggtaaacttctacttcctgaaattaagcgtttctgaacagagattcatcaaatctgcagaaaagagaaaggcagataaccgtaggttctgaggctcggtgtttcctccctaatggctttgccaacagaaatactgacaggttttgtctgtcacgggccttactatttatcaccttttcctctcctacctcctactgtggtcttgcctcatctgtacttcatgtaccttaagcctaatagtgaatgttgaagaaatgtctctctttggaaattatctgttttattttattgatttaaggtcaaattaagaaataagataatgagacttgtcaaagaaaacgaatacatagaagatgaaacttgcaatcctaatgcctctcctggcaaagaagacatttcccaccaaatcactaagaactcatgagagcctccgttttcctaattccagattctgtatttatttgagctgcccagcccaggcctgcaggatagggccccactccatcaaggctcctgtttcctcctgagcccgagcagatggtaccttctcttatagcctccatccttcccagaacactccaggtactattttctattttctgggggcatttggcatagttcactgtttcctgagaggcagcatagcttagcggagagctctcaggctttggtgtcagtgatttgtgggtctgacccctgatccaccaggcgtgctatctgatcttggatttctcagctcttctagaactgagcctcagtttcttcagctataaaatggggaaaatatctgcctctcaggattgaggttaaataaagtgtgaactcagcacaggcctggcacacagtaggtgcttagatatctgttttcaaatttctgtcttaatgtgtagtttgtatcttctttattatttccaccttaagaaataaaagtttgggatgaaaagtattattggtaactgccgaatgtatatttaatccaatcagtgatccaggagacaaaaggaatgggcttggtttgggtgagtgataaggaggcaaccttccacataggaggtgagaaaggggaaatggccttagcaaaggcagaggggcaggaaaatacaggctgtgtttgtggaactcagaaagctggagggaagacaagagcagaagagaccattgtccccaaattgtggatcaccgcaattactaagccagtaagttttgattttgccttttaggctgaacaaaatcattgaagatttcttagcagaataatatgattaacagtgtcttcagaaggctattgtgtgggaacaattaactaaacgaatgaaaacagcgcccctctgctcggtgtgtagtgcagcatcccatttgtgtctccgtgcgtccagaatatgctccaaggcatggtagacccagtgaacaacacaagactgataagacagtgcccccaacaacactggaaagtttacctttcttcacacatctaatgcgcctcttttttggttataaataccaggaaccgccgggcgcagtggctcacacctctaatcccagcaatttgggaggccgaggtgggtggatcacctgaggtcaggagttcaagaccagcctggccaacgtggagaaaccctgtctctaattaaaaaaaatacaaaattagccgggtgtggtggcgcatgcctgtaatcccagctactcgggaggctgaggcaggagaattgcttgaacctgggaggtggaggttgcagtgagccgagattgcgccattgcactccagcctgggccaaaaaaaagagtgaaactccgtctcaaaaaataaataagtaccaggaacccaccttaacttaaaaaaagaaaatgtattggcatatgtcactggaagcccaagggctagatccaaggggtcatacaatgtcattgagacctacctctgtggtaccacttctgagatgacttcaggcataacagacaggctttctccaaggtgaagacccccaggttcagacagcccttgggcttaccagccctattggggcactccttttttttccactcaaaagcactctccttggttctgtttgcgtcgtgagccgatccctgagccaaacactgtttccagggggtgaggtacctagactagaatcctgggcctgggtccctcacatgtggcacagagggaatggcagtgttaccaggtttggagcaagagtggagacagttcctgaaaacaaaagttgccggacaggcaaaaaataataaacaccccacaaaaaatcatgcaaagaaaacaccggttagaagacagcagaatagacttgtcctcaaggagggagataagagaaagcatgaaggaagagctgtcaggtacagggataaggaaccaaaaactcagttgtttaactctctgtgagtccaccttgttaattctgcttcatctttccattaatttttatttttcctttattaaaaattctactttgatggtagtgcttttggagccaattattcctcacagcctctggatgagagttggccaaggtaagcaagacatactttaaaagatatgatgggcatgtgttatttttagataatttcactttatccactttgaatgttgtttagaaatttctaatataaagcatagaatcctgttttctcttataacatttaatttcagtgggaggatcacttgagaccaggagttttgaggctgttgtgtgcgatgatggggcctgtgaatagctactgcactccagcctgggcagcatagcaagacgccatctcttaaaaacaaacaaacaaacaaaacaacaacaacaacaacaacaacaacaaaacaccttattggccgggcatggtggctcatgcctgtaatcccagcactttgggaggctgaggcgggcagatcacaaggtcaggagattgagaccatcctggccaacatcatgaaaccccgtctctactaaaaatacaaaaattagctgggcatgacagcacatgcctgtaatcccagctacttgggaggctgaagcaggagagttgcttgaaccagagagtcggaggttgcagtgagctgagatcacgccacagcactccagcctggtaacagagtgagactccatctcaaaaaacaaaaacaaacacctaagcatttccaatgataggctaatatgaaagtctaaaatgaaaagttatttaaagaaatctagatcttcatatttaaaaccaaatagaaacacttttggaatatatttaccagcagaatactcagatatggcattcttatgtttgagacttagaaaaataagcatcttggccaggcacggtggctcatgcctgtaatcccagcactttgggaggccaaggcgggcagatcacaagctcaggagatcgagaccatcctcgctaacacggtgaaaccccgtctccactaaaaatacaaaaaagtagccgggcgtggtggcaggcgcctgtagtcccagctactcgggaggctgaggcaggagaatggcgtgaacccaggaggcggagcttgcagtgagccgagatcacgccactgcactccagcctgggtgacagagcgagactccatctcaaaaaaaaaagaaagaaaaataagcatcttttctcagagtgtcttagtaagctgctgaaaaggacaaaagactcttaaaatggtaatttgcacagtgtatttgatttaaggtctctttgagtatttttgtacccaatacagagggtaacaggaaatagaattaactgagaaaaagcccctgctgcatctgttgtgtgcctagtatcattttcagatcaccaagtcagatttaggacacatttaaaatgtgtgtatcaaaaatatttagctctccggattgaagtctactctccatccattctctgggcaaatactgactgagaacttactgtgtataatgtagtctggatctgggaaaggaaataaagatgggtaacagtgggtccccacctcaggtaggttttcagctgccctcaagaatcttgggatccagggttgtagaataaatacaatattttattacatcagtaaaagtcatctccaaactgttatttttcttttatgtatccaagaaatgtcttctgcttttcagagcaccaggactggttagacttaatattttcataccctgggcaactgtaacaattctattcctcttcatggccattggtaggggaatgcaaaatttttgcatccaagattgccacggcgccccctacatgcacactgaactcctcatctgcccagctagctaatcctgtgccttatgggtttgtagtagtttttatactggaaatcagagatcacaggactggaaggatcatggagtcttacctcattttaacaatgatgagcaaaatgagcgaggtgtggggtatttttaagtaactcttgcagagcgaggtgagtagaagagccagttctcaaatgcaagtgctgaggccctcctttgctgtctgtggattgacttcttttccttttatgttgttctggtttttaaaggcagcagcctccttggaaagacgaaaagcatcctgggttcaggctgacatctgcacttaacaggtacatgggttgtttcctggtaggagtagattttaaagcaatttaactgtcctgatattttttacatagcatccagttgccagagtgtgtttatgtaagctgtgttgatatgacatgttcaaaacaaaacccaccattttttgagtgtctacaggggaaagtatagagcacacgaggtctgggatgagactcccagggtttgcatcttgctgtatgaccttgagtagatttttaaacttctgattgcctcagtttactcatttgaaaaatggagataatgctacctagatcatgggttggttgtgagggttgaataagataatacctgggaagcatatgtgctgaataaacatcagctattatcatgatcactttgggccagactccaggagtaagagttctacctcagccattttttttcaatcctgacaacaccctacaagaatgagtattattttccattctaaaaggttaagtgacttgtttaagggccttagctaataggtgaaggactaggatttgaaaaaatgcagctgagcatggtggctcacgcctatagtcccaacactttgggaggctgaggccagaggatcgtgtgagtccagcagtttgaggccagcctgggcaagatggtgagaccctgtctctatgaaaaaaaaaaaggcgtggtggcacgtgcctgtggttcgagctactcaggaggctgaggtggggaggatcacctaagcccaaggaggttgaggctgcagtgagccatgtttgcgccattgcattccagcctgggcaagagagagacgctgtctcaaaataaaaaagaaacccgatgaatggtgcaaaattttaaatatactcaaacagaagagttataaaaggcctgtggtgcccatcctcagcttcactcattatcagcattctgccagtctctccaaacctacctcccacctcagtcccgtgactggctagtatagtattgtaccttgaaatgtctccagcagtttaaggccgacgagaaccttttttaaaaaacataaccacaatgccgctattacacttaacaaaattaaaaataactccttaatataattcaatgcctggtcggtatttagattttcccagttggctctgcattcgtttgatattctcttgagtctctttgaatctgtaaaaagaggctggaatctgaacccaggtctctctgatctcagcggccacgctctttctgttgcactgtgggttctgcccttgtctgcctcttccctcctctgaagccacgtggcttcatagccacctgaggctgtcactggaatgaaccacaaagaagcactgtaggctaatgaagttgcttaccgtaaagtcctttctatggccgacagtttgaccttatgatgagataaatagataatcatctcttgcaaccaaagctgtgtagacattgaagctatctgggagaatttcagaaatttgctatacattagtggctcccacattttcttttaggactactttacagccttaaaaaacatggaggcctggcgcagtggctcatgcctgtcatcccagcattttgggaggccaaggcgggcgaatcacctgaggtcaggagttcaagaccagcctggccaacatggtgaaacaccgtctctactaaaaatacagaaattagccaggcatggtagcgggttcctgtaatcccagctacttgagaggctgaggcgagagagtcgcttgaacccgggaggcagaggttgcagtgaacaccactgtactgcagcctgggcgacaagagtgaaattccatctcaaaaagtaacactagtaaaataaaataaaataggccaggcacagtggctcatgcctgtaatcccagcactttgggaggctgaggcaggtggatcacccgaggtcgggagttcgagaccagcctggccaacatggtgaaaccccgtctctactaaaaatacaaaagttagctgggcatggtgacgcacgtctataatcccagctacacgggaggctgagggagaagaatttcttgaacacgggaggcagatgttgcagtgagccgagatcacaccactgcactccagcctgggcaacagagcgagactctgtctcagaaaaaaataataaaataaaataaaaaaaatattgaggccctcaaagagtatttgtttatgtgagaatatctattgatattagaaattaaactgagagattttttaaagatactagtgaattaaaaaaataataagcccattacatgttaacataaattatatctttttgaaaagaaacacaaaaaaagtattgaaaatagtgacaatgttcaccttttacaaatccctccaaggcagctgggtggtctgtgcctgcgctcagcggtgggggcatcacacctcacgtggccgctggggaagcccgccgtgcttgggagagagcgagagtgaaaaaacagaggacactttactatcattttgagaatagtcttgatcttaccttctccctggaagggttttgcaaaccactgctctaagtgatcctttacttagaaacagctactctcaggtggagaaaacctagtgcagccacaggctaaactggccacagccagcttccgagctgggaagaataggaagctcttagacggaagccatgaatccgaggcccaccttgttgaacttgatcgccatgccatcagcttcagcatataaggctatatgagtctaagttaaaatattctggagtgtgggcgatcctcagaggctgttaattgatataaagaacttcaggtaggtcctaaccccttatttgatggttgattataaatcagttattcttgccttctttcctgttggtaatattcaacaaagactattgcattttcactaaggaaaacggattttcagccagcctctctcctcccctccttaggaccaattctgattctgctcttcacacgagtgctctgagtaccaagccccaggacccctatggaggagggggccagtcggcctggcctgccccatacatgggtaagacacacaggccactgctgacagcagctgtgcttgctcattctgtcctaggaaccaagggagagagaagctgaagtggtgtttgcgcttcccggttcagtgatcttagagaggcagctcgtggcagggaagcgtgtgtgtccatgatgcagtcaggatggatggagctcccagcgtcccctgcctctgccctgcttcctccacagcacgctctccctcttggtgtctcttggccctcttctgggcacccgtcatcttctaataacttcctgactggtctcctgatttccagtctcacatcccttcaatccagttttatgttaagttccccaagagtcctctttccccacccaggatctgaacaaactgagaaatacaactagaagtgacagtcagagctagatatcacctttattactactaagaccaggttggaggaagtgactgtctctgtaggttggtgggcctgctgagactgaaccccagcatgaggctgactccccctgagtggctggcagcactggccagtgtggtcccctgggaggaggggtcaggcaagcctcggggagggagggtggagcagaggcctgctgccttgagatgggggaagaggaggtcgggctggaactgtgcatcacctgctcagttgccccctggccactgtgagtaaggggatggagagaggccaggagtaacccggagtggggaagaggcccactcatgccatctcacagctctgcttccagagcgaacccaaacctgatcatcttgctctcccacttaaaatcctcagtgccacccctcaccttcaggagaaagagcccagatcttctttggaatgacatgagccccaaggcctggctcctgtctgcctctctcccttttctctctgctcccccgcctcacacccaaggtagccatgcgaaccactttgggttctactggtgtttcttcctgttcctgtctcttcctctctctctcactcctggccagcaccctctccatccgtaagcctcagcttgtgtgtgtcctcatgtctgtggagccatccttgaccttccttcctctcagctcagagttatcgtgtccttctaacatcccagactgctctcttagcacctgcaatgcttggctgcttttttatgtgaacatgcatctctttctctgctcagtgtagatttcttgaaggcagcatcttaatggtcttgttctctccagcccctagcacagtgcccggcacagaggagcccgtactgatggagaagtgtgaagaatcacacactggctcacatgtgcacggcatttgccaaaacaccctctcggtgctggcacctgacctgtacatgaagtgaggctggtcattcagacacatttcaagcctacctttctggggtttataatctagaaagaacaatggtcttgaattatccattccatatgcagattgactcttgcccagaaactttcagggctgtgtatttgttcttgaaacaggaataaataaatctttagccaagaaaccagcttttctggttttctttgctttttggacaatttaaagcctaaatggcctctgttccttccaggagaacacttatgatcgtatttctttgtatatagcagggatagtactgaataataattgttgctatatttgttctattggtgcaattcagagaagactacatttgcttaaatgattgtttgcttgtaaactatgggagctttcagaattggttagggacatctacccatgcttccatacatgggaatatgaaagttggcagtgatgttgaaattgatgttggaattggatatgggtgcactgctcactgcttagaggagtggggtgtgtgggaagagggatgagtttagtttcaggataggtagagatgggaatatgtaaacaaagcctaaaaaaagcagaggctgtaatcagtgggggtgcctgtgagcacagcaggatcctaatctccatggaccgggagccagctagacagacagatttttaccctggagctcctgcatttctgcctctgccgatccttcatttacattaccctctgcaaagtttacacttctctagaaagggccaaaggcctagagaaacaaggcaatcacaggtaattcaagtgaggattttttgaggcttgcatgctaagaaaaagaaagtaactgaagaaagaaattacctgagctgaagtattcattcttagcgatgtagcctctgagagaagaggtgagaaatgtcagaaggggtaagtgaggatggaataagaaaagcaaaggaatgtaaacattggtccaggtagacagagcaatgagaaaaacaggaagaaagaaagaaatcctggatcagggttcctgcgttgacttgagaatcgtggtggtctctccttttcaaatcagcagttagaaattgttgggctacaatatctgacaaccatggagggtgggctggcctccaactcagatgtctgaactgtgtgcctgctcctgcagttgccttgcaagtatagcagaactcagaaacacatcctaatatggatgtgtttacatgggaaagccagtgtttaaaatattattcaagtctccaaggatggaaattatttctggagaattatatttgttggtgggagctattttaaatagtttcatgtattttcctcctgtgtttcattaaagtttttcattttctttccttttggattttaaaactatcaactggctttgcaaaaaggtatttcttataggaccaaccaaagaaagatttaaacagtgatgggaaaatataattgaagcccagaactgggttctatgttcgaagcaataataactcttctttccctgggaatctctcctaggcagaatgatgcagccacacttttttgttattgttgttgctgttgctgtgagcccatgaggagagcatctgctcacggcttaactacatgagcaataaactatgatacattcatgagtggagatttgtgtcacaagaagacaaagcctgatacatgttgagtaattttcataatagctattgagttccatgacaattaggcataaatgataagcagttggtataaatgacagaaataaatttttatggaaccaaacaggatttttataatttctctctttttgtttaattattcagaatctataaagagggaatgttggccatttccctggcagcatgtgcaccttaatgaccatttcacacttacatgcagatagggaagcacaggactctgtgggacacgtgccctgtcccatagcctaggactgtctcctaacacccctcctgacatcgggcatgtggaggagggactggggtggtctcttcctttcagggaacagtctagagctaaggggagcagagtgcgtaataggtgtcttctctgcatccagggctgtagatgctgaatattgccatctttggggaccacagtactcagctccttagcgtggagggggcttggcatgccttggacctggtgacctttcacctgccaataagctttgacctgcagagttaaggagaaggtttacaatgcaaagaaccttgaaagatgtaagcctgttaattgcatggattgggcgggggtacagtggcaggtacaagcatcccagatctgaagaggggcaaaaagagtgtcacccagggacaggagggcccagagtggggaggctgaaacaccagaggcctcctttaggacaatggttaaggggtcttccccttgccttcccttctacttagcaaatcaaggctgtgtagggagttattttagatttgccaggcatgggagcacacagaaggaacatggtctcggttcccttagttagaagagaccggccctcggtggctctgaggtttcctggaacacagttgcagccttggtcatcgctgtcccatccctgtgggactgataaaattagtgtcctgtttccagagagccagtcacaactcattcctttttctttttaaccctttatttgtagtgctatcttgtgggtttttaatttagcagtaaaaatccaggcttggatattttgatgatatgttagcttggtgccagtatatcagtcattgccaccaccatccttctggtcaccgcagcccagaccctgagagttgcatctgattactcccattcccatgcccctacgcccattcagtagccgagtcctgttcattttatcccagcagtatgtctcaaatctgcctctggttttctgtcctcactgccagtatcctacttggttcctgtttgccttggactattgcattggttttctagtcggcctccctgccttaaggctttctcctttcaatccacctcctactctgctgcaagagcagtctctgaagcttaactctgatcatgtcacttctccaactgaaaccttccatcccctacatcctgccaaatgaccagcagcctgcttcggtccagcccatctcccagtcctcccaccatgtgctgcagccacactcttccatcttccttctccttcttatccttccccaaccaccccccactcctcctcctcctcctcctcctcctcctccgcctccacctcctcctcctcctccgcctcctcctccgcctctgcctcctcctcacactgggcatccccttcagcttcgcttccggttgtctaaatcttccaggtactacagcaaattggttagggacatgaacattctgaagacacacgggccagagttctagtcccagaacttactagcagtgtgatcttggggatgataatagcatctacgtcgcagagttgctgtggggatcccatgagatcacctgtgtaaagcgcctggcacatagtaagtgagcagtcaggttggctgttggttatcctcttcttcaccattatccttcaatgaatggcgcctcaggtgccacctactccatgaagccttccttctgttccagtctgaggagagcatgcactaatggggctgtcacatggggtatctgccagccactcaggcagtttcacatggtagccctcagttgagtcctcatgtttcagggacaggtcaggcttaataattaaacctcgagtgactggtgtcttgatgatgaagagatgcttcagcacgccataccagattgctatataaaacctagtttttagtttttaacaggatagtcactttttagtaatcagaatgaagttccctgccctttcttaatatgagggtctcaggaaagccaaaataggaatccgcaactcctgtccttttgacgttgctggttgtagagccacagcttccacagcttttctctctctgcacctcagtgttcacctgttcacactgcctgtcttttgatgggttaaatggctgataagtaagaatgggccaaggaccttctgcaatagagtctcctgagacgacaattaaaaatgtaggctgggcgtggtggctcacacctgtaatcccagcactttgggaggctgaggcagacagattacctgaggtcaggaggttaagaccagcctggccatcatggtgaaaccccgtctctaccaaaaaatagaaaaattagccgggcctggtggcacgcgcctgtaatcccaactactggggaggctgaggcccaggaggtggaggttgcagtgagccaaggtcacgccaccgcactccagcctgggcaacaaagtgagactctgtctcgggaaaaaaaaaaaaaaaaaaaaaaaatgtagattccttggccgactctcacaccttctgaatcaaaatctttgagggttgggcccaagaatctgcattttagcaggctcacccaagggctctttatgtgctgtaaaataaagctttcagtcacttacttagagtctggttctgtgggcctgaaagaaattctgtctttgtgtgtctgcttcatttatcgacctcttcgtattcctgggcactcttcctgttgcccctgggctctgttaaaatgttatatcttctacctgtgttatagaatgtgctaccgtgttaccctgatctgtcttctcacctacactgtatcacccggccccacctagcacttaatgcagaaacttattaaatatgggttgagtgaatggttattagacatttcattcaaattgtatagactaatcaggttaacctataggttaaccttagccaaaaactcatctaaaatgtaagtaagctatacttaaaggcttagaactttataataatgtatcctgattctgtactgaaaacttatttggtatatttgattgctcttaagggaatgctaagatattacattcttggcacggttctttagttttagcttagagcaataggaaatactatgctttgtcatctgcagtataatttatggattaaaaatacttcattcagccagaatttattccaagtcaaagttttaaaactttgtgaatagctatctcatgtaccctttaaattaacttagactccagataaatcttcttcttaaaataacttcactgcataagaaatatatataatatcctacagcatgaaacttcggatttgttcctgtagacacccatggtaagtatcaaacagtgatgtaggctttttgagttacctgctcttaaccccatgatgaagcatttggaagagaatttccatctatacttctttactttgtggtttgaatagagattctcaggctttgtaaaaattgttctcctctcaggacagtgacagtaagaaaatttcagacagacaattttaaaggaaaagaaaaaggaaccaaatttagtttcaaattagctatacctatttttagtataaatgataaagcaccttaaatgaaaatcagtgtatcaaaagtgccttagaattttcaaaattctatttcaaatcataaagagttactgattcataaattcatgaaaatgaaagtaccacataaaagtgttttctttttttctttttcctttcccgctaggtttctgtgatggtgagaataatggacatggggaaggtatgaactgattttacctacctatattggagtgggatgctgattagtggacataacctttcaatacctttactaataaatattcatgttttcaggactcccccaaatgctgacaactgctgattggcttacttttcagagagcctctagaaaattaaggctagccatgttcagggccaggagaaaggaaatatgtggttgcattacaaaggttcctttttatctaggtccccacagtcacaaggttgagcaaggaaccaaaaattgtaatcacatgaaaatatgaatgaattggcctggcacagtggctcatgcctgtaatcccagcactttgggaggctgaggtaggtggatcacttgaagtcaggagttcgagaccagcctgaccaacatggtgaaaccccgtctctactaaaaatacaaaaattagccgggcgtggtggcacgtgcctgtggtcccagatactcaggaggctgaggcaggagaatcgcttgaacacgggaggcggaggttacagtgagttgagattgtgccactgcactccagtctggcgaccgagcgagactccgtctaaaaataaataaataaataaataaataaattaattaattgatcacttaaacaattagttattccagtagtctacccatttagaacgtcttcgttgacagataacaatgccaggaaaatgcaaattggttatgaaatgaaaatgcaaaccttacataagatactgagtttcgtaaagccaattaaaacattgttggagatctatggaaatgacactcaaagccattgacaaatgagggtcagacacagttcatttatttactcagtaccagggactgttttcttttctctaaatctttataatctggaatttaatttttataatctaaaaataaacaactaaattaggtttatatgtcacagaggtgagaccctaggggggacatgatgaatgaggagcatcttgcaagacgcacagctctctgtcatcatcctgcagctccttttctgggcaagcccttttaggccatgaataaaatcacaaaaaggtaaaacatcaataaacatctaatccactagaacagaaattaataaatggcttcaaggttgactgcattccttcagtgcttcgaagaattcccaacaaatcttggatatgaaaagggactaaaaacaatgaactctaagaaaacagtccccattaaggcactggagtctgccccaaccatgttcttataaccaacctcttgtgagaagtagccttgagctgtgtgtgatgacaccttactcagtccttcaaacttttcccagcatttgacagtacctttcagggcaatttttatttatttttatttatttttatttttattttttttttggagacggagtctcgctctgtcgccaggctggagtgcagtggtgtgacctcggctcactgcaaacctccgcctcctgggttcaagcgattctcctgcctcagcctcccgagtagctgggactacaggcacccaccaccacacccagctaatttttttttttgtatttttagtagagatggaattttgccgcattgtccaggctggtctcaatgattatcattatattaatgattaagtcaggtaacatttgaagaaaagagaatcaacaaggatgttgacaaaatacgctcttcaaaagagagtgatgtaaatatcaggattaagagagacacctgggaacactgacaaagcatggcctggtttagcagaaatgactgctgccctggtggtactggacaggttgcctgaagagcattgtatcctccccttaccgtgctgtcaaataagttagaccgctacccatacttaattcattctagaagtccacaactgcatttatatcatcagttttattaaatacaagataaacttattttagagtttttgtttcaaagtcttttctcaaaatttactaggaaagtttgggccctgtgtcatgtgacttctttctggggtccattattcttgggtacccggccatcttgtgtggggctaagacaggatagtcatgacagtcacactggagcttctgtggccactggaactcaacagcattcctggttctgagtagtcactggtgtccctaacttggaatccccttcctgacatcagatcacttaactcctgagggctggcccttgttttctggtctctttctgagaataaaaagtatttacttgttctgtgacccagcattcttgttttacctggcacgactgagagagttaaagcagaaagccctggaatggtccctttatacaggttgtttcatagcattaaagagccaacagccgtcccggcagctgcccagcctcagatcctcttggttgttggttcctctttgtcccccatttccatcccacaaccaaggagcttcactgccaccatgtcttccagctaatactcctcttctcaatactttccccatttcatcgttgttgcaggttctctcctcatccctcttcttccattctctcctttgccaagcctgcagagcccccctgccctggcctcaattgtctacattttacttcctaccatccccttgactcagcctacactccagttgaaaagagttgctccactcttaccttcccctctcttggaattcccttctcctgtgtctctaaagggctccccccagtgcccagctccaaagccctcctggcctcttcctcttctgcacttcatctctcagcagcatcataccctcggctctctcgggcttccactcgttttttccttcagtgatcgttatttatgtgttgcccttatccactgactagattacacattcgtgaaaggttgaatccatgtcttactcatttctgcaactcccacagtagtgcccaaagtggcttccctagtagacagtccataaatgagtcatttttgtgtgttaaataagtcaaacattttatttgttaaatcagtttttacaaagataatttgttcagccaaaggtaggtaggatggatgctttctctttttgttgttgtctttgtttttttgggacagggtcttgttctgttgcccagcctggagtgcagtggcaccgtcatgactcagtgcagcctcagcctctcaggctcaaggagacctcccacctcagcctcccaagtagttgggactacaggtgtgagccgccacacccagctaatttttaaattttttgtagagacgggggtctcactatgttgcccaggcttgtctcaaactcctgggctcaagcgatcctcctgcctcagccccataaagtgctaggattataggcgtgagccaccgtgcccggcctggattcctgccttctcatgcaatgactgtgctgctttttttttccctttagtagcatctttccctggcccattgaaagaagagaatctgttaaatgttccgaagccactgccaaaacaactgtgggagaccaaggaggtgggtgaacagtactcagctatgtttgttgtcactgaatgtttgtacttagaggtcattgaaaaatcctgcagaggtgaaagcaagaggaactgggggaaaaggagaagatttgtctgagaacagagataagaatatacaagggaaggacgtttcaagtaaaaattatcgcgcttgtgtcaatgaattagcacattgatctcttggcttactaattttcatatgaattgacttatttaaaaaaaaaaaaaaaaccctgctaagtcctccatatcttatttgttttgctaaaagctctgaaacctggttgtaagtcataggcagatttttctgtttttttagccagcactttataccagtctccagcttctgtccagaattactggtataccagatagctctttttaactcaagggcatttgacctgagtcctccaagagtcagtagacaagtcatctgttttactatgatttccatgcgcctttgagaatttgtatctaaaattgtgctagctgacctccacctcggctctctaaacctcacccactgtggaagaaaggggaggtcccacggtacttgccttggcctttcttcccagagggaagctgtgttgactttgaaagaaaacagttaatctgttccagcccttaaggatgctctattgcaattgtttgtattgcctgtgtacttaactatccccacctgtttaggatccctttggcccagttccattttcttctgccaagtctaccagagtcaccattagcattagttgtcttaaaaggctttttgtaaaagcaagatgtatttgatgtttaatcatttgggaagtaaaaaagagatatgatttaaaatttacatatttaaacacaggagaagcaaccacactgtcttttggctgtgagaggcacatgtggttgtggaggcttttatcagaggataactatgtcttctccaccaaagagggcagtggtgtgccctcctccctgagtaccagggactggtctctggaaagagatgttcatctcccttggttcttgtggatttgtaatactcattcctgtccgtctggagcttatattctagttgaaatagcttagtttcttctgacattcatttcttttttcaccctgcttttttcttttatttatttcatttcctctcaagccaattggaaaagaaatgtttatttaaaagctctatgtcgtccagacccagtggctcatgcctgtaatcccagcactttgggaggccgaggcgggtggatcacctgaggtcgggagtttgagaccagcctggccaacatggtgaaaccccgtctctactaaaaatacaaaaattagccgagtgtggtggtgcatgcctgtgatcccagctactcgggaggctgaggcaggagaatcgcttgaacccaggaagcggaggttgctgtgagctgagatgtgccactgccactccagcctggatgacaagagtgaaactccgtaaaaagctctatgtgtaaaacattggtcttttaatgttaatccagaaggtaaattgataaggcatcaaattaggaaaatgtattaatattatgcctcccttaggcctggaagtttgagtttaaaaaagtcatgccaaaacctaaaaggctgctgtgtgaggactctgtcgacacgcaagctctcacttgcgcccactagagcctcaaggtccttacgaagacacttttcaaaaacttgaatttggctttacagcgagtaagcccagctttcattgtctcttctcagattcagtccctgtcaggacgccctcgatcctgtgatgttggaggtggcaagtaagtaatattctttctgttcgtgtttcagggactatcctgaaggtttttcccaaaagtctcgctgctttgttacagaactctcagaaacgtaacttgctatgcataaattgaaagtcaactgcattttcataaaaacagccactctcttttgatactcatatttcatctgtttaaactaattaaattacatgactataataacaaacaaaacttacataagtatgtttgagaatcacacaactgactcttggtaaatacacaactctccgggtagaagcagtgtcagaagcagaaacgtgcaggaatcgagaggagcctaccagccccgagctgtggcaggctgtgggcatcggtgacatcctggccaggggaaaagggaagcatcagttcacctggcagcttaatggcacagaagttaattaagagagtttctgtgaatgtacttaatgtcactgaactgtacacacagaaatggttaaaatggtaaattttatggtatatttattttacaacaatttaaaaacataaatggaagataaatatattttccatttgcaatacaaaaaagtttctatgaaaccattaatttgttagtggatttaatagtatgcaacttcactccctaaaaggtttgagacaacttacaaaaatatagtacaagcaaatgaaaaaggaagttcatgaggaagttgagtctaagagagaacgaggagatgagagagataatgaggcccttgccttaacagaaactgccttgggagggccggctggtgtgctgcgtgggacggtacagacagctgctggggaggttcacagagaggaccccttggaactcgatgggctgtgtcctgagagagccccaaggaggcttcctggggctgtttatcatagtgtccgtgagagcagtcccaccacttggaactgaagccaattcagaaacagcaaggctgcagggccaaaataatgtggtttggaaatgggattcttgcatgatctgacttagtacatacaatcaccagtgggtcagtgggtgaactaaatccacttcaagcagtcattgaatgtgatttcccccaacagagcttcctgtgagtatctcacagcagcgcagtcaaggcactctctactgagtacctggagctcagacattctttctggcaggttaaacgtaaactcaggtgatttgctgagctgcgccacgggttgatgtttgcttcagaaagtgggcaagcctgccaggacgcatgcccaacaaaagacaggccgccgagaggtgcaggacattcccatggaaggggcaagcttttcctcaagggagtctccctcaacctagtctggttcaggggcttcctggtaaaatggaaatttggaaacaaaaacaaaaacaaaaacaaacattttcctcaagaatcaattttggcttaaccatcagataaccttcaggctctgaaagcctaacattatagaattgggctgcagtactttagccctcaagaggtttttgttgttgttgtttagttagtttgtttgtatttatttatttatttgagatggagtatcgctctgtcgctcaggctggagtgcagtggcatgctcttggctcacagcaacctctgcctcccaggttcaagcgattctcctacctcagcctcccaagtagctggaattacagacgtgcaccaccatacctggctaatttttttatttatagaaaagatagggtttcaccatattggccaggctggtcttgaactcctgacctcaggtgatccacccactttggcctcccaaagtgctaggattacaggcatgagccaccatgcccagcctgttttgtttttaaagatagatagggccttgctatgttggccaggttggtcttgaactcctagtctcaagtgatcctcccaaagcactgggattacaggtgtgagccaccatgcctggccaacctggagagttttaaagcaggtgtttcttaggtagagaaagttgctttcttgctcttactttacagatagaattccattcagtgacttctagtcatgcagatatttattgaccccctaattcttggcactgggttaaacaatgaacaaaacagatcaagttcctgctttcgaggagctaataatctagtagagcaagatgggcagaaacaaataagcaaagcacagcaaaagtcatgtgtgggtaaatgcactgaaggagacgcaactgtggcaggtggacaggcagccaccagcgggcgttgaggaaacctttctgatagtgtgaagcgacgcagagagggctccaggcagcaggaacagcaagtgcaaagaccccaaggcaggagtgggcctggagttcaaggaggcttgtattgcttggatctgacgcagagaagatgggagtcgttagagggtcttgaaccggggggcgcattactttccttagatcagtggtgactccgttaggtagtaactatatttggaaaggaaccacctgtatttctcccagctgcagaggaattgtgtgaacgttactaatgacctgtttcacagtggtcacattttttccatccttgctctgtgctgttggacgcttctccctgccgcgcccctgctctctctgccttcactcccacctgatcacccatggatctttcttctcagtcagaaagcccatctgctgtcacgttgagggctctgaggtctcaattttatttttctagtccttgatctttaaccctataaacagttccatacttccagccatctaagacaaaattcaggctgggcgcagtggctcatgcctgtaatcgcagcactttgggaggctgaggcaggccgatcacttgaggtcaggagttcaagaccagcctggccaacatggcgaaaccctgtctctactaaaaatacaaaaatttgctgggtatggtagtacatgcctgtaatcccagctactcgggaggctgaggcaggagaattgtttgaacccgggaggcagaggttgcagtgagccaagatcgcaccactgcactccagcctgggcgacagagcaagactctgtctcaaaaaaacacaaaataaaataaaaagacaaaatttatattcagtttttctacaaccaaaatgagccttcttcctcaccctccggttggacacctctcctgctgcctcatttctttccaaaactccacagttcgcccagtcctacttttaccaagaaaagtgaggcgaggctggcaggagtgagtgctcagctctcttctgccactgattcccccgtcaccacccttctctggtcctagggacaccgaggtccctcctagtcaggccggccactttaccactccctggccctcctcccgctggatttgtggaggcctttctctgctagttaactgtccctcatctccagaattctccgccatgctttctgaaagcatatttactctcaggtgttccttcctgcttacccatcatcagcccaccatgccctggctgccacctctgctgttcagtggaaccttgagaatgtcggttgcctcctgtacgtaactgagagagaaatatccctgctgcatgtcttcctagtgagcagaaactcaaagccaaaatagaattcgtgatctcatccatacccctgccctcattcccaatctgctcacatcttcagtgtcccctgtctcagtgaggggctccaccagtccccaggctaaaggccccagagttgttcttgagtcctacttccctgtctctagagtctagcctgcctctccctccctgcgctcgtggcctcctgctggagcgttcagcagagtcatagcggcctctccacctccaggcctgctccgtgcaccccaagaccccttccccaagtctgttagccacgctgtcctaagaaaagctgatacctctcccccaccacactgcccaccccgcgtccagccttccactggcgtcgtgtcagcctctcatcagtcccagcctcgggtgctctctacctgcttttccacttccatctcccaccactaaccagccctcctaaactcaacctcccgtggtctgaatcctcacagttctgagggcacaccatgtggtctcacacctccctgcttttgcgcatgctgtgagctttgcctgaaatctttttcctgactagatcacctgagttctttagcctttaaactaagctcagatgtcctccaaggaagcctccccaggtcagctgggcttccctccacatggcctccctccaggctctatcactgcactactgaattgtattatgttgccggttatgctccttatggctcagtctcttgaagccctgatgccagtggctggcccctgggaggtgctctgctgatgtgtgcaggagggaatgaagtgtcctcaggattcgtgacttccctctgctcctggctggtggcaccttctcccgcattctcctccgcgtcaccctcactgctcttttcctatatcacccctggaccactgcaggtggtccttctaattggttctccctgcctctccttctgcctgctgaggccatcctccacactggaaccacagtgacatttctgaaacgccattctccagcttaacctggcctccctctttccacagtccctgatccagactcctgagaacagcacattctctcccgcctgcctctccctccccatgtgccaccctccctcctcaccctctgccctgacacctgacacctcagccatgcccagctactcttaattccacgcacacactgtgtcacatccatggcaaacccgtcccctccacagcccatcctgacatggacaactcctgcttttttgctcccggtgtcacttatatgcactggttacacacaccccttctcaaacccagcatagcgcgcttcctgccacgttgcagttacttgctttcccaggctgtctctcctgcccatctgtgaattccaaaacaaggtcctctcagacctggctagcaggcccctccctggggccccgcccttgagagggcttcattcccaaagggaacgtaccaccagtgtatacgcactaggcctggggggtggctagagagtcagcagggtgtggacagagtttggctgcataggctgggatagctatgtgcgtactgcagtacagaacagaactagggggaagagaaggggacgtggactgagggccaggctgtctccctgtgcattctggcacagaactccaagaagtctgagaattctacatgtaaatctggcttcacaggctattatgaaggtataatatgtcaggatagacacatagaacaaagttcatgtaagggtttgttcatttgatttataacttttaaaaatggaaacagatggtatgcgggccttcttttatactcttgctccaggcctgtacatttcaggagtaggcctgaccccggcggacacactcgccctgcttgttcatcatggtgccgccaacatgcggcccgctgcctggcacacagtgcctagcccatagattgtgatgaatgaatggcaacatctctttgtcactttaaagtttatgaagactgtaattttaaaaatatatcttggaaggtatattggaaggtagctagttactcagagatactttttctggtagcaaagataacttaaaaatctagcaaaaagaactacataaatagcagtgcctcacattttatagagtggtttataattttcagaatacttttgcatccataatctaatctggtcttgattattctagaccctaatctagtattcctgtaatgtgggcacaggtagtgggtgaggatatgtgtttcggagaggttaagccgagcaccagtgttctcagaatcagagaggccgcaccaggacctcggtcttttgtagccactgctcttatttgacaaggaaaaggtttcagccatgtttggtttcccaacagccaaatacattgtagaaagtcattcttaatctttcttttttcagtgcttttccacataatggtcaaaacctaggcctctcacccttcttggggaccttgaacactggagggtcattgccagatctaaccaacctccactactcgacacccctgccagcctccctggacaccaccgaccaccactttggcagtatgagtgtggggaatagtgtgaacaacatcccagctgctatgacccacctgggtataagaagctcctctggtgagtatctcctgcttagcagtgacctggtggcttaatcataggtggtccccacccatgtggcctgttcagtgaatcattgaatgagaatgactgcatcccagttagagatgataatgtaccttcttgtatctcctgaccctgcggacatttttcttggatgtttctgtttctcctgggttgatgaatttggggcagctctgctgaacctcattccttatcatcctcactcgctgctctatccagggacttggggaataagatatgggagccaagaaataagcatccactccgtgttggctgaacagtattagtggctgtcatcaacatatgataatttataatttaggccatctctctggattcctttcattttccattagatttctaaaggcaatattctgcattttagaaaatttacagtggatatgatgaaaatatttatacttaatatctgtgtgtgaagtagaaatcccccacagttccagttaaagatgtagcattagctatataaagatgctacccataatgggacttgggtgttactctctgggtttgattgtccacagctcagaccccatattgaaattatgactacatttgtttgaagcctgacacttttttttttttttttttgagatggggtcttactctgtcacctaggctagagtgcagtggcacgatctcagctcgctgcaacctctgcttcccaggttcaagcaattcttctgcctcagcctccagggtagctgggattacaggcatgtgccacgatgccgagctaatcgtttttgtatttttagtagagacagggtttcaccatgttggccaggctggtctcgaactcctgacctcaagtgatccacccgccttggcctcccaaagtgctgggattacaggcgtgagccaccactgacatacccttgtcaatgtctagggcaggtgataatcctcttactcccagtggtgcagtacagcccctggccgtaacagtcctacccagaattgtgttgtggagcatttcatttggaagggatgctcagtgatggtctccaggtgaaagcagtgtttgctgcctttcactctgagactcatccatgcaaatcagaactcaccacccaaatgagagtggtccccttcagggggggtcacctggaagtttttctaatgattgcagtgatgctgcctggtgcaacacaatcttaggtttgaagaattgatttcagagaacacctttatttttgttttttgggtcattttagtatccttaatagtagcaggtttttcatcgactgagtctcagttttgatatttatacatttgcttcataggagaaatttgatatttgcttcacaggagaaactctcgaaacctttatgcccagattcagagtctgggcaattcaccttttgggtgaatcctcaatgtatgaagatatctagggtcccagaagtaaagcagcatcagcacatagctcctttgggtctcagggaagctggcattttccagtacagcctttgacactttgcttcaagctgaagatcttatgtttagtcactggttgtcttctcaaaaaagcactattttatccagaacatgtcagaaccaatgtcagtttctgtattttcttttttttttttctttttgagacagactcttgctgtgtcgcccaggctggagtgcagtggcgccatctcggctcactgcaagctctgcctcctaggttcacgccattctcctgcctcagcctccccagtagctgggactacaggcacctgccaccacgcccggctaatttttttagtagagacggggtttcaccttgttagccaggatggtcttgatctcctgacctcatgatccacccgcctcggcctcccaaagtgccgggattacaggcgtgagccacgcccagccggcaaaattatttttaagaattttaggctgggtgcggtggctcactcctgtaatcccggcactttgggaggccgaggcgagtggatcacgaggtcaggagatcgagaccatcctggctaacacggtgaaaccccatctctactaaaattacaaaaaattaaccaggcgtggcggcacatgcctgtagtcccagctacttgggaggctgaggcaggagaatggcgtgaacccgggagacggagcttgcagtgagctgagatcatgtcactgcactccagcctgggtgacagagcgagactctgtctcaaaaaaaataataataataatagtgataataataattttgccagctgctggatttttgtcatttcttccttttcgtaacttttatcaaacacttaaattttttgtcaacacgaaacaacacatagttctgcttaccccacctgctggtacaagaaagatgggctgaaggttaaaacgtaggtattgccagttgagatacacacagcagcagcagccgaataattgattcactgggcgaacctgctccatgccaggccctgtgccaggtgctgaggatccagcagggcataggacaggatccccagtttctgggagctcatgccctagcagcctatgctgcaaagatctctctcccaaatttccttgctcatgatcaaattcacccctgtcccccaaataaagcaccagcaaaaacttccttttccctgagttggtatagactgtgatgaacaatttcctgggaaccagaaaatcaaagagggaccctggggtgggagatacagggaagtgtcccttcctgtgactccctagtgtgctaagggtaattaaagaccaccaagacagctccccaagggccatgactcgccgtggaaggatgttctccaaaggtagcaggggatgcaggcagtgtgcttgggacagagaccttccggggctctaaacagaatttgttgtacagccctagggtcctttccctgggtctgggccgagcacctggaatatttgcctctgttaccccggtttacctagttttgctcacctaggggttgttgacgtgatctccctcctcatgggaaaacatcgttgtcatctttgtggccccatctctgttagtgcaggggcatcttttccttgccattggtgcatcggatgcagtccctgtaggagagctgtccaggagctcctttacctacagaatcatcatcgcatgtgacagtagacagttttctttcatttttggaatacaaaagatttggtctgaaattataagtaacttgtgaatttgttgtcttccaggtctccagagttctcggagtaacccctccatccaagccacgctcaataagactgtgctttcctcttccttaaataaccacccacagacatctgttcccaacgcatctgctcttcacccttcgctccgtctgttttcccttagcaacccatctctttccaccacaaacctgagcggcccgtctcggcgtcggcagcctcccgtcagccctctcacgctttctcctggccctgaagcacatcaaggtttcagcagacagctgtcttcaaccagcccactggccccatatcctacctcccaggtaaacacacacagacagaccaaccactacagtgaaacagactgcaagatataggaagtgcattcctcctctttactattttgggttacactcattattacaccaagcacccatgaggtctcaagtgcagtctgttcgctcttatatgtgaaatcagagcagaagtgtcaataatgcagaatgaattcatgattttcttttctttttttgagaaagggtctcactctgttgcccaggctggagtgcagtggcacaatcgcggctcactgcagcctcacctcccgggctcaagcgatcttctcaccttagtcttcggagtagctgggaccacaggcatgcaccaccatacctgactaattttttgatttttttgtagagacaagttctcgatatgttgcccaagctggtctcaaatgcctggactcaagccatcctcccagcgtggcctcccaaagtgctgggattacaggcatgagccactgcacccagcctaattaatgattttttattataataatagcagatttgctgtgttgattactctttaagcaaatgttgaacaatctgtagtcactaactcacaaacttggggttgagaggaacggtaggatatagagaatgccatccaggtaagtctaaggcaactgagggaaaccaggttaggatttcaaagttggcatggaaaatcagtcattgactctctaagtacattaagccataggggaaagccaaagaaaacatttaataccttcctgaagctttgataatgaattagacctcttccctaattgtctacagatttgagaaacaatacttttattgttcatgaaatgctaagtatgttgaggattatatctcttataaggatgaaaagaagtctgttgagaaagaggcacatttaaaagtcacccacccatacaaaaaatggaaaaattagctgggtgtggtggcacacgcctgtagtcccagctactccagagcggaggtgggaggctcacttgagcccaggaggtcgaggctgcagtgagccaagatagcctcactgcactgtagcctggcaacagagtgagaccctgtctcaaaagaaaagaaaagcccattatagaaacacaggggttgaaacatcctataaattctaaactcagaggtggttctccttataccataatcatcgaggaatgtgttttcaaccttttgtcacatcctctgtctattacagcatcattttttttttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgtgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctattacagcatcattaactactcaccacctcgccataaattaatgatttagaaggaagagttgacagaacacaacggagagttagaggatcttgttattggtcactctttaccaattactagccgtggcgtgttgatcgtatgagtgatctcttttgggcgagggtgagaggacatttcataatttttaagtctcactctgtcgcccaagctggagcacaatggcacgatcgcggctcccttgccttgaattcctgggcccaagtgatcctcctgcctcagctgggattcttcaagtaaatgtgactacaggcccatgtcaccacacccagctaatttttttaatttttttgtagaaacagggtctccctgggctgggtgtgtgcctcacacctgtaatccagcactttgggagtccaaggcagacggatcacttgagggtaggagtttgagtccagcctggttaacatgacgaaaccccatctctactaaaaatacaaaaattaaccgggcatggtggcacacgcctgtaatcccacctactcaggatgctgcgacgtgagaattgcttgcaccctggaggtggaagtttgcagtgagccaggattgcaccactgcactccagcctgggtgacagagttactctgtctcaaaaaaaaaaaaaaattagaattaaaaaaagaaaagaaagaaatagggtctccctatgttttccaggctggtcttaaactcctgagctcaagtgatcctcgcacctcagcctcccaaagggctggaattagccagtgtgccttgtgccaggcatgagccactgtgccctgccataatttttatttttttttagagacagcgtttcactctgtcacccaggctcgagtgcagtggcgcgatcacagctcactgcagccttgaactccctgagctcaggtgatcctcccaccttaacctcccaagcacataggactacaggtgtataccatcacacccgactaatttttgtatttttttttttttgtagagatggggtttcaccatattgcccaggctagtccataattattgttttcgtggttcttatgttattgaattacctttaattttattttgcaagattattttataagatctaaaagtattcttgctttttagctacattttaaggagactgtatggccagagtgtcccctttcagatgtgtttttaatttgtttaatatttagattttttttaaatgaatgttgctggacacagttgttctgactgtaatcccagctactcaggaggcagagactggaggattgcttaaggcccggagttcaagaccagccttggcaacatagtgacaccctatctatctcttaaaaaaaggaaattttaaaaagtgaatgttattcatgcacatagtttaaaaagtaaaatagttctaaagggcttgttatagaaaaacagctgtctttccctctcgttaggcatattcctcactgcctagagatggctgtcaaccattttaactaatctctttggtataaccatgttattattattttgagacagagtcttgctctgtcacccaggctggggtgtagtggtgcgatctcaactcactgaaacctccacctcccaggttcaagcgattttcctgcctcagcttcctaagtagctgggactacaggcatgtgccacgacgcctggctactttttgtatttttagtagatacagggttttaccatgttagccaggctggtttcgaactcctgacctcaggcagtctgcccgcctcggcgtcccaaagtgctggattacaggcatgagccacctcacccagcctaaccatgttgttttatgctttttttgttctacatttttggtgttaggcattatctaatgacatcctaccaatgaagattagaatttaattctctttccactctcccacagactccaccacacacatatgtgcgcacatgtgcacacacaatttcctacccaccctcctcatttattataattttggttagagcaatactcaatatttagtgtttttatagttacaatgtagtcagagttgacatatagtatactatgaaacaagaaaatgagaattttttttcctcttgggagttaataaatgtctgactttttttattagcctggttatctatatgtatctatgtgtatgactaattcagtccccaactcttggagttgggcagatctcctctcgacacattcaaaactaaattctctagtagctctatagcaaagagtgcctgtgactttgtatgacttaaaatgtctttatttgatctgccatttaattattatttggctgaatatagaattctaaatttgaaataattttcccttggcatctattgcctattcatttgtaagttgcattgagaaatccagtgccattcggactcttaacactttgcatggaatccccctgctccaccccaggcttgtgagatctttttgtccccagtgttctgaaacttcaagatgatgtggcttggcgtgagtctgcatatttggtgggttccttcaatctggaaactcacagccttcatttctgggaaatgttctttatttcttcaatgatttcttcccttcagttttctctgttctttctctctggaactctacgaatgttgactatcctggacttttcctctattatccttatcttctctctctcctcttttgcttctctgtggttgcttccttgtttgtttgttttgctttgctttctggaagattgtctcagctttatcttccaacacttctgttgagttttccatttctgctctcatttttaaattgctatgagttcttttttgttctctgagtgttcttttttaatagcatcatacttattccacagatgcaatatcatcttttatctctcaggtttttagtggtctttttttttcgaatttatctttattttctataatagaattttcctaaattgcataaaagtagagaacataatacaataagtcctcctatacccatcatttaccctcaacaattaattttttttttttgagacagggtcttgctctgttgcccaggctggagtgcagtggtgtgatctcggctcattgtaacctccgccatccaggttcaaaccattctcctggcctcagcctcccgaatagctgggactacaggtgcacaccaccacacctggctaatttttgtaatttttagtagagacgggatttcaccatgttggccaggctggtttcaaactcctgacctcaggtgatccacccacctcagcctcccaaagtctgagattacaggcgtgagccagcacgccagccttgttatcttgtttcatccataccctgcttttaaaaattgcagatattttaatatgtatctctaatagataaggattttcttagtagcctaaatattgtcatgctgattttggtttttcacaactacttcttcctgcacacatctttccaagattgtgtgtgtctgctctggcctctgactttcacggcagatggtttcctcagggcctggtgatcctcagtgctctgctcatgtttaagaacaggacactgaggggctgtctccttgcggctctacactagagcggagtatgagactgaggcgaagggagtcatggcaggacaagcgtgtagaaagttttttccactctctgactgagtattggttggaaggagcgctgctaaaactgtaaccaaaggaggcattttgcttccagaaaaatctcaaggaaaagtattgcaagcaacagtagtcactgttggatcgggttctaaaggtaaggctggagagattcaaccagttagcgtgaaagttggagataaagttcttctcccagaatatggaggcaccaaagtagttctagatgacaaggattatttcctatttagagatggtgacattcttggaaagtacatagactgaaataagtcactactgaaatggcatcagtgtgaagctgcccattccactgaagttctgaaatctttcatcatgtaaataatttccatatttcttataataaactaatgataactaatgacatccagtgtctccaaaattgtttccttgtactgatataaacatttccaaataaaaatatgtaaatgagaaaaaaaaaaggacactgagaagctggctggcagctctgtgtatgtgggcaggcctgctgagtgtggtcttcattgtagaatgatctagcttggtcatttccttgggaaactcctggtgtcataagttttacattcttctctggccaggcgtggtggctcacacctgtaatctcagcactttgggaggccgaggcgggtggatcacctgaggtcaggagttcgagaccagcctggccaacatggtgaaaccccgtctctactaaaaatacaaaaattagccaggcgtgttagcatgctcctgtaatctcagctactcgggagactgaggcaggagaattgcttgaacccaggaggtggaggttgcagtgagccaaggtcatgccactgcactccagcttgggtgacagagcaagactctgtctccagaaaaactctgtctccagaaaaaaagattttctctcttcaggccttgtcaggttccctaaaggacactcttccaatgtcgcacctcggcatatcaggattccggcatcctgtgagccgggttgggaaagaaaggtggagatcttaagattcgatcgtgaaatttcttctaaagaataaaatacctaggaatccaacttataagggatgtgaaggacctcttcaaggagaactacaaaccactgctcaatgaaataaaagaggatacaaacaaatggaagaacattccatgctcatgggtaggaagaatcaatattgtgaaaatggccatactgcccaaggtaatttatagattcaatgccatccccatcaagctaccaatgactttcttcacagaattggaaaaaactactttaaagttcatatggaaccgaaaaagagcccacattgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagatataatgccacatatctacaaccatctgatctttgacaaacctgacaaaaacaagaaatggggaaaggattccctatttaataaatggtgctgggaaaactggctagccatacgtagaaagctgaaactggatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattaacaaatgggatctaattaaactaaagagcttctgcacagcaaaagaaactaccatcagagtgaacaggcaaactacagaatgggagaaaatttttgcaatctactcatctgacaaagggctaatatccagaatctacaaagaactcaaatttacaagaaaaaaacaaacaaccccatcaaaaagtgggcgaaggatatgaacagacactcttcaaaagaagacatttatgcagctaaaagacacatgaaaaaatgctcatcatcactggccatcagagaaatgcaaatcaaaaccacaatgaggtaccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattccttagggatcttgaactagaaataccatttgacccagccatcccattactgggtatatacccaaaggattataaatcatgctgctataaaaacacatgcacacatatgtttattgcagcactattcacaatagcaaagacttggaaccaagccagatgtccaacaacgatagactggattaagaaaatgtggcacatatacaccatggaatactatgcagccataaaaaatgatgagttcatgtcctttgtagggacatggatgaagctggaaaccatcattctcagcaaactgtcgcaaggacaaaaaaccaaacaccacatattctcactcataggtgggaattgaacaatgagaacacatggacacaggaaggggaacatcacacaccggggcctgttgtgggatgcggggaagggggagggatagcattgggagatatacctaacgtaaatgacgagttaatgggtgtagcacaccaacatggcacgtgtatacatatgtaacaaacctgcatgttgtgcacatgtaccctagaacttaaaaaaataaaatattaaagaaaaagaaatttcttctaaaccctgtgttttcagtaaagtgcctcaccttctaatatccagagacccttagttttattatctcgaaagtagaaccttccagtctcctggcaggtggcaggatggtgggggccagtgcgcagaagcacactcaaggcaagggctctgcaggtccaactgccccttacacaaactgtgaccagaatctcctggttttagcttcaccgcctgctccctgctgtccccagtcccagagccctgtggggactgagtgctgtcagtgagattgcctcctggtttttcctcactgccagcctagcatcgggttttctcagctctgctaagccagctgccaccgggccatctgctgctcattttccagcttttgttgccattttcttctctcccgttatctttgtcctcgtgttgtttgttatcatttagtgttctgtgctgttgtttagtgttttttattaatgcttattgcttgttaatgttgtagtgtcttgttttaacaggatttggggatgacagagctaagggcctttttcaattttccacttttaaccagaagacacggctataaaacaaaacaaaacatgattttcacggagaaaactgaaaggaaattggttaaattggctgttttcttgtttagttcttttaagacaatagaacttgtcattgaatggaacatgctttgtggggaagtaaaatttgagatatactttgaaggatgagaaacgggcttctcacagcattgcacagaacaccgcggtgaggaaaatctcaggcttcctctcactctgacatttcctaatcctaaaggacttaacgccagaaacgcagaagctcattagtggctttgtgtgtttgttttgcagatggtgtcctcagaccgaagccaactttcctttctgcccacagaagctcaagcccaggtgtcgccgccacccccttaccctgcaccccaggagctcacccagcccctcctgcagcagccccgcgcccctgaggcccctgcccagcagccccaggcagcctcctcactgccacagtcagactttcagcttctcccggcccaggtgagttctggcaggagcgttggtgcagagggaatgcttgttttgctctgagttccaagctaaatgatcatctccttattccctgaagggctcatctttgaccaacttcttcccagatgtgggttttgaccagcagtccatgaggccaggccctgcctttcctcaacaggtgggtgatcgcccctgccttctcctcccttggtgcataaactgtaccatttaggttgttcattctgtagaattcagaactgagcagaccagacatgccactttcctggttctggttgtgttctgtggctagaagagcctttcatcttctttggccctaaaatgctttctctggctgccttatttagtatcaggcttcagcagaggaactattggaacaatcggcaggagacttttgatgacactctcgttgtagaactgtaaaatcatgaacactggaagggacacagcacctgcctcctcagcgccctcatgttgaaactgaggcatagggagagtggcgcctgctcccaccgcagagtcagaaggtggcgccgcatttggcctgcacccaggctggtgcacccagcacagcgtggggcctcctggggagagctcagtcctggggagtgaggggagtgcgttccgtaaggtattttcaactcggccactttcttttacagtttagttttttcctaacattgactatttttaatattctagattttatagtattcaatagtattcaataagtatggactgggccctccgatggattaaggagtggaagaagggttgaacaggttccagaacttttttttttttttttttttgagacagaatcttaatctgtcgcctaggctggagtgcagtggcgtgatctcggcttactgcaacctccacctcctgggttcaagtgattctcatgtctcagactcctgagtaattggggttacaggcatgtacccctacacctggctaaattttatatttttagtagagatggggtttcactttgttgaccaggctaatcttgaactccggacctcaagtgatccacccgccttggcctcccaaagtgctgggattacaggtgcgagccactgtgcccagccaagaacttaataaaatagctgggcatagtggctcacgcctgtaatcccagcagtttgggaggccgaggcgggcggatcatgaggtcaggagatcgagaccatcctggctaacacggtgaaaccttgtctctactaaaaaatacaaaaaaattagctgggcgtggtggcaggcacctgtagtcccagctactcgggaggctgaggcaggagaatggcgtgaagccgggaggcggagcttgcagtgagctgagatcgcaccactgcacttcagtctggacaacaaagcaagactctgtctcaaaataagtaaataaaataataataataaaataaattaagatagctgtttcctaagcaggccacagatgaagctttgtggcaagaaccaatcctccttgcctccctgtttcccaaagagccattttagtctaggtgggaatcaccgtctccctgaaaaatgatagacacttcttttgagactttttttaaaatggcttagaaaattaatttcaggaaaggaacctaaaattggcactggttataaccagtcctcatagaggctttctcatagggaggagcttgcctgagtttcctccttctgagtgtgaaaaggaaagccttcccctttctcagttttctagaaaccagggaagaggccaggtgcagtggctcacacccataatcccagcactttgggaggccaaggccagtggcttacttgaactcaggagtttgagaccagcctgggtaaaatacagcaagaccctgtctctaaaaaaaatacaaaaattagccaggcatggtggcatgtggtcccagctatttgggaggctaaggtggacggattgcttgagcctgggagctggaggtttcagtgagccgagatggcgccattgcactccagcctgggcaacagagaccctatctttaaaaaaaaaaagaagaaagaaaccaaggaagaagagtccatacttccttggttatagacagagcctttgaagggttcccacagaaggcagtttgcaaaggccttggtgaggctgaggacagatgtctgaggggccacagaaaccatgagcattggtgtctcttgggatggtgtagtgggctggggaaaagtcaccacgctgtggacctcagggacccctcctccaccccagcgtctgcctgcctgacaagaatattgtgcatgcattaccataagagcaaagcactctgggatcctggaaagaagggaatatggattagtttgcaagtcaggttttgctctgggagcacattgcaatactcacttcctccttggaaacagaggtgtggccttcctcacatgaccttcgatgcttccaggtgcctctggtgcaacaaggttcccgagaactgcaggactcttttcatttgagaccaagcccgtattccaactgcgggagtctcccgaacaccatcctgccaggtgagcgagctatccctcagcttctttactgcttttatgttgttgtgtgttcaggaaccttcataagagagtttaaacaacataatattatataaagcaaaaagttaacgttccctgggtcgacttgactttttgagatgcaggtgtccagcctcagagaccgtgacacagggcggtgggcctggtagtcaaagccttttctgaaagatttcatctggcccagtgcggtggctcacgcctgtaatcccagcactttgggaggccgaggtgggcggatcatcaggtcaggagatcgagaccattctggctaacacagcgaaaccccgtctctactaaaaaatacaaaaaaaattagctgggcatggcggcgggcgcctgtggtctcagctactcgggaggctgaggcagaatggcaccaacccaggaggtggagcttgcagtgagccgagattgtgccactgtactccagcctgggcaacagtctccaaaaaaaaaaaaagatttcatcttaggtgactgatgactgttcaaaaggaaaaaacctgcaaaaattgggagttgtgcaactgactgacaagaatgtagattccagggcaagaactgtgggcctgggggtggtcaggatgtgtgggatagcagtttaggggactgtcatcagctgggtttgcttagtagcctggagccttcgcgcctcctaaccgcactgttttcccctctggccactcctttcagaagactccagcaccagcctgttcaaagacctcaacagtgcgctggcaggcctgcctgaggtcagcctgaacgtggacactccatttccactggaagaggagctgcagattgaacccctgagcctggacggactcaacatgttaagtgactccagcatgggcctgctggacccctctgttgaagagacgtttcgagctgacagactgtgaacagaaggcagtggaacagaagaatgtttttctgcaacagccaaaatagaatggaatagaatgaagccagctgataccacgggctttcgttatcttgacatagaaggaagcaatgccacggctccagggtttcagatgagatcccatctcagacactgtggcttcctccagatcacacagctttgtactgcctctcccgcctgtggccaaagtcgtgttgcagcaggcaggctgcttggagcttcccatgaactggaaagctcacctccactgcatctttttactggccatccagtcagccgatgtgtaagagtaggaaatactgtgtcactggaggcctccgtagcattgtgtagtgtgctcagaaccactgatctccgtccgcaccgaaggcgggcccggagtgggaggctcggcctggggcggcggcaccggagagggcacctcgatgcctgctctgacctgacccagagggcgaggccctccagcgggggacattcccaggctgagtggaccccacggctctctcccacgcctggattacgacatgaagtttttaccacaagcccgagggcaggcttgagttaggcagactgaaggctaattttcattttctcccagctggtttctgctgcttcagaaaagtacaccttttccttatggaccagaggaagaggaagaccattttatcagtcactgaaaagagtcccctggcactgatgagcctgaagagaactgtgctcctcctcgggggctggggaaggaagacagggactgcaggtgtctcatactcagtggcctccagacaaactccagacaagcacagacctccccactaagagcagccagagggagctggtgaggccctaaccccacccaccgagcaactgagcttccccatccctccccagagctgtgtctctgtgggctgggagtctaatgtcacccccctagaccgtaagctccttgagggcagggacagtgccttatcattgttgaacccgtagcacctaacacgtgcgtggcagcacagtcgtgtgctggagtgagtgctgcagaaccgtgcgtgcagcgcatgatgaatgagtgcgtccgccatgccgtaaggcaggctcacctgtagctatccccttccctgccagatcttctcagagctttagcttttctagcactcgtgcctatggtgaagcatgcactttaatatgcttttaacactaggtgaccaaatcacagtgaagccgggcactgcattctccttgggctgtgctccacgcgggtgggtgggagctgtcttctgagtacatccggaagggctgagcaggtgagtgccctgagcatcctggctgggccccacccaggaagatcttccttctcagatccacgtttggctctaaattgcttcaagtagagattcattctttgaggttgaaaaaatagtttatagtaaaacgaaggcctaattcatggaagcatcattagtcatcaataccttctcataaaatagatgggccagatttccaccaccgcctgcctcctctaacttgggtgatgccagtaggtttgaagggggcagagcactgcagggggaggggggggtctaggctgtgagaggacagggtggagaggaggagaaccctgaaggagagacggaagatgccaggacctttgcttggacagccattgcccttccaggagaccctggagtgtactgagggttgctggactgttccacccagaggagcaaggctgtacaatgagggtctgaatctggcacacctgtcccttatgtaaaaggagtcgtggtcacaagaccctgggctggttagcctctcccgacctcattccatttctatcttctgaccttgcctctcatctttaaaataaccctcatggggtgcccctccaccttcctctggaatccaagtattcctgtttcacatttgccccaaatctttgctgtggaattgggaaatcaaaccagagtcctcctcgcctgatttccagctcaggaagggcctgctggcctgccctgttcccagttacactttcagatccctttgtgctcaagatctcagagggggtggctttttgttaaagagccttcagtcgcaatgctacccagcaccccatgtgccaaaagaaaccagctcctgtgtcaaagggcttccaaacctgatctcactctcaacaggcgatggtgctgatgtttcaagaattgtgtttttataaaacagaggtctcagcatagtcactcttcacatagtgccttacccatgggtatcgtcatatccgggtcccagttcagtttgtctgcacagcagccaccctgcctggcaacagagaccccaagacctacacagtgaaccctactgccccaaaggcgttctccaggtgacttgtgaaaacagacctccggggaagtgatttattgggggtgtacactgggggcaatatggtttagcactgaattcaatttgtccttaggtctatgagtgagtccgatcttttcttgtgaaaggttttgggcatcgtacaacccactctgcctagaaggtgtggaggactcaccacgggcagggtcgccctggcccacagcacgtgagcctgcactcactgcggcctttgtaacaaaaccagttgtggtcctcagcatttgaagcagctgcatacttcagagtaaactatttttcattatttagttttgtcacaagaaatcgaccattgtactactctcacttacagcagttaaacagcatagaactaaaaacctgtctgcatttccattttttctttctgtatggttgtgggttttaggacatagggggttaggagaaggggtttcttgatcatgtcatgaattctcctttgtcctgtttctcctgtttcatttctcctccgcctgctgtatattacctgagctggtgttgtatcttcaagtccatatgcgtatttgcagacctttcctgttcccactcttgttggctcttctgatttatgcacagatggttcccagcatgtgtccagtgcttcatggatgggaccatcccagcaactaatcagacttcctgccagtgtcctaacccccagggcaccctgttcaaccatatttaaaaattggaatttgtataaagttgcttccaagttttataatgcatcattttacatcttttgtaattaaaagcatcacaatgaggttgtctctgca

SEQ ID NO: 1643 - DNA, 115460 bp, Homo sapiens; identical to SEQ ID NO: 1642

SEQ ID NO: 1644 - DNA, 17272 bp, Homo sapiens
tacacccaagagtgtctataaacaacaacaaaaactgcaaaccaaaaactagtttacaatactgaagttataggaaacaagcacaaaaggccattgggtggggctggatggagcatgatctggtccttaaagtatgcagatcgcctgggaggcccagcctatggagattgggaggagagggagatgctggtgactggagatggtgagagcctgggctggggtagtttttagtcatgggcttatggaccctcccctcttctccagctagctcaggcctttaagaggcaggcccaagaagggaaccccaggaagccctagaagctccccagcgcctccatcccatggacccggatcccctgcaggagggggaagttgagcagtggcccaaagacacagtcgtcctcctggcttggggctggggttaccagggtccccaaggggctggcctggaaccagaggttctcataggacttggggctgggggtgaggcccgccaagaggggctgagtggagtcacagcggagatagtgccctggccctgggcttgtggggctgcccagcagctgcccataaaggacctgatcgctggtgccagactgggattggggctgggtggaaactgctcttgggtccccctggagcacataggtctggaccagagtggggaggccacaggtctctgagctgttatgggactcccagggcaccggcttcttttcatcctcctccagcactgtgagcttggtgatgggtggcgtgccaaggccgggcagctggaaggcatcctgcacacaaggatgtggggtgagagcacggctcatttcagatgtctgccccagccactgtccctgtctgggtccgggcagctgtggggacattcaactgttgttactggtggaacacaaagggtaccacttgcaaagcactagtatgttcctcacacatgcctgacacatgccatgcaccgttcagactcagcatggtcagtttttccatatcacagggaggtgactgaggctttgagatggacagaggtgggattcaaagttgggtctgcttcagtccaaagggacgagatgttgccggaagtgacaggaaggcctgagtacttggcttcagaaggtgtcccttcactgagcctgggccgacatccccatctcatttccctctccctcctggattctcacctcctccatgattgtgggcacccaggagcccaggctgctgtgagctgggtctgggacacttggccagaggggattcttcctgctggagaagggggcaggtggaggctgagtcagacacaccctccgatctttccattttttgtcccacccaccccacctgaagaggtgcagctgcccttagtgcagagagaagaagctgggggctgggactctcagacatgggccccaaagtttgggaaggctggaagggacttagatgggcccatctggacctgaggttccctgtgggtgggggaagcaggatctcaggtctctcaaagggactcacttggggctgcaacagagccaggcagttccacagaggcaggtgagcaacagcaggaggccgaacaggcccaggatgatgtgtagctccgacccctctgcagtgagggcagggccggaagaagttagaatgcatgttgggaaggctgggtctcctccctccgaccaggggattcaaagtcagtccccagctactctcaaaatcagcatcctttgggtggggtaccctccaaacagccatctctgcccagcccccgtctccccttacctggggtcaaggtcatcagggtgaggactgtactgttggtggccccagcctggctggcagccatgaggtggatgtgatacagactggcgggctccaggccatggaggacaaagccacgggaggaggcattcaggatggcggctgggaggggtgtacggtcagcataggcctggatggtaaagctgcctccgtggcagctgagcacccccttccaggccttctggggctgtgggggaactgaggatagactcacagaaggactggttctgagcgttggtccagaagatggtgtagtgggtaagggggctcttccccagctcagggggctcaggcacccactccagctgtgcccaggtcttgccaatgtgctttagatgcagctctggggcatgggagggagctatgggaagagagaggtgcgggggctgaagggagtggggcagagcaagagcccggttggacttcttgtggcttcccagacactgtggggtgggtgagaaaagagtccaaggggactcatgcccaagcctcatttttcccagggatttaatccagattccatctactgctaataagtgtctgagccaggatttgaacctggctctgcttgactctaaagcctcactttctgatttctaccaggcctgatttcatctgatttactctctgatttctgccactcactctccgaatttatgccaggtcctctgtccaatttctttttgtttttgagacagggtctcgctctgtcacccaggctggagtgcagtggcgccatcttggctcactacagcctcgacctcctgggctcaagccctccgatcctcccacctcagcctctcaagtagctggggttacaggcatgtgtcactgcacccagctaatttttggtttgtttgtttgtttatttatttatttatttatttttctgtagagacaaggttgcctaggctggtctcaaactcttgaactcaggggatctgcctgccctggcctcccagagtgttaggattacaggtgtgagccactgcacccggcccctctgtccaatttctgttacatataacaccttatttttgtctgggaaatggtttgatttttgccaggtttgctccttgaattgtgccaactccctactcaatttctatcccagcacctgatttctgtccagctgtagggatccagtgtaagccaggggattgggagagatcctctccagggctggaagtatggtaggaaggcaatgttccctatacttctgattgctggggaccaggcagagccttgggagagagaggagaggattctggaaaggggcctgatagttgacaaacccatttcttgagagtaggcatagacatgctgggagggtcccatggtgtcctggtacaagggagtcacgatgatctcatagagctgaaagggcctgatgttctctgtagagagaaaatggggtaggcacttctgttagggcctaacctgtgctaatgatcaggagctagcctcagacctctagtgagggctaacctggcctcatgattcagggttaacctccacaatatcttctttagatcatttgatgagaattagggaagaaaagtggaagagagagctagaagggtggcagagtcagggctatagaaaaaggatcaggttagactgtaggaagaacttcctgattatgaggatatgaaatgagaacaacgaaggatcaagaaaggctggagaatccatgtctcttgggcagttcaggttgtcccatgcctattgtcagataagcactgcctccctttgtccctggccctgcccaactttccaggccagcctcacccttcagcagaaaccccgtggctctcccattctgttccatcctccaggtcttgttgctattgctcgcgctgggggggcccaggccccactcaatcacatagccctgaggccatggattggggggctcccagcctacccagaggctgtgagggtctcgggccatggcatggagtctggtcagagctgggcctggagacagggtgggaaatggtggaatgaaggtgaaaagaatgcaggcccttgagccagaagcctgggttcaaatcctggctttgctatttacaggctgggtgacctttggtaggtcaacatcttagcctcagtttcctcatctgtaaagtagaaatgatgataaaagttcctaactcatagggtcttagtgcagattaaatgacttgatgcacgaaacaagcctggcatagcgcctggcatggagtagttcttgttagtgataacagctaacactctattgttcttggtatgtgtcaggcgtagtccttgatatattttattttattttactttactttaccttactttattttattttttatgcagagacttgctctgtcgcccaggctggagtgcagtggcgccatctcggctcattgcaacctccacctcccaggctcaagtgattctcctgccgcagcctcccgactagctgggattacaggcaaccgccaccatgcccggctaatttttgtatttgtagtagagatggggtttcactatgttggccaggctggtcttgacctcctgacctcagatgatccgcccgcctcagcctcccaaagtgctgggattacaggcgtgagccaccatactggactccttgatacattttaattcactgagtcctctaatagtcatacccaggaagtactactcttttccccattttactaatgagaaaactgagagacacagagaggttaagaaacttgtctaagatcacacagctagtaagtgggaatattagctatgattattgttattgtgattattagtcccaccttgcgaggaccaatgtttagggaaagcagtgggtggtggcagctgatttcctgagaatgagcaatgaactcatagaccaggttccaagtggaaaagcctggggctttctctcttggctttcttggcagaatgggctgtgagtgtgtgtgtgtgtgagagagagagcttaacctggtctggctaatgataataacaacagcagacacatgcagagcagttactttgtgccaggcacttgtcttaactcatgtacaccccatggcaccgctcagtaggtgctgttatcatccccatctgctggatgtgtaaacagaggccggggatgggaggtaacttactcaggtcacactgttagcaagtgataggactcgttttttgtttttttttgtttttttgagatggagtctccctctgttgcccaggctagagtgtaatggcgtgatctcagcttgctgcaacctctgcctcccaggttcaagcaattctcctgcctcagcctccggagtagctgggattacaggtgcccgccactatgcctggctaatttttgtatttttagtagagacaggggtttcaccatgtaggccaggctggtcttgaactcctgacctcggatgatctgcccacctcggcctcccaaagtgctgggattacaggcgtgagccactgcgcccggccaataggactagatttaacccaggcagtctagcctttgaattgatgcgcttgacctctgtgctcttctggctgccagccccctttacctctgctttctgagaagaccaccggagtgggacgagaggtcccggctgagttataggccacaagggccacctcctgggcttctgaaggcaggtggaaggtgcagctgagctctgtggtgttgcagaggggcaggatggccccagcctggcctgagggtctccaagaaaccacataaccttggatccgtccgctgtcttcctccaggggcactggctgtggggcacaggaggaaaaagagaaggggatgtgcagctcatcttgagtcaaggagagcctctaggtggggtggatggatcatacaaacggagcctccccaggctggggtccaggcttctcacccccctccccttttccctctgttcccttgtgctaggttctaggaaggagggcaggaagaaacaagttggtggacacagcaggctcttaactattcactgaaccacactgtgacgtgcgttacagtctgtccaaaagctaactcagctccctaggcacatgcaaagtgcatgcaaatcacatataaatgcgtccacgcctcccagacctgttggagtcctaagccccggtttgtagggatctgtttggactgcgggaggtgtcgaggtggagggatggccttcagagggagtcaccttccagaacagctgcactgtcctggggtccagctgcctctgccgccaccatgtgtccagtctgacagtgggggctgtggatggaacaagaagagggggtgccagttggggaggggcctggggcctggactggatactgttggctgctcccagcctctcatcacctccttaccccgttcggtagttctcagctccaggctggggctccagtcgctccagtggccaggcaggggccagcggatgcagcgtatctgcagggtgtaggccgtggctgggaggagcccgcagagctcatactgaagggcctccaaggggagggggcccacctggtgaggggtggacaggactctgagccttggatcgctgggccattctagggccagctcgagcccgacttaccctgccccctgcccccaccacctcaggctctccaggttgccctctgcctcaccagtgcccagctggcttctccacgctgcggcttgtggcgcagctcacacttctgatttatgtgcaggcctggctgccatggctcccagcacagctgtaggcagcctgcctggggaggggccgcttcagggctggggtccatggtccgcagcatggggggctccagtttcactgcaaggagtggggctgtcagaaggtctccctatcccaccctagagggctctgccttagctccctcttgtctccctgtctgtggttcaccatctgtccacgttgccaatgacacgtttctgtggttcgatctctatgtgtctttgtttctctctaggtctctgtttccgctcttgccccagggcctttgcactggttgttacttctgcttgaaatgttttccctccagatatccagcggcttgctccctcatttccttcaaggatctgctcaattgtcaccctcttagtgaggcctttcttgaccagcatattaaaatagccagtgctccccttcccccctctctctctatgcccttctcctcctttaatttctcctttctgcttattgctatctgaaattctatcttattttcccccccacttgaatctaacattctgagggcatttttgatgctttgtatccccagtacctagagcagtgcctaacatgtagtgggtgctttaggaaacacgctgaaagcatgactgaatgtgtctctttgcctctgtgtctcttcctgtctctgggtctgtgtccccatttctctgtctccagctgcacctttctttgtctctgtccctcttctgtgcctctgtctctaggtcttccagtgtcttcttgtctgtcgctagttctgtgtttccctctccattcctctcagtgtctgcccattttggggatcccctccctcccctgcatcacccaccaacatccatgggatcaagacacagttgtggggacatgctggtccccagcgcattctctgcctgcacccagatgcccatattctggtacaacagcaggtgtttgcgtgggatgcagcagtggctctgcccgtccttgggcacgcagtccaggatggagtccccttgggtctgacagttgccccggctcctgccaatagtccaggcttgggtgccaagcagaggaagaaagcgaggctcccttctccctcccagaggcatgcccagcatcctacccatgccctaccccagaatccaaagggaggggaccaaggtgggggcccctcctcacttgaaactcttcagagtgaagctggtgggtaggtgggtctcaggtcctggctcccactggcagatgaggctgctggttgtgaggttcatgaggcaggagaggttgtggggtatggctggagggtctgcatgtgggtgggaagagtgtgagggctttgggtgggaccactcagaaagcttcctctgggaccagctggccctgttgccttgccctggcttggttcctctgttgtcaccttgtctgtccccctgtctccaggcagagtggctctggaagggcagccctgggggaagctaagttgcaggcatgcaccggggcaagcatcacagactcccagcagcccagtggtggcccacttccaaggcccccaactctagaccctttgtcagtgacagtgtagtgtttgagttttcatcctggtcctgccattcattagccctgtgatcttgaagttatttaactgctccatgcctcagcatcctcatctgtaaaatggggataatggtaaaatcccaccccctagcgttatcacaagggctaaatgactcactctacatgaagtgctcagaacagtgcctaacttacaggaaatgctatgtaagtgttagcagtggccattactggtgctttttttttttttttttttttttttgagacagagtctcactctgtggcccaggctggagtgcagtggcgtgatctcggctcactcggctaatttttgtatttttagtagagacggggtttccccatgttggccaggctgttctcaaactcctgacctcaaatgatccacctacctcaggctcccaaagtgctgggattacaggtgtgagccactgcacctggcccattactgattcttaaacaagaacctcggtctttgttttttccttatgcctcagcttggcacaaactccatcctgctcagtttgaaaggaagtttgaaactggggtgggggacaagcccagctggtagaggatgttctccctggagacaccctcagatggctgaggacttgggctatgtagagtagtggtcacaacactggctttagagccacactgcctccatccttattaatgtgtgataagggcaagtcacttaccctccctgaacctcagtttcatcatctgcaaagtgaggctacatagtagtaccaactggtactactgttacctgatatcatgcccataaagtgcttattagataagagctcaataggtagtactcttttttttttttcttcttttttttgagaccaagtttcgcttttgttgcccaggctggagtgcagtggtgtgatctcagctcattgcaacctccgcttcctgggttcgagcagttctcctgcctcagccccccgagtagctgggattacaggcacccgccactatgcctggctaatttttttgtatttttagtagaggcggggtttcgccttgctggccaggctgatcatgaactcctgacctcaggtgatccgcctgcctcggcctcccaaagtgctgggaatacaggcgtgagccaacgtgcccggctggtaatattcttattagtattggcaggagggtgttggaggcagagtagttggatggctggaaggacttacagcctgcgcgcagctcaacctggtccaggatctgcaggctgttgccccagttcaggcagcaggagagaaaggcctgagtgtggttgaggtggggcagggtgatgatagattcctgggtcccatcagacagacgctgctgcctgcccccgggctgaagctctgctcccagtctccacagaatctgtggctccgggtccagatggctgcagttctgcttgatgatgcaggaggctgtgatgggatcccccaggtggacgatgggggctgagacactgatgtgcccgcactcctccagacctggggtggaagagaatgggccaggaacgacgcctctgcctagcagagctgggctataatctaggcctttgtactcctagactcagaggcctcaccttcctgtctcacccttcaagatatgggggctggaaatggaaggatggggacggagacttcgagaggctacgggggtgacacagagatagtgatgtgctggtaaccgtttatcagccagcttggcagagaaaagcagaccctggtttgtagtgtgtgcctttccgcggtgtaagtgctctcactgtagctgatttcagcctattgatgtgacatcattgatcggggagttgggaagagatgtgcacaattagtttttgcaagccagcaccagcacaccaccagatggagactgttaactccccagtgccctccccaaggatggtgcaagcagtgattagagtgataagaacccatagccacagcaatcttttcacaattcaaatctgattctgctaccccatctccatcgcagcacttcaatggcacattattgctctgaaaggcagtgtggtgtgatggatgagtgtggatgttggaactagactgcctaggtttaaattctggttctattgcttattaattacatgatcctggtatatttctaagacttcctgtgcctcagttttctcatctgtaaaatggggataaaaatcgtccctaccttagtgttgctggaaggattacatgcgataacatatggaaggcatttagagcagtgtctggcatgtgagtatttgctgccatcattaggataaacactcaaatccttcaatagctcctgtggcctggcccctgcctgaccctctcagttccagcttataccggtctctcagctccagctattctggctcattcttgctattctttgaaaactccaaaatctttctaatctctggatctttgtccctgctgtttttttttttttgttgttgttgttttgttttggttttctttttcttttcttttttttcttcaagttcttgctctgtcactcaggctggagtgcagtggcacgatcacggctcagtgcacccttgacctcctaggctcaagtgatcttcccacctcagcctcctgagtagctgggactacaggttcatgccagcacaccttgctaattttttgattttttttttttttggtagagatggggtttcactatgttgcctaggctaatcttgagctcctgggctcaagcaatcctcctgcttcagcctcccaaagtgctgggactacagatgtgaaccactgtgcccggcatgctgttctttttggagggactcttctttctctctcccacccctgtttcacctggttaacgcttaggcatcttgaagaaaccagaccaggcactaacgaactggaggaggccaaggtccctgtacttcctcaaagctcttattatccttcataattatagagtcttatgattatttacttatctatcactccagctagactataaattctgtgaggccagcagaccttggctgtttgcttattactgtattcccagtgcctagtacagagtaggaccttggtgaatatttattattattattattttgagaaggagtttcgctctgtcacccaggctggagtgctgtggcacaatctcggctcactgcaacctccgcctcccaggttcaagcgattctcctgcctcagcctcccgaaaagctggggctacaggcacgcaccaccatgcccggctaatttttttttgtatttttagtagagatgggttttcaccatgctggcaggctggtctcgatctcctgacctcgtgatccacccgcctcagcctcccaaagtgctaggatgacaggcatgagccactgcgcccggccgatgaattttttttgataaataaataaacaaacaaatcaacatacactttgcccgcaatgctttctgtcctctctcaggtgttcttaggcccgttttactgatggggatgcgaaggccctaagaggagaagcagtttgcccagggtcacagagcaagttcatgattctcaacaaagggcttctactgcttcacaggctcaggatttcttttttttttttgagacggagtcactctgctgcccaggctggagtgcagtggcgtgatctcggcttactgcaagcgccgcctgctgggctcacgccattgtcctgcctcagcctcccgagtagctaggactacaggcacccggcaccatgcccggctaattttttgtatttttagtagatacagggtttcactgtgttcaccaggatggtctcgatctcctgaccttgtgatccacccgcctaggcctcccaaagtgctgggattacaggcgtgagccaccgcgcccggcccagactcaggatttcaggctggaagaaactttacaaggttgtttgcttcaaaactctacctgatgctctgccctctacagcagggcttgagtggcctatttttgtatagcctaacaactaaagatgtttcttacattttaaaagagttaaaaacaagcaaagcaaaaaccaaataaaaacatgccacagggctgggcgcggtggttcatgcctgtaatcccagcactttgggaggccgaggtgagtggatcacctgacgtcaggagtttgagaccagcctggccaacatggtgaaaccccatctctagtaaaaatacaaaaatttgcagggcctggtggcaggtgcctgtaatcccagctattcgggaggctgaggcaggagaatcgcttgaacccggcaggcggaggttgcagtgagctgagatcccgctactgtacttcagcctgggcaagagagtgagactccatctcaaaaaacaaaaaaacaaaaaccaaaaaacatgcaataggcagggcgtggcgggtcatgcttgtaatccccatactttgggaggtcagggcaggtggattgctggaacccaggagtttgagaccagcctgggcaacatggcaaaactacatctctacaaaaaaatacaacaacaaaaaaaaattagctgggtgtggtggcatgccctgcactaccttggaggctgaggcgggaggatcacttgagcccaggaggttgaggctgcagtgagctgcgattgtgccactgcactccagcctgggcaacagagggagaccctgtctcacaaacgaacaaacaaacaaacaaacaaacaaacaaggaacagagacagtatgtggcctgcaaagcctaaacattactgtcagaaaaagtttgccaacccctgctgcacagcatctttatcaatcctggctttagcttgcatacccctggggatgggaagttctctacctctcaagacagagtttccatggttggaaaccaagctctgcctgggcttctttatttcaggatgaaacctgtccccttgtagcttccatcctgatccctttgctgcccaccaaggctgcataggacccatgggttgcttctgacagcttggtagagatttgcggacaagatctgcgcctcactggccttttccaggatgaccagcccgggtcgtctcaccattcctcttgggtggtggtttgcctgtggaagtctgtgggtgggagaccagctaccccacatctgtggctcagacttgaatcttgtgggattctctgggaatcccaggagccatgtggcagtgcaaggaaattcccaatatctctccttgtagcttcccctccccactgcaccctcatccttggccatactcacttccggggagcagcaggatgatcagggcagcccaagtcaggctgcagtttcccagccttgccatagcaccaacttgatgttcacctgtaggcagaagggttgtttaagaccatgggctttggagtcagagctgatcttaatccttgtctgtcactgtgcagctttgactaggttgcttgacttctctgagccttcgtttctttgcaaaatggaagtaacagcagcctatactgcatgggactttgagaggaagacacaaaatgatgcaagtcaagggcttttcacagtgcctggaacataggaaatgacagtgacagccacagttattatacttgccttccaggaaagagcagggaaaggagcagtgaggaagagcattcttccgccttcccagctatctaagctaggctacccctagagagcagaacctgagatgaggaattgcatgctggtagtttattttgagaagatcctagcagcagataagggactggggagaatgaaacagggaaggagagaaagccagcacaaagttacatcatcatgttggtcacctctatggacaactggggctctatcctgctggaaccttccaaagagccatgtagaacacttctcagagctgtccactggagggtcaatttatcccttggatgggagggaagatggaaagatttacccactgactcctgccccccattggtcaagggatgcctcttggggtgttcattccctggcacatccaggttgggcatgcatgagtactaggcaggttctcctggggaagccatgccagtgttgtcagggacactccctggaagaaagggagaactctatggagcagctgaggcaaggggctgtcaggttatgcctgcaggaagctggctgcctcagccatgtgggctgagagaatatcaagtggggcacccgaagggtccagtgtgcccccaattttgggcacagacctctggtggccttctggggtcaggcatcatgaggtcacggccatagcacctggatggagggtgccttggctccagtcttaggaagtatgcagaggtttctaccacttgggtgggtgtccagcctcatcttcaccctgctcccattggggtcttggagccaacacctgatcctccagcacgagttggtgctcttggtggcagatcagtgggaatcgctggtcagcttgcacgtacatatctggacacatacacgcaggtggtgtcccagcagatccctcgtgctcagcagggagaaaggtaggagaatccttttctcttcctcccagacagaggtgtggataagaactgcccagatacccaaggttgttactgctcacaggggtcttacccaaacccccagtctatccatgtatatattgcagtatcggaatacccagtgactgctagcccgtaagtctcctttgtgcaaatcagaaagaaagcaccccttcctctggatggatgcagcaccacactaggacctggcaactagggaacagcctggatttcggctccagttactcctcagttttgtgcagtgagaaacctgtacaagtatcccgagcatctgtctacccatcggtggttggtaaccttcttactatagcataccagtttgattatccccccgcaacactggttggggaagatttagcctccaaggcccagattttgggacactggttttcatctccatgtgcttttgatcctatcccagccctgttgccctagccagggtcagcttcaggcccagcctatgccccgtgcagtaccaccctatccgcctccactggctcctgtccagagtagacaacctaaccccaagaggccccggcatccttcccctgggtgctgggtgttggcctgcttggcctcagtctctggtcctccactgcagccctggacgtcccccagcctggttaagtgggcctaggacctgttggagcatggtctcactctctggggggccgatatgcagagaggtttggagcccagctcagattcaggtcacctgacttgatctccagctccgccacttaccagctttgtgatcttggacaagttacttcacctttccgagccgagcctcagtttccccatctgtgggaaagaaataacattagcactcactcctcagcgttgttgtgaggatgaaatgagattattttggtaaaggcatttagccctgtgccttgcatggagttggcactcagcaaccataggttattttcacgagccataaatagcaggtcagcagctcacagaatccagcacagttcagttttcccctcacccctgcctccctcacagcctgtgtggtcacacctcccaggactgccaccttgcttttgtctgtgccacactgcgcagttccaaagccccctttctggatcctctcctcctaactcctgggccccctggccctcctgtcactgcggccatctctgctgggctctgcaggtgctcactcctgtggcccagcacagctcgatgtctcctgggctggctgccttcacattccctctttctgtttctccctcatcacgctcagccctctcccctcacactctcttccccacttcacacccctcgctcccttgctgtttctactctcacctcgagattctttctgtgggaagggtggggagggaggagggggctgggaataaacagaggggagaggcatttccagatatgctgcagataaagaaaaagagagagcaacaggaagagtgacagagtgaggcggtgactgaaatccacacagactgaaacgacagagagactcgccaagaggacgattgaggccagagagatatcgagagacagagaaaaagggcccaatgtacgccgacccagagagtgggcggggggggggcactcggaggcctggagcccgggaagcgtctgttaccgagagtttaagattcaagagatagcaggaaatatgcgagacagagaaactcagagagatagcaagccagagagaagctgaggaggaaagatggaaacagagagtgaaatagagacccagacggggaggggttgcgcggctggaactcacagacacacacgtcctgagagacagaggcatggggaggggagaatgattatgcctgtccccagcccagctcagtgtccccaaggagatacttggctgtgagtgacttccctggtgcaatacccccaaaagtaggggcatcctgtgaaaagagactcagtgtccagggctggggttccaaaggacgaatcccgggccccaggcctaggaccccggacatgaacacttggcagagctgtggggagtggccccaggattccagctctccatcaagcccaaggctcagcccctctctagggatcccctactcacgttggcacctctggcccagcccctgcttggcctccttggtctctcttctcgtcaagagaagttcctgaaaccagctgcagtccagcttctctccccgagctctgtcgttaatggctcagcctctgacaggcccgggggctggggattgcaacaccttccgagcctccctcctgccctcccttgcgccttcgagggcacaggcagccccttcctcccaggaaggagcctgtgagggaagctggtgaggcccgggcagccttcctgccttgggggtcttaaagggctggggaatgtggcaacgatgtccccctcccctgcctccggatttcctgagctcaaagctttgaggctgggcagggcccaggctcccacctggctgggtgccatccttatgccccctgccctgggggagcatcacttggaggcaggccctggctggaaggctcacccggccctaagcctcttttcagctctagccttggggaccacatcttcacagtactc

SEQ ID NO: 1645 - DNA, 17272 bp, Homo sapiens; identical to SEQ ID NO: 1644

SEQ ID NO: 1646 - DNA, 17272 bp, Homo sapiens; identical to SEQ ID NO: 1644

SEQ ID NO: 1647 - DNA, 6173 bp, Homo sapiens
cttctgtgtgtgcacatgtgtaatacatatctgggatcaaagctatctatataaagtccttgattctgtgtgggttcaaacacatttcaaagcttcaggatcctgaaaggttttgctctacttcctgaagacctgaacaccgctcccataaagccatggcttgccttggatttcagcggcacaaggctcagctgaacctggctaccaggacctggccctgcactctcctgttttttcttctcttcatccctgtcttctgcaaaggtgagtgagacttttggagcatgaagatggaggaggtgtttctcctacctgggtttcatttgtttcagcagtcaaaggcagtgatttatagcaaagccagaagttaaaggtaaaactccaatctggcttggctggctctgtattccagggccagcagggagcagttgggcggcagcaaataaggcaaagagatagctcagaacagagcgccaggtatttagtaggggcttcatgaatgcatgtgagttggtttagtagagagacacaggcaatttcagacccttctatgagactggaagtgatttaagagggaaaggatagccatagtcctgaatacatttgagctgggtttcaggatgagctcacaagttcctttaaaaaaaattgacttaagcaaatcctgggaagagtttttttgctatacaattcaaggttttaaggtcctcggattcatatactttataaatgaattagccagcttgtttaaaatgtagggaaattgtgggaagaatgccttctttacttaattcaaggttttaaggttctcttaatcaattctactagctaattagccaattatttaaaaataaaagtttgaaattgccaaaaaaaaaagacaaggaaaaggaaagaaagaaagccaccagtctgtttggcatacaatacttaattgttgcctgacctacgtgtgggtttcagatgcagatcctcagttttcagctcttcagagactgacaccaggtttgttacacggcttaaaatgatgagtatatccattgaatctcaaccttatctctctctagaccttcttggttaagaaaccatgtagtttgtatgaagtaggtactcaaaagatatttgatgatttaatttttactggagaagaaatattcatatatgttttcttatttttacatgttttaaatatgtaaagattaaataaacactcttagaagtatttaaatttcctaaagtaaatttatctcaaccagtaacaggaccctcccaatactggaaagttgagtgtgaccgcatttagtggtgatgagtgtgagcttgcttggggagagggcaggacatttaggatttcttaagcttagagtcaatacaataaagattattgagtgctcacttgggtgggctataatcactgctcacaggagttcatgaaccacaagtaaaagagtgaggagatatgattagctcacaaataactttaatacagagcagaaagtaatgaactactgcaatggagttatcacagtgctaaggatgctcagagggcatctctgataggcagaggtgagggttagggaaggaagctgtagtctagctagctagagctgctggaatagacatgacaatggctgctgccaaactgttttctcttctgaggacagatgtcccgtgcaagtggcttggtggaagggactagtgtctctaatatagggtgatttataagcaggaaagtgtgtcctagaaattcagaccagagtgatagattggaattggatcatgggggactcattgaatgttatttattgtatttgtttttgcgatcagtgttagtaaagtgtcaaagggattgagcagatgagtgacatcatgcaacacaagttttgagtttcacttgtcagactgactggagaggggcctggttagttacaggaaggtaatttggcatgcagccactatttttgagttgatgcaagcctctctgtatggagagctggtctcctttatcctgtgggaaaagagaacaaaggagcatgggagtgttcaagggaaggagaaataaagggcagagaggcagcggtggtgtcaggggaagcccacaggagttaacagcagggttgcctcaacctagagaggaagcgacctggtgccctcggctctgtggcttccttcatctaacaacatcttccactctacaacaatgccagggaaggcggaggctggtacagtgcatcaagacacagctactcctgggtgacagaggttcagggccagctcactaagtaggcagaagtttttgacatatactttgagagataaagcaagattctgtacctcaaccttcagaatttcccctaccactcattatagttccggagctatatagctcctatcattctatcataaccttagaataccagagaacatatcatctcatctaattatctcttactatatgtgaaaaaaatgaaggacatgggggaagtgtgacttgccccaaatcacatatttcatggtagagccaggtcttctgtttgtcatatcagtgttcttcctgccacaaccatcttgaagaatctatttctcagtaagaaaatatctttatggagagtagctggaaaacagttgagagatggaggggaggctgggggtgtggagaggggaaggggtaagtgatagattcgttgaaggggggagaaaaggccgtggggatgaagctagaaggcagaagggcttgcctgggcttggccatgaaggagcatgagttcactgagttccctttggcttttccatgctagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattggtgagcaaagccatttcactgagttgacacctgttgcattgcagtcttctatgcacaaaaacagttttgttccttaatttcaggaggtttacttttaggactgtggacattctctttaagagttctgtaccacatggtagccttgcttattgtgggtggcaaccttaatagcattctgactgtaaaataaaatgatttggggaagttggggctctcgctctggagtgctaaccatcatgacgtttgatctgtacttttgatatgatatgatgctcctggggaagtagtcccaaatagccaaacctattggtgggctacccatgcaatttaggggtggacctcaaggcctggaagctctaatgtccttttttcaccaatgttggggagtagagccctagagtttaaaactgtctcagggaggctctgctttgttttctgttgcagatccagaaccgtgcccagattctgacttcctcctctggatccttgcagcagttagttcggggttgtttttttatagctttctcctcacagctgtttctttgagcaaaatggtgagtgtggtgctgatggtgcaccatgtctgatggggatacctttagtggtatcaactggccaaaagatgatgttgagtttagtgttcttgagatgagatgaggcaataaatgaagaggaaggacagtggtaaagaacgcactagaaccgtaggcattggcatttgaggtttcagaatgactaatattttagatgaatttgtttgacattgaatgttcatgtgcttctgagcagggtttcaatttgagtaaccgttgcaataacatggggcagctgttttgctctttgtcttcatgacaactgtacttaagctaacagccctgaaacatgagattaggctgggcagaatgctgctagagaggaccacttggatggtctttattctccttctccatgtccctctccatcacctggaagtcacctctgggtgccactctggtgccttccttgtcgaagctgtagctgctcacatgacacctatccctgttatccagtttgcttgactgggacgttttgccttccccttcagccaggaagtgaaagtcccagtttttatttatcacaggtgttggtattggtggtagaagaggtagaattatggaatcaggcctcctgtcaggatttctttttgacagtccctctcagacacctctgcctaaggccagctttgccattacaaactctcccttctccctctctcccttcttctcttcctcttccttcttctcgctctttctctctctctctttctccctctctgtctcttatacacatacacaaagatatactctattccaacatcctctacccaacctgacagagatgtcctttgctgtaggttcagcagtggggatgagaaatacagctctcaaacaggataactaaagcttattatcttatcaagcttgttcccttgcagacaagattgatcaattatcataggctttctgggtgttctttctgaagctttctcaaagtctctttctcctatcttccattcaaggcaaatgattgccatttaacatcaaaatcacagttatttatctaaaataaattttaatagctgaatcaagaaaatctcctgaggtttataattctgtatgctgtgaacattcatttttaaccagctagggacccaatatgtgttgagttctattatggttagaagtggcttccgtattcctcagtagtaattactgtttctttttgtgtttgacagctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgagacgtttatagccgaaatgatcttttcaagttaaattttatgccttttatttcttaaacaaatgtatgattacatcaaggcttcaaaaatactcacatggctatgttttagccagtgatgctaaaggttgtattgcatatatacatatatatatatatatatatatatatatatatatatatatatatatatatatatattttaatttgatagtattgtgcatagagccacgtatgtttttgtgtatttgttaatggtttgaatataaacactatatggcagtgtctttccaccttgggtcccagggaagttttgtggaggagctcaggacactaatacaccaggtagaacacaaggtcatttgctaactagcttggaaactggatgaggtcatagcagtgcttgattgcgtggaattgtgctgagttggtgttgacatgtgctttggggcttttacaccagttcctttcaatggtttgcaaggaagccacagctggtggtatctgagttgacttgacagaacactgtcttgaagacaatggcttactccaggagacccacaggtatgaccttctaggaagctccagttcgatgggcccaattcttacaaacatgtggttaatgccatggacagaagaaggcagcaggtggcagaatggggtgcatgaaggtttctgaaaattaacactgcttgtgtttttaactcaatattttccatgaaaatgcaacaacatgtataatatttttaattaaataaaaatctgtggtggtcgtttt

SEQ ID NO: 1648 - DNA, 6173 bp, Homo sapiens; identical to SEQ ID NO: 1647

SEQ ID NO: 1649 - DNA, 33229 bp, Homo sapiens
tccctcgcccggaggcagagatgcgctggcgcatcaccgccaggagcccacagtgaaagaccatcggatggaaggcgacgcccagaactccaggagaccgctgtgggaggacgcgaggccaggtgacgaataggccaggcgtgagttcccaaacagcctcctccccttcaagagagtaagcttgggccacaggctgggacggaagcagaggggcagacacgccaccacccgcccggcctcgaacctacggcggcacagttcagcggaggcggcccagcggtcctgtcccgcgcctgcgcactccaggccccgccccgccccgcgccctccaggcccggcccgccctccaacctctgcgtgcgcacagcctagagcccgcctccgtgaaagactgccgggcgcatgcggtcggggttgttcactggctgtccggggctccgcgcgcgtcgccggcccagctctgtcgctgacgggaggatctgaagccggccgcaggtaggctgactccagggatcccgggggggatctgttctcccgcgcaggagtcagcggcgcgagctgagcccggcgccgaatagccccgccgccgcggtgacggacgtcgctcctaccaatcaggggcgaggtgactcggcgtcctgcccaatgggctgtgtgcctaacgggagtggggcgggcgccccggccggcgagctgccggctcccgcgcgcgggcctcgtggccgggcggcgctggggagaggggccaagcggggcgcggggcggcttcagaggctgcggggcctgcgctgccgcgctgggccgcgccgaatcagctcggccgggctcgtcggacggagaaggccgtaggggagtggagcggcgcccccccccacaccctccgcccttgctcttcgtctgcgaggaagcccggcagtcgcccatccattcaagcagtgcgggcctcgggcctccggcctcggcgcgggctcagccgcccggggctgggcgcggcagctccgcgccgtaggacgagggggcctgcgaactcgccggccctgggccccgcggctggcctttgggcctcacggcttcctcccttcccggcggccgggggtcggggcgctggcggtgtatagagctcaccacgtttgcgtggcgcccttccgtccacgctcgttacagtttcgaatcctcagcggccctgtgacgcgggcggcgcagagattctcacccccattcccctaggtgagaacccgcgttgcaggcagctcaagtgacatgattgaggtctgcacactagtgatgggggctggcacttcatctcataacattgaaagaaaaagcatttcccccctcagtctttgttgaatttctctgatgcgtcttgatttacgttacttctgtgccggaaaaccttcttgcgccttccgtcaccttcaggattaagttcagattgggcatgccagtttgcacatgatctggcccttgcctacctttccagtttatcttccactgtatatccctgcttccccgccttccccctcacggccttacctctgttctctgtagctgccctgcacctgcctgttcaccctgttccctttcctgtgctctgagtcgtgcagtcagtccttcaaggcccattgcaagtcatatctacaaaacaggagccgcctggatccgcccactacccccaggacttgtctcaccttcctctgatggccatggtactgaaagcgtctgctctcatcgtccccctttatagtctaaacatgttttctgtctgcttccaccgtcactgaattactcatttatttgttaatgtttcatctctccaactggactgccagaaagttgagatatgggcccaaatctgattaatgtttgcagtccccaagcacagtagctgtcatgtaagtcagtagcccataaggatgaatgaatgagcctcccgcctgatctttatgtacactggcatatgtattgccaggcactgagactgcaagaatctaaagagagaaactaaagaacgtaaagagagatgttaaactcttagagtaaaattgggacaaatcaaatgtaattggatgagatgaatcttttgtagaagtaactcactcggtggcagaggaatttctaggatcatccaaaacttagggagaccagggtatagtctcagtaaggtatatgtctggttagaacatatctaaaatgtacctaagactgattttcatgtgtcaataaggaactgtaaagtgagagacttagggtcagataagcttggagacaccgcatactgtatagcagtgatcacagtgcgagtttacttgctaaacactcccaggattcttgcgttaaatgacttggtttaatcagcgtttctctgatttatatccataacaccctttttgagaatcccatgtgcattttgttgaaaccagggagcatgcttttggaaatgctgcagcagaggatgcaaagagcctttggagcggggaagacttctgagcattcttccttccctgccaagtgtgttctttcttgctctggggagggggtggggcgggggaatgcttcgagcacaactccttagttttcttgttccttagtttatttttatcataatttggcttcacatggaacgttcctgaggaggaaaatgtcctgaccatgccaaagtaagcattttctgctactttctaattgtgtttttcattttggtcacatttgggtttgctgaccaaatggacgatcctggacctctgaagctggggaccagtgataaatcctccgtggtgagcctgtcacggtctcctcacctcttgtcgatgctgttttcacctgcatcttgactctgctgcccttatatcttatttctcctttccctgccaccgtggcactgctttttggatttaatctcatctcccctctctttgagtcctctgcccgtcatgtgcttcagactggtttcttatctgatgtccctctcccccagtatttacagtctctcttcattgcatgcctgggagagatttctgacaaggagcaagttgttgttaaattatagaagagaactactttttctttttttttgaggtagtcttattctgtcgcgcacgctggagtgcagtggcatgatcccagctcactgcaacctctgtctcctgggttcaagcgattctcctgcctcagtctcctgagtaactgggactacaggcgtgcgccatcacagccggctaatttttgtatttttagtagagatgcggtttccccatattggccaggctggtctcgaactcctgacctcaagtgatcctcctggctctgcctcccaaagtgctgggattacaggcatgagccaccatgcccagccagagaactacttttaattaaaggaattttggtttagctgcaaccacttttaaatgttgatgttctttccttttagtctatcttttgtaacctagaggagctgtgttttcttgatgatatgttgtagtttagccaaagacattatttatttcctggagaactggagtacttatccaagtttgaatttttttcccatgtagggaaaataatgaggcacctgcctggtatcccagtgtctggcagtgatgtcagcaaacatttggggtgtagtgttctatcagccagcttagagctggttttattaggttgactctgaaggttattagttgtcaaagctttaaacaaaagctgtgttattagagtagcagttgtttttctacacgtatttgactaaagccattcagtgatccaagaaatgtttgttttgatcctatttaaacctgacgagaaccttctgaagtcctgtgacagagaaactgaggcttcaagagggttcatagctaataattggcagagccagtgtttgaacccagatgagtttggtttgttgagatacatttatatcatctgtaatttttccttcttccaggtcaaagagtaaaatgaagtacattctggttactggtggtgttatatcaggaattggaaaaggaatcattgccagcagtgtgggcacaatactcaagtcatgtggtttacatgtaacttcaatcaaaattgacccctacattaacattgatgcaggaacattctctccttatgagcatggtaagcacagtggatttcttcataataattgcatgtggcagaacatgtcagcacttgggaattatgtgcacggtttgcataacttttattttctgccttctaacaggtcccttaatacagcagaatgatacttttctcacctagaaaggaagaagcagaattctttttttttttttttttctttgagacaggatcccactctgtccctcaggctggagtgtagtggtgtgatcatggctcgctgcagcttccacctccttggctcaagcgatcctctcacctcagcctcctgagtagctgggactacaggtgtaaatcaccatgcctggctaatttctaaattttttgtacaggtggggttccactgtgttgtccaggctggtcttgggtcctcccacctgtaatcccaaagtgctgggttttataggtgtgagccaccatgcccgactgccttttacttctttgttgttattgagaacctgtcaatggtgtgacatacagctgtggctgttacttcaaagattaattgcttaaaactgggagagatgttaaaacatacctcttaagttttaaaattctgcattcgtactcctactctctagcgttgaggtgaaaatatgcaagcattaaatgtcactagtgcagaaatcctcgtaacaaatggcatcaggaaaagatccatatacctgagtgatatttaatacagaattcttgagcagaggatgagttatctctctgagggagaaaatgagactttttttcctttcctgtgtttgagcttgtctcctattgtgatggtaggaatgaatcattctgggcaaaatttctagagtgaagtttcatggaatgaatgtgcaacaaaagaatggggtaaatatgtgcagtttcacaaagttgtttagaacaaaagcagagctcggaagctgatttttataatcagcacaagcttaatatgcatatatccaggttttgaatcaaatattgttatcatactttaaaccatattatgctcaattaggagacgtttctgaaggttctttttccctaagcagcagatgctgtatactactgtaaagtcctgtatgcacagcccactgggctgtcatttcttcccatcccatgctattttataactcttcttaagaatgagtttgttgacaggctagaagtatgaggttaccttttagagaatagctggtaatttttctttttgtgtgtcatatttagtcttctagaagtgaatttctgtgcttcctattacgtaattgcacaccttgttaatgagtgttttatttcaggattgcagttgtgccatggtataggtatttttcacttaacgtaaatggtttctctgttcactgcaggtgaggtttttgtgctggatgatggtggggaagtagaccttgacctgggtaactatgagcggttccttgacatccgcctcaccaaggacaataatctgaccactggaaagatataccagtatgtcattaacaaggaacggaaaggagattacttggggaaaactgtccaaggtaatactggatttacctttaaagcttaaaagtcttaaccagtttaatttcttctccctcccacctctacacagatgtgtaattcccttttgagtacagaagtttacattgtatgtgatttcagcatgaaactctcaaggtattgttactgaaatatgccttcagttgaaaaatcagaattatattgttgtttgctaaaaaaaataatttgaagaactacttcttcgttgaagcttgtcaattctgctaaggcagcatgatacgagtccagagagctgttgtttttacacagtaatgagtgtgaaagtggtaaaggcaactcgattagggcattaagccagatggcatgtatgtgtgcatctgggacttactatgtatagaagtgagaaggaaatgaacatctattgtgtatactggtttccaggccgttcatcagtgccatatggcctaggaggagcctgagaagtgggtttctgggtcctcccaagctttcactggcacagcttcgcttacatctatttgctgttttggggttttgtacaaacattcatttaaggaaaatgttttgctgctttaaaaaggtggggatggaaaactactgatctagtataatggcagtggcccaaatttggagaggttgctgaaaagtggctttaatctgagttatgagagcagatctgcttttggctttagactttactggcctgaaagctgagggtcacactgacagctggctctggtctggggctgccctggcaagattctgggctaattgggtcatgtttggatcttagcttcccctctcaccagctttgtgaacatgggcaaattaacctcttcaaaatgtggattccttttctgtaaaatggagacaataacaacacctacctctctaggttgttaggaagattaaagaaactaaaagtcagtgaagtgtttccctgacttcctgacacatagaaaggaatcagttaggaattagaatggttttgatcttacagtttgctgtttatttattcatcatccatcaaatttgcattgaatgctcactgcagtcagaccctcactggtgctggtgatgcatgtgatgagcaagaccagagaagtcattgcccacatggaggttacctgtgggggaggcaaacaacaaacatgaaacaaaacgagacgtctgtcagaagctgtgaagaaaccaagtggagtgaggacagagtgactggggaaagccactttgggcaggtggtcggggagtctcccaagagaggccatttgagctgagaggccagtcacagcgagagtggaatgagaagtgcggaggcgcagggctacgaaggcgtggttggtccgggaatggaggggaggccggcatagctaaggcagagtgactgagggagatggtcagagagcgggggtggtagccacagccaggttctacccagtcgctgggccgcagcaagaagctaggagtgtactcggaggagtgggaagccaccgaaaagttgaagtgtgggagtgatgaattctgacttgaattttaaaagatcactttgacgccatgtgtggagtagataatgaatattcttctgcgtgaggcaaatgaatatccttgtgcatgaggcattgctgtaactggagtaacctggagttaaacagtaatcttcaccttttaggaacttgccatctgtgcccaacaactatgatttttgaagtgttgagcaattgctggcattctttgagcattgacatggcaggcactttaccgagcattttacaggtgctgtctcacaaaatttccacagcttaacaggtggggaaaacaagcttaaaatggttctataattggcccaaagatccacagctaacgagtcatgagactaaggtttgaatccagacattctgaccccgggtgctgtgcttctaaccactctgctgtgctgtgctggctcactgcagtggattgtctaccctttggtaaactggaaacatatggaacagggtcccagaagtctcttgttcctggaagtgcactgaagtgtaatgtgcctaccttcagctgtgagcaatagggttggctatactggtgtgtggccaaaagggtagactctgcacaggggcacgtgcgcctgtgtggctcaggacactgctgtcagccttgctctgttgcagggcttccagcaacaacttagacatctggctgcaggaagtgtgagctcagagatttgttgaggccagttaaagggggcctcaaaagtatttttatgaccctattgctactctctccaggcaaagagtgctgcagtttgttttcacagtaagtgcatttgtctcaatcaatgtagatggacaagcgtaagttccctgtttgttttctttttcccagttgtccctcatatcacagatgcaatccaggagtgggtgatgagacaggcgttaatacctgtagatgaagatggcctggaacctcaagtgtgtgttattgaggtttgtatgattcctgcacatgtgaacaagtgtactcatctccttagtcagccatcaataactgataagacagttcccagtggagcccttggccttcctatctctggtgcagtatgttgcaatgtggcaggtaagggcacagttaacagtcatgtggaatggccacgcaagggaaaaccgtagtttgcccagtgttccttttttgtagcatttatggtacaatcacttagtactgattgtccccatgagtagtgtgacacattttcatctgtctcttgagcaagtcagcagatcttttgctttcgtctggcaagagcattcgtctccgaatgagcttcatttggtttcagtatctgtactcctgctgtgctgatcctagctgttggatctcagtgttcctcagataacaggagactcaaaagttccagcagtttgtttataactaatactttttttttgagacagggtctcactctgtcacccaggctggagtccagtgcagcagtcatggctcactgcaaccttgacctcctgggctcaagcagttctcctaccttagcctcccaagtagctgggactacagtgcgcaccaccatgcccggctagtttttgtacttttttgggagaggcagggtttcgtcattttgcccaggatggtctctaactcctgaactcaagccatctgcctgccttggcctcccaaagtgttaggattacagatgtgagccaccgtgcccagccaactgatgctttttcagtacaaaaattatttatggttaactaaggagataagatttaggtttttcttttttttttttttttactttgtcactgtgatagagataacattcctggcacctctctcatctgacctttttcttgaaatgatgtggaaagttccataataacctttgggaaggatgagcctgtccaaaagaataaccttttagtacaaagagttgtctaattcctgttaactgttaactaacattatacagggttagagagtccgtgttacataattactgatactgaatcaggaagacagaacagttgttagaaaactaaactgccagagaagggtttagtgcctaacctctgaaacaactttgttcttctagcttggtggaaccgtgggggacatagaaagcatgccctttattgaggccttccgtcagttccaattcaaggtcaaaagagagaacttttgtaacatccacgtcagtctagttccccaggtaagtaagacattgaaagttttactttgggggagatggagaggagggaggaaaggtaaaccggaatgattttcactcattgtctagtagttttcacttgaggtgcaggaagcagagaataaagaactttgtaagtttaaatttgttacaatcatacttttttgaaaagatcaaatagaaaacatttgaaaaatcagggcagttgcatttgcagatgtagattggccgtgtgcatttgtctttactatatggtggaactagagtaaagaggctgtttttaaagacaaatcttgtggagaggagtcaatagtaacaaaaattgggaagccggaaagcagatggatgcatagaaccgactaagctgaccttgagtgccggatcttaagcccgcagcagtgaaagcagagaagcagccctgtttgccctgcagaaccccaaaagctcaggagtgggatgagggtgggcctcatgtaactactgcttcagaagactcagaccctgacatctttttcctacagtgcacagttgggcgttagcctcctcccaccttggcagaagactggaggcttgttctctggggagggttcctggatgagcagacagtagggacagttgagggcagtaacactggactacaaacatggggttatgtgtaatgttaacgctgttgacagtccttgccttcttccaccatttggttcccagaatcatcatgtttaggcttggccattccacgtaggaggttgtaagattgtcttctggggtatggatagcccaggataaaagacactggctctggcggctccccatgaaataagccagccagattttcaccatgacaagcctacacactcacacataacttataggtagcatttaagcaggcctccatacacttggagaaagcatctgataggtaagagaccaaacaacagaaagaaagaaacttacagggaactgaggcgctacaagcagaggaaactttaaaaaaacaccaaaaaaccaaaaatgacctgtcattactattcttagaaaattagaaggagataagctatatccgttaggtaagaactggatgctataagaaagaaacattgagagaacagaaaagaatccttggaaattaaaaattagatagcagaaatgaaaaagttaagagaaagtaagttgaggaaatacccaaggaagtacagcaaaaagaccaagagatagaaaataggagagaaaaggtaaaattagaggactggctcagaagttctaatgtccaaataataggagttccaaaaaataagaacacagaaatggaggtataatctgaaccccaggggtcagcaaatgatggcctatgggccacatgaacctacccccccgtatttggaaatcaagtttatggaaatacagctgtgtctgcttgtttatgtgctgtctgtggctgcttttgctctagaacagtagagttgaatacttgtggcagagactgtgtggcccacaaaacctaaaatacttactatcagggcctttacagaaaaaattttctgaccccttatctgaacaattcaaggaaatttctagacatcagtttctgggttgaaagggcccccttggtgcctatcatattggatgacagatgacctacaccaaggcatattattgtgaaggttcagactaatggggcagaagttctaaaaggctctgaagagaaaaatcaagaatcattgtgccactggaccccttagcaacaatactggaagctaaaagacattgatgctatttcattaaaaattctagtggaggctgagcatggtggctcacacctgttatctcagcagtttgggaggcagaggtgggaggactgcttgagcctatgagtttgagaccagcctgggcaatgtgacaagagcctgtctcgatttaaaaaaaaagaaaaagtccaacagaaaatgatttccatcctacaagtccatgtgtaacgtgtatctgttaagtgtgagagaagaataaagatgatttagtacagaaaggaaaagtgtggcacatggtttgggaacagtatttaaatacttaaaaagtatgtaaacccaaaagaggactgcaggcacaggaaagtgtctaatgggggcaggatcctcatttaacagggaaatcaatagaaaatgcctccaagtaaatgtggagaagtagcacaccagcaagatcagttaagagttgaagagcggttgtttctagggattggaaaggggagagtgggtgagggccgatactgcttacaagctcggttagaaccatttgattctaaaatgcatgcatgtgtaactttgacaaacataaaagctaaattacacaagtgaccaaatgatctatttccttattaaaagaggttcaaggaaaagtcatacttgaaaattccttatcagagggaaactaacttttttttttttttcttttgtgaaatagccaagttcaacaggggaacagaagactaaacctacccagaatagtgttcgggaacttagaggacttgggctttccccagatctggtaagatttcctgatagctggttgcagtgtaatcttttatgtctagttaagatcactctatcatgacagacaagacctttgtcttgttgggttgcttttgataattgatgatggagaaaataggattagttctttgaaccgggctgtagtttgcaagatgttcatacttagagcgtgttaggtcttgtactccccagaccttatttttcctctcagtctttttactctcatttttactcctacttgggaacactaatggaggaaaatcccagagctcttgtagttcattaatgtattcatttgtactgccattctcttatgtttctccagtttggcgtttacggattttagctttgaaacgagtcataatatttttatggattatgtgcctggtgctgagagttaacgttttcgttcatcttaacaatgtgatgtctgttttaatttcagtcaggagaaacccctacttctgtcattttttccttctgtctaagccatcttgttctctactgctaggttgtatgcaggtgctcaaatccacttgacacatcagtgaaggagaaaatatcaatgttctgccatgttgagcctgaacaagtgagtagaaattcccatctctaataagttgttttttgcttctaattgtcctaaagcctcttgatcagtttcgtgaggcttgttattttctaattagagatagtgggctgttccagaagaacccattgccatcggccattccctgcctctcctggttccccaaacaacacctgtgtccctcctgcctcttctccgtgcctcgttgtactttgtgcttcagccgggtggagtatctttcggttcccctagtaccctccactctccctatgattgtactttttcactggctaatttctgttaagaacccatgtccccctcttcctgttggcttggcagtctcctactcactctcatccttcaggttctagcgaagacatagtgttgtctgagaagctttaactgccaaacctcctggcccttggccttcagggttaactgcgtccttcactgggctcctgtgtggtgtcgcatgtatgctgctgatgggcccatctttctggtgtgtgtgtgtgtgtacatgtgtggtgtgtatctcccttcacagactctaagcttctggagggcaagggccacctcattcaactttctgtttctggtgcctggtgtctagggtgttgtaggctgtcacagagatcttagtgtttttgttactgtacctatgatgcaggaaatccaaaatttggaacctgtaatgtatctaagtgtggtgcttagtatggaaattctagtggtgatacattgagcatgtagctttggccaggttttagatatttctggcctagcaagtgaaggaaattcaattctgtagcagaataggttgtcattaaaattgttcaattttttttttttttttttttttaattgagacagagtctcgctgtgtcgcccaggctggagtgcagtggcgcgatctttttggctcactgtgacctccacctcccaggttcaagcgattctcctacctcagcttcccgagtagcttggattacaggtgtgcaccaccactcctggctaatttttgtatttttagtagagatggggtttcattatgttggccaggctggtctcaaagtcctgacctcaggtgatccacctgcctcagcctcccaaagtgctgggattacaggtgtgagggcgcccggccttaaaaatattcactattaaaaatgtaacaagtatttccacatttaagtttaagtttcagattttttgctttttttttgagatggagttttcactttttcatccaggctggagtgaagtggagcaatctcagctcagtggaacctccacctgctgggttcaagtgattctcctgcctcagcctcccgaatagctgggattataggcacctgccacgatgccgagctaatttttgtatttttagtagaaatggtgttttgccatgcgggccaagttggtctggaactcctgacctcaggtgagccacccgtcttggcctcccaaagtgctaggattacaggtgtgagctaccacgcctggccttgccttttttttttaagagacaaggtcttgctgtgtcaccctgactagagtgcagtggtgctgtcacagctcactgcagcctgggcttaaacagccctcctgcctcagcctcctgagtagctagtaccttaggcggacgctaccatgttcagctgttttattttttgtagagatgaggtcttgctatggttgcccaggctggtcttgaactctttgggctcaggcagtcttcttgcttcagtcttccaaaatgttgagattacaggcgtgagccggcaatgcccagccttacttactcttttaattggaatgtttatcttactgagttgacttgatatagtctgaatacaagtctttcatcaggtatgtgattttcacatattttctccctatctgtgccttgtcttttcattttcttctctcttttttttttttttttttttttgagatggagtcttgatctgttgctcagactgtagtgcagtggcatgatcttggctcactgccatctctgtctcccgtgttcaagcgattctcctgcctcagcctcctgagtagctggggctacaggcatgcaccaccacacctggctaatttttgtatttttagtagagacggggttttgccaagttggccaggctggttgcgaactcctgacctcaggtgatctgcctgcctcggcctcccaaagtgctgggattacaggtgtgagccaccgcacctggccttcattttcttaatagtgtcttttagagcacagacacttttaaatttcgatgaagtccaatctgtttttttcttttatggattgtgctttcactgtcgtgtctaagaactccttgctcttaaccaaggtcatgaagattttcttgtaaaagttagttttaggtcttacatgatccattctaggttaacttttgtgtgtagtgtgaggtaagggttgaaatttttacatgtggatatctacttgcctcagccccatttgttgaaaagactatccttggatactattctgtactttttaaaaataaaggtacattatagatttactaatcttcataaagttgtttagacttatttatagctattcataatttttattactaccgtgtatttttaaaaattatattttctgattagataataccccatgtgtaggagaccctgctgacctctgtccattcatctacagcctagcaaccttactaaaattctattagtactgattgtttacctgtaaattcttttggtttttatggataagcagtgatattgtatgcattattcagtggcaaccgcttcttgttttctggttcatttttttttcttatctaatgataatggctaatatcttcagtacatcattgaatagaagtactgaaagtggccattctggccttgttctggactttaaatagtaaacattaatattaaaccatgtgatgtttactgtgggttttttatattgccaaattttccctaatcttaatttaccaataatttttattatgaatttggttttgaatttttatcaagtctacatctactgagggaattgttttcctccttaatctgttttctatttatgtggtgaattccactgttaaatttcctaacacagtagttctcaaacttgactgcacactggaatcacttggggagctttaaaaatactgatgcctgcctcctaccccacaagatcctaattcaagtggtctggggtgcagcatgggcttttgaccttttataagctctgaatgattccaatatgcagctgagtttgagaaccactgttcctagttaagccattcataggttcgtggacatgatttttttaaagctacatttgtgatttggatcatgaattattattattattatttttaagacaggttctggctctgttgcccaggctggagtacagtgatgcgatcttggctcactgcaacctccaactcccaggctcaagtgatcctcccacctcagcctcccgagtagctgggaccatgggcacatgccaccacacccagctaattttttgggtgtttttttttttttttgagacagagtctcactctgtcacccagactggagtgcagtggcacaatctcagctcactacagcttcaagctcccaggctcaagtgattctcccacctcagctaccccccagttagctgagactacatgcacatgcccaccatgcctggctaaattttgtatttttttgtagagacagtgttttaccatattgcccagtctggtcttgaactcctgagctcgagcaatcctcctgccatggcctcccaaagtactaggattataagcataagccaccttgcccagccatgaattttttttaaaggacttttgcatccatgttcataatagattggccactaattttctattctattcttgagtctgttttagtagtttatctagaaaattgtccttttttctgttttcaaatacataatatttttacaaggtcacgtagctagtaggaggctgtaagcctggtgagtttttgcttttatttaataacttgcttttttctaaacaggtgatctgtgtccacgatgtctcatccatctaccgagtccccttgttgttagaggagcaaggggttgtagattattttcttcgaagacttgaccttcctattgagaggcagccaagaaaaatgctgatgaaatggaaagagatggctgacaggtttgcctgcaatgaggagctgggagtgctagcctcctttactcttttgtagggctggtgaagccgactctagccctagcacttttgtacttttgcacttctgccatccactcattagaagagcctttgtagtaagagatgttcagaaaggatcttagctgtcacgtagctgtggcacagatgaggagatcctgatagggccaggccaggtgccgggcctccagacaatgagttcgggttatgtcttaacacgcttgtctcttaccaactagatcagtgcagatgggcgtcctggtggcagcgggtgagtgtgcatatccaaagcccacacgaatggctgacagtggctggagcactcctgggtaccactccagagttctgagctgtgtttgggaatgtgtctcaccccacaccagaaagggatcacattaggacggggatgtgttgctgcctactccactacatccttttaaggctcggtgatgctgtcacattccttcagaaatcttcacttcgtgtcttagagcaatgggcaggccttatcttagttgcaagatcaatatgatggcctagaagcatttggagagggcatactcattccgttgctctgtgagaatcatttttcatttcaacattttcctttcagtctttgtctgcttacatatagctatcagaatggcagttttatcatcctttttcataaaacattataagcattttgctctgttattatattttacaatgaaaacttttaatgagtgtggacttttctattttgtgaatgtcccataatttgtttgacacttgccttcaccccattaattcttgtgaattgtctatgtctgttattttttttggtctttggtatgaaaaaaattttttgtaggcaaatttgtgtgagacgttgaaactctttgtaagtttcaaaacaaaaacaaaaaaaaaatttttctttacaaagcctgccatgttgatctgaaaattacttcctctttactggtctgtacacagaactcagataatagctattcccgttatattcttcccaggtgtgtttttgttgttttttgtgggggttttttgaggcagggtctcacactgttgcccaggctgtagtgcagtggtgcagtcagctcactgtaacctccaactcctgggctcaagatccccccgcctcagcctttcaaagtgctgggattataggattatgggcgtgagctcatcctggccagacgtggttttttttcccttgaaatagctattttggtctcatgatagcgtgtaccttctgagtaattgggtttttcttgacgtttatttgatagatatgatcgcttgctggagacctgctctattgcccttgtgggcaaatacacgaagttctcagactcctatgcctctgtcattaaggctctggagcattctgcactggccatcaaccacaaattggaaatcaaggtaaggagggtggcacaggtacagccaaaggatgagcagggaagcagtctgtagtctcgtaggtgctgtgtcatatctgctttctgtttggagctcagaattactttttaaggaattactttttaaggattaaaaagatttgtggttgcttcgtggctttgagaagacagtagagcattttcaggaattaatgaaggggagagatggctagaggagagggtgagagagacttgagttcttggctatgactatcaggtaaccaaataaaatgccctgtggaaatggggaccactgatggaccacaggcatgctgcacagttgatagctggaggctcttggagactttgttggcatgtgggctgcctttcctaacctgtgcttatcacttattgcagagtgggaatgacagtattgacctcacggagctgtgaggtttctctgggatgcagggcaggcactcagtaaatggtagttactgtgttctggtctgtgccatggcgggcagcagctgagctggtggaatggtggggcatggccctgcttgtctgtgggtggcagtagagtgtcatggttaagagcatggatgccgtggctaggcgcgttggctcatgcctgtaatcccagcactttgggaggccgaggtgggcagatcacgaggtcaggagattgagaccgttctggctaacacggtgaaaccctgtctctacttacaatacaaaacattagccaggcatggtggcatgtgcctgtagtcctagctacttgggaggctgaggcaggagaattgcttgaacctgggaggtggaggttgcagtgagccgagattgcacctctgcactccagcctgggcaacagagtgagactctgtctaaaaaaaaaaaaaaaaaaaaaaaaaacatggatgcctgagcccggtgaccagggctcagattctagctctgtcatctacaagcggtgagacctagacaacttacttaaccctctttgtgcctcagtttccacattgttaaaaagggatggtgatggtgccttcctcctagggttgttgtaagaagttcatgaatacaaagtgctgagaattatgcctggcatatggtaagcactatgtcagctgtcgttaaaccctcccttctgcctgtcccctttattccttttcttcctggcccatcagctgaagcttttcaggaagagatgaaggtcagaggtaaagttggggctcagtgctgaggttgttaaacaggccccatgtagctgtccccacattggggtttgctttctacttcccaggtgtttctcagcgtgagagtttagtttgctttgtgctgctggacaggttcctgcagaatggcctgttgtacgagttttaagaatttaaatcccattacacagccctgacttcttatttgctagttctttccatcattcatttattttatccacttggagttagtctgtggctgccatgtgtttgtcaggtggcagaggatgagagatggatgaaaaggcaacggtctccgcctttaaggaatattgagtctcttaggaaggaaggagcacataggagaggctgaacctgctgtggcagacacatgaggaaggcagacttcctcatggagggacaccaggttgggttgggtaggatggagaaggctcggaaggggcattcctgttagaatagatagagcacgtccaagggcttggagatgtggagcagttggaaacactgtggatggaaattgtgaattggaggctgtctggagacaggctggtgagggcctgcccacaattccatgaactgggccaaatctgggtcttaccctgaggttcaggaaactaactgcagggtttaggtaggagattgtagaaaagtggtgaacaccctaatttaaaaagtgggcacgagatttgaacagacacttccaaaaaaagatgtaggtgataaacacgaaaaggtgctcaacacctctagttagggaaatcagtgcagatgaagtcacaatgagatagtgacacaaaccccctagagcggctgagtgttagagaggctgtggagctcttaccttgctgccgggagtgtaaaatggcaccaccacactagaaaacagtctggtagtttcttatcaaggtagagacgtgtgatccaataagtccattcccagatactcacttgagagacttgaaaacgtccacaaaaaaagatttttattcaaatggacaaattattcgtaatagctgaaatctcgaaacaacccaaatatttatagcctgtcaatggatcaatttgtaatggtttatttatatagtagaaaccactcagcaatgaaaaggaagaaaccaggctgaacactgactggctcaagcccataatcccaacacttagggaggctctgctgtgggaggatcgcctaagaccagtagttcgagagcagcctggtcaacatagcgagacccccgtctctgcaaaaaaaagttaaaaaagaaaaggaacaaacaactgataaacacagcaacatggatgaacttcaaaaacactaagcaaaagaagccagacacaaaaggttatatactatttggctccatttatatgatgttctataagaggcaaaacgaatctgtgatgatagaaattggatctgaggttgtttggggtaggaggtagaggggcacattctgggaagatggtaacttatgttttgttttgttttgttttgttttgttttgttttgttttgtttgagatggagtctcgctctgtcacccaggctggagtgcagtggcatgatcccagttcactgcaacctctgccttccaggttcaagcagttctcctgcctcagcctcttgggtagctgggactacaggtgcatgccaccacacccagctattttttttttttttttgtatttttagtagagatggggtttcaccatgtttgccaggctagtctcgaactcctgacctcaagtgatccacccgcctcggccttccaaagtgctgggattataggtgtgagccaccacgcccggctcattctatatcttggtgtgtatgtttgacaaaactcttcaaagtatgcacttaaaatgcttgtattttattgtatgtgaattatgcttcaatatggtagaaagaaaaagaaaaaacccacaaaagctgggcggaagatgggctgaggaggctgtcattgaacagaaagccctctagagtctgctgcagaggcttagctgagacccgatcctgaacacagtagagtgcagaaagagagagatttgggaatttaatgattttgaaggaaactgttgtattttaaaacctcatatttaaaaaatgtttaagttattaaatatattaagttgatcactttaaagccagtattaagatgatcactttaaagccagaatcaagaaagacaactttgataaaatgataatattatttaaaaattaagaacgcacagcctggggtcacgagcctgcttttctcccctgtctgaataacatccagtacatagattctgcggacttggagcccatcacctcgcaagaagagcccgtgcgctaccacgaagcttggcagaagctctgtagtgctcagtgagtagagttcgctgccttgggtttccagagttcttttggtttgttttaatgaaaaagtcctcttgttttcatgtgccagtagtaggtaattgacttgttaaaatattttttaattgttgaaaagactacatgccatctgatttaatccttaaaaaatgcagcttgtcaatatcattggatctgaaaagctgctctgattttgatattgtttgccatatgcatctattgatgaggctcatttaaggatttttcatccagaacatttgatgagtacccatcagtagagtctcatcagttgttttggcagctgttatttataatagtaaaacattagcaagaatttctggttcactagaacagttgaatattacggaggtgtacaccttcttctgagtgtcttggtcagtacggcacacagagctgatgaagaaaggcccccttaggggagcattttaagccaagaggtaagataaattgttaatattaatatatgtatttaaaattttgggctgggcacagtggctcatgcctgtaatcctaaaactttgagaggctgaggtgggaggattgcttgagcccaagagttcaagaccagcccaggcaacatagggagaccctgtttctacaacaaaaacaacaaaaccagctgggtgtggtcccagctccttgggagatcaaggctgcagtgagctgtgatcacaccactgcactccagcctgggtaacagtgtgagaccctgtctcaagaaaaaaaaattgtgaacaactcagtaccaaagatagtgcagtggcagtattacaattatgtatactatctttttcacttgcaataagcatgttcttaagttactaagaaaagtccatagtttcatatgcagtttctaagttgatagtgtttacatacaattcattgtcacagtagcacaatgtatggggttaattcatggcttcagtgtcttggtaatggcccgttaggcgattattgcaagttggactggtagaaaaggggaattgcctttgtggtttgttcttttgtgcagtggagtgctggttccaggaggatttggtgttcgaggaacagaaggaaaaatccaagcaattgcctgggctcggaatcagaaaaagccttttttgggtaaggagctctgcagtgcagtcttcacttaagagtaggaaagagtggggaacggtgccacgtgggagcctatgaacaaagtggggggattactgaaacatgctgtctttgtggataggagctcaagtagaagccttcatgttttctctttagagacaaattcagtcttggaaagcttatttatgcttatgagctacatgtagatgtcgtggaattttgagagaatgaattgtgaattcctgtccatttaatgaacccagctgtttgtagcacacgtgaggttgagttttatatctgctcacttggcacaacagctgactgtaattggacaaaatgattttgcatgcctcctggtgctgtacattttagtaattttcaacttgaacaattataaataaaaacttaatgagagagggtaagaaaacttgaattttaaagtactgaggctaggcacggtggttcacacctgtaaacccaacacttgtggaggctgaggcaggagggttgctggatcccagaaatttgaggctgtagtgagccaagatctctccactgcactccagagtgggcaacagcaagaccctgtctggggggaaaaaagtactgaatagaatatcacttacttctaaaatcggataactttgcaaatctagaattttcatctactttacatgcagtttttgaaatctaatacaagtaaagtgtaacagcagagagtacttgttcatagcaggaagttatgagtttgcaattataattctccaaataaaggacacaaaggccattgcagaggctgctgggaaaagtaggagctgccttttcaatggagttttgtttgttttttccccccgactggaaggcgtgtgcttagggatgcagttggcagtggttgaattctcaagaaacgtgctgggatggcaaggtaagcgtgcattaagacactcattcaattcccgcttgtgtatttctggaggatatgaggcctgttgccgcctgggtgatcaggagctttggagaagggcaggcctgggttcctagcacctcatggtgtgccgtaagggagctgccttgcctcttgaggaacagcacggctcctccatgcaggaaggagggagcacagccagactccctcctttgccttctgcctctgtgttcctgttcttgagattctgtcactttgatcaccgtggccaccatcctgaagctggtgcctggtgtgaagtccttgtcctaagtgaggcttgggcagttattatgagaacctgggctctggagctattgaaactgggctcagattccaaccttaccgcttatgggtgattttaagcaatttacttagcctttatgggcctccgttttttctgtaaaatgggagtaataaaggtacgtacttcacatgattaagggagataatgtatgtaaatagtctctagtagtgcctggaaaatagggaaatgctcagataatatcagctcttcgcctagctgtgtattactatgtgacagacctccctaaagctcagtggctcccaacagcagtgacttctcatctcagtattctgtggtttggctcagtgcctgggtttcagctgcacgtggtgtactatctgagatggcacactcctgccttgtgttcagctgtgagctcggcccagccgggacgtcaagatgctgtctccacctagtggctcatcattcattaatccagcccaagcttcctcacacagggtgggcagctggactccaaaatgacaggcctgttatgcaggcacttatcaggcctgctgatgtcccgttggccaaaacaagtcacgtggccaagccccgagccggcaggggaggagaacacacatgggtgtgaagactgagcatgctgcactggggccaccctggaatggtccaccacagcccatttattctctgtagcccacccgacaaatactagattttcagaaagaccttgtaaattctgtggaaaataaagtaacctgaaggaatgtaaaagcagtttgactttataaagaacaagtgactctggtggccagcatatggtttagggctgggtttcattcaccctttccctgagaggctgcttcacagtgacctggcggtgtggcttagtttggtagacagcatgcccttgagtgctggcttctgagtcctgagaggcactgtcttatcacccgccaccccagagctggctttctggtctccctggatccttcacagccccagacctctgcctctcacttaggttcccaaatgggtaggtgctttggtgatgagcttacacttcagttgagactggaccctggttcaggccaggaggagaacagtgcccagcgttcacatagtaccaggaacttggtcctttgccttttggtctttagtggttttgctttggttagacggtaagttcaatgaaggttagaaaggttgagttgaaatcagttcatttctgactgagctattgagtgaaacagttgagtagggctttgtattagctgctgaagatgaaagaagtatagaagaaatagtacttgtttatctcagagagacaagagtctgaaacattaagacaatataaaaacttggctgggcatggtggttcaggcctgtaatcccagcactttgggaggctgagttgggttaatcacttgaggccaggaggtcgagaccagcctggccaacatggaaaaaccccatctctactaaaaatacaaaaaataaccaggtgtggtggtgtgcgcctgtaatcccagctacttgggaggccaagacatgagaatcacttgaattctggaggtgtaggttgcagtgagccaagattgtgccactgcactccattctgggtgacatagtgagactcttgtcttaaaacacaaacaaacaatataagaactgtcacaggcggggcgcagtggctcacgcctgtaatcccagcactttgggaggccgaggcaggcagatcacctgaggtcaggagttcgagaccagcctgaccaacatggagaaaccccgtctctactaaaaatacaaagttagctgggcatggtggtgtatacctgtaatcccagctactcgggaggctgagacaggagaatcgcttgagacctggaggtggaggttttggtgccgagatcacgccattgcactccagcctgcccacacttgttgcccacaagtgtgaaattctgtctcaaaaaaaaaaaactgtcaaagatacagtatctaattaaaaattactaggttatgccattagttttgattttcccattttgtactgattgactttccagagagttatacttaacgtaaaaaaattcacgtgtgtgtgggttgagtattttatgtcttaaaaatgctatttattgccggtctggtggcttgcacctgtaatcccagtactttgggatgccaaagcaggaggattgcttgagcccaggtgtttgagactagcctggcaatatagcctttgtctctccaaaaaatgaaaaaaaattagctggatgtggtagtgtgcccctgtagtttgaccttcttgggaggctgaggctggcggattgcttgaacctgggagttcaaggctgcagtgagctatgatcgcaccactgcactccagcctggacaacagtgagatctcgtctggggatgaggtcagggggatgctatctttagtttttgttctaatcactgatcttaaactgaggagggaagttgtgtttagagcttagcaatgaaactattaatcactttcgtttgtaactattttcataacaagtattttggtatttcagatgccaattctacagagtttgaccctacgaccagtcatcccgtggtgagtcaagtgtttgaacctccacagggcttagaagggtgtagaaggggcatttatgaacgtgattgatgattagagacaagaagtgagactgcttgagtccatcccaaagaaccctgaggttttgggcactcagacctaccagagaggaaaaacttttctttttcattatgtaattcctccctaatctttcattgaccacagaaagtttttaagacaggtaccagcccaggaaactggaggggattcctgattaaaattcttctccatccctactcccctcaactcccagaacacagtatagatactaatatgagaccctggcatgtgtacttactgtgtgccagccgctgctctcactgctttcatatgtatattttatattaattcatgggatccccagccatagtcctgggagaactgctgggttggagcactggttggcttaaccgtatccaaagattttccaggctggcgtaccttgcgttagatttcatgccgagggcatgtggcattctcagcccgctgtactgttaggcacatggaggagggacgatgcctttaatcacctttgaattcccagcccagggtgacagggatgtaaagggaagggcacttatttacgtttttcagcagtcagcaaatgtgaatgcgtactatatgctgggactgcccttgtcactgaggacaccgtgctaaatgagacggacaaagttcttgatctcacggcacttagacagcatcactgtgtttgttgacctgaaattgaactttgctgatactaaggcctcaggagtggaccagcaaatgttttgcagcatggggctttggggtcaggaggaacagggcacagagagcctggaatcagaaggtgcctgggaacgctgggctgagaggtggactgggccatcagtgcatggcccacccagtcctcagatgcttgctaagctgcagggtgctagccctgcatcccttgcctttgagcagtcatcaggctagctggggcgatgacagacatgttatgacacatccagtccgtgtctgtgctactgtatcagtctttctaaggaagtgatgcttaccgtccacagtgctggggcgggactagcctgaggaggggctgctgtggtcctgtctgcagatcaggaggacaggctgaaggacggagcctccacccaaccgaggttacaaatgccaactgggaggcattttcttctgtgacaaaatgtctcataaggaaagcctggagaattagagcttacttacaagcctttgccacccactcagcgagggaggtttctctctagcggaagcagagttctgtagttggtgtctgttttctgaacatctccaggtcgtagacatgccagaacacaacccagggcagatgggcggaaccatgaggctgggcaagaggagaaccctgttccagaccaagaactcagtcatgagtaagagctgcctcacgctggcccagcctttggctctgcgtgcccaggacgcgtgtcttagggtgatgctgtggcttcgaggagcaggctggctttttttggtttcgttcttgcttttgaagttcattctttcctctcttattcatacccttttaggatgcactgtgatagccatagaagcagtgtgggtcttagaaaggacactggcagtgcagtcagactcctaggcatgggcgcctcaacagaatgaggcagtgaggttacattcatccttatcggttactttcctattaagaccagccatatcaattgctgatgtttggcaatttttgtcacacaaagatggcaatttcatatgattcagcctaagtagattctgttctaataaagtactaatagatgctgaaggtttagggtagttttcggaggaaaatagttaagaaaatgactattacacagatttccttcttgtctactgggaaaattctgcctttactgtattagcagaggcacccttgtgtctgtctgggcgttctgtagcagcatagctggagtcacttgagtatcggatctttctcttaccaactctgatgttctgtggatttggggatctcgaggcaactgtgaaatgagtcagtagagcagcccgttcgcaaatgtccagcttgttcacatgcagccactgagggctgatgacctttgatgaccatgattggaactgaatgatcatcagaggtcatctgtgcagctcttaaaatgcctcccatcctgccacgttcccagggccttgccgtttcgtacatcctgatttgctttccaaggcagttttctagcagcaaagtgcccatactttgcaatcatgtgtttgagggtggtggtgagagtcttgtttctgttacagctttctgtagtgttgtcagaaagagtcaaaagcccaagaattagtctaaactgtgttgttaagagcaggtgaccttagcagattcatagaaatagccctcaaaagacctggctgtgtggatgatgaaaagtaaagcaggaaggaggatgtctttgtgaacgcatcatcctgtgagataaagttctttacatacagcccgtttgttttgccagggaaactctatggagacgcagactacttggaagagaggcaccgccaccgatttgaggtgaggattccagcttgctggtactctggaaagatagtgagctgagagaccagcagaattatttttcatgcctcaacaggtgaatccagtctggaaaaagtgtttggaagaacaaggcttgaagtttgttggccaagatgttgaaggagagagaatggaaattgtggagttagaaggtgattattcgggcagttttatttaatggaaaacttagtaaagttttcttggcatatgggaaaatataaaaatgttatcttgttgctcctgacctaacagaattaggaagcagcactgtctcatgagggaaggggtcttgataaacatggggtctggactctagaaacttctttctggtacatggccttcctcggggagccatttaacttctggccgcagtttctccttctccaaaatgcttggagttggtactaaagccacttcagccctctcctgaaccgcaagactcagtctacagaaatcctgggagccagggtcttgggcgggaccctggacaggaggccttcagccaggaggggacagcacaaaccgtgctgagaaagggtatcagatcactcatgctttgaggttccctttatctagattcaaatgagaaagtcattttcaaattattttagggcctatggaaacaaacatttaagcagattttgttcttttacactttgtgcataaccttcacaatgaagctgtttcttttgaatctctatttcagatcatcccttttttgttggggttcagtaccaccctgagttcctgtccaggcctatcaagccctccccaccatactttggcctcctcctggcctctgtggggcggctctcacattacctccagaaaggctgcaggctctcacccaggtaggcgcactctttgcttcagtaatccattagtcttctctagtcctttaggtggtcgctgattcattacagcaacacgtcacagtcagtcataagaaaaaaaagccacaggcgcctggggtgaaagtttcctctcctttcccggagctttctcacggtgtttccctggcatattggccaggtccccctttctgcagcatctgagctctggtggtgctgaccagatcacacttggcgtaggaccctctggtccatgttaaggggaactagtttttcctgggaagtaagccacaatgggtaggtttatgtcccattgccacctttatccagaaccagtactcagagttggtggtagggtgtgtgactgaagtataaatggaatgtatatcttttgtagctagaagaaggaaatctttctgcagtttcatgttaaatatattatgtagcaaacagtctttgtgattcctgccatgtgcaggcaagtgtccctgtaggaaccgtggttacaaaaacagggacgtaaagtgagtttttggtgggagatgatgcgtaaaccatctgaattctacagggacacctatagtgacaggagtggaagcagctcccctgactctgaaatcaccgaactgaagtttccatcaataaatcatgactgatcttgtagcgtaagtggtactttaaagttttagtttttaaaaacatggtgataacacactgcgattgcaagaatatcatggaagtttagggctgaaaatttttatctgccaggaatgaaagtggtgaggtcttgaatataatccagaggttgagagagaaaagaaagtagtgaggtcattgtgggtatcaaatgggcagcccttcctccaagttgcagtgcacctcccagtcctgccctggggatgacagcttggggagcatggtcactgggcagttgtctcaatactgattactacattctggtgccagtctgaccagttctggggcggggaaggggagggtctgaattcttagaccctattgtttgatgtagctgtaaattttggagatcttgaaggaagggacagatacaacaatgtggcacttgtcatttctgcagagcctcaggttttcatcaggaagtactttaaaactgacactgcttagagaacttttttttgttgattgctgcttattctggaattccttcaaagttggaacaattgccaaatagacgtcgaatgtttgtctattaagtgacagggtttgtaggttcataaagtgcaataactgtgggcactgccacgaaatgtaaatgtcctttgagataactgtgtggactgtgttggcagaagtacgcattctgctggtgaggtatcaaatgagggagtgtcagtcatctggggtctggaataagaaccaggggtatgggtgtgtggttccaccgctcctgccctaaggcctgggcagggggacctccctgaatcctgcacaccgtgtgttcatcaccagtgggcctctggtgctgggtcagtgccggtctgacctgctgatcccagctgtttcccctcctgccttggttggttgaccccctgtcctggcatagcctaagtaggtggtgggtaggcatgagaagttagtatcaggaggagggcctgtgtgctaggtaagcgtttaacacggatggactcattaatcccctgaccagggagtttgctataggctgtttcacagtcttaaggagctgatacaacaagaactgttaccagtgaaggaggtagatatttggtcagttacatggaatttctgactgcctcgcaagtggagaattgcccgttagtgacactgttacgaggtgctgtggagaaagaatgcttgcattgggtggttgtagaagtcgatgtgtgaggtcttgaaaaggtctgattctgtaggaattataaatttagcgtctaattattcccagtaggctccttctactgctctgccatgaaaaacaggcttagtttcccatggcagctgactagaaattctaacttttctactttaatgtacatcatataattcccacttttttttttcttttaaacagggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggtgggtggggctgcagagtgccccatcggtcaccttgtttctcaactacctcgcatcattgcagatgctagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatgaaacaccaagatgtctgtctctgaagcgtgattttaaaatccccatgcctgtggctgcgcttcctatttctagggctgggaaacactccttgcatcaaggggtcacttacagaacaaagaatcttttgggggaaacttcctctaaaaccctctcatatatagacagctttgactggagggtccatttttcttccaggatggtgttactgcagttgaaagggcaatatgaagttactttcttaatgtgacctagcaataggcatagctacgtggcactatattctggccagactcgatgtgtactctaacttaagaaataaatcagtaaggcagaacaaga

SEQ ID NO: 1650 - DNA, 16961 bp, Homo sapiens
tattacataacattctttattttacaagtatttattgaaggcttattattggtcatatatcgtgtaatacatagggaatcaaatggttagtaagatggagttgatccttgccctaatgaagtttaaagaccagagaggaatacaaacaggcaattatgacacagaatactaagccttattatattcagggatcttctgacacatgtatctgcaattttgtactcactgaatcttctcttccataataaaagcatgttgatgcaaaattactcagataaaagaactcattagtaatttttaaaattccatattaaatatatatacatatatattttaaattttttaagttccagggtacatgtgtaggatgtgcaggtttcttacatagataaacatgtgccatggtggtttcctgcacctatcaactcatcacctaggtattaacccatttatgccagaggttgcaatttgttgaatgtgaaaaatcagaccttggcaatgaccttgagcaggatataaagaacttccacatgcttagcattccagaaatggaacactaggcataaatgggttaagcccagaatgcattagctattttttctaatgctctccctcagcttgaccccccaccccctgactggccccagtgtgtgttattcccctccctgtgcccatgtgttctattgttcagctcccacttataagtgagaacatgtggtggttggttttctgttcctgcattagtttgctgaggataacagcttccaactccatccatgtccctgaaaaggacaggatctcattcctttttattgctgcatagtattccatggtgtttatgttccacattctctttttccagtctatcactgatgagcatttgggttgattccatgtctttgctattgtgaatagtgctgtaataaacatacatgtgcatgtatctttgtaatagaatgatttctattcctttgggtctatatgcagtaatgatatttctggttctaaatccttgaggaatcaccacactgtcttccacagtggttgaattagttgacattcccaccaacagtgtaaaagcgttcttatttctctacaacctcactagcatgttgtttgactttttaataatcaccattgtgacatgagatggtatctcattgtgattttgatatgcacgtctctaatggtcagtgatgttgagcttttcttcatgtttattggccacatgaatatcttctgggaagtgtctgttcatgttctttgccaactttttaatggggctccttttttcttgtaaatttgttaagttccttgtagattctggatgttagacctttgtcatatggatagattgaaaaaattttctcccattctgttggttgcctgttcactctgacagtagtttcttttgctgtgcagagctctttagtttaattagatctcatttgccaatttttgcttttgttgtaattgcttttggtgtctttctcataaaatctttgcccattcctatgtccagaatgatattgcctatattctattccagggttttataattttgggttttacatttaagtctttaatccatcgtaagttgattttcgtatatggattaagaaacaggaacagtttcaattttctgcatatggctagccagatatacagtaggattaattgaatagagagtcctttccctattgcttctttttgtcagctttgtcaaaaataagagaagaatcaaacagacacaataaaaaatgataaacaggataccaccactgatctcacagaagtacaaacaaccaacagcaaatactacaaacacctctatgcaaagaaactagaaaatctagaagaaatggataaattcctggatgcatacacactcccaagactgaatcaggaagaagttggatccctgaatagatcaataacaagttatgaaagtgaggcagtaataaatagcctactaatgaaaaaaagtccaggaccagatggatttacagttgaattctaccagaggtacaaagaggagctgataccctttcttctgaaactattccaaacaattgaaaaggagggactcctccctaactcattttatgaggccagcatcatcctgataccaaaacctggcagagatacgacaacaaaaagaaaacttcagtccaatatccctgatgaacttcgacgcaaaaaatctcaatgaaatactgataaaccaaatccagcagcacatccaaaagcttatctaccacagtcaagttggcttcatccccaggatgcaaggccggttcaacatatgcaaatcaataaacgtcattcatcacataaacagaactaaagacaaaaaccacatgattatctcaatagacacagaaaaggccttcgatacaattcaacatcgcttcatgttaaaaactctcaataaactaggtattgaaggaacgtatctcaaataataagagctttttatgagaaacccacagataatatcatactgaatgggcaaaagctggaagcattccccgtgaaaactggcacaagacaaggatgccctctctcaccattcttattcaatatagtattgggagttctggccagggcaatcaggcaagagaaagaaataaagcgtactcaaataggaagagaggaagtcaaattgtctttgtttgaagataacatgatcctatatctagaaaaccccatcatctcagcccaaaagcttcttaagctgataagcaacttcggtaaagtctcaggatacaaaatcaatgtgcagaagtcaccaggatccctatacaccaacaaaaggcaagcagagagcaaaatcatgaatgaactcccattcccaatagctacagagagaataaaatatctaggaatacagaagaagtgaaggatctcttcaaggagaactacaaaccactactcaaggaaatgagagaggacacaaacgaagggaaaaacgttacatgctcatggataggaagaatcaatatcatgaaaatggccatactgcccaaagcaattcacagattcaatgctattcccattaaactaccattaacattcttcacacaattagaagaaactattttaaaattcatatagaaccaaaaaaaagctcgtatagccaagacaatcctaagcaaaaagaacaaacctggaggcatcatgctatctttcatactatactacaaggctacagtaaccaaaaaagcatggtacaaaaacagacacatagaccagtggaagagaatgaagatctcagaaataagaccacacatctacaaccatctaatctttgacaaaccgtacaaaaacaaacaatagggaaaggattccctatttaataaatggtgctgggagaactggctagccatacgcagaaaattaaaactggacccctttcttatacctatacaaaaattaactcaagatggattaaagacttaaatgtaaaacccaaaacaataaaacaccctagaagaaaatctaggaatgccattgaatatattttttacatatcagttgctttggttatatttacatcctgaaagtcagcttgaaatatgcaattcttttaaaactctgcaggaaggtaacctgataatattctttagagcagggaatcaaaaaagatgtatatggcaccattcctgatttgtctttctagaatcctacaaaattaattctttgtaagttggtaatacttgtgaaaagtctgcaaaaagaaaagaaaactgtggtgcattttccaggtacctacaaagttctatgtgcattaggtgttgaagatatacagggagaaatacagattttcaatctggaaagagatgaaaacatgctacccaatcactccattacagcatggcatgaaagcagaggtacctgcgatatgcaatgggaaccaaagttctgatgtttctcacggtaatagagagagctggggagggtttcagagagcagcgtcatcaaggtcctgagtgataaagaatttatcaggtccagaggtgagatagataaaagtttccaggtgggagcagtccactgtactcttaattcatctttctgaaatacttcttctcagaatagcagaacagtatacctctcagatcatacaaagagtcatctgaatcaacagagtaaggatgacaaactactctctagagaaaaattcttctattcaagcagaaatgcaagagaggaaagtccacccagacaatatgaattaaacataaccccataatttcaggcttaccaaagctgaaagaagtcagctctaaaccaacagagcaggaaacaagaccattattcggcaggaaagagctagaagatagcaatcagttgaacaatactgtaattaagattagtaaatttgactatgacacttagtttgtacttaatttgaagtttacaaagctcttctaccaatttccaaactacaaactgaaggagaaggtaagttttggtcttcaatgaaaaaaccctggtttaggcaagaaagtcagtagcctaatagctaaggaaacctaagcttcaaggcagttcttctcttaaaacttcaacatgagcccatgcaacattaaactaatattcatgatgctcacagactggaatttaccaggaaatccaaatatgcctctaaataccatttacttatttgtgaaatggcttttttcactatttagccccaaggaagtctttaggcttgaaagacaagttctagcattttacagttagaaactctgtgagcttagcactgtaagagattaattttctctatctataaaatgaaactagttatatctactttacagaacttttgtagcttatagtatgtcaacttcttagcacaaagcttgtacctaatgaaaaaagaaaagaaaaaaaatagggtgtttacgataccatctttctggccagaggtactggaggtctataatctgtagaagtatactatagcagtctgacatatctgagaaagcctcttttttcccttctttaaatatgtcctccataggaccatcttcccttcaataacttatatctgtgaatctcaagagatccaagggccttattttctccttacaacaggctcttgggttcctcaaggtaattagagaaaggaaagacactcaggcagacagttaaactgtgaataaaatttacgctgtgaataaaacaaaacatacacttcaaatcctgacaatcttagaaaaaaatcactgtaatagaagggatttcaaaagagaaaaagaacaacgtgttgtatattgttccttttattaaaaaactgaacggtgaagccacccaagattttgcatcttcagaatttttttttcctttctcctgtgtagtctctggttgttcacattccaaaatgatgtttactgttttccaagggagtgttcaggagggcagctgccttggaggtaggtcaccaggactcctttgcattttgcatgcaaataaagactccagaagggactgtagctgctagaggcctttgctagctgctacaggtaggtccacactgtcgcaggctgctctgtctcttagccccaacgtctgttcatggctgtggttttaaaagagtccctcaacagatgctctatttaataactacaagacaataaaaactagggttacaagccaacaaggatcatattgtctcttaatatttaatcatatcagtttctttaagtaaaaaaaaaaaaaaataccagcactgatatttgagatcctggtatatttttgtaaatgttaagacattcacaggaaagatgccattctgaagctaaatgcttaagcaacatgtactgcacatgcaaccaacatgctttagaagcacatgcatctgaaggtaactgccactgaaaaaaacgaatatgtttctgaaacatacttaagaaacaggctaaatatagtaacttagatacattaacatgtataccttgcaaactttaatttaggctcagtgctgcctgaatccacatgactaggtactaggctatttatcccatttacacaacaaattaccagggtttatcttttctactggtggagcggtctccctaactaggagaaagagtgaagagttaaggataaaattttgtaaactgtattttgagaacagcttatttttcgtggaaaaaaaaaatagtgaacctatctgggaaaagtttcctattgcatcttcctcctaagctaccaccatacaatatattacagactctgagaagttctgaaataaagaaaactatttaatacattctatatttattcaactaccagaaagaactgagaagaaacagcttactaatttcaaccctaatgctcactttgatctgttattagtggctgtatggaacattgctgaagcttaacaagataacgcgacacaactgatgagcaattcctacctggcagatgtgtgggtcactgctggttcattataaagtttggaaaatgctaatataagataaacctatggtgctttcaatacttgttcccagttccctttttcatatctcacttctggtatttaagagccaagtaacagaggaaggaaaaggggaaagaatattatgttaaaatgcaaggaagggtaagtctctattaattttactctctaatcacctatttcttcatcaacattttagacatttatggatccagtgtgagcaatgatttaaacatctattctgaaaatgtgaagagaatgtaaagagtgaataagattctctcctcctcagtgaatagtctattaagactattttaatagaagccagttttacaaagctgggtcatgtcagataagtgatgagtatgtcaatttctctgtaaaagccaccttctctgtggaagacagatctaagctgctgtggcctcacatgtttctctcttgagggattcttttcaagaaaagaataagcaacctaaggcagcctaactactttacgaatgtgaactgaacttgagtcaaccttttttttagctgggtctttacccttttcggttcacgtctacttaggttacaagtagcattcttgggagagctgatttgacatgtgaaaacagaacataataaagtagaaaattactcacataaaatagtgcagacaacttagaaacagcagacaagcaggctcaagcaagaaattcataagaaaaccataatctctccagtcaccctctgatgaataaataggcattaatttgcataagccatcaggaagtgaggaagcttgcttttaataagaaagttagaaatttttcaatggagctcacccagtttgttcctcagatgtggcaaatcatatatccccacagttcccagctgcatgaacaaatgactgataaaatcagtgacatcctacaaagagtttacaatggtaaactgagtcattatgttgagattaagcatcatcatgaaagaagacataaaatagttaggcaggcactcagtgctaaacttctgatacttttcctccactgaaatactcttacaagtaaacccaaagttgtttaaaacaaaacaaaaaaaagacaaaatgctgagcttgatatattgaatccaaattttaaaaagtatacctatctcaataagtcttctaaaattgttatatcttaataatgaacccagaaggctcagtgaaaaaatgtcacaatattcccaaatcttttattgtagaaacacaggcgacatttctggctgtgtgataagcttgaaatttattaatcactagcacacaaagtgagaaattaaaccctctagtatggatttctcaacatagagttcttgtttctgtttgttttgtttttgagacagagtctcactctgtcacccaggctgaaatgcagtggcacaatgtcagctcactgcaacctccacctcccgggttcaagcgattcttctgccccagcctcccaggtggctgagactataggcgtgcaccaccacacccggctactttttgtatttttagtatagaggggtttcaccatgttgaggctggactccatcttctgacctcaggtgatccaccagccccagcctcccaaagtgttcttgttttgagtagcaacttgctttagaaacactgatggtcattttttttagcttatagttctattaagattggagcctttcaaacaagagctcaattagaaagccctaagatttgcttcactatcaccaaataaaatttccagccataatgagtctacttcccctctacatatttcctcagcccttgagtagcttaatcttcaaaataaaatctgagttccttctctactgctcccttttagagtcagtttcttttactgcctcagagaaagtaaaatgagaaacagtaggttagaaagcctattcaggctgggcgtggtggctcacacctgtaatcccagcacttggggaggtccaggcgggcggatcacttggggtcaggagttcaagaccagtctggtcaacatggtgaaaccccatctctactaaaaatacaaaaattagctgggcgtgatggcgggcacctgtaatccaatctactctggaggctgaggaaggacaatctcttaaacccaggaggtggaaggagcgagggcctgggagacagagctagactccatttcaaaaaaaaaaaaaaaaaaaaaaaaaaaagcctattcaacaggaggtcattttttggagcttagtttgttttacaggacttcctgtctctgggcaatttggtggagagaatgctacacagaggagctttatacatgatcatcattaaaaatgaacaaagtacataagagcataaagaagaaaaaataatcacatatccagccatcatgtaaagtcagacataattaagcattttcacagtattctgtttcgtgttgttacattgtgtgtgtgtgtgttttgttttgtttggagacagagtctcacgctgtcacccaggatggagtgcagtggtgcaatctcagctcactccatgctctgtctccagcgttcaagtgattctactgcctcggcctcccaagtaactgggactacaggcgtgcgctgctatgcctggctaatttttgtatttttagtggagatgaggtttcaccacgttggccacgctagtctccaacttctcaaagtgctggaattaaaggcaggagccaagctagcctgcattgtgtttttatataggagattgcctgcaggtacttttaagaagtgcaaatttgctaaagtgtgccaagtacaatgaaatggtaaatgctactaaaatctgataatcttagaaactggcctgtagatagtattgtcttttgttttggccagcccagtgttttaaaggaaatttgaatttgaatgcctctaagactgtttccatcttgccacaggcctgattactccttattagtttacataaggttatttcaaatgcttagatacccacccacctgagtgggccctaaatgtaatatgcaactcccataaagtgctcagataataaaatgcctggaggatgctgagtaagaaaaaatctttcatttttttattattattattattttgagacacccaggctggagtgcaatggtgtgatctcggctcactgcaacctctgcctcctgggttcaagcaattctcctgcctcagcctcctgaatagctgggattacaggcatgtgtcaccgcacccagctaatttttgtatttttagtagagacggggtttcttcatgttggccagactggtctcgaacgcctgacctcaggtgatcgcctgtctcggcctcccaaagtgctgggattacaggtatgagtcaccgtgcctggctgaaaaaaatattttaaaaacatacctagtacctcctgctcaactcaaactatgcaaaaactttagatgtcaaacttttattccttccaaacttttatctagcttgaagtcacatccaaatatatgtatctccatccctactatacccccaatttctcaagctgttaaaaccaagttttaaaatggcttagaaatctcaaatcataaaaaatgtttctctttcagataagccctgaataaacagaacttaataaagcaagtttctagcaataggagctattctgattgattccgaagtggaatgccgagaatggcaaagaagctgtgtctctcctggtgagatgcaggatgctgagggaagcagaaggtaaaagcaggagcctaaaagaatgctgtggtgtggaaaaactactcaacgtgctttttcctattctcagtcagcaacaacaatcaatacaaaagacttcggtgaccccaaaatatgtaggaagttctccccaccagcaagcaagcaatcaattctgcagcagacaccagctcagtgccctccagtacaactccaatgctacctaccaggagacagtttcagatcccgtaggttgagggcttagtccccaagactgcctgcccactttagacaccagtctcaagtccaggcctccagaacttctgatggactggcttcaaattggggttcccataaccccctctttgggttcaattaatttgacagagtggcataaaaactcagggaaacatgtttatgatttattacaaaggatatttgaaaggatataaatacacaggcacttgaagagatacatagagcaagttctggaagggtcccagacacaggagcttctgtccctgcggagttagggtggaccacccttccagcatgatgagttcttcttcaccttcctgtcagaccctacatgtttagcgcttcagaattccctcaaatctgttcttcttgggcttttatggagcgttcattgaatacacatgattaaagcatggataaccatgttaaaatataattaggttataaggacatgatctaaacctaacaaggcctgtctgttcagattcttcttggtgtctctgtgcagtgttccttctgctatggtatggggcagaatactctctggtatgagggtcttagaaaccataatcagattagagttctgcagtgggcagatgaaaggagggtaggagaagatcagagagagagattctggtttctgtaacaagggtcttgggagtgagttatgagccaggaaccatggacaaaacctatatatgtcataacatacaaatactctgcatgtaccaactactcaacaaactcgagcagcaagaacaataagaaacaatctacttcaagcatatctgaagcatatataaagaggataaaaggaagcaagttgtagggttccagtcagtggagaggcgtgaaaatccaattgatttgtaggataacaacaacgatggcaggtaagcatggcaagaatttgtcaaatatttctgtaatggcagtaggttgagtatgttttcgtttatgtaagactctttgaatagcaaatactactcaagttttgatgttttctctttttacaaaaataaattttaatgtaaaagatgctttctaattctataggaacaattctcacatgcaatacttattacatgggcttgtgttttccttgagttacgcatcctttcaagcacggtttccccagctgcaggaaataccctgatgcttatggtaaaatctgtaaactttctgtattaataaatgtcacccatcaacagtggatgactttattattcaaagtcaactccatcttaatatctttcttaagtttttaaactctgtttcccatcactcttgcaattggatttactaaaataacatggtattttatcactttgcaagctatgtttatctggaactacctgattatattaagtttcaaaaagaagtatcctattatattctactctgcctaaggaaattatggtgcttgtcataagacctaactactgaccagagtggttgatttttctgcagaaaaagaaaacatggccctgataatggttttgtcaaatgggcactttaaaatagacatatcctgaaatcagtagggcaggagtattttttctattgttattcctaatgaaagaataaggattcgatcaatgccatccagaaccatatgattaggcagggttctaccctccaacagcatatatattaattctttccaactcatggttgggaacacatataactttatttggctttaaaaagtgattttctattgacctaatgtgactaatgttcttaggcaatggcaaaacaccaaatgtgcttacaccgtgattcacaaaaagtgatacaattcctcattcagccaccagctaattccctctgtccctaccagctttggactactatttaagctaagaactaactgatgaaaaaataataaaagaagaaaactgcttttgtctatatctattacatctctggtaattaaataatgattttagaagtttccccaccagtttctccaattctgcagaatttaagaatcaaaagttttctaagtcaaaagaataaactatgtacttgtctctttttacctattcctcatctcctaaataatttatttaacctatttcccaactgaattccacttcattcattcattttttttgtaataaattgactaggtgtctattgtgtgtcaaagaagaagggatagagacagaggaaaagaaaatgacaaaaaattatgtacaaggtttatggtacatggtaacaattgccttgaatatctcttcctttgcacatgcattccacatgcaattgattcttaatctgaagtcaaagaacctttgaagggctgtgacagagtaactgtaagaggtctgcaaaggcctaggctcatcaacgtatacaccaaagattattttcaggttaaatataccacatatacattacaattttaaaaatttatatagatactattgtaagtatgttttttacaaaaaaaatgcgtagcatctggaaatgatactaaaaatagttaacaactggttaagcatgggtttccactaattcagtggactggtggccatcaacagctagcatggacaaactggtttccaccagctgcatatcacaccagcaaatccagttgaggaaaggcaacctcttcctctctatttcatcttttttttttccatattaaagaaaggtccttattttaaaaatatttctgggagttattattctaaaaaatattgtaaacttgcttggaccgccataaccttgtgacaaaccacaactcccatgagaaattataacaagtttagaactaggcctttgttggtgctttgtcttttatcatatttaacagagttattccctactttcccacttcttcccagatgttttaaaggctgtaaacctttcaccatgaaaaagtctgtcttaatttatactctatgtataatgagaaacgcctagtttcaggcttatgtatccaatttacttgaaccatttaatatttagcttacaagaaaagttccagcttgtgaagaacaaatgaaatgggctgcaatttgtgctaaactattttaaccctgagtatgtttgcaattggaaaaagtgtgttatgagaatgaacaatagttctttcctaatgagagaaggaaacaagctgggttgacttggctacctttcactttaaccagcctaagggagtaactcctaggttctctctttctgttagtttagaagaaaaaattactcaacatatttagtacatttaagataatgaatcatttaggcctatcactacctcagccaacaggtagtgataggaaggacagcatagtaactgcaagaaaacaaaatgtgtaatctctctatctttcctacagatttagaacaaagccaaatgactatggcaacatttagaaataaagtggtagtaataaggaaaataaattaagaatttagtcatacttaccaaaatgtaaattttaaacataatttatacatattcaaatgtagcactggtattttgtaaacctactaaaatcataattttaaataaagtggcaaaattataccaactactactactcttgggaagagtggtgtcaattccggtcatcttcttaatctaaaattaaaattctgagggtctactaatcagaagaggtttcagatatcaaatcattgaaaatgtaaatccaacttccaacaaaactaaccttaaaaaaggcaaaccacttgtagtcattcaacacaatctcaaagccttggttgtaaatgatggtgaaatggccagaattgccaaggtcatcatatgctgtatccagcttctgaaggtacaccactacttttttttcttgtggtcctaaagaaaaaaaaaaaaagcacaataaaggaaaattatttggatttcaataggggaaagaatcccccaatttcaattttaattgtgctgctttcctttcatgctacccagtttgagcacagtctgcctagtgaagaaaccagaggctccatcttgttgcctcaaacagttcctgctccgaggcaagactgtgaagttaggctctaaaaatttgagataatgcaagcagaagcagtggctcacgcctgtaatcctagcactttgcggggctgaggtcagaacttcaagactagtttgggcaacatagtgagaccctgtctctacaaaaataatttttaaaaattcgctggttatggtggtgcattgcctgtagtcccagctatttgagcggctgaagctgaggtggaaggattgcttgagcccaggagttggaggctgcagtgagctatgattgcacaactgcattccaacctgggcaacacagtgagaccttgtctcaaaaaagagagatatgctatgcagcccagcaggcagggagacccccaaaactacagtacctttccagagcatcccaacactgaagaaatttttccactgaacaaaaggagaaatggggaatgttgaaaattacaggcttccagaaacggagaaaaggcaaaatgctagtcaaaagtgggaaatgcaagaataaaaggtatgacaacaaaaagataaataaacagactatcagatcctaaggaagacaatgtgctaagcccaggagaagacacaaaatgatctattcggagaagaaatggggtacctttctcctcaaaggctctacagtttagaacctcataatctgaatccttccaaagtttattcagcaaactagaggtctgtatcctataaaaccaattagtgctgataggaatgatacgtttaaccttcatagatgagggctcagacctgtgggtgcctttaattactgaattaaggccaaaggtaattttataggcagagccttcctgaaaatgattcagctgtgtccatctggagagttgtgtattttaaagtttttccatgtttgagagtaatgctctgacatgggagattgcatgtgacagggcagtgcaaatcctgatctctttctgccccaaccttcaaactcaaatttaaaaaaaaaaaaaaaaaaaaggccaggcgtggtgactcccgcctgtaatcccagtactttgggaggccgaggcgggcggatcacgaggtcaggagatggagaccatcctggctaacacagtgaaacccgtctctactaaaaatacaaaatattagccgggcgtggtggcatgtgcccgtaatcctagctactcgggagactgaggcaggagaatcgcttaaacccgggaggcggaggttgcagtgagccgagatcccgccactgaactacagcctgggtgacagagcaagactccattctcaaaaaaaaaaaaaaaaaagttacaatgttcaggattatgaaatgctatacagtcagttaaaaaggtatttctttagtaacaaatgacttaatctttgttctgttgacaagaaaattatagctgattttttactgactctgcagaagtcacaggctgtaagagggtttgggtagaccacagtgtgactcttctaactagtgattgtcttttttccaccccacccccttcactaggttctttgttctaggggtaaccatgttatctgaaggcatatggaatatctccagtatgttcaaacactaggtatttattgagagccttccatgagccaaacattgtgcagactctgggcatttctaattactaggttcagagttaagttttctttgttattaattttttaaaaaatttttacctccttgcaatgcatgaaacaatgcagagtggtactagccgttttctagtactcatcaacacccgctcaaaccaaaatcgctgggcagaaagtccctttcccaccatctaacaaaaagagaaaacttcatgctatatcctcgagagtctctgagctcatctatcttcactagtaaaatagtaataaaaaataaaaataaattttaaaaataacgctaccagatcggactggagaaccaaacgattgcagttcccaagtctctctcaaagcaaacaaaattaagcgggaggaataaaaaagttcttgatcaaagtgttgagtccccaagataaccaagaaagtgtggagttagaagttctcagcagatgaactttaacttcgcgagcctggcggggaagaaggtccccaagggtccccgaatccagtcaagatgctctggccacccacaagcgtctgcctggggggaagcggtagttggcgtggcgctgcgttaggggctcaagggcagaaaggacgacccggaggactgccgagccggcggcttacccataaccgagcagttgacatcgcgctgggaaccgctggagcccacctggaagacccaggtgcccagcaggtcaagataggtgcagttggcaggtgtgtcgcagcgcacggcgccgtcgccggagagaagcagcaggagggcggcgagcagcaaggagggcccagcacccatgctgcagggagctgagaaaagaggtgaagaattaccaggaagccgagcgctgcgggctagcggtgagtccaccacgaggcgcgcgccttgaaatagctacg

SEQ ID NO: 1651 - DNA, 16961 bp, Homo sapiens; identical to SEQ ID NO: 1650

SEQ ID NO: 1652 - DNA, 44182 bp, Homo sapiens
tgcagttatttttaaaactttattttaaaaatatgagcatctattttaaaagttttgataattattgccattattttcttgtgattggtacaatttaaaaataagtctatgttttcacattgattttaaaaaatatagcatgtttgaattacaaatgattaagcaaactctattacttcatagctgaccatcttccagaaaattcccacttaattgaatacttagaaaaaaatggccagtggccgattgaaaggtatattaaaattaagggcagttttaattctgaagacaaatatcttcatggaaatctatttgtaagcttctgagattgctgctgaaagtctacagtctgtgaatataccaattcccctttacaactgatgcagatcattatgaaatactggaaggcataccctacaatttaggaattggtgtggctgccactgctatgctctcaattgcacactcatcagttcctctgcggatccggaagtagccattctcaccccagccggtgccccagctgtttttaacaatccagtaatccatcccagaggctgagtcagtgccatagcccacaagcagaacagcatgattagtcagctcaaaggggttgaaagggtctcttagaccagtgtggtggtagatcccctttttgtagtggaggaagtcatcatatacttcaaaagcaactgccatgggcccatgatggaccaactcaagcttcatcagggcttcattgcagcctccatagaaacctcctacatagtggtactcagaggagtaataacgaaagcagtcttccttcattttgcatggagaatcagtgcctgtgtaggggaagcaagcttcttccaccagcccaaaatcttgggcgtactttcctgcaataaggtatgggaagccgccttcacagcctgaagatgaataacacacatggttaccccttagtagaaaaaggattatcccattttctattttttcttctttgctccattattctttgcatgttacccctgaaagttgttcttagcttaagcatcacttcattcatccatccattttccaactagctaactatcctttcatcctccttctacttaacagatatctacttagcacctaatatggatgtagctatggcaaagtggttaagtggggaggctctgaagcctatataggtttaaagccaaagccgtgtgaagagtttaacttctctgtatctctgcttacttacctgtaaaatctagatggtagtagtactttcctcatagggttaaattagttacttcatgtaaaaatagcaaaagttaggtattatggtcattgctaagcagccagaccccacaacttggctctttctcaagcaagtcttttccctgacaacctcttgccgaaatgtctttcctaccttcctcatgcagtcctggccctattatatatattataactctgtactttttcttcactgttcttcactctgttgttataattatttaatctctatctcttacttaactgtaagcttcatgaggataaagattgtcttgatatattatagcccctatagcctacaagtcacaactagtagtacatattttagaaagaatgaaaggctcactggcaaataatcactcatcagcagtttcactagtgagctgggaaattcctagtggccaaatctgggcttgaaagcataaactttaaaatggtaacgtttctccctcaatcaattatagctgtgttttcgacatacatcacatacagcctgatctgaaagcctaagtacagattttttttttttcataacagggcctcactccgtttgcccaggctggagtgcagtggcatgatatcggctcactgcagccttgacctcctgggctcaggtgattcttacacctccgcctcctgaatagctgggactacaagcacacaccaccacgcccagctaattttttgtatttttaatagagaaggggtttcgccgtgttgcccaggctggtctcaaactctaggactcaagagattcacccatctcagcctcccaaagtgatagggttataggcataagccactgtgcccagccctaagtacagaattttaaaattctcccagagagaaaccagtgttagtatagttttaataaaagttgggttttggagacgatgattagaagtgaaactccaatgctaaaagctgtgagaccttcaaattattagaaaaatttcttagttcctgttccccgcccataaatagggattatacttactacttctcagagttttgagcattgttaggcaatatatgtaacaagcagagctcactcaatatatagtaactattgacattttgctggatggtacagtaaattccatgagcaatcatccattaataagtgatagggccagacttgcactcagattttctgactatagacactgcgctctctctactgcatcatccttttgcctttgccaacaacagccagctgcacacaggtaaatagctcataaatggtgtctgaaatgcaacacttaccttgagcatactggctacaagacacaacctcctgagggcttaggattggggtctgagaattgttggttagtatacggattctcgcttctagcatacccatagaagcaaatgagtagcagctgccacaggatgctggcgatgaaaaaaagacacataatccaagagacatctgaagcctcacagagaatcatgcaaaaaccttagtgaatcacatacattaatgtttatactgaatgttgttgtttataagaatcagcacaataagaagactcaactaacaagcattgttgagcttattaaggcaatcattaagatttcatcctttttcatcaaaaggcaaacattagtacatgggactttctttgagaatattttagaaactaaaaaaacccctcataatttctgagaagcttttggcaatattcttgataatgatgaaaggatttatgtctacaacgttcaaagccatcaggttgggtgatggaggaatacatgtgagctgtggaggaatacacgtgagctgagctttcaaatatctctaatgcaatgagatgaaggtttatgtccctctaaaatcatgttaaaaccccaatcccaaaagtgatggtcttaggaggtggggcctttgggattagtgacctaatacaaaaggctccagagagaactctcatcccttctaccatgtgaagttatagagagaagtcagcctgtgagtcctatttccttttaactactgccatttctgatgttccctaaaattctccccctaaaaatctcagattgaccatattgtacactgttttgctactgagagattatctaaattatgaagattagaaaagcacttggaagaaggacctgtgaattcatctagtgtacaacctgctcacttgatagataacgtgtaacggtggctcagaaagaagcaatgagctgtccaaggacacacagctaatagatagcagggacaagtgccttactgtctcctaaggcaggattagtgtccttttcaatttatgggtctgtgtctactttaacaaatattcagattttctctccctgtctcgtagtcactagacagggcaaaattagcttatatcttttgttttcaaaaccatgcagatgatactatccataggacccatccttcaaatgacggaatgtcaaagaacattgtacattgtacactgaacatataactgtgttcagcagtaccttccaacagtgaagaacacactgaactaggagtgaggatactttttttttcctcctttcttgttttgcccctcattagctgtgcaacactggacaacttacaaatacaccttggcgcctcatgaaaggaaaccaatgtcaaagaaataacacaacccaggagagtctggaaaaggtccctttctgaccacccagctttcttggcccatagcagccatggaaataatctctctcagtactggtcattaaactcccattatctgaccatcgatcactgtgggaggcacaggctgcaagtgcattcaagggctctgaatgtgttctatttacagagcaatcacaggaacaagggaagaagataaacttcatcaagcccctgacctgtaagaatgtgtcagctaccaaggtaattaatgcctcatttcaacagccaaggccaatctgattctaaaagagccatttatctcttaagaatactgcaatgcaataaagaataagaagtgaatctagcccagccagagctctgcagtaatcaaatttctacaatctcaaatagatagtgtgatcttcatatggtataactatgttcagcagcaccttctaacagtgaagaacacactgaactaggagtcgggagtcaggattcttttttttcccctcctctcttgttttgcctatcattagttgtgcaacactgggcacttgaccttttgacactgtttttttctttttaatcttttgtgtaaaatgaattgggtggagcagtttaaggtctctgccttcctgctcaaataatataaatagcattttgaaacaagacttaaatggactagactttacgcattatgaaaacactctgtatttcctaattaatgtgacccaggagagacacttcccttctctcttaaaaatacaataataaataaaaacagcatagctgggagaagaacaaagaaagcccattctgccgtatttctaagcttctcttccctctcatacctcaaagtattaataaatctaggtataaggcttgttcttaaatctgttttcaagtgtaaaggtaaaacctcatttgtcctcccactatttcttttttctttaatttcaatttgctctctgactacagaaaagctgtgaattcccttaattgcagctaattctgaattctgggttatacagaacactggtattggcaaagttggtgggaattttcaagtagcccaattagcaggaagagaaaatacttttttccccaacttacagtatagaataccaaaagaaagtcaaaagaggaaactttaagtacattattttctcaagtacctgacaagatactgtagatgagggatcaattcaaagcaattaatccatcaaagccctctgttttgaaattgccatttctctgtacaaatcatacttataacagtcaaagaataaagaacatgggagaaaataacagcttttaccaagctatatgaaaaccaatgtcaaataatttggctttagaaagtcgaatttcctttccctgaattattatctcatataacttgtcaatcatttcttttgggaagggtttgctaaactcttctaccttctcttatgttaccaatgaatttaaaaaatgctttattaaagtagttatcatgctttactttaatgttttgcttgtatgtcttgctaaactgtaaatcactaggacaaggactatgtcatattagtcttcatttcctctgccattaaaaaaatcctaatatattttagatgttctggtaacaacaccagaagcaacactatagtatcagtagctcaaattatatcatgccaatgctatcatgtgccaggacctcaatgataaagtcaacacataatatgcactatgaattaatcctctcaggcacaaaaaatctatttggtgatagcataacttgcaatctcttaacatggacccttcaatttcactttccattcatttctcaattatcttcaaatttatcttatttccaatcccactttccaaagaagccctccccaggaaattgagaaggtagggaaagatttcaggacctatactttctttagagctgaagagcccagaataactggtagaaaagcaaagagacgagacccttggtgtcagatgaaaaacagaaatgttgctgactggctgttataagacccacttggggctctcaacattcagaacactgcaagaattcagtgagatgggagcttggagggcaagtgatgaaaatgagacacggcagagactgattatcactaaaagtttaggaaagggaaacaacagtttatctttgggtactataaatttataatcctcccaggagacactaatcagaatgtttccagacagcaaatactaaacctattttatagtaacaaatcagccatgggtagtattatcttcaaaatgagcttagaagtaataaaactgagtattgcatagattctccaagtcattgttggctacaactcaggataacaagataatttgctatcaagtgcagttagaggacatgttatgaaatcaactcacattgtatcaaacttctgaaaataactggtaaaattcaataataggaatacttttcatgaacctgggttccgccctcacgccatcactcaggaagctgggttaatacttaccatcacatatcgtattctaatgtaaagtgaattgaaaggtccttacacagctcaaaaaatctaccaggaaaataatttaaggatttattttacgggttcatgtagtaattaatgactaaattaatgggggtgggggaatacaggaacaggtatcaaagaaagattccaacaaaccacttgcagaatggtacacaattctttgcttctactagaatctttcctactaggaggacaaatgagtttgtcttacatatcactctgattgtcactagctacctggaaaatatattgagaagagtactgaataaatgctaagctcagtagaaaagaaaattttttactaaagtttgtcatggatataaaaggaaagaataattcataggccacctattttctatttctgtaaaaaggggatcatgcccattccatctaggtatccccgaaatccatcacacagagcaactgttcaataaatagttccaaacaaattaacaaaaaacttaggcttatttttttaccttggtttcgaacaggactgacaaaattgataccatgaacatttctccagtcccaagatgttggcaaatgcaaaatcttttgctgtatttcagcagtcagtggtgcaggtttgggcctagaaaggaaatatacatttgatatcaacatataatctttcctttgaggatgatttcctaaactctactataattctatgatttcagctaccagactagctaggatctagattcagacccagagcacctgttttatgagtgattcaatgtgtcaattacacaatggagttgtgtaaatggctttcattcgctgtttctttttcaggatctagtattgataattttcctttgtgaaatgacactggttttgtatatcactgtgatgttatttttagtttgcctgaatagctgcattcttactcatttttgaaagatttttgaccaagaaagagatgagaagtagaagacataagaagggtttagagaaaacagaggaatcactgatgtttgacttaggagacagacacattggtagtgaggtggctgtaaaagaagtgaagttggcaaagggaaaaaagggtctatgtgaggcaggagaacaggttctggaggcagggaacataaggccaattcacactgacttcctagaactaaataaagtggaaacacttcagcaatggcaggaatgcgaagggctttgtcacttcacttcatcctctccgtttacatgggccacaacccccaggagtaacaccctctccattaacacaaggcctatactgagtaaatgactttgtaacttaactccaccctcttcatttacataaggcatacaccaggtaaccaatgggaaacctctagacggtattgaaaccccagaaaattctgtaaccagggccttgaatcatttacttaggcccactcccatcctgtggagtgtgctttcattttcaataaatctccgcttttgttgcttcattctttccttgcctcatttgtgagttttgtccaattctttgttcaagaagccaagaacctggacaccctcaaccagtaacaagcataacacaggctgactagctccgtaaacaacagataaaactgtttcattatagaaccacaccttatatgacagtgttgggctgtaagacacacaaaggagagttgcctaggcccatgaatgaacggacatttttgggaagtgagaaaattgttctaacagcttctctgtattagcgatttcacacatacatacacatgcacacacacacaaacacacgcgcgcacacacacacacacacacacacacagagagagaaccacagctttagacacattcgacttcttggagtttccccaagactgccaaatggcctctctgttctatatctttatgctgctgctcctgtaacctcaagtgcctgttgctcaccacttaaaactcccctaagagtttttccctaacttgtaattttcaaaactgctcataaagtagcctccactcaccagcccccagcgaaaactcacttcctctctctctctgctccttcaaatttgtttttagggcactagtcacaatgtggtaaaaattattttttgttactataaactatttgaatttcttattcaactgggcattgtcatatcacactgttctagtttttcagtggttaccagatgttttttactaggctaaaatttagtcaatggcaaagattctttctgggctacttcatgccctctgcacctatccacaaatggtcccgtctctcacagcttctcttagatataacacaggttaagaatacatgacaaggggccaggcgcggtggctcacgcctgtaatcccagcattgggaggccgaggcgggcggatcacgaggtcaggagattgagaccatcctggctaacacagtgaaaccccgtccctactaaaaatacaaaaaaaaattagctgggcgtggtggcgggtgcctgtagtcccagctactcgggaggctgaggcaggagaatggcatgaacccaggaggtggagcttgcagtgagccgagattgcaccactgcactccagcccgggtgacagagcaagactccgcctcaaaaaaaaaaaaaaaaaaaaaaaaaagaatacatgacaaaatggaactgagatgaaacaaagagaaaaacaacaacgatttcttcaaaaatagcaattgtaaccttgacaattgtatagattacacaaacactagttaattgttcactaattttttctcctaagccagtcacattggttgaagatatacatgatacagagataaatatgagatggtcattaacaatatggaagacaatgttaagagacataatatacacaaagattactataacaagttacagtaatgctataaaacacacaatttggacaaagtctatataatcaaggatcataaaaatctgtgcctcataggtaattttatatatagggtgagagaaaaaacaaagcttggacatttcttctaagatgtataaataaaaactaagatgcaaacaaaccatttccatctttgaatggaaatagtttctgtggtttcacattgagagagtatgttgaagaagaaactcaatttttttttaattctctcactgaacactatcaactgtcaacacaaaagacttctgtgatcaaatgcatgtgggtttttccccacaaatcaagcaagcaaccaatttcacagtgaatactagctgggtgtcctccaatccagttttgacactgtgtacttagagatggcatcagatctcacaggctgagggctccgtcccacaaaactgccccctacttctcatgccaattgaaagccctaggttgtttacctgtgcttctggccaaccagctataatgtggggatcctatgacaccctccttgggttcaattaatttgctagagtgactcacagaactcagagaaatactaactaatgtttagtggtttattataaaagatactacaaatgaaacagatgaagaaatgagtagggcaaggtatgggggaaggggcacacagcttccatgccctccctgaacacgccaccctccaggaacttccacttgttcagctatctggaagctctctgcaccctgtccttgtgagccttatatggggacttcatcaaataggcacaactgacaaccatgtagagatgtgactggacataaagggaatgatgtaaacacagcaaggcctgtccagattcttctgagcctctctctgttcagtgttccttcctttagggtatgacacaggacatctttggaaatgaaggtcttatgacccaagatcagaaaggcaggagaagattagagtgctgccctgggcaggtgagaggagggcggaagaagatcagagagagagagagagagagactctgttttctgaggcctacttctgaggcctaatgtgccccaacgttaaaagatagtgacaagggctatgggagttatgagccaggaactgtggacaaaatctagtatgtgttaactagttgtcttgtttaaacctaagaatatactaatataaaggataaaaaagaaatttaagtttggcagcataatgtaatttcagggcatatgattttatcacttactatctgtgtaacatttggcaaggaacctaacattacaaaactacagttcacttctattaaagtgggtataatcatgcttacctcaaagggttgttatgaaaattcaatgtaataatgggtaacaagtgcttagaacagtgtttttctctgataagtccttaataaaatggcagctgttatgaagataacattcatatcattaacaggactaaataagatgctgatacagtttaaagcaattatctggcacaaaacagtcattacaatattaagttccttttttctaccatcctataaggcagagatttgcccatcattgcacacacaaacaaaacaaaaacagtgtgagaactgaggcttaatgatgttgtcaaaggtgtttgacccagagcaactccatcttgaataggagctgggtaagatgaggctgagacctactgggctgcattcccagacagttaaggcattctaagtcatagaatgagataggaggtcagcacaagattcaggtcataaagaccttgctgatagaacagacaggctgcagtaaagaagccagctaaaacccaccaaaaccaagatggcgatgagagtgacctctggtcttcctcactgctacactcccaccagcaccatgacagtttaagaatgccatgacaggccaggtttggtggctcacatctgtaattgcagcactttgggaggccaaggtaggcagatcacctgaagtcaggagttcaagaccagcctggccaacatggcaaaaccctgtttcaactaaaaatacaaaaattggctgggcatggtgggtcatgcctgtaatcccagctacttgggaggctgaggcaggagaatcatttaaacccaggaggcagaggttgcagtgagccaagattgctttaccgcactccagcctggacaacacagtgagactctgtcaaaaaaaaaaaagaatgccatgacaatgtcaggaagttaccctctatggtctaaaaaggggaggcatgaataatccatcccttgtttagcatacaatcaagaaataaccataaaaatggacaaccagctgccctcagggctgctctgtctatggagtagccattcttttattcctttactttcttaataaacttgctttcactttgcattgaggactcgccctaaattctttcttgcacaagatccaagagccctctcttggggtctggatcaggacccctttccagtaacactgtgaaaatgaagagagagcaagaggagtctgggggataaaaaggtgagaattacaaacattttgagtacaagatacaggattggctcttaatcttttggcccacattctttacaaatctagtgaaagctctagattcagaaatgctcataaacaataaatgctgtctgtaatttcagcagtttcaaagactccctatatctcaagttaagaatctttgagagtttctattacgtcattggattcttagaacagaactaatttataaacaaaaatgctagtgaaaaatcaggaagccagattataatatctgctttcatatttcctacttcactcaattccatctccttatcttaaaccttctataaagctttagtcatgaaaacagtccttcataaacccagcccttgtctaaaacaaaagtggttggctggagggagaagggagctttagcaggagtcctcagaaacatagcatatgacacttggtaaagcagctgtgactgaggctcccatctttcaggcaggagccacagtctccctaggctcaagtgctaacactcctcctcttgatgcttgtttggatttttgttgttgaatagatctcagcttcctgtctcatgcagatacattaagacacattaggacttcactttggtgaatttgagaaggggatatgatatgctccgttttccaattttgattaactagagcatttcacagacaagaaattctctagaataaacttggagaaatactgcaaaagattcttttaagaaaggggtagaattatgggaggatgccatcagttggacaggaaaaaccttcacatagtctcacagttgaaaaatgccacaccttagcattattagtctgcagatgaaaaagttagtaatgttgatatggacaggagacagggaaatactgggtagaagagggtggtccctcagcaaaggccccaccctcaagcctgaagacctaaggccctaagagaagacaggcatttctgttttcacaccaaaaaaggtgccttttggcccgccatgccccccatccttcccccatataaacccaaaatcttagcaggcacagatacaaggagctgaacatccagaggagcagaggaacagagcggcacagagctgtggagagtggtgggacagcacagcagaaaaggagggaagaggtatttgaacccagaggagaacaggaacaagtggactccaggggaagaacacctttcccctccatcctccttctctggctgagagtcgtctcgcggagagccacctccaccactcaataaaaccttgtgctcatccttccagcccacgtgtgatccaattcttctggtacactgagcaagaacttaggctgtcacattggacccctgcccttgcaataaggcatggggtctaatgacctgattaacacaagccatctgcagacggctaagctgaaagagcacactgtaacacatgcccacttgggcttcaggagtctccaacatccactcctagacactgctgtggggccagagcccaaaagcaccccccatggcctctgcacctgcccctctgcatgctccccctaggggtttgggtggtagggcaagggcaaccaaaggtgtgagaagccacacctctgtcatatgcctgcgagggagataagggaactctcacatttcaaagtgttttagttgagtaattattaatctattagtagtttattcaaataatacaaatttgagccatgaactctacagatattagaggattaaacattgtattctctgagaatttgaggctatttcaatgtattaaggaaaaataacctacctatataatttttcaaattctgctagctccccattgctttccaattccttaccccttagtcacatgatcctaaagcaaagtatggcattacaggacttatccgtggccatttaacaaatgttaaggaactatattagatagatgtagatcctaagctagatccagctatactttcagaaaaataatttttttttaaattatctaaatttctgactagacagattcaaagtattatgatataatttcccaaactaagaaatataccatggggcttatgggtaaagatgaaaaatgccacctctggttgagagtaatagagctatactgataacttttttttttttttttttttttttgctggacatcaaagcatagagaggattttgagatttttttttaggtggcaaattttacagttactgtaggcaagttgagggctatttgaggcaaagggaacagcacaaatgaagatgaaaaatgaaagttttcattcattgtgtgtcatatcgtttgaaagcagagcaaggtgataaatatagttatggtcataattagatgggtttggataccaggctaaatgtatccattaggtagtgggcagtaacacagtctcgtaatcacccaacgggttctccttcctcacggcctacacagaactgattatcaagacagggaaattgcaatagaaaatgagtttaattcacgcagagccggctgtatgggaaactggagttttattattactcaaatcagtctcccagaacttggtataagaggatgaaactagaagcatttcataaaacagctaagaatgggaactgggagaggtagcgacgaaagagatggcaggcatgaaaccgcctttgcaaaaattataccagtgagaaaactatgagagtgaaagagagctaagctaacccatcccccatcttgccttccacttaaatattcctgggctattgggccaagctaactttggaagtcatttcggctacagtttaaatgacaatgggccttgccctgaaacccaaccacttttgtgaagctaatggaggcagtcaggctgtggggagaagaggaacctgagtccagctaaggcgcagacttgagagattgtcagccgttattccagaggttataagacatgcaactccatcaattactccagcaaataacatcattattgtagaatctaagactggctttttgaaatatcttttcagggaaattttatatttattttatttattattttattttattttattttatcttaccttatcttattttattttattttatttttgcatgtctgacacccgtggttctacctggacccagcaaccccactcctatggccccacctagaagcaattcagcccacaggaggacagcttcaactccctgtgatttcacccaccccaaccaatcagcagcaagcatctgttacctggccacccccaccccttcccccaagctgcctttgaaaaacccctacctatgagctttggacaagataatttgaatatgaactccatcccccacgtggcatggccagcctagtgtctcttaagctctttctctactatattgccatggtttttctttatgcagcaggcaggaagaacccctcaggtggttaccggcaggaggctaatccatagcatgggggaaacaggacaaagctgcatgccagagtgtagaaaatggaaagggggcaatggaaacaacagacatgtgaaagaaaaactcataaataggacttggagagtgacagaatatgtatcaataggagataaagatcgttaacagatcacataaaaagttacaactgggatgaccaataaaatggcgagcaacactggtaggactgcttaggagggaggatggtattcagcattcatatttttattaatgataaaatgtgtgcttgattaccttgggatttttcgactgtggccaccacttctcctaatcatatctcccagggtaagagtctcatattccatgtatgtagttgcagtccaagacttctgaatggcattgatagctttcacaaagttgtgatcatacttgtagagcctattagaatacctgtccccaaaaatgagataatttcagatatagtctttactgatgtaaatagagtaattaaaacaggcattcacactctgtgcctaagtggaaagtggtacaatctttcaggaaggtaattggcaatatgtatcaatagcctagaacagcctggcatgtcttctctaaaaataaaagttcaagttaactaagatgcatgtataaggattttccatgaagtacttttaaactactaatagattgtaaataaccgaaataaatattctaagataagggactgattaatgatgtttcattttctatatattcatttaaaatgtctagaaagttatttaatgatatggaagagtgctcacaactatattatattaaatatgagaagatatcaaagtttatacataatcataatcaatttatcaacttttgcacagtaatatatgtatattatatgtatattaacgtatatgtataatacatacatatatatgtatgcgcgcacacacacacacacacacacacacacacacacactataaatgcatttttaaaatgccaaacatggttacctctgaatggtggcatgagatgccaagctttcccctactccctacagtttctacagtgtacctttataacctttttaataagaaaaaagagaaaagcaaaacctgtatgcaacatatatacaaaatgcaagcattataaccatatgatactaaaagaaattatactttatggacattcggtttatacttgttactcagaatttagttcttgaaccaatatcagtagcaacacccagaagtttattagaaatgcatactgtaagtactcagcccagatcacctgaatcagaatctcctttttttttttttttttaaacaagatccccaagtgattcacaataacattaaaatctgagccacattggtttaccttgtgccaaatgcttggatatatatgtaaatagattcaacacacaaagagcatatttacaaagtagaaaaattcaggaagctgattattcacttaattaaaacatttatcatacctgtgtgctagatgctaggaattatagaactcaccatattattactattaaaaaagagtctgtggtttcagagtgactcactatctaagacttccataaacattcaactatgcaaaacaagatataattaacctgaggaacattttaggcatactgcaaacttttctttcccttataaatcatgtgtgtagagagagaattttgatatggtctaaaaacctaagagcactgaaaataatcagaaaaacgtgcaaccaggttgataatgttttaatgtttttgtcgaagttctttcccacttgttgcaaagtgtgaaaaacccagagacgtacccttatcaagcagattataaaactgtatcatatgtatgactacactaacacaataacaaaaacaagttatagttgtttcattgtttctttaggcaaaagaatatattttaaattgtaaataaaatacttttgagatattttcccacaacgccagtcaatatttcattgactgtagatatttgaggagcagtagcctgctgtttcgcttgctttatcataacatctagcaaaacctcgtgtgttgacatgtgcattaaaataatgacaagatagcatcctacgtcttaaatactattatttttggtgtttaagatccaacgagattaaaaataatgtatcttactatgggataacagatcattaagagctgaaagagacctcaaaggcaattcagtcccacatgctcacttcacaggtgaggcaatgtaggttctgagcactccggttgggagcttcttcactaaatgagagaatgtttgaaatatcaaatagagtacaatagtacatagcatatcctaaatgatagggtacaaagtaaacaagttaaaagtaaatgtgtagctctaggatcaagccaaacaaagctatttaaaacctaaacttaaaatgaaggggatgaattagtctagatcttgcccagcacctttgcagacaattcatcctcctttaaatcatctctcttacctctgtgctgcagtcattcattactaatgttgcctggcttgggatgatttgtacatgtacatttttagtggcttttacaactacataaaacagaaaaagtaacaacatttcatctcttccttccaaaactaataaagtctaatttgaaatctcctgtttgtgtggtttagtcagttatagatttaatttaacagtaaacattaactgcagtttatagtctgaattgtgtccccctcaaaattcatacgttgaaattctaaccccctgtatcacagccatatgactgtatttggagacagagctttaaagaggtcattaaggtaaaattaggtcatatgggtgggccccaatccaatatgactgatgcccttataagaagaggacattaggacaatcagaaaagactgtttaggagcccagtaagcaagcagacatctgcaagccaaggagtgtggccttggaagaaaccaaacctgacaacacctcaatcttggacttctagcctccaaaactgtgaaaaaacaaccttccttaagccacccagtctgtggtactttgttatggcagccctcgcaaaccaacaggctgcataaatactaagaactttgatttcagttatttatggtcttgtttaaaagttgcccaattagtatcacctatacttgttgcagcataaacatacgtatctacttgtatcatgcaacatgttattacatggcaataagcaaaatggcttttctttattagtaatttgcaattctgtggtccattacatgatttcatttaaagtaatcattggtccattacttttggaacactttgaaaaaatactctcaataatgttggtcaatttatttttccagtaaggttttacatagcatgcctaatatttctaagccaaagatattttgtataatcaaactaaaattccaaaaatgtacacacatattcatatatactataaaacaaaactaaacgtatgtctcatttgtagcaactcacttttcctgagaattcttaaggtgtgctatgttgacatacacattctcagaggcagttcccaccttctttccggtgaaacaagcccagttccggcccaacacatcatgcacccacccagtcattgtctcgttgcagtaagtggtcaccttgctgccctcttctttatactgcaaacaaataagagaaaagaaaaccaagtaaaatctgtcttcaaatttcaggtccatttccatggctctcattcacagtaaatgtgcccctttcaaaacaaaaacttcaccctgagaggttacactgtaagaattattctagaaaaagaagacatacaaacttttctgtggttagcactgttggccaccaaacaaaatgtatataacaaaacacttccaggaatgaaggccaagggaaaacaaaacaaaacaaaacaaaaaagaaagaaaacagaccatctggcatattcaaggcatttttcaaaagtgacttcacagtccttacaagaagactatgaggatgcagatgataataaccacattttaccaaggacaaaaggagctcagctcagagataaggagctcctaccaaggcaacaggcgaagtggcagaaacagaattctcctcagtctatcacactacaattttccactgagacaagggccacactaggaaactacaagaacaaatgatgaactttttttttccagggatggagtcttgctgtgttgcccaggctggagtgcagtggtgtgatcttggctcactgcaacttgcacctcccaggttcaagcgattctcttgcctcaacctcccgagtagctgggattaaaggtgcttaccaccacgcctggctaatttttgtattgtttagtagagacggggttttgccatgttggccaggctggtcttgaactccagacaagtgatccacccacctcggcctcccaaagtgatgggattacaggtgtgagccacagtgaaacagaatcctttttttctgtcaatctctcaatttattagcatattctgatcatgagggggctaaagtaacctgagtattaaatatattctttacactttatttcagtaatatggccttttgtcttatttcagtgttagaactgaaaaataactattatttttaacagatccaggatttgaactaagatgctctggctccagagcctagtcaccctcatgttagaacatctcctcatggaggcggggcacatgatccaggatgactgtgtagcatgtgggagacagaaagggaaaatgctgtgctaaatttctgaggagagacttgggcacagacaatttcaggctctgacttaatttaatagaaaagactatttgtagaaccttgggcaagattttacgaggctttagttctgttgcctgtaaaatatggaaagtagaaaaaaaaatcctcaaaggtataaacattctgggattccatgatcaaatgcagggtttggtaaacacttcctataatggccagacagcaaagaccactaggctttgcaggccacttagttctcttgcaactgttcaactctgcccttgtagcacaaaagccatcaaaagcaagactcaaacaaattggcacaggggtcaactatgtttctataaaatttctgtttacaaaaacagacagtagggtggttttggctccagaggttgtagtttgtggactcctgctctactctaatacacattatttcacttgtttgcagaggttggcaaacttctttttgaaggactagatagtaaatattttaggcttgaaggctggaagacctcagtcacaactactcaacctaaaaggtgcaaagggaatacataaatgaatgagctaggctgtgttccaataaaactttacttacaaaaagaggtttgtagtttgccaacccccagtttagagaaatgtgtgggctaaactacacttaaagttaaaattaccttattgcatctgactctctgaattcaaatcatatttagggggagagttaaaaatgtatggctttagaatccagaaaaactggacttgaattgtgggaatcaccactcactgtgttatatagcacaggaaaagttactctgggctactcatatccgcatcttgcttttatctttggtgatattcatgatattctctttttttcagacagagtctcactctgttgcccaggctggagtacactggcgagatgtcggctcactgcaacctccgcctcccaggttcaagcgattctcctgcctcagcctcccaagtagctgcgactacaggcatgtgctaccaggcctggctaatttttgtatttttagtagagatagggtttcaccatgttggccaggctggtctcaaactcctgacctgaggtgatctgcttccttcagcctcccaaagtgctgggattacaggtgtgagccactgtacccagctggttgttcatgatattctggatcccatatgtctgcttctagtgaagaatggcttcactagcatgagttcagttcccaactactcaagtccctgctaaaaccctactcaatatgatgaccatggaaacaaagacccaggacattgttgggcagcaatatgagagggtgtgttgtgtgaaaaggttaataaaattaacttcatactaaactatgtaaaacttctactttggtagatcgaaacagtgtaacatggtaactttataggatgcaacctaaactccataaagttgtattatgtacttctctctggcactggctcttgatcctattctcttctccttggttgcatgctggtaaggcaggccaggtagggttaggccgatgctccctcccacctctgctgtttgaggaagcagtctgacaatgtttccagagttcttaagagctactttatagatattgacacacatacacaaacaaaatgctacacacaggaagacattcactgcagtataacacaagttaaaaataaaaacaatagaatgtcctagaaaatgcccaaatttaaaaagtattaggtaaacaatttattcaaaggaataatgtgtaacattgtatatgataaacctgagttctataggaaaggggtgagcaaactaaaattggagaagactgcctatttctataaatatagttttactggagaacagcatgcccattcatttatacattgtctatggctacttttgtgccacaatggcagagatttcatactttataaatattgtacagattactcataaatcttacaggttcaagagaacacagaaatgatatagtcttgggggacaaaaaaaagacctaaggaagtggtggaactagaactaagcatcctacccaatgccatcctccacttcttcctacaatttgtcttctcacgaagagccagagaggtaaacaattactaaaatcactgacgggagatacccagaaatgacagaaaaggcttttttttaaacccaaagggcttccacctatattatttgagcctcacgataatctctttgggataaaatttctttctaatgaagaaaaggtgactctgcaaaattaaatggagaggaaaggattcaaatacaggtttacatgttacaaaggtcattgctttatccattgtattctctaaaaaaaaaaaggtgcagagaattaactgactcatgagtcacgttcaaattgttgcccaaggcctttaaagggctgcctaaaatttctagcagtcctcataggtgttctcccattcttcaggtacctatgttgccttggctctttcagtctttttaccatgcctgcctagggtttttgacgcagaacagaaagaaagaataatgccttcaggcctagactgcctagactgctctgccactgattggctgtgtgatcctgagcaagtcacgttcctctctgtactttcagtttcctcatctttaaaacaggagcaatggccaggtacagtggctcatgcctttaatcccagcactttggaacgccgaggttgggggaatcacttgaggccaggtgttttgaggttacagtgagcaatgatccagccactgaactccggcctggatgacagaatcagatccattctctaaataaataaataaataaataaataaatgaagcagggatgataattacagactatatctcatgggctgtgttttatgtatactaactcatttatttttcacgatagtctatcaggttgttctttccacaaaaacataactatgacaataggatttttgtttattcagtacctagaaaactatctggcactaggaagtaattaactactaaatgagtgaataaatgaataacagaagaggaagaacaacaaatgtcaagtcctatttcaacagttaacaaggcactgagaataggtaagtttataattaacagaggtgtggtgatgccaatatatcacaatgtctgacagtccaaatcacagtattacttcagaagtgcaaatgttcctctccaaagctgcttccctatttgtaattttaggttgacctagaagttccaaaaatttcccttcaagctttctaattgcaaatccttatatctgtggttgtcttaattttttttttttttcaagatggagtcttgttctgtcacccaggctggagtgcagtggcgcgatctcagctcactgcaacctccgtcttccgggttcaagcaattctcctgcctcagccgcctgagtagctgggattacaggcatgcgtcaccacgcccggctaatttttgtatttttagtagagacagggtttcgccatgttggccaggctggtcttgaactcctgacctcaggtgatccgtctgcctcggcctcccaaagtgctgggattacaggcatgatccaccacggccagccttcttatttaatattcataaagccagtaattcttaatagacacactatttatatgagtaatcctaaaaaactacaactttgtttttgttgttataacttaaaccctacacattccattaaattgatggaattattttcccttttaaaattttattttatactattcttacaatctgaaataatgtatcaattttagaacctgaaattattctgtaaaagtacagagctgcaatgccactctgcacgacaacaacttagtaaaagagaggcatttaccagcggggaagccaagtacgcagtaccttaagggggaccatccactgtacccctgtgattttcttgatttgaatgttttcggggtatgtcattttttcctgtgaaatacttcttttgtgatttctgacgttgtatcaccaattaagaagttgaagttttgaccccgctatccagcttgaaatgcagccaaaaaatttttctgagttttcacttatataaacatcagtctctgaagactgccttgcacagatgagataatttaagtttccattcatttatgctaatttctactgcaacaaatagataatttcctaaaatatgaagatcaagccctagtatttaagtttaaaaaactattatgattcaataactatccatttgcttcttcaatattaccattaagttgccacacattctcaaaatatcccttcttcaatttcccactcattttatcagctatccaattagatatacctagtcatagggaaattttggaattgaagttatttttgggaactgaagttatttatcttggatcttttacttgactgctttttgacactgaggagagggaaaaaaaaattccttaaacctgttctactgttttcttgattaataatatacttagccaatgtctgaatacttactttacataacaaacttggctagaagacagaggcagtttagtaaagtggactccgccctttaaatccagtctgtcacttatcatttacgtaaccttgagcaagtcaaaactagtgagcctcagttactttatctgaaagtaggaatgatatctataattgatactactttactggactgctatgaaagatatagatgaaattgaagttggaagagttaaaaagttatacaacattaaacaagtgactatactaacattaccatcattaccatgaaggatacttcatccatgccttcatagaacttatattctatccaaaactgccaactgggcagctgacactgggacctatcctttcaaccagtggtttccagcggaacattggaaacaaagtattgtaactcccatatatatttctaacataaaaatacaattggccaggcgcagtggctcatgcctgtaatcccaacactttaggaggctgaggcgggtggatcacctgaagtcgggattttgagagcagcctcaccaacatggtgaaaccttgtctctactaataatacaaaaattagcctggcatagtggcacacgcctgtaatcccagctacttgggaggatgaggcagaagaatcctttgaacctgggaggtggagattgcagtgagctgcaaccatgtgccattgcaccccagccttggcaaaaagagggaaacaccggctcaaaaataaataaataaataaataaactaattaaattgaaaacttccactattatttaatatatgaaacaacattggtgtgcccatcagatctaatatcagatgttcatctgttatgtacagtgtgctagtaagtccctataagatagttaaggcacagcatattccctttttcacatctgcctgcttaaactgacttgagcatcttatctgaattaatcaggctaacactcataaaatgaacaagtagtttaaaatatacttgcaaagaaacaaggatttgcaaatactaatgatgcaaacataagaaaatggcagtttttttataattaccctattctgacttctgtcaaacatgttgacagaagtttttaaaaacagatgttttgaaatggttccatcactataatattttttttagtcctagacatcaataaagcaaatgtttcagttaaaatttgtctattaaaattgtcatccctaataccaattgataattattctaaatccttctaaagctgtgacactttcatacttttaacaaaaatgtgtcaaaatctactgaaattctttaagattttaaaacacatcagaaaattttgtttccaaatgttgaaaatttacagtcatgaaaattatcagtaacagggactctaacattacttttggcaacaaaatcataataatgaagaatattttacattattttcaaatgatatcttcttaaaatatattttgggtagggcacaattttatgacattaataaagtatttaatcgcttaatatttcacattttataacaaatgtagtacagtgatacatgtatatataattttcaaaatgtacctatagataatttagaatacataataaaaaatttagacatccaagtctaatccatcaagatgatttgtaattttgaaaagagtactttgcatggagttgaatgatttgatgattaaccaaatatggaaatattatattccagcaacattaaaaaacaaaaaatgtttccatttttgccctttgtttactgtagaaatctatatacgtacaattacctccatttgctgtcagaaaggaaccaggcaaattttactgaattggtattttgccaaatccatcagagtgtcacatctttcctcagaaagaaaccaacttccctatgtcagttccaaggaatagctatagttttctgcctattaactggactgaaccatgcatttaaaaagtcgaattgtaataaaatgcaaaactgccaggaaatagttacagtggttacagccaagcaacttccagcattttactgaaggaactggaagtttacatgtgaaaatggagggtcataaatctgtttatttccagtgctgaaaggacattacattaaaaccaaaatacacactccagaattagctaagaaaacagcaatttactgcacagcaaagtagtcaaagtccctgggctcattcctcacttacttactcataaactcaaaccgtaaagttggaaaaaaatcttaagagttcatctaatccactcctcagctcatgttcctcactatactcaacagaggtgaggcacaccatgcagcatttcaaagcttcggtcctccaggctttggggaacccctgcagtcagaacactcaggatttcccttgatagctaattttgtttttagtagttttgaaagttagaacatcactgtttttaactctgagccctatcttggcctctataggcttacacaagattaaaacataaataaataaatagaataaaatataaaagtctaatctcttttccactaaatcatccaacatatatggcctgagggcccaccatagcctctaaggacacaaaggtaacacttcaaagaacacatcaataaaacaataccacatgatatattacataacattctttattttacaagtatttattgaaggcttattattggtcatatatcgtgtaatacatagggaatcaaatggttagtaagatggagttgatccttgccctaatgaagtttaaagaccagagaggaatacaaacaggcaattatgacacagaatactaagccttattatattcagggatcttctgacacatgtatctgcaattttgtactcactgaatcttctcttccataataaaagcatgttgatgcaaaattactcagataaaagaactcattagtaatttttaaaattccatattaaatatatatacatatatattttaaattttttaagttccagggtacatgtgtaggatgtgcaggtttcttacatagataaacatgtgccatggtggtttcctgcacctatcaactcatcacctaggtattaacccatttatgccagaggttgcaatttgttgaatgtgaaaaatcagaccttggcaatgaccttgagcaggatataaagaacttccacatgcttagcattccagaaatggaacactaggcataaatgggttaagcccagaatgcattagctattttttctaatgctctccctcagcttgaccccccaccccctgactggccccagtgtgtgttattcccctccctgtgcccatgtgttctattgttcagctcccacttataagtgagaacatgtggtggttggttttctgttcctgcattagtttgctgaggataacagcttccaactccatccatgtccctgaaaaggacaggatctcattcctttttattgctgcatagtattccatggtgtttatgttccacattctctttttccagtctatcactgatgagcatttgggttgattccatgtctttgctattgtgaatagtgctgtaataaacatacatgtgcatgtatctttgtaatagaatgatttctattcctttgggtctatatgcagtaatgatatttctggttctaaatccttgaggaatcaccacactgtcttccacagtggttgaattagttgacattcccaccaacagtgtaaaagcgttcttatttctctacaacctcactagcatgttgtttgactttttaataatcaccattgtgacatgagatggtatctcattgtgattttgatatgcacgtctctaatggtcagtgatgttgagcttttcttcatgtttattggccacatgaatatcttctgggaagtgtctgttcatgttctttgccaactttttaatggggctccttttttcttgtaaatttgttaagttccttgtagattctggatgttagacctttgtcatatggatagattgaaaaaattttctcccattctgttggttgcctgttcactctgacagtagtttcttttgctgtgcagagctctttagtttaattagatctcatttgccaatttttgcttttgttgtaattgcttttggtgtctttctcataaaatctttgcccattcctatgtccagaatgatattgcctatattctattccagggttttataattttgggttttacatttaagtctttaatccatcgtaagttgattttcgtatatggattaagaaacaggaacagtttcaattttctgcatatggctagccagatatacagtaggattaattgaatagagagtcctttccctattgcttctttttgtcagctttgtcaaaaataagagaagaatcaaacagacacaataaaaaatgataaacaggataccaccactgatctcacagaagtacaaacaaccaacagcaaatactacaaacacctctatgcaaagaaactagaaaatctagaagaaatggataaattcctggatgcatacacactcccaagactgaatcaggaagaagttggatccctgaatagatcaataacaagttatgaaagtgaggcagtaataaatagcctactaatgaaaaaaagtccaggaccagatggatttacagttgaattctaccagaggtacaaagaggagctgataccctttcttctgaaactattccaaacaattgaaaaggagggactcctccctaactcattttatgaggccagcatcatcctgataccaaaacctggcagagatacgacaacaaaaagaaaacttcagtccaatatccctgatgaacttcgacgcaaaaaatctcaatgaaatactgataaaccaaatccagcagcacatccaaaagcttatctaccacagtcaagttggcttcatccccaggatgcaaggccggttcaacatatgcaaatcaataaacgtcattcatcacataaacagaactaaagacaaaaaccacatgattatctcaatagacacagaaaaggccttcgatacaattcaacatcgcttcatgttaaaaactctcaataaactaggtattgaaggaacgtatctcaaataataagagctttttatgagaaacccacagataatatcatactgaatgggcaaaagctggaagcattccccgtgaaaactggcacaagacaaggatgccctctctcaccattcttattcaatatagtattgggagttctggccagggcaatcaggcaagagaaagaaataaagcgtactcaaataggaagagaggaagtcaaattgtctttgtttgaagataacatgatcctatatctagaaaaccccatcatctcagcccaaaagcttcttaagctgataagcaacttcggtaaagtctcaggatacaaaatcaatgtgcagaagtcaccaggatccctatacaccaacaaaaggcaagcagagagcaaaatcatgaatgaactcccattcccaatagctacagagagaataaaatatctaggaatacagaagaagtgaaggatctcttcaaggagaactacaaaccactactcaaggaaatgagagaggacacaaacgaagggaaaaacgttacatgctcatggataggaagaatcaatatcatgaaaatggccatactgcccaaagcaattcacagattcaatgctattcccattaaactaccattaacattcttcacacaattagaagaaactattttaaaattcatatagaaccaaaaaaaagctcgtatagccaagacaatcctaagcaaaaagaacaaacctggaggcatcatgctatctttcatactatactacaaggctacagtaaccaaaaaagcatggtacaaaaacagacacatagaccagtggaagagaatgaagatctcagaaataagaccacacatctacaaccatctaatctttgacaaaccgtacaaaaacaaacaatagggaaaggattccctatttaataaatggtgctgggagaactggctagccatacgcagaaaattaaaactggacccctttcttatacctatacaaaaattaactcaagatggattaaagacttaaatgtaaaacccaaaacaataaaacaccctagaagaaaatctaggaatgccattgaatatattttttacatatcagttgctttggttatatttacatcctgaaagtcagcttgaaatatgcaattcttttaaaactctgcaggaaggtaacctgataatattctttagagcagggaatcaaaaaagatgtatatggcaccattcctgatttgtctttctagaatcctacaaaattaattctttgtaagttggtaatacttgtgaaaagtctgcaaaaagaaaagaaaactgtggtgcattttccaggtacctacaaagttctatgtgcattaggtgttgaagatatacagggagaaatacagattttcaatctggaaagagatgaaaacatgctacccaatcactccattacagcatggcatgaaagcagaggtacctgcgatatgcaatgggaaccaaagttctgatgtttctcacggtaatagagagagctggggagggtttcagagagcagcgtcatcaaggtcctgagtgataaagaatttatcaggtccagaggtgagatagataaaagtttccaggtgggagcagtccactgtactcttaattcatctttctgaaatacttcttctcagaatagcagaacagtatacctctcagatcatacaaagagtcatctgaatcaacagagtaaggatgacaaactactctctagagaaaaattcttctattcaagcagaaatgcaagagaggaaagtccacccagacaatatgaattaaacataaccccataatttcaggcttaccaaagctgaaagaagtcagctctaaaccaacagagcaggaaacaagaccattattcggcaggaaagagctagaagatagcaatcagttgaacaatactgtaattaagattagtaaatttgactatgacacttagtttgtacttaatttgaagtttacaaagctcttctaccaatttccaaactacaaactgaaggagaaggtaagttttggtcttcaatgaaaaaaccctggtttaggcaagaaagtcagtagcctaatagctaaggaaacctaagcttcaaggcagttcttctcttaaaacttcaacatgagcccatgcaacattaaactaatattcatgatgctcacagactggaatttaccaggaaatccaaatatgcctctaaataccatttacttatttgtgaaatggcttttttcactatttagccccaaggaagtctttaggcttgaaagacaagttctagcattttacagttagaaactctgtgagcttagcactgtaagagattaattttctctatctataaaatgaaactagttatatctactttacagaacttttgtagcttatagtatgtcaacttcttagcacaaagcttgtacctaatgaaaaaagaaaagaaaaaaaatagggtgtttacgataccatctttctggccagaggtactggaggtctataatctgtagaagtatactatagcagtctgacatatctgagaaagcctcttttttcccttctttaaatatgtcctccataggaccatcttcccttcaataacttatatctgtgaatctcaagagatccaagggccttattttctccttacaacaggctcttgggttcctcaaggtaattagagaaaggaaagacactcaggcagacagttaaactgtgaataaaatttacgctgtgaataaaacaaaacatacacttcaaatcctgacaatcttagaaaaaaatcactgtaatagaagggatttcaaaagagaaaaagaacaacgtgttgtatattgttccttttattaaaaaactgaacggtgaagccacccaagattttgcatcttcagaatttttttttcctttctcctgtgtagtctctggttgttcacattccaaaatgatgtttactgttttccaagggagtgttcaggagggcagctgccttggaggtaggtcaccaggactcctttgcattttgcatgcaaataaagactccagaagggactgtagctgctagaggcctttgctagctgctacaggtaggtccacactgtcgcaggctgctctgtctcttagccccaacgtctgttcatggctgtggttttaaaagagtccctcaacagatgctctatttaataactacaagacaataaaaactagggttacaagccaacaaggatcatattgtctcttaatatttaatcatatcagtttctttaagtaaaaaaaaaaaaaaataccagcactgatatttgagatcctggtatatttttgtaaatgttaagacattcacaggaaagatgccattctgaagctaaatgcttaagcaacatgtactgcacatgcaaccaacatgctttagaagcacatgcatctgaaggtaactgccactgaaaaaaacgaatatgtttctgaaacatacttaagaaacaggctaaatatagtaacttagatacattaacatgtataccttgcaaactttaatttaggctcagtgctgcctgaatccacatgactaggtactaggctatttatcccatttacacaacaaattaccagggtttatcttttctactggtggagcggtctccctaactaggagaaagagtgaagagttaaggataaaattttgtaaactgtattttgagaacagcttatttttcgtggaaaaaaaaaatagtgaacctatctgggaaaagtttcctattgcatcttcctcctaagctaccaccatacaatatattacagactctgagaagttctgaaataaagaaaactatttaatacattctatatttattcaactaccagaaagaactgagaagaaacagcttactaatttcaaccctaatgctcactttgatctgttattagtggctgtatggaacattgctgaagcttaacaagataacgcgacacaactgatgagcaattcctacctggcagatgtgtgggtcactgctggttcattataaagtttggaaaatgctaatataagataaacctatggtgctttcaatacttgttcccagttccctttttcatatctcacttctggtatttaagagccaagtaacagaggaaggaaaaggggaaagaatattatgttaaaatgcaaggaagggtaagtctctattaattttactctctaatcacctatttcttcatcaacattttagacatttatggatccagtgtgagcaatgatttaaacatctattctgaaaatgtgaagagaatgtaaagagtgaataagattctctcctcctcagtgaatagtctattaagactattttaatagaagccagttttacaaagctgggtcatgtcagataagtgatgagtatgtcaatttctctgtaaaagccaccttctctgtggaagacagatctaagctgctgtggcctcacatgtttctctcttgagggattcttttcaagaaaagaataagcaacctaaggcagcctaactactttacgaatgtgaactgaacttgagtcaaccttttttttagctgggtctttacccttttcggttcacgtctacttaggttacaagtagcattcttgggagagctgatttgacatgtgaaaacagaacataataaagtagaaaattactcacataaaatagtgcagacaacttagaaacagcagacaagcaggctcaagcaagaaattcataagaaaaccataatctctccagtcaccctctgatgaataaataggcattaatttgcataagccatcaggaagtgaggaagcttgcttttaataagaaagttagaaatttttcaatggagctcacccagtttgttcctcagatgtggcaaatcatatatccccacagttcccagctgcatgaacaaatgactgataaaatcagtgacatcctacaaagagtttacaatggtaaactgagtcattatgttgagattaagcatcatcatgaaagaagacataaaatagttaggcaggcactcagtgctaaacttctgatacttttcctccactgaaatactcttacaagtaaacccaaagttgtttaaaacaaaacaaaaaaaagacaaaatgctgagcttgatatattgaatccaaattttaaaaagtatacctatctcaataagtcttctaaaattgttatatcttaataatgaacccagaaggctcagtgaaaaaatgtcacaatattcccaaatcttttattgtagaaacacaggcgacatttctggctgtgtgataagcttgaaatttattaatcactagcacacaaagtgagaaattaaaccctctagtatggatttctcaacatagagttcttgtttctgtttgttttgtttttgagacagagtctcactctgtcacccaggctgaaatgcagtggcacaatgtcagctcactgcaacctccacctcccgggttcaagcgattcttctgccccagcctcccaggtggctgagactataggcgtgcaccaccacacccggctactttttgtatttttagtatagaggggtttcaccatgttgaggctggactccatcttctgacctcaggtgatccaccagccccagcctcccaaagtgttcttgttttgagtagcaacttgctttagaaacactgatggtcattttttttagcttatagttctattaagattggagcctttcaaacaagagctcaattagaaagccctaagatttgcttcactatcaccaaataaaatttccagccataatgagtctacttcccctctacatatttcctcagcccttgagtagcttaatcttcaaaataaaatctgagttccttctctactgctcccttttagagtcagtttcttttactgcctcagagaaagtaaaatgagaaacagtaggttagaaagcctattcaggctgggcgtggtggctcacacctgtaatcccagcacttggggaggtccaggcgggcggatcacttggggtcaggagttcaagaccagtctggtcaacatggtgaaaccccatctctactaaaaatacaaaaattagctgggcgtgatggcgggcacctgtaatccaatctactctggaggctgaggaaggacaatctcttaaacccaggaggtggaaggagcgagggcctgggagacagagctagactccatttcaaaaaaaaaaaaaaaaaaaaaaaaaaaagcctattcaacaggaggtcattttttggagcttagtttgttttacaggacttcctgtctctgggcaatttggtggagagaatgctacacagaggagctttatacatgatcatcattaaaaatgaacaaagtacataagagcataaagaagaaaaaataatcacatatccagccatcatgtaaagtcagacataattaagcattttcacagtattctgtttcgtgttgttacattgtgtgtgtgtgtgttttgttttgtttggagacagagtctcacgctgtcacccaggatggagtgcagtggtgcaatctcagctcactccatgctctgtctccagcgttcaagtgattctactgcctcggcctcccaagtaactgggactacaggcgtgcgctgctatgcctggctaatttttgtatttttagtggagatgaggtttcaccacgttggccacgctagtctccaacttctcaaagtgctggaattaaaggcaggagccaagctagcctgcattgtgtttttatataggagattgcctgcaggtacttttaagaagtgcaaatttgctaaagtgtgccaagtacaatgaaatggtaaatgctactaaaatctgataatcttagaaactggcctgtagatagtattgtcttttgttttggccagcccagtgttttaaaggaaatttgaatttgaatgcctctaagactgtttccatcttgccacaggcctgattactccttattagtttacataaggttatttcaaatgcttagatacccacccacctgagtgggccctaaatgtaatatgcaactcccataaagtgctcagataataaaatgcctggaggatgctgagtaagaaaaaatctttcatttttttattattattattattttgagacacccaggctggagtgcaatggtgtgatctcggctcactgcaacctctgcctcctgggttcaagcaattctcctgcctcagcctcctgaatagctgggattacaggcatgtgtcaccgcacccagctaatttttgtatttttagtagagacggggtttcttcatgttggccagactggtctcgaacgcctgacctcaggtgatcgcctgtctcggcctcccaaagtgctgggattacaggtatgagtcaccgtgcctggctgaaaaaaatattttaaaaacatacctagtacctcctgctcaactcaaactatgcaaaaactttagatgtcaaacttttattccttccaaacttttatctagcttgaagtcacatccaaatatatgtatctccatccctactatacccccaatttctcaagctgttaaaaccaagttttaaaatggcttagaaatctcaaatcataaaaaatgtttctctttcagataagccctgaataaacagaacttaataaagcaagtttctagcaataggagctattctgattgattccgaagtggaatgccgagaatggcaaagaagctgtgtctctcctggtgagatgcaggatgctgagggaagcagaaggtaaaagcaggagcctaaaagaatgctgtggtgtggaaaaactactcaacgtgctttttcctattctcagtcagcaacaacaatcaatacaaaagacttcggtgaccccaaaatatgtaggaagttctccccaccagcaagcaagcaatcaattctgcagcagacaccagctcagtgccctccagtacaactccaatgctacctaccaggagacagtttcagatcccgtaggttgagggcttagtccccaagactgcctgcccactttagacaccagtctcaagtccaggcctccagaacttctgatggactggcttcaaattggggttcccataaccccctctttgggttcaattaatttgacagagtggcataaaaactcagggaaacatgtttatgatttattacaaaggatatttgaaaggatataaatacacaggcacttgaagagatacatagagcaagttctggaagggtcccagacacaggagcttctgtccctgcggagttagggtggaccacccttccagcatgatgagttcttcttcaccttcctgtcagaccctacatgtttagcgcttcagaattccctcaaatctgttcttcttgggcttttatggagcgttcattgaatacacatgattaaagcatggataaccatgttaaaatataattaggttataaggacatgatctaaacctaacaaggcctgtctgttcagattcttcttggtgtctctgtgcagtgttccttctgctatggtatggggcagaatactctctggtatgagggtcttagaaaccataatcagattagagttctgcagtgggcagatgaaaggagggtaggagaagatcagagagagagattctggtttctgtaacaagggtcttgggagtgagttatgagccaggaaccatggacaaaacctatatatgtcataacatacaaatactctgcatgtaccaactactcaacaaactcgagcagcaagaacaataagaaacaatctacttcaagcatatctgaagcatatataaagaggataaaaggaagcaagttgtagggttccagtcagtggagaggcgtgaaaatccaattgatttgtaggataacaacaacgatggcaggtaagcatggcaagaatttgtcaaatatttctgtaatggcagtaggttgagtatgttttcgtttatgtaagactctttgaatagcaaatactactcaagttttgatgttttctctttttacaaaaataaattttaatgtaaaagatgctttctaattctataggaacaattctcacatgcaatacttattacatgggcttgtgttttccttgagttacgcatcctttcaagcacggtttccccagctgcaggaaataccctgatgcttatggtaaaatctgtaaactttctgtattaataaatgtcacccatcaacagtggatgactttattattcaaagtcaactccatcttaatatctttcttaagtttttaaactctgtttcccatcactcttgcaattggatttactaaaataacatggtattttatcactttgcaagctatgtttatctggaactacctgattatattaagtttcaaaaagaagtatcctattatattctactctgcctaaggaaattatggtgcttgtcataagacctaactactgaccagagtggttgatttttctgcagaaaaagaaaacatggccctgataatggttttgtcaaatgggcactttaaaatagacatatcctgaaatcagtagggcaggagtattttttctattgttattcctaatgaaagaataaggattcgatcaatgccatccagaaccatatgattaggcagggttctaccctccaacagcatatatattaattctttccaactcatggttgggaacacatataactttatttggctttaaaaagtgattttctattgacctaatgtgactaatgttcttaggcaatggcaaaacaccaaatgtgcttacaccgtgattcacaaaaagtgatacaattcctcattcagccaccagctaattccctctgtccctaccagctttggactactatttaagctaagaactaactgatgaaaaaataataaaagaagaaaactgcttttgtctatatctattacatctctggtaattaaataatgattttagaagtttccccaccagtttctccaattctgcagaatttaagaatcaaaagttttctaagtcaaaagaataaactatgtacttgtctctttttacctattcctcatctcctaaataatttatttaacctatttcccaactgaattccacttcattcattcattttttttgtaataaattgactaggtgtctattgtgtgtcaaagaagaagggatagagacagaggaaaagaaaatgacaaaaaattatgtacaaggtttatggtacatggtaacaattgccttgaatatctcttcctttgcacatgcattccacatgcaattgattcttaatctgaagtcaaagaacctttgaagggctgtgacagagtaactgtaagaggtctgcaaaggcctaggctcatcaacgtatacaccaaagattattttcaggttaaatataccacatatacattacaattttaaaaatttatatagatactattgtaagtatgttttttacaaaaaaaatgcgtagcatctggaaatgatactaaaaatagttaacaactggttaagcatgggtttccactaattcagtggactggtggccatcaacagctagcatggacaaactggtttccaccagctgcatatcacaccagcaaatccagttgaggaaaggcaacctcttcctctctatttcatcttttttttttccatattaaagaaaggtccttattttaaaaatatttctgggagttattattctaaaaaatattgtaaacttgcttggaccgccataaccttgtgacaaaccacaactcccatgagaaattataacaagtttagaactaggcctttgttggtgctttgtcttttatcatatttaacagagttattccctactttcccacttcttcccagatgttttaaaggctgtaaacctttcaccatgaaaaagtctgtcttaatttatactctatgtataatgagaaacgcctagtttcaggcttatgtatccaatttacttgaaccatttaatatttagcttacaagaaaagttccagcttgtgaagaacaaatgaaatgggctgcaatttgtgctaaactattttaaccctgagtatgtttgcaattggaaaaagtgtgttatgagaatgaacaatagttctttcctaatgagagaaggaaacaagctgggttgacttggctacctttcactttaaccagcctaagggagtaactcctaggttctctctttctgttagtttagaagaaaaaattactcaacatatttagtacatttaagataatgaatcatttaggcctatcactacctcagccaacaggtagtgataggaaggacagcatagtaactgcaagaaaacaaaatgtgtaatctctctatctttcctacagatttagaacaaagccaaatgactatggcaacatttagaaataaagtggtagtaataaggaaaataaattaagaatttagtcatacttaccaaaatgtaaattttaaacataatttatacatattcaaatgtagcactggtattttgtaaacctactaaaatcataattttaaataaagtggcaaaattataccaactactactactcttgggaagagtggtgtcaattccggtcatcttcttaatctaaaattaaaattctgagggtctactaatcagaagaggtttcagatatcaaatcattgaaaatgtaaatccaacttccaacaaaactaaccttaaaaaaggcaaaccacttgtagtcattcaacacaatctcaaagccttggttgtaaatgatggtgaaatggccagaattgccaaggtcatcatatgctgtatccagcttctgaaggtacaccactacttttttttcttgtggtcctaaagaaaaaaaaaaaaagcacaataaaggaaaattatttggatttcaataggggaaagaatcccccaatttcaattttaattgtgctgctttcctttcatgctacccagtttgagcacagtctgcctagtgaagaaaccagaggctccatcttgttgcctcaaacagttcctgctccgaggcaagactgtgaagttaggctctaaaaatttgagataatgcaagcagaagcagtggctcacgcctgtaatcctagcactttgcggggctgaggtcagaacttcaagactagtttgggcaacatagtgagaccctgtctctacaaaaataatttttaaaaattcgctggttatggtggtgcattgcctgtagtcccagctatttgagcggctgaagctgaggtggaaggattgcttgagcccaggagttggaggctgcagtgagctatgattgcacaactgcattccaacctgggcaacacagtgagaccttgtctcaaaaaagagagatatgctatgcagcccagcaggcagggagacccccaaaactacagtacctttccagagcatcccaacactgaagaaatttttccactgaacaaaaggagaaatggggaatgttgaaaattacaggcttccagaaacggagaaaaggcaaaatgctagtcaaaagtgggaaatgcaagaataaaaggtatgacaacaaaaagataaataaacagactatcagatcctaaggaagacaatgtgctaagcccaggagaagacacaaaatgatctattcggagaagaaatggggtacctttctcctcaaaggctctacagtttagaacctcataatctgaatccttccaaagtttattcagcaaactagaggtctgtatcctataaaaccaattagtgctgataggaatgatacgtttaaccttcatagatgagggctcagacctgtgggtgcctttaattactgaattaaggccaaaggtaattttataggcagagccttcctgaaaatgattcagctgtgtccatctggagagttgtgtattttaaagtttttccatgtttgagagtaatgctctgacatgggagattgcatgtgacagggcagtgcaaatcctgatctctttctgccccaaccttcaaactcaaatttaaaaaaaaaaaaaaaaaaaaggccaggcgtggtgactcccgcctgtaatcccagtactttgggaggccgaggcgggcggatcacgaggtcaggagatggagaccatcctggctaacacagtgaaacccgtctctactaaaaatacaaaatattagccgggcgtggtggcatgtgcccgtaatcctagctactcgggagactgaggcaggagaatcgcttaaacccgggaggcggaggttgcagtgagccgagatcccgccactgaactacagcctgggtgacagagcaagactccattctcaaaaaaaaaaaaaaaaaagttacaatgttcaggattatgaaatgctatacagtcagttaaaaaggtatttctttagtaacaaatgacttaatctttgttctgttgacaagaaaattatagctgattttttactgactctgcagaagtcacaggctgtaagagggtttgggtagaccacagtgtgactcttctaactagtgattgtcttttttccaccccacccccttcactaggttctttgttctaggggtaaccatgttatctgaaggcatatggaatatctccagtatgttcaaacactaggtatttattgagagccttccatgagccaaacattgtgcagactctgggcatttctaattactaggttcagagttaagttttctttgttattaattttttaaaaaatttttacctccttgcaatgcatgaaacaatgcagagtggtactagccgttttctagtactcatcaacacccgctcaaaccaaaatcgctgggcagaaagtccctttcccaccatctaacaaaaagagaaaacttcatgctatatcctcgagagtctctgagctcatctatcttcactagtaaaatagtaataaaaaataaaaataaattttaaaaataacgctaccagatcggactggagaaccaaacgattgcagttcccaagtctctctcaaagcaaacaaaattaagcgggaggaataaaaaagttcttgatcaaagtgttgagtccccaagataaccaagaaagtgtggagttagaagttctcagcagatgaactttaacttcgcgagcctggcggggaagaaggtccccaagggtccccgaatccagtcaagatgctctggccacccacaagcgtctgcctggggggaagcggtagttggcgtggcgctgcgttaggggctcaagggcagaaaggacgacccggaggactgccgagccggcggcttacccataaccgagcagttgacatcgcgctgggaaccgctggagcccacctggaagacccaggtgcccagcaggtcaagataggtgcagttggcaggtgtgtcgcagcgcacggcgccgtcgccggagagaagcagcaggagggcggcgagcagcaaggagggcccagcacccatgctgcagggagctgagaaaagaggtgaagaattaccaggaagccgagcgctgcgggctagcggtgagtccaccacgaggcgcgcgccttgaaatagctacg

SEQ ID NO: 1653 - DNA, 17780 bp, Homo sapiens
tggaagttctataaaatatgtatttgctaaacattggaaacaagttaaatgtttatcaattgagtaatggcaagtaaattggggtacatgatcttgaaggaacatgacttattctctcattcattatacaaacatatagactgccaaagagctatcagatacacagcaatttaacagttaccacatctgacttcaatgaatacacagtctggtagagtcttctaaaatgataattaccaaactacatagaaagcgagcactatttgtggtctaacgttaagaggaaaacaaatcagattataaaaccatctgtacattacgattgcaactctaaacatgtgagagtgtgaacaaggtctggacgggtgaatacaggaatgacaatattgatgtggttagattggatgactttttctttagcattattacaattgttttcgagctttaaacttttagattgttccaaacgtttctaggggggaaaaaaaagctgctcccatagccctggctccccaggttggcagtagcatgaatgatggggtattttcccagatgggcaggggcttgccacaaggtgactgggaggggatattcaaggcagtccaggagagttgggttacggaaggctatcactctgtagacttgggagtgctcactgggtgccatcgtaagaaccagcctcttctgtgtctgggctatgccacgcagcagcacctgcaggctcttccaagctttgtcagcaccacaacttgggcacagcacagcagtgccaggtgtggaaagcagaagtctaagaggcagacaaaagggttgagacctgcaagagttggtggctagttcctcatgctggaaaggatgatctctatgtgaaaggtaccttatccctcttctacagaccaggaaactgaagcttgatttgtcccaagctactggagttggggttggaatccatcccttcttatttgggggcagggtttttctatttcccttactggcctgggagcaggtggagatgcatgaggtcatatggaagagacaggctgataggatgggtggagtcctttgggaaggaggaggcaatggggaatctattggtaggaccccatggtggacgtatgagaagccaagcatttgagttttgactcgatgcagtaggcagtggggagcccttgcaggtttggggacatgatggaagagggcttaatgaagacgaggctggtgtaatcaggggagaggctggatcaggcacatggtaagggtgatgtgtggcatttgttttgtgtaatcagaatagtacccacccatccaacttcttggaaatatgtatttctgcttctccatgagattggactggaagcttccatcttatatatcccttccccatggataacagcaccttccagggatgggcacctgatacaaacttggcctatcagagcacttccctgggaattttgcccttggggccagagaaacatgggtgtcagtccctctctggtgataaagctgtgtcatgtaaagtctgggggatctataatgactaaaagatttgagagtcagagagagggaattctagcttggctcaggccctggtttcccctcactttgagggctcagacacccttttgcttgtgccacaatatgaacaatattcaccaccctcatttaactaaactagtctgagttgaatttttgtcatctgcaaaccaaaaagttctgatgacatttgcagtaagagaaatgtctactctttgtcattcaaagagttcaatttgttcattcttcaaattttgagcacaattctcaacaacactctagggttgttttgtgtgcattgggtccatcattttgtgcctgtaagaaataacaacaaaaatctttcctcactagtcagcatcaggttcaggaactccaggttctctgtagacacaaggctttgggattcccttcagagaaggagcaatgcatctccatcactcgtgtggtaagtaaaattgctgctcagaacacttccatgcctgctcctttgtgattcagatgaggagaaatcaacgtggactgagcgcccacacaggacagccaggcatttcccatacaggtggtaaaggtatcttctgaacttctccccagcaaatgcatagatgagaggattcaggcaacaatggctaaatgcaaccgtctcagtcacactgagggccagcctcagatccttcctcatgtcacaactgggaaagaagtcatagagcttaagcgtctccaggaaaatcataacgttgtagggtgtccagaagaggaaaaacacgatgaccaccagaaggatcagtttaatggctttggctttcttgtggttcttgcaggaaaacagcgtctggatgattctgaagtagcaataactcataatgagcagggggagtaggaagccaagaaaatttgtttccacattgcggagcacgggccagatttcctggaggacctcggggtagtcaccaaggcattcattttctttctgctttgtgaacatgaactggggtgctgccaccaaaatggctgctgcccagacgcctaggctgatggtgacgccatgctgcacggtccggttgttcatggagttggcggccaggacgatggccaggtacctatcaatgctgatgacggtgatgaagaatatgcttccaaaaaagccgatgaagaagaaggcggtagtgaatttgcacatggcattgtggaggcccttttcatttatcaaatagtgagtccagaagggcaaagtggctacaaacagcagatcagacaaggccaggttcaggaggtaaatgtcggtgacactcttgggcttcttgctgttggtgagggcaaacactaccaacaaatttcccaccaggccaatggcaaagatgacggagtagaatatggacaggaacacagtcccaaagaccacgatgtccccaatataacaggcctcagccaaatcatcgtactcaaagttttctgtcactgattcagggaactgatccatggtgaaggcctggatcagaaagaaaaacaagtaactgtgttagttatcagagaaacaaagttggaattctgtgtggcctcatatgtaggcaggcaggaagaaacaaatattggttgggtgcacactacatttcccaacttcccacttgccatcttgtttaatccccacaacagtcttgtgatgaagactgcaacagactcttctgacaggagaggcggactcctttgacttgcccaaagccatgcagtaaatggctctgtgagcatttggctctaggcatttttttttttttaaatggagtctcgctgtgtcacccaggctggagtgcagtggtgcgatctcagctcactgcaacctctgtcccctggggttcaagcgattctcctgcctcagcctcccaaatagctgggattataggcgtgcactaccacgcctggctaatttttgtatttttagtagagatggggtttcatcatgttagccaggctggtctcaaactcctgacctcagattatccttccgcctcagcctcccaaaatgctaggattacaggcgtgagccacagcgcccagccagctctaggctttttgaagcttgagacagatctgttttacttttactgcccaaaatctctccaaaagctagctagtttgaccaatgtgtggatgagaaagggagaaccatgagcaggagggggaggggggtgagatggggtgaattgggggtgcagctgtaattcacacttccagtccaaacttccccaaagcaattctccatcctcttcctttgtttccaccttttccaccctctggccccttacttttccatgaagctaggcctggagagagaagcctcagacccagagccttgggcagaacagcacccggaagccctcatctttgttttttgagaaccatttcacctcctcttctccttataatcaacaagtccttctctttcttagcaggtatcagacagagtcatacactctagagtgactaccttgttttgggctgcccaggactttcctggttttagccctgaaagtcccatctattgggaacccctcagtcccaggcaaatcaggactgttggtcatcctacaacgctaagtgaagagaaggtgttgccatcattcaggactctgcagtcatagaggggctgactgattcaagatggaggatggggctccgttagtctgctgggctagtctccgggtgactaattccccctacgattaccagccctatagttcactttggtttggacttccccactattcttatctcctgtttccttctgagcaggaattgaaaaaagaagacacttctgcaggctgcactccccttcttttcgcagccaggacttgctgctcattcactccagagccggctgggaggcagccctttcacacggctcctctgggcgtctcctcgtgataccacagatgggtccctcagaaaccctcaaaacaggcctcctggttgtcactgcctccctccttaccacaacttacagcaaagctcacgctttaaccgagggagtttccacgccccactacaccctttccatgatggttttacccaggtggtgtctcaccaagatgagggcccacccagccagggtgtgtcacttctcgcttcccagcctctgctttggggcctgcatctcacccagactctcctgggataagtgggccggggctttacaacctaagctgtctcaggctgtgatgagttctcaaccccagggaacgtgtatgctttctctgcttcaggctacaatgcccttttctcagagaataatctctggctgtgacgttaattaataacatttaagtcaaatggtataaaatggctgacatacagctatttttgagccacatccatgtcagttttatatgactcaagctaatatgtgggaaacagaaattgctacttagtgcctgcagcttgtcacagagcatgatcttcccagacaagctgctgtatgagtaaaaatagtcaagtccttggtggttctatgttagggaccctggagctagctactttctccctccccttcccccagtgagaagagctggcaaagccgacctcgagaggtggccaaatccagtaaaaattgtctcgcatctctttatgtgcctgtggtcggtccttcagcacaggaacttctgtggactcgggcactcccgagattgaatcctgcatctgtcctctctggctgagtgatgggtgagcttgaaacctctgagcctaacattccttgtctgtaagatcgggattcattctcatgcctgcccacagaactgttttaaggggagcacctggcacagtgtgtcacatacagcaagcacttaatacatgttcaatttgtttcctgcattatgtgaggaagcaaaagccctttggatctttggaaacatccaggctgcctgtggactcccatgttccacctccaccctgggtatcctgggaatttggtctttaaaggtcactttatttttttttccccctgaaataagacatgctttcttttcagattattttgggggaggtaagccaccctttattgagcttttactaaactgtcaggctcattgctctgtttggattaatattgatctaatccgttctgcaattctgaaaaaaaaaagttctatatttaattcactgcactgctgaatgcctctggggatattcatgatgagaggaaggaatgggacaaatgtggagaaggaagggaaagttagaaataagcaactgattgcctggtggagtggcagaggggtcccaaatcaggccctttgccttactgggtgcttgggctcagggctgccacgtgcacaggggcatctctaatttgcaccaagtctccatataagctgggggtggtctggcttggcaaggagctcatgaaaagatcagtcaggtacagtctaagccaggaaggggcttgtcttctcaatggggaaaattcacataaagactttgattaagacagaatggaagaagtgggtgaatgtatcttctgcagatgggatgcaaattcagataatgctctgggcaggatggttttgcctgatacgtggtgatattatgtattgagagccaaatggctggttatgggcatccatctggcttgggactgctccctgccatccagggggtctgctcagtgagggcagacgaacactctgcagccctcatcctagctccctgctgtctcagagtccccagtgaagaccctagaattgctgtggctcccacaggagtctctcagtgctggcacagtgggtgcatgcagtgggtgctcacccagcatatcatggtccctgctatgagccatctggaccatgctacagaggaaagagcagtaccaatatcgctttctatgagttcccacgtgactctgaggaacagcactggtcattgagggacatttttgatcttcatgttcacatttccattttgcacacactgtgcctcacaggaggcacagctgggtgaagcacctggcccatcccacagctagaagcagggggagcaggactgaggccaaggcctgtgctgttcccactctcccttgaagatggaggagactcgggccctgggcttaggggccaaatcctggcaggggagaagagtcaaggactcgatgactatcaaacagttgagtcccaagtccagtggtaaaaaggcatcaaaacaacagccttagcttcctcctctaaaaaaataacctcttaggtttgttgagagcataagaattaaattactttaaattgcttattgggatttatcgtagacacacacatgctcaagcaagtgtgtacactgtcactgcaacaagcttcaaatataaatgaagggaaacaaccccaatgtccatcactagggacagatcaaagcacgataagtccaattaatggaataccaagcagctgcttaaaaaccaaacagtttctagctcttggaaacttgggaaaaacaacaaaaacaggcagatctgtatattctgtcatgcaacaatctctaagatatactggtaagtgaaaaaagctaggtgaggtaccatgtacatagtatgctgtcatttgtggaaaagaatgatgtgtgcgtattttgtataaagtttaaatatctcttaaggaatacactggtggtggtaattatccctggagagggattctgaaggattgaggatatgggaaaggagacagtttttatggtaaacttttggaaatgttttttaccatgtacacatactacgtattttggaaaatagtttaattaattcgtttggaattttaaaataaaaatcaacaaaaatatgagttatatgaaaaactaaaaaatgagtaacttagtacaataacaagcatgctgcacataataagtggtagccaacatataaaaggatcatctctatttttatgggcaaatagatgaattcagagagggtgaataacttgttcgaggtgatgcagtgtgtgtgcaatagggctgcagtgagggcccagatgtgttcggcctcagcacttttttttaacttcacattacagcccttccccattcctttttcccaagactaggagttcctaagagaagacccacgtcctcttcagctctgcaggccaatgttcaacagaaggcctggtacacagcgaatgccatatgaatatttgcagaaggataaatattatatcctagacctttgttccaaagagtttcatctagtagtgatgacagcaccctatcagtcaccctgatcccaggggtgctcatgagcacacaggtgtcctttctgatcataggctaggaagccttgaactctgagaagttagtaggtgcctgatgtgttaaatgaattaataaataagtgaatgaaagacttcaaggagcaagaaaagagattcgtcagctctataatatggagccccaggagatgagaagaggctcaccagctctccacagtcagaagacaacttggcaaacacaacctctcatttcaaccatacctctcacatgtggcttttgaacatatgtggtcatgaaatagatatcagcgtgggtaattgcagctctgtcttctgtgcaaatctcaagaaacagcaggagtcattgggcaacatagggttttgcctggttctgaagagacttgtattctgtgtgctggagctagttcaaaccgcccttggtagccaaatgccccagagcatgtgaaggcaccatttacataaaaaatctgacatcgctgaagctgtgtccttcgcagaagtattccagtgaacttgatagctttagcaaggcgctttttaaggaagactgagcctgagctgagtgtacctcctatttgtggatcctccaagatgttcaaggtttgggagctgagcctaagatagggcctcctggcagcagatgcgagtgtggccgtgccttgggggtggccctcagggtggtcaaaggcctgccagaggtctaattggttttcatcttagactggaccatggctttcctttgtccctgagggacactagaaaccaagtggaagaatcaaatgagaagactttgcagtgtctacccagctgggtttcatatccacaagggttgtaagacgcatgcattctgggatgttgcactaataaaggcatcatcaactaaggctgcactttacaacttagtgcagcagccagtaagaatttaaaccttctctgggccatcctcaggcctccttacccactattcagttaagccaaggttttactaaatggccttgagctgggagagtttcggtgaacctagacagagctttgagtgtacacatgtttcacacccaagtagaaatttgtaaaattccccactcacatccgtggctgatcctggtctacttcctctggcctacttccttttctcatgcctgctcatttattttttaactttttaggggagggacactcatcattacccattgtttccaatcagcttcccttttctatacttcccttcttctttaggtggccagaatccatttcttcttcaatctgacattcttttatgttgctttctccctctcttttggcttcacatccagcttactgttttctaaatccagtgtatcttctggtagtttttaccctcctggtctctgtttatggctttttagtaaaagtgaagactgggtttgaggttcagtctggtgccaagaaaattgtgaggcttaatttttttctttgtaccaaatgagagtagagaattgcttgaggagccccaacccaaactttccttatgaggatgccattgtgctgttgacattgtggaatctgaagtcaccctcagaaagccccagtttagaaagggaggaggctgccattcccggatgcctgctaagtgtcatgctccacacacaagatcccaccacattctcttcacaaccccactggagaaatgatgatccccatggtataaattaaccagcagaggcccagagatttggttaacttgttcaaggaagcaaaagagccaggatctcaaccccagatgcctctttccacaaagcctgtgctccttgcaccgcacaatgcttttctccctggaggggaaatctgcaggatattgcaggccacttctctcgaagtagaactgaaaatagtagacccaggccccttaagagaaactggtccatgatgcatctctgaattcgttggggttctccccctgtgggctcataacccagcaggctgcccctcagggattggtgagtggaaaatggaatgcgggatattatttgctcctctagccaccactaggtggtccacactgccagatccccaggaatctagctcccagcaaccatagtgaggaaactggggtcattttctctggagaggaaaagtctgaaggctgaaggtttagcctattttctgccttcaaatatatgatagtgcttttaagagccacatgtttcacaggagcccatacatttctgagcatgaatggctgagagaccctgggcaggtcactctgctctgcttcagtttcttgatgtatgaaattaaagcattggaccagaccacctctaagagccttgctagctctggcatgctcaatttttcagcaagaatcaaacagaaggaaactgtttgtttgagacaggatctcgctctgttgcccaggctggagtgcagtggcatgatcatagctcactacagccttgaactcctgggatgtagcaatcctcccacctcagtctcctaagtagctgggagtataggtgtgcaccaccatgcccagctatttttggtagatatggggtcttactatgttgaccaggctggtcttgaacatctggcctcaagagatcctcctgcctgggcctctcaaagtgccaggattacaggtgtgagccatcatgcctggccaaggaagcagtcttaaagagcaacatgagtcctaggtcagcaaaagtgtggtctattgtcaacagagaggctgcccagcagcctgcccagggaacatgacacttctacacttctggggcacagcctgtgagcattcagatgaggttctgtttggagatagggagctggatcagttgatcaagtcttggcaaatcttgtttaccttgtactagatagaaaggttctcagtcggctgccatgcccagacccctgactgtttgggaagccaagttttaccaggtcctgatggttttctcatttatgatggcagctatttttataacacatatcccttgggattcagagagagctaaggctgatggggagaggggtgctgaattccatgttaaggagctataaggaaacattttataccccatcccctatgcaagtaaattcagtgactatctattcctatagcaatgagcccatctagaacagcatggcattgtctacccaccagtttttcacacaggccaaatgcacacccaacccttccctccaaccaccaccaaaaaaaaaaaaaaaaaaaaaatagcaacaggagaatcctattgggtttagtgaattgcccctttacaaaacctgccattattttgtgtttgaagccccacccttccctttcctcttcaaaatactttatggtatttatttatttatgtcaaagtaaactgtgaaattttgaagggaaatacttcataatttttttaataattaggaaagagatagacttgttaattgtttaattattaattaagtcaatatttttgagcatctgtaccatattctagtctaagtagaaattaaaaataaaaacatttaattattcttgttaaaaataaggacagagatctcctcaccttctgtttttttctcagagcatttactttagaaaactttttttttttttgacatggagtttcactctcatcgcccaggctggagtgcaatggtgccatcttggctcactgccacctccacctcctgggttcaagtgattctcctgcctcagcctcccaagtagctgggattacaggcgcccaccaccatgcccagctaatttttgtatttttagtagagacaaggtttcaccatgttggccaggctgatctcaaattcctgacttcaggtgatccacccgcctcagcctctcaaagtgctgggaatacaggtgtgagccaccgtgcccacctagaaaacttttacatactttctcctctctttgaacatgtgtaaatccttttgaaactagataggctttttgtcagctttatgagctaagctagtctttcccaaggacctgggcgtcatctctttgaaatgtaaacaaacctaagggagatagtgcttctatctcttagtttctgtgggaaggtatgagcctaactgaagagccttgctcagtgctgcaaaattaccccttgtcttaaagataaatttgattttcctctgggtagagccagttagctaacacaagtggttaccctaattaccaggtaaatttagagtgaaccatgtacggcaaacggtgctggcaagacctcttacttgaggaacagttattgtttgccttgataacatgtatgtaacaggttgtatctacttggctatacaaaagggggagatttctttctgttcttgcaacctcttagtagatggcctataatgctctgcatattttggtttactgcttattccataataaaactgttctttctctactccttttgtggagagaatctctgtgttgaaagaagactttgttaattatatttcaccaatactaggcactgtgctagattctgtagaggcaaaagtgtttaagatacagttcctagaagtgtttattattgctcagtaacagaatataagaaaagtcatgggaagcccaaggattgaacctctatatctgtctccttaaaaactgggggagggtgatcaagaggatatcacaaaaaaaaaaaaaaaaatctgccgtttgagctgatgttttaaggatggggaaagtcttccaggttgaccaagatggaggtggcagtgaatagtgggtgggctttgaagacaaaggcacagagggtctgagcataggaaggtttcctggggccaaggccaggcagagggaaataggaacagaaggcagtgaagatggtggagttgggaggagcccacatgctcccagagtgttcaggaaagtcagtttaggctgagtgcagggcttcggggaaggatgcagagaaagccaaggctgaaaagggagaagagggacatagagaggggtctgaaattccacactaagtaactacaaggaaaaatgatgaaagactttgaaatagacacacactgaagattactgggagtcctttctggcatactctttggggctacctcccccttttattgcctgagctaattttacagcaccgtaggttatagcagatagcagtgcaaatgactcttgctcatggaaatacaaattttgtctagtggagatgcactggattaagtgccctgtagatatggaccaattgtgcctttatctctaaattcatctcagtatttctggaagcatctcacccatgctgttggtttggctgtagactgctaattctccttgctgcgtaggattccactgtgtgactagtccatgatttattgccatttctactgctaatgcacacataggtggctttcagtttgttgctagtttggacaatgttgccgtgaaaatttttgtgcatgtacatctcctacaacgtggatgcattttaaaagtttagtcttgagccaaaccaaaaagtatgaatccaaatatgaagatcaaaaataggcaaagctaagctatattgtttagggatgatatttagattcagtcaaactatagggaaaagcaaggaagtgatcaccatagaagtcagacttgtggttctttgtgggagaggaagaggctgtggtcaggaagggacatgagagaggcttctggggttctctttctcagcctggatggtagtaatgtgggaaattaaatctaatactttgctaacccagacattgttctttcagtgtgttgtattttgcaataaacaaaatacaacacactgaaaagagactttccattttctccttaagcacactttaaggggaaaacaaaggtggtctaggaagatgtttaaagacatatgatacagcttttcttccttactcacaagctaaaaagctgcactttggccaaacaagatgagggggtcgaagcatcagctgtggccagcgtgccgtgagaatcccacctgtgaagcagccagcagattctgagcccctcaagagggcaggtgggatcaaggttcagctagaagccccaactttcccctggctcttctgggcagagtgagtgatgccagagagcccaacttctcggaatgcctgggctgtgctgctaggaatcagaacaagtccttgggaaaggcagccaagatctggattctgccattctggttccactccctcctatgaccgtgacctgctgtggagcagcagaagttcccctccttgttcagctcctccattacaggtgctggttccaaacgtctctggactcaggatactgggtcagaggctggggctggggaggagcagttggatgcctggatcccaagaaggaggttttttgaggctagggtctctggctagggagaaccatacctgacattgccactgtgccatagctgcctagggccgggcaggcttcctcctgggatggggtggggtgaggaaggggatagacgatcgtcctgactgggtcagctctaatacgttctttgctttcctgcccctacagctctggattcttcacaacctcattcaatagtagtcagtgtttttcaggtatccaaactttctgaggctcagtttcctcatgacaacaacatatatcgtttcttgagcatcaaagatgggtcaggcagtgtgtttgggacttcctataccatgcctttaatccttgcagaaagttgacacatacccattacatggcttcaaaggctgatggacaatctccattttaaaagcaggaaacagacttagcaagcccagtgcacagtcaccaagtgcagagccaggacttcattcctgacttcattccttcattccaaagccaagctgcctatgtccccatctgtgaagtggggccagctgaggagcagggttcaggagcagactttgtggagactggcacgtggctgatggatagtaggtgctcccatcccagaggtgtggcaagtgccaggtaagcctgagcactaagaagaaccacactgaagttgggctgagactatttcctgccctgccttcctttgtgaaaataaagccaagcaaagaggaagatgaaagaatccaccctagccttcctgagcccatttctcattcccaggggttttgaaccccaatccactgcccccattcccaacccacagtggtcctcaaggctctccagcacaggtccgtcacccaccctgcctcctctcaggaaacccagctccctccaaagcgccctctgggcctgggatgccctgagcaatgcaagctttcttgcctgctttcacgtggttcaattttcctttttttttggctcaatttttttctgcctcaagttttctacctcaagtatttcaaaaattaatttttttttcttttcttttttttttttttttttgtggagtgggtgttgaaagaatcctaaactttcttagccattctctggactgagctataaactcacaaagcaaggattgcaggctctgtgaggctgtgattgccagaggcaaggcaagagaaataacaagccgtggtcagtcctcagctggggcctctgatggatttcctcctgtcttgcactcataatttctttctgaagaccatgttttccacccacacaaacctgagcctgagtatcctcacaatggttataacaacatatatcaaaattgaacactaaatttgtgccaggaatttattaatggagaaaccccgcctctactaaaaatacaaaattagccgggcggtggtacatgcctataatcccagctacttgggaggctgaggcaggagaatcacttgaacccaggaggcagaggttgcagtgagccgagactgtgccattgcactccagcttaggcaacaagagcaaaactccgtctcaaaaaacaaaacacaaacaagaaagaaaacccaaaaaacaaaaaacaaacaaaaacccatagatggtacaaaaagtggaagaaaaaggaaaaaaaaacccatgaaactatctgcaatgcagtttcctagaatcaaccacagtaatcttttagcttttctctatctaaatgttatacatattttatatttatattaagtgcatttatatttatattaaaatacagatacaaatttaaaaactctttattattaaattttcaaataaaaagcaacttttcaaataaaagcagcgagaacctccttatacccaacacctggcttcaactattagcaacccatggtcaatatttcctctatttcccacttaatgtctctactgaattatttaatttcacccataaacacttgtgtgcatctctaaaagttaaggactcttttttgaaaaagactttaatacaatttctcatctcaaaaaattagcaataattcctcaacagcatccagatgcaatttttcatgcttttttcagttagtttaaaatcatgagcttttctccatgtctctaaaatgtaattactaatgcttctaatactattccaccaggttgagtgtattataaatgatctgatcaccccttgcctcccactcttccatccccttggacatatttaggctacaacatccccaggaaaatggtttccattgtctgcacgtaagcaaacaggcattattaacctattagctgtccactgctccaccccacccacaggtacccaactagtcctgtgcacctacctggcgtggactgccaagggaacctctggatctgccagtcagccaccctgtcctgctcagactttaccagagacgagtatttccctttccttccctctaagagcattttatttgcagagttagccaatagtatcttgtttcctgtaagggagactatctttagatgctgccacaggcaagctcagatactccagggtggaggccagctgccaacaggagggcctgactttataaacctggaagatctaaacctcagggaagactgcggagctggagggagagaggtgccacttaccccaacctggaggtggggggcagggagcaggccctgcagtcagcaaagcacagcacagtcagctctcattaatggggagccttcaggaagctgggagagctcatggggccctcagcttccctgcccacgagagggagcccagagtactcactggaccacactggggcacacacagctcttctcctcaaagtgcagtcccaggcactgggagcttattaaagacagcacctcaagccctgccctatatctgctgaattagaatctgcattttaatgaaattcttagaagagtgatatgcatactaagtttgagaagctttggtactgaaggcatctagtgagtaccttgcaccttgtagatgctcggtaaatatttttttcctcacctctctgccccaaggcatttagtggctccctatacccatcagtcaaggctgaggacacagctttcacccaggacctggcctatgctcctttcacagtctctccccctgccactcttgccctgcagtggggagcctggtgggctccggcatccagccatgcttctgctccctggcctggccagcttggggcgactgcaacgtgaatctcaactgccactgcctcatcaccttccgatcacttcattacctgcctgacccctggcatatgctatataattctgatccatccctaactagggcctggcccatggtggccttcaatacaccttcattaaatggtctgtgaccccttcaaggcccctctggccccttgctgcccacatcccagccacatccggtgctcccttacctctagtcgctgtggtgttccgaggacagcgggtgctctgtgtgctccccaccttgcccctcctcacctcccccaaccccaggacagagctgggggctgcagtgcagtgctgcgggcttggtggcctgctcatggtggaagaagtccaccagcagttttctttctttgttcttggtctcagtgtttggccacctttccctgcctttggccagaaggccacaggacaaaagc

SEQ ID NO: 1654 - DNA, 16946 bp, Homo sapiens
tggaagttctataaaatatgtatttgctaaacattggaaacaagttaaatgtttatcaattgagtaatggcaagtaaattggggtacatgatcttgaaggaacatgacttattctctcattcattatacaaacatatagactgccaaagagctatcagatacacagcaatttaacagttaccacatctgacttcaatgaatacacagtctggtagagtcttctaaaatgataattaccaaactacatagaaagcgagcactatttgtggtctaacgttaagaggaaaacaaatcagattataaaaccatctgtacattacgattgcaactctaaacatgtgagagtgtgaacaaggtctggacgggtgaatacaggaatgacaatattgatgtggttagattggatgactttttctttagcattattacaattgttttcgagctttaaacttttagattgttccaaacgtttctaggggggaaaaaaaagctgctcccatagccctggctccccaggttggcagtagcatgaatgatggggtattttcccagatgggcaggggcttgccacaaggtgactgggaggggatattcaaggcagtccaggagagttgggttacggaaggctatcactctgtagacttgggagtgctcactgggtgccatcgtaagaaccagcctcttctgtgtctgggctatgccacgcagcagcacctgcaggctcttccaagctttgtcagcaccacaacttgggcacagcacagcagtgccaggtgtggaaagcagaagtctaagaggcagacaaaagggttgagacctgcaagagttggtggctagttcctcatgctggaaaggatgatctctatgtgaaaggtaccttatccctcttctacagaccaggaaactgaagcttgatttgtcccaagctactggagttggggttggaatccatcccttcttatttgggggcagggtttttctatttcccttactggcctgggagcaggtggagatgcatgaggtcatatggaagagacaggctgataggatgggtggagtcctttgggaaggaggaggcaatggggaatctattggtaggaccccatggtggacgtatgagaagccaagcatttgagttttgactcgatgcagtaggcagtggggagcccttgcaggtttggggacatgatggaagagggcttaatgaagacgaggctggtgtaatcaggggagaggctggatcaggcacatggtaagggtgatgtgtggcatttgttttgtgtaatcagaatagtacccacccatccaacttcttggaaatatgtatttctgcttctccatgagattggactggaagcttccatcttatatatcccttccccatggataacagcaccttccagggatgggcacctgatacaaacttggcctatcagagcacttccctgggaattttgcccttggggccagagaaacatgggtgtcagtccctctctggtgataaagctgtgtcatgtaaagtctgggggatctataatgactaaaagatttgagagtcagagagagggaattctagcttggctcaggccctggtttcccctcactttgagggctcagacacccttttgcttgtgccacaatatgaacaatattcaccaccctcatttaactaaactagtctgagttgaatttttgtcatctgcaaaccaaaaagttctgatgacatttgcagtaagagaaatgtctactctttgtcattcaaagagttcaatttgttcattcttcaaattttgagcacaattctcaacaacactctagggttgttttgtgtgcattgggtccatcattttgtgcctgtaagaaataacaacaaaaatctttcctcactagtcagcatcaggttcaggaactccaggttctctgtagacacaaggctttgggattcccttcagagaaggagcaatgcatctccatcactcgtgtggtaagtaaaattgctgctcagaacacttccatgcctgctcctttgtgattcagatgaggagaaatcaacgtggactgagcgcccacacaggacagccaggcatttcccatacaggtggtaaaggtatcttctgaacttctccccagcaaatgcatagatgagaggattcaggcaacaatggctaaatgcaaccgtctcagtcacactgagggccagcctcagatccttcctcatgtcacaactgggaaagaagtcatagagcttaagcgtctccaggaaaatcataacgttgtagggtgtccagaagaggaaaaacacgatgaccaccagaaggatcagtttaatggctttggctttcttgtggttcttgcaggaaaacagcgtctggatgattctgaagtagcaataactcataatgagcagggggagtaggaagccaagaaaatttgtttccacattgcggagcacgggccagatttcctggaggacctcggggtagtcaccaaggcattcattttctttctgctttgtgaacatgaactggggtgctgccaccaaaatggctgctgcccagacgcctaggctgatggtgacgccatgctgcacggtccggttgttcatggagttggcggccaggacgatggccaggtacctatcaatgctgatgacggtgatgaagaatatgcttccaaaaaagccgatgaagaagaaggcggtagtgaatttgcacatggcattgtggaggcccttttcatttatcaaatagtgagtccagaagggcaaagtggctacaaacagcagatcagacaaggccaggttcaggaggtaaatgtcggtgacactcttgggcttcttgctgttggtgagggcaaacactaccaacaaatttcccaccaggccaatggcaaagatgacggagtagaatatggacaggaacacagtcccaaagaccacgatgtccccaatataacaggcctcagccaaatcatcgtactcaaagttttctgtcactgattcagggaactgatccatggtgaaggcctggatcagaaagaaaaacaagtaactgtgttagttatcagagaaacaaagttggaattctgtgtggcctcatatgtaggcaggcaggaagaaacaaatattggttgggtgcacactacatttcccaacttcccacttgccatcttgtttaatccccacaacagtcttgtgatgaagactgcaacagactcttctgacaggagaggcggactcctttgacttgcccaaagccatgcagtaaatggctctgtgagcatttggctctaggcatttttttttttttaaatggagtctcgctgtgtcacccaggctggagtgcagtggtgcgatctcagctcactgcaacctctgtcccctggggttcaagcgattctcctgcctcagcctcccaaatagctgggattataggcgtgcactaccacgcctggctaatttttgtatttttagtagagatggggtttcatcatgttagccaggctggtctcaaactcctgacctcagattatccttccgcctcagcctcccaaaatgctaggattacaggcgtgagccacagcgcccagccagctctaggctttttgaagcttgagacagatctgttttacttttactgcccaaaatctctccaaaagctagctagtttgaccaatgtgtggatgagaaagggagaaccatgagcaggagggggaggggggtgagatggggtgaattgggggtgcagctgtaattcacacttccagtccaaacttccccaaagcaattctccatcctcttcctttgtttccaccttttccaccctctggccccttacttttccatgaagctaggcctggagagagaagcctcagacccagagccttgggcagaacagcacccggaagccctcatctttgttttttgagaaccatttcacctcctcttctccttataatcaacaagtccttctctttcttagcaggtatcagacagagtcatacactctagagtgactaccttgttttgggctgcccaggactttcctggttttagccctgaaagtcccatctattgggaacccctcagtcccaggcaaatcaggactgttggtcatcctacaacgctaagtgaagagaaggtgttgccatcattcaggactctgcagtcatagaggggctgactgattcaagatggaggatggggctccgttagtctgctgggctagtctccgggtgactaattccccctacgattaccagccctatagttcactttggtttggacttccccactattcttatctcctgtttccttctgagcaggaattgaaaaaagaagacacttctgcaggctgcactccccttcttttcgcagccaggacttgctgctcattcactccagagccggctgggaggcagccctttcacacggctcctctgggcgtctcctcgtgataccacagatgggtccctcagaaaccctcaaaacaggcctcctggttgtcactgcctccctccttaccacaacttacagcaaagctcacgctttaaccgagggagtttccacgccccactacaccctttccatgatggttttacccaggtggtgtctcaccaagatgagggcccacccagccagggtgtgtcacttctcgcttcccagcctctgctttggggcctgcatctcacccagactctcctgggataagtgggccggggctttacaacctaagctgtctcaggctgtgatgagttctcaaccccagggaacgtgtatgctttctctgcttcaggctacaatgcccttttctcagagaataatctctggctgtgacgttaattaataacatttaagtcaaatggtataaaatggctgacatacagctatttttgagccacatccatgtcagttttatatgactcaagctaatatgtgggaaacagaaattgctacttagtgcctgcagcttgtcacagagcatgatcttcccagacaagctgctgtatgagtaaaaatagtcaagtccttggtggttctatgttagggaccctggagctagctactttctccctccccttcccccagtgagaagagctggcaaagccgacctcgagaggtggccaaatccagtaaaaattgtctcgcatctctttatgtgcctgtggtcggtccttcagcacaggaacttctgtggactcgggcactcccgagattgaatcctgcatctgtcctctctggctgagtgatgggtgagcttgaaacctctgagcctaacattccttgtctgtaagatcgggattcattctcatgcctgcccacagaactgttttaaggggagcacctggcacagtgtgtcacatacagcaagcacttaatacatgttcaatttgtttcctgcattatgtgaggaagcaaaagccctttggatctttggaaacatccaggctgcctgtggactcccatgttccacctccaccctgggtatcctgggaatttggtctttaaaggtcactttatttttttttccccctgaaataagacatgctttcttttcagattattttgggggaggtaagccaccctttattgagcttttactaaactgtcaggctcattgctctgtttggattaatattgatctaatccgttctgcaattctgaaaaaaaaaagttctatatttaattcactgcactgctgaatgcctctggggatattcatgatgagaggaaggaatgggacaaatgtggagaaggaagggaaagttagaaataagcaactgattgcctggtggagtggcagaggggtcccaaatcaggccctttgccttactgggtgcttgggctcagggctgccacgtgcacaggggcatctctaatttgcaccaagtctccatataagctgggggtggtctggcttggcaaggagctcatgaaaagatcagtcaggtacagtctaagccaggaaggggcttgtcttctcaatggggaaaattcacataaagactttgattaagacagaatggaagaagtgggtgaatgtatcttctgcagatgggatgcaaattcagataatgctctgggcaggatggttttgcctgatacgtggtgatattatgtattgagagccaaatggctggttatgggcatccatctggcttgggactgctccctgccatccagggggtctgctcagtgagggcagacgaacactctgcagccctcatcctagctccctgctgtctcagagtccccagtgaagaccctagaattgctgtggctcccacaggagtctctcagtgctggcacagtgggtgcatgcagtgggtgctcacccagcatatcatggtccctgctatgagccatctggaccatgctacagaggaaagagcagtaccaatatcgctttctatgagttcccacgtgactctgaggaacagcactggtcattgagggacatttttgatcttcatgttcacatttccattttgcacacactgtgcctcacaggaggcacagctgggtgaagcacctggcccatcccacagctagaagcagggggagcaggactgaggccaaggcctgtgctgttcccactctcccttgaagatggaggagactcgggccctgggcttaggggccaaatcctggcaggggagaagagtcaaggactcgatgactatcaaacagttgagtcccaagtccagtggtaaaaaggcatcaaaacaacagccttagcttcctcctctaaaaaaataacctcttaggtttgttgagagcataagaattaaattactttaaattgcttattgggatttatcgtagacacacacatgctcaagcaagtgtgtacactgtcactgcaacaagcttcaaatataaatgaagggaaacaaccccaatgtccatcactagggacagatcaaagcacgataagtccaattaatggaataccaagcagctgcttaaaaaccaaacagtttctagctcttggaaacttgggaaaaacaacaaaaacaggcagatctgtatattctgtcatgcaacaatctctaagatatactggtaagtgaaaaaagctaggtgaggtaccatgtacatagtatgctgtcatttgtggaaaagaatgatgtgtgcgtattttgtataaagtttaaatatctcttaaggaatacactggtggtggtaattatccctggagagggattctgaaggattgaggatatgggaaaggagacagtttttatggtaaacttttggaaatgttttttaccatgtacacatactacgtattttggaaaatagtttaattaattcgtttggaattttaaaataaaaatcaacaaaaatatgagttatatgaaaaactaaaaaatgagtaacttagtacaataacaagcatgctgcacataataagtggtagccaacatataaaaggatcatctctatttttatgggcaaatagatgaattcagagagggtgaataacttgttcgaggtgatgcagtgtgtgtgcaatagggctgcagtgagggcccagatgtgttcggcctcagcacttttttttaacttcacattacagcccttccccattcctttttcccaagactaggagttcctaagagaagacccacgtcctcttcagctctgcaggccaatgttcaacagaaggcctggtacacagcgaatgccatatgaatatttgcagaaggataaatattatatcctagacctttgttccaaagagtttcatctagtagtgatgacagcaccctatcagtcaccctgatcccaggggtgctcatgagcacacaggtgtcctttctgatcataggctaggaagccttgaactctgagaagttagtaggtgcctgatgtgttaaatgaattaataaataagtgaatgaaagacttcaaggagcaagaaaagagattcgtcagctctataatatggagccccaggagatgagaagaggctcaccagctctccacagtcagaagacaacttggcaaacacaacctctcatttcaaccatacctctcacatgtggcttttgaacatatgtggtcatgaaatagatatcagcgtgggtaattgcagctctgtcttctgtgcaaatctcaagaaacagcaggagtcattgggcaacatagggttttgcctggttctgaagagacttgtattctgtgtgctggagctagttcaaaccgcccttggtagccaaatgccccagagcatgtgaaggcaccatttacataaaaaatctgacatcgctgaagctgtgtccttcgcagaagtattccagtgaacttgatagctttagcaaggcgctttttaaggaagactgagcctgagctgagtgtacctcctatttgtggatcctccaagatgttcaaggtttgggagctgagcctaagatagggcctcctggcagcagatgcgagtgtggccgtgccttgggggtggccctcagggtggtcaaaggcctgccagaggtctaattggttttcatcttagactggaccatggctttcctttgtccctgagggacactagaaaccaagtggaagaatcaaatgagaagactttgcagtgtctacccagctgggtttcatatccacaagggttgtaagacgcatgcattctgggatgttgcactaataaaggcatcatcaactaaggctgcactttacaacttagtgcagcagccagtaagaatttaaaccttctctgggccatcctcaggcctccttacccactattcagttaagccaaggttttactaaatggccttgagctgggagagtttcggtgaacctagacagagctttgagtgtacacatgtttcacacccaagtagaaatttgtaaaattccccactcacatccgtggctgatcctggtctacttcctctggcctacttccttttctcatgcctgctcatttattttttaactttttaggggagggacactcatcattacccattgtttccaatcagcttcccttttctatacttcccttcttctttaggtggccagaatccatttcttcttcaatctgacattcttttatgttgctttctccctctcttttggcttcacatccagcttactgttttctaaatccagtgtatcttctggtagtttttaccctcctggtctctgtttatggctttttagtaaaagtgaagactgggtttgaggttcagtctggtgccaagaaaattgtgaggcttaatttttttctttgtaccaaatgagagtagagaattgcttgaggagccccaacccaaactttccttatgaggatgccattgtgctgttgacattgtggaatctgaagtcaccctcagaaagccccagtttagaaagggaggaggctgccattcccggatgcctgctaagtgtcatgctccacacacaagatcccaccacattctcttcacaaccccactggagaaatgatgatccccatggtataaattaaccagcagaggcccagagatttggttaacttgttcaaggaagcaaaagagccaggatctcaaccccagatgcctctttccacaaagcctgtgctccttgcaccgcacaatgcttttctccctggaggggaaatctgcaggatattgcaggccacttctctcgaagtagaactgaaaatagtagacccaggccccttaagagaaactggtccatgatgcatctctgaattcgttggggttctccccctgtgggctcataacccagcaggctgcccctcagggattggtgagtggaaaatggaatgcgggatattatttgctcctctagccaccactaggtggtccacactgccagatccccaggaatctagctcccagcaaccatagtgaggaaactggggtcattttctctggagaggaaaagtctgaaggctgaaggtttagcctattttctgccttcaaatatatgatagtgcttttaagagccacatgtttcacaggagcccatacatttctgagcatgaatggctgagagaccctgggcaggtcactctgctctgcttcagtttcttgatgtatgaaattaaagcattggaccagaccacctctaagagccttgctagctctggcatgctcaatttttcagcaagaatcaaacagaaggaaactgtttgtttgagacaggatctcgctctgttgcccaggctggagtgcagtggcatgatcatagctcactacagccttgaactcctgggatgtagcaatcctcccacctcagtctcctaagtagctgggagtataggtgtgcaccaccatgcccagctatttttggtagatatggggtcttactatgttgaccaggctggtcttgaacatctggcctcaagagatcctcctgcctgggcctctcaaagtgccaggattacaggtgtgagccatcatgcctggccaaggaagcagtcttaaagagcaacatgagtcctaggtcagcaaaagtgtggtctattgtcaacagagaggctgcccagcagcctgcccagggaacatgacacttctacacttctggggcacagcctgtgagcattcagatgaggttctgtttggagatagggagctggatcagttgatcaagtcttggcaaatcttgtttaccttgtactagatagaaaggttctcagtcggctgccatgcccagacccctgactgtttgggaagccaagttttaccaggtcctgatggttttctcatttatgatggcagctatttttataacacatatcccttgggattcagagagagctaaggctgatggggagaggggtgctgaattccatgttaaggagctataaggaaacattttataccccatcccctatgcaagtaaattcagtgactatctattcctatagcaatgagcccatctagaacagcatggcattgtctacccaccagtttttcacacaggccaaatgcacacccaacccttccctccaaccaccaccaaaaaaaaaaaaaaaaaaaaaatagcaacaggagaatcctattgggtttagtgaattgcccctttacaaaacctgccattattttgtgtttgaagccccacccttccctttcctcttcaaaatactttatggtatttatttatttatgtcaaagtaaactgtgaaattttgaagggaaatacttcataatttttttaataattaggaaagagatagacttgttaattgtttaattattaattaagtcaatatttttgagcatctgtaccatattctagtctaagtagaaattaaaaataaaaacatttaattattcttgttaaaaataaggacagagatctcctcaccttctgtttttttctcagagcatttactttagaaaactttttttttttttgacatggagtttcactctcatcgcccaggctggagtgcaatggtgccatcttggctcactgccacctccacctcctgggttcaagtgattctcctgcctcagcctcccaagtagctgggattacaggcgcccaccaccatgcccagctaatttttgtatttttagtagagacaaggtttcaccatgttggccaggctgatctcaaattcctgacttcaggtgatccacccgcctcagcctctcaaagtgctgggaatacaggtgtgagccaccgtgcccacctagaaaacttttacatactttctcctctctttgaacatgtgtaaatccttttgaaactagataggctttttgtcagctttatgagctaagctagtctttcccaaggacctgggcgtcatctctttgaaatgtaaacaaacctaagggagatagtgcttctatctcttagtttctgtgggaaggtatgagcctaactgaagagccttgctcagtgctgcaaaattaccccttgtcttaaagataaatttgattttcctctgggtagagccagttagctaacacaagtggttaccctaattaccaggtaaatttagagtgaaccatgtacggcaaacggtgctggcaagacctcttacttgaggaacagttattgtttgccttgataacatgtatgtaacaggttgtatctacttggctatacaaaagggggagatttctttctgttcttgcaacctcttagtagatggcctataatgctctgcatattttggtttactgcttattccataataaaactgttctttctctactccttttgtggagagaatctctgtgttgaaagaagactttgttaattatatttcaccaatactaggcactgtgctagattctgtagaggcaaaagtgtttaagatacagttcctagaagtgtttattattgctcagtaacagaatataagaaaagtcatgggaagcccaaggattgaacctctatatctgtctccttaaaaactgggggagggtgatcaagaggatatcacaaaaaaaaaaaaaaaaatctgccgtttgagctgatgttttaaggatggggaaagtcttccaggttgaccaagatggaggtggcagtgaatagtgggtgggctttgaagacaaaggcacagagggtctgagcataggaaggtttcctggggccaaggccaggcagagggaaataggaacagaaggcagtgaagatggtggagttgggaggagcccacatgctcccagagtgttcaggaaagtcagtttaggctgagtgcagggcttcggggaaggatgcagagaaagccaaggctgaaaagggagaagagggacatagagaggggtctgaaattccacactaagtaactacaaggaaaaatgatgaaagactttgaaatagacacacactgaagattactgggagtcctttctggcatactctttggggctacctcccccttttattgcctgagctaattttacagcaccgtaggttatagcagatagcagtgcaaatgactcttgctcatggaaatacaaattttgtctagtggagatgcactggattaagtgccctgtagatatggaccaattgtgcctttatctctaaattcatctcagtatttctggaagcatctcacccatgctgttggtttggctgtagactgctaattctccttgctgcgtaggattccactgtgtgactagtccatgatttattgccatttctactgctaatgcacacataggtggctttcagtttgttgctagtttggacaatgttgccgtgaaaatttttgtgcatgtacatctcctacaacgtggatgcattttaaaagtttagtcttgagccaaaccaaaaagtatgaatccaaatatgaagatcaaaaataggcaaagctaagctatattgtttagggatgatatttagattcagtcaaactatagggaaaagcaaggaagtgatcaccatagaagtcagacttgtggttctttgtgggagaggaagaggctgtggtcaggaagggacatgagagaggcttctggggttctctttctcagcctggatggtagtaatgtgggaaattaaatctaatactttgctaacccagacattgttctttcagtgtgttgtattttgcaataaacaaaatacaacacactgaaaagagactttccattttctccttaagcacactttaaggggaaaacaaaggtggtctaggaagatgtttaaagacatatgatacagcttttcttccttactcacaagctaaaaagctgcactttggccaaacaagatgagggggtcgaagcatcagctgtggccagcgtgccgtgagaatcccacctgtgaagcagccagcagattctgagcccctcaagagggcaggtgggatcaaggttcagctagaagccccaactttcccctggctcttctgggcagagtgagtgatgccagagagcccaacttctcggaatgcctgggctgtgctgctaggaatcagaacaagtccttgggaaaggcagccaagatctggattctgccattctggttccactccctcctatgaccgtgacctgctgtggagcagcagaagttcccctccttgttcagctcctccattacaggtgctggttccaaacgtctctggactcaggatactgggtcagaggctggggctggggaggagcagttggatgcctggatcccaagaaggaggttttttgaggctagggtctctggctagggagaaccatacctgacattgccactgtgccatagctgcctagggccgggcaggcttcctcctgggatggggtggggtgaggaaggggatagacgatcgtcctgactgggtcagctctaatacgttctttgctttcctgcccctacagctctggattcttcacaacctcattcaatagtagtcagtgtttttcaggtatccaaactttctgaggctcagtttcctcatgacaacaacatatatcgtttcttgagcatcaaagatgggtcaggcagtgtgtttgggacttcctataccatgcctttaatccttgcagaaagttgacacatacccattacatggcttcaaaggctgatggacaatctccattttaaaagcaggaaacagacttagcaagcccagtgcacagtcaccaagtgcagagccaggacttcattcctgacttcattccttcattccaaagccaagctgcctatgtccccatctgtgaagtggggccagctgaggagcagggttcaggagcagactttgtggagactggcacgtggctgatggatagtaggtgctcccatcccagaggtgtggcaagtgccaggtaagcctgagcactaagaagaaccacactgaagttgggctgagactatttcctgccctgccttcctttgtgaaaataaagccaagcaaagaggaagatgaaagaatccaccctagccttcctgagcccatttctcattcccaggggttttgaaccccaatccactgcccccattcccaacccacagtggtcctcaaggctctccagcacaggtccgtcacccaccctgcctcctctcaggaaacccagctccctccaaagcgccctctgggcctgggatgccctgagcaatgcaagctttcttgcctgctttcacgtggttcaattttcctttttttttggctcaatttttttctgcctcaagttttctacctcaagtatttcaaaaattaatttttttttcttttcttttttttttttttttttgtggagtgggtgttgaaagaatcctaaactttcttagccattctctggactgagctataaactcacaaagcaaggattgcaggctctgtgaggctgtgattgccagaggcaaggcaagagaaataacaagccgtggtcagtcctcagctggggcctctgatggatttcctcctgtcttgcactcataatttctttctgaagaccatgttttccacccacacaaacctgagcctgagtatcctcacaatggttataacaacatatatcaaaattgaacactaaatttgtgccaggaatttattaatggagaaaccccgcctctactaaaaatacaaaattagccgggcggtggtacatgcctataatcccagctacttgggaggctgaggcaggagaatcacttgaacccaggaggcagaggttgcagtgagccgagactgtgccattgcactccagcttaggcaacaagagcaaaactccgtctcaaaaaacaaaacacaaacaagaaagaaaacccaaaaaacaaaaaacaaacaaaaacccatagatggtacaaaaagtggaagaaaaaggaaaaaaaaacccatgaaactatctgcaatgcagtttcctagaatcaaccacagtaatcttttagcttttctctatctaaatgttatacatattttatatttatattaagtgcatttatatttatattaaaatacagatacaaatttaaaaactctttattattaaattttcaaataaaaagcaacttttcaaataaaagcagcgagaacctccttatacccaacacctggcttcaactattagcaacccatggtcaatatttcctctatttcccacttaatgtctctactgaattatttaatttcacccataaacacttgtgtgcatctctaaaagttaaggactcttttttgaaaaagactttaatacaatttctcatctcaaaaaattagcaataattcctcaacagcatccagatgcaatttttcatgcttttttcagttagtttaaaatcatgagcttttctccatgtctctaaaatgtaattactaatgcttctaatactattccaccaggttgagtgtattataaatgatctgatcaccccttgcctcccactcttccatccccttggacatatttaggctacaacatccccaggaaaatggtttccattgtctgcacgtaagcaaacaggcattattaacctattagctgtccactgctccaccccacccacaggtacccaactagtcctgtgcacctacctggcgtggactgccaagggaacctctggatctgccagtcagccaccctgtcctgctcagactttaccagagacgagtatttccctttccttccctctaagagcattttatttgcagagttagccaatagtatcttgtttcctgtaagggagactatctttagatgctgccacaggcaagctcagatactccagggtggaggccagctgccaacaggagggcctgactttataaacctggaagatctaaacctcagggaagactgcggagctggagggagagaggtgccacttaccccaacctggaggtggggggcagggagcaggccctgcagtcagcaaagcacagcacagtcagctctcattaatggggagccttcaggaagctgggagagctcatggggccctcagcttccctgcccacgagagggagcccagagtactcactggaccacactggggcacacacagctcttctcctcaaagt

SEQ ID NO: 1655 - DNA, 18242 bp, Homo sapiens
tggaagttctataaaatatgtatttgctaaacattggaaacaagttaaatgtttatcaattgagtaatggcaagtaaattggggtacatgatcttgaaggaacatgacttattctctcattcattatacaaacatatagactgccaaagagctatcagatacacagcaatttaacagttaccacatctgacttcaatgaatacacagtctggtagagtcttctaaaatgataattaccaaactacatagaaagcgagcactatttgtggtctaacgttaagaggaaaacaaatcagattataaaaccatctgtacattacgattgcaactctaaacatgtgagagtgtgaacaaggtctggacgggtgaatacaggaatgacaatattgatgtggttagattggatgactttttctttagcattattacaattgttttcgagctttaaacttttagattgttccaaacgtttctaggggggaaaaaaaagctgctcccatagccctggctccccaggttggcagtagcatgaatgatggggtattttcccagatgggcaggggcttgccacaaggtgactgggaggggatattcaaggcagtccaggagagttgggttacggaaggctatcactctgtagacttgggagtgctcactgggtgccatcgtaagaaccagcctcttctgtgtctgggctatgccacgcagcagcacctgcaggctcttccaagctttgtcagcaccacaacttgggcacagcacagcagtgccaggtgtggaaagcagaagtctaagaggcagacaaaagggttgagacctgcaagagttggtggctagttcctcatgctggaaaggatgatctctatgtgaaaggtaccttatccctcttctacagaccaggaaactgaagcttgatttgtcccaagctactggagttggggttggaatccatcccttcttatttgggggcagggtttttctatttcccttactggcctgggagcaggtggagatgcatgaggtcatatggaagagacaggctgataggatgggtggagtcctttgggaaggaggaggcaatggggaatctattggtaggaccccatggtggacgtatgagaagccaagcatttgagttttgactcgatgcagtaggcagtggggagcccttgcaggtttggggacatgatggaagagggcttaatgaagacgaggctggtgtaatcaggggagaggctggatcaggcacatggtaagggtgatgtgtggcatttgttttgtgtaatcagaatagtacccacccatccaacttcttggaaatatgtatttctgcttctccatgagattggactggaagcttccatcttatatatcccttccccatggataacagcaccttccagggatgggcacctgatacaaacttggcctatcagagcacttccctgggaattttgcccttggggccagagaaacatgggtgtcagtccctctctggtgataaagctgtgtcatgtaaagtctgggggatctataatgactaaaagatttgagagtcagagagagggaattctagcttggctcaggccctggtttcccctcactttgagggctcagacacccttttgcttgtgccacaatatgaacaatattcaccaccctcatttaactaaactagtctgagttgaatttttgtcatctgcaaaccaaaaagttctgatgacatttgcagtaagagaaatgtctactctttgtcattcaaagagttcaatttgttcattcttcaaattttgagcacaattctcaacaacactctagggttgttttgtgtgcattgggtccatcattttgtgcctgtaagaaataacaacaaaaatctttcctcactagtcagcatcaggttcaggaactccaggttctctgtagacacaaggctttgggattcccttcagagaaggagcaatgcatctccatcactcgtgtggtaagtaaaattgctgctcagaacacttccatgcctgctcctttgtgattcagatgaggagaaatcaacgtggactgagcgcccacacaggacagccaggcatttcccatacaggtggtaaaggtatcttctgaacttctccccagcaaatgcatagatgagaggattcaggcaacaatggctaaatgcaaccgtctcagtcacactgagggccagcctcagatccttcctcatgtcacaactgggaaagaagtcatagagcttaagcgtctccaggaaaatcataacgttgtagggtgtccagaagaggaaaaacacgatgaccaccagaaggatcagtttaatggctttggctttcttgtggttcttgcaggaaaacagcgtctggatgattctgaagtagcaataactcataatgagcagggggagtaggaagccaagaaaatttgtttccacattgcggagcacgggccagatttcctggaggacctcggggtagtcaccaaggcattcattttctttctgctttgtgaacatgaactggggtgctgccaccaaaatggctgctgcccagacgcctaggctgatggtgacgccatgctgcacggtccggttgttcatggagttggcggccaggacgatggccaggtacctatcaatgctgatgacggtgatgaagaatatgcttccaaaaaagccgatgaagaagaaggcggtagtgaatttgcacatggcattgtggaggcccttttcatttatcaaatagtgagtccagaagggcaaagtggctacaaacagcagatcagacaaggccaggttcaggaggtaaatgtcggtgacactcttgggcttcttgctgttggtgagggcaaacactaccaacaaatttcccaccaggccaatggcaaagatgacggagtagaatatggacaggaacacagtcccaaagaccacgatgtccccaatataacaggcctcagccaaatcatcgtactcaaagttttctgtcactgattcagggaactgatccatggtgaaggcctggatcagaaagaaaaacaagtaactgtgttagttatcagagaaacaaagttggaattctgtgtggcctcatatgtaggcaggcaggaagaaacaaatattggttgggtgcacactacatttcccaacttcccacttgccatcttgtttaatccccacaacagtcttgtgatgaagactgcaacagactcttctgacaggagaggcggactcctttgacttgcccaaagccatgcagtaaatggctctgtgagcatttggctctaggcatttttttttttttaaatggagtctcgctgtgtcacccaggctggagtgcagtggtgcgatctcagctcactgcaacctctgtcccctggggttcaagcgattctcctgcctcagcctcccaaatagctgggattataggcgtgcactaccacgcctggctaatttttgtatttttagtagagatggggtttcatcatgttagccaggctggtctcaaactcctgacctcagattatccttccgcctcagcctcccaaaatgctaggattacaggcgtgagccacagcgcccagccagctctaggctttttgaagcttgagacagatctgttttacttttactgcccaaaatctctccaaaagctagctagtttgaccaatgtgtggatgagaaagggagaaccatgagcaggagggggaggggggtgagatggggtgaattgggggtgcagctgtaattcacacttccagtccaaacttccccaaagcaattctccatcctcttcctttgtttccaccttttccaccctctggccccttacttttccatgaagctaggcctggagagagaagcctcagacccagagccttgggcagaacagcacccggaagccctcatctttgttttttgagaaccatttcacctcctcttctccttataatcaacaagtccttctctttcttagcaggtatcagacagagtcatacactctagagtgactaccttgttttgggctgcccaggactttcctggttttagccctgaaagtcccatctattgggaacccctcagtcccaggcaaatcaggactgttggtcatcctacaacgctaagtgaagagaaggtgttgccatcattcaggactctgcagtcatagaggggctgactgattcaagatggaggatggggctccgttagtctgctgggctagtctccgggtgactaattccccctacgattaccagccctatagttcactttggtttggacttccccactattcttatctcctgtttccttctgagcaggaattgaaaaaagaagacacttctgcaggctgcactccccttcttttcgcagccaggacttgctgctcattcactccagagccggctgggaggcagccctttcacacggctcctctgggcgtctcctcgtgataccacagatgggtccctcagaaaccctcaaaacaggcctcctggttgtcactgcctccctccttaccacaacttacagcaaagctcacgctttaaccgagggagtttccacgccccactacaccctttccatgatggttttacccaggtggtgtctcaccaagatgagggcccacccagccagggtgtgtcacttctcgcttcccagcctctgctttggggcctgcatctcacccagactctcctgggataagtgggccggggctttacaacctaagctgtctcaggctgtgatgagttctcaaccccagggaacgtgtatgctttctctgcttcaggctacaatgcccttttctcagagaataatctctggctgtgacgttaattaataacatttaagtcaaatggtataaaatggctgacatacagctatttttgagccacatccatgtcagttttatatgactcaagctaatatgtgggaaacagaaattgctacttagtgcctgcagcttgtcacagagcatgatcttcccagacaagctgctgtatgagtaaaaatagtcaagtccttggtggttctatgttagggaccctggagctagctactttctccctccccttcccccagtgagaagagctggcaaagccgacctcgagaggtggccaaatccagtaaaaattgtctcgcatctctttatgtgcctgtggtcggtccttcagcacaggaacttctgtggactcgggcactcccgagattgaatcctgcatctgtcctctctggctgagtgatgggtgagcttgaaacctctgagcctaacattccttgtctgtaagatcgggattcattctcatgcctgcccacagaactgttttaaggggagcacctggcacagtgtgtcacatacagcaagcacttaatacatgttcaatttgtttcctgcattatgtgaggaagcaaaagccctttggatctttggaaacatccaggctgcctgtggactcccatgttccacctccaccctgggtatcctgggaatttggtctttaaaggtcactttatttttttttccccctgaaataagacatgctttcttttcagattattttgggggaggtaagccaccctttattgagcttttactaaactgtcaggctcattgctctgtttggattaatattgatctaatccgttctgcaattctgaaaaaaaaaagttctatatttaattcactgcactgctgaatgcctctggggatattcatgatgagaggaaggaatgggacaaatgtggagaaggaagggaaagttagaaataagcaactgattgcctggtggagtggcagaggggtcccaaatcaggccctttgccttactgggtgcttgggctcagggctgccacgtgcacaggggcatctctaatttgcaccaagtctccatataagctgggggtggtctggcttggcaaggagctcatgaaaagatcagtcaggtacagtctaagccaggaaggggcttgtcttctcaatggggaaaattcacataaagactttgattaagacagaatggaagaagtgggtgaatgtatcttctgcagatgggatgcaaattcagataatgctctgggcaggatggttttgcctgatacgtggtgatattatgtattgagagccaaatggctggttatgggcatccatctggcttgggactgctccctgccatccagggggtctgctcagtgagggcagacgaacactctgcagccctcatcctagctccctgctgtctcagagtccccagtgaagaccctagaattgctgtggctcccacaggagtctctcagtgctggcacagtgggtgcatgcagtgggtgctcacccagcatatcatggtccctgctatgagccatctggaccatgctacagaggaaagagcagtaccaatatcgctttctatgagttcccacgtgactctgaggaacagcactggtcattgagggacatttttgatcttcatgttcacatttccattttgcacacactgtgcctcacaggaggcacagctgggtgaagcacctggcccatcccacagctagaagcagggggagcaggactgaggccaaggcctgtgctgttcccactctcccttgaagatggaggagactcgggccctgggcttaggggccaaatcctggcaggggagaagagtcaaggactcgatgactatcaaacagttgagtcccaagtccagtggtaaaaaggcatcaaaacaacagccttagcttcctcctctaaaaaaataacctcttaggtttgttgagagcataagaattaaattactttaaattgcttattgggatttatcgtagacacacacatgctcaagcaagtgtgtacactgtcactgcaacaagcttcaaatataaatgaagggaaacaaccccaatgtccatcactagggacagatcaaagcacgataagtccaattaatggaataccaagcagctgcttaaaaaccaaacagtttctagctcttggaaacttgggaaaaacaacaaaaacaggcagatctgtatattctgtcatgcaacaatctctaagatatactggtaagtgaaaaaagctaggtgaggtaccatgtacatagtatgctgtcatttgtggaaaagaatgatgtgtgcgtattttgtataaagtttaaatatctcttaaggaatacactggtggtggtaattatccctggagagggattctgaaggattgaggatatgggaaaggagacagtttttatggtaaacttttggaaatgttttttaccatgtacacatactacgtattttggaaaatagtttaattaattcgtttggaattttaaaataaaaatcaacaaaaatatgagttatatgaaaaactaaaaaatgagtaacttagtacaataacaagcatgctgcacataataagtggtagccaacatataaaaggatcatctctatttttatgggcaaatagatgaattcagagagggtgaataacttgttcgaggtgatgcagtgtgtgtgcaatagggctgcagtgagggcccagatgtgttcggcctcagcacttttttttaacttcacattacagcccttccccattcctttttcccaagactaggagttcctaagagaagacccacgtcctcttcagctctgcaggccaatgttcaacagaaggcctggtacacagcgaatgccatatgaatatttgcagaaggataaatattatatcctagacctttgttccaaagagtttcatctagtagtgatgacagcaccctatcagtcaccctgatcccaggggtgctcatgagcacacaggtgtcctttctgatcataggctaggaagccttgaactctgagaagttagtaggtgcctgatgtgttaaatgaattaataaataagtgaatgaaagacttcaaggagcaagaaaagagattcgtcagctctataatatggagccccaggagatgagaagaggctcaccagctctccacagtcagaagacaacttggcaaacacaacctctcatttcaaccatacctctcacatgtggcttttgaacatatgtggtcatgaaatagatatcagcgtgggtaattgcagctctgtcttctgtgcaaatctcaagaaacagcaggagtcattgggcaacatagggttttgcctggttctgaagagacttgtattctgtgtgctggagctagttcaaaccgcccttggtagccaaatgccccagagcatgtgaaggcaccatttacataaaaaatctgacatcgctgaagctgtgtccttcgcagaagtattccagtgaacttgatagctttagcaaggcgctttttaaggaagactgagcctgagctgagtgtacctcctatttgtggatcctccaagatgttcaaggtttgggagctgagcctaagatagggcctcctggcagcagatgcgagtgtggccgtgccttgggggtggccctcagggtggtcaaaggcctgccagaggtctaattggttttcatcttagactggaccatggctttcctttgtccctgagggacactagaaaccaagtggaagaatcaaatgagaagactttgcagtgtctacccagctgggtttcatatccacaagggttgtaagacgcatgcattctgggatgttgcactaataaaggcatcatcaactaaggctgcactttacaacttagtgcagcagccagtaagaatttaaaccttctctgggccatcctcaggcctccttacccactattcagttaagccaaggttttactaaatggccttgagctgggagagtttcggtgaacctagacagagctttgagtgtacacatgtttcacacccaagtagaaatttgtaaaattccccactcacatccgtggctgatcctggtctacttcctctggcctacttccttttctcatgcctgctcatttattttttaactttttaggggagggacactcatcattacccattgtttccaatcagcttcccttttctatacttcccttcttctttaggtggccagaatccatttcttcttcaatctgacattcttttatgttgctttctccctctcttttggcttcacatccagcttactgttttctaaatccagtgtatcttctggtagtttttaccctcctggtctctgtttatggctttttagtaaaagtgaagactgggtttgaggttcagtctggtgccaagaaaattgtgaggcttaatttttttctttgtaccaaatgagagtagagaattgcttgaggagccccaacccaaactttccttatgaggatgccattgtgctgttgacattgtggaatctgaagtcaccctcagaaagccccagtttagaaagggaggaggctgccattcccggatgcctgctaagtgtcatgctccacacacaagatcccaccacattctcttcacaaccccactggagaaatgatgatccccatggtataaattaaccagcagaggcccagagatttggttaacttgttcaaggaagcaaaagagccaggatctcaaccccagatgcctctttccacaaagcctgtgctccttgcaccgcacaatgcttttctccctggaggggaaatctgcaggatattgcaggccacttctctcgaagtagaactgaaaatagtagacccaggccccttaagagaaactggtccatgatgcatctctgaattcgttggggttctccccctgtgggctcataacccagcaggctgcccctcagggattggtgagtggaaaatggaatgcgggatattatttgctcctctagccaccactaggtggtccacactgccagatccccaggaatctagctcccagcaaccatagtgaggaaactggggtcattttctctggagaggaaaagtctgaaggctgaaggtttagcctattttctgccttcaaatatatgatagtgcttttaagagccacatgtttcacaggagcccatacatttctgagcatgaatggctgagagaccctgggcaggtcactctgctctgcttcagtttcttgatgtatgaaattaaagcattggaccagaccacctctaagagccttgctagctctggcatgctcaatttttcagcaagaatcaaacagaaggaaactgtttgtttgagacaggatctcgctctgttgcccaggctggagtgcagtggcatgatcatagctcactacagccttgaactcctgggatgtagcaatcctcccacctcagtctcctaagtagctgggagtataggtgtgcaccaccatgcccagctatttttggtagatatggggtcttactatgttgaccaggctggtcttgaacatctggcctcaagagatcctcctgcctgggcctctcaaagtgccaggattacaggtgtgagccatcatgcctggccaaggaagcagtcttaaagagcaacatgagtcctaggtcagcaaaagtgtggtctattgtcaacagagaggctgcccagcagcctgcccagggaacatgacacttctacacttctggggcacagcctgtgagcattcagatgaggttctgtttggagatagggagctggatcagttgatcaagtcttggcaaatcttgtttaccttgtactagatagaaaggttctcagtcggctgccatgcccagacccctgactgtttgggaagccaagttttaccaggtcctgatggttttctcatttatgatggcagctatttttataacacatatcccttgggattcagagagagctaaggctgatggggagaggggtgctgaattccatgttaaggagctataaggaaacattttataccccatcccctatgcaagtaaattcagtgactatctattcctatagcaatgagcccatctagaacagcatggcattgtctacccaccagtttttcacacaggccaaatgcacacccaacccttccctccaaccaccaccaaaaaaaaaaaaaaaaaaaaaatagcaacaggagaatcctattgggtttagtgaattgcccctttacaaaacctgccattattttgtgtttgaagccccacccttccctttcctcttcaaaatactttatggtatttatttatttatgtcaaagtaaactgtgaaattttgaagggaaatacttcataatttttttaataattaggaaagagatagacttgttaattgtttaattattaattaagtcaatatttttgagcatctgtaccatattctagtctaagtagaaattaaaaataaaaacatttaattattcttgttaaaaataaggacagagatctcctcaccttctgtttttttctcagagcatttactttagaaaactttttttttttttgacatggagtttcactctcatcgcccaggctggagtgcaatggtgccatcttggctcactgccacctccacctcctgggttcaagtgattctcctgcctcagcctcccaagtagctgggattacaggcgcccaccaccatgcccagctaatttttgtatttttagtagagacaaggtttcaccatgttggccaggctgatctcaaattcctgacttcaggtgatccacccgcctcagcctctcaaagtgctgggaatacaggtgtgagccaccgtgcccacctagaaaacttttacatactttctcctctctttgaacatgtgtaaatccttttgaaactagataggctttttgtcagctttatgagctaagctagtctttcccaaggacctgggcgtcatctctttgaaatgtaaacaaacctaagggagatagtgcttctatctcttagtttctgtgggaaggtatgagcctaactgaagagccttgctcagtgctgcaaaattaccccttgtcttaaagataaatttgattttcctctgggtagagccagttagctaacacaagtggttaccctaattaccaggtaaatttagagtgaaccatgtacggcaaacggtgctggcaagacctcttacttgaggaacagttattgtttgccttgataacatgtatgtaacaggttgtatctacttggctatacaaaagggggagatttctttctgttcttgcaacctcttagtagatggcctataatgctctgcatattttggtttactgcttattccataataaaactgttctttctctactccttttgtggagagaatctctgtgttgaaagaagactttgttaattatatttcaccaatactaggcactgtgctagattctgtagaggcaaaagtgtttaagatacagttcctagaagtgtttattattgctcagtaacagaatataagaaaagtcatgggaagcccaaggattgaacctctatatctgtctccttaaaaactgggggagggtgatcaagaggatatcacaaaaaaaaaaaaaaaaatctgccgtttgagctgatgttttaaggatggggaaagtcttccaggttgaccaagatggaggtggcagtgaatagtgggtgggctttgaagacaaaggcacagagggtctgagcataggaaggtttcctggggccaaggccaggcagagggaaataggaacagaaggcagtgaagatggtggagttgggaggagcccacatgctcccagagtgttcaggaaagtcagtttaggctgagtgcagggcttcggggaaggatgcagagaaagccaaggctgaaaagggagaagagggacatagagaggggtctgaaattccacactaagtaactacaaggaaaaatgatgaaagactttgaaatagacacacactgaagattactgggagtcctttctggcatactctttggggctacctcccccttttattgcctgagctaattttacagcaccgtaggttatagcagatagcagtgcaaatgactcttgctcatggaaatacaaattttgtctagtggagatgcactggattaagtgccctgtagatatggaccaattgtgcctttatctctaaattcatctcagtatttctggaagcatctcacccatgctgttggtttggctgtagactgctaattctccttgctgcgtaggattccactgtgtgactagtccatgatttattgccatttctactgctaatgcacacataggtggctttcagtttgttgctagtttggacaatgttgccgtgaaaatttttgtgcatgtacatctcctacaacgtggatgcattttaaaagtttagtcttgagccaaaccaaaaagtatgaatccaaatatgaagatcaaaaataggcaaagctaagctatattgtttagggatgatatttagattcagtcaaactatagggaaaagcaaggaagtgatcaccatagaagtcagacttgtggttctttgtgggagaggaagaggctgtggtcaggaagggacatgagagaggcttctggggttctctttctcagcctggatggtagtaatgtgggaaattaaatctaatactttgctaacccagacattgttctttcagtgtgttgtattttgcaataaacaaaatacaacacactgaaaagagactttccattttctccttaagcacactttaaggggaaaacaaaggtggtctaggaagatgtttaaagacatatgatacagcttttcttccttactcacaagctaaaaagctgcactttggccaaacaagatgagggggtcgaagcatcagctgtggccagcgtgccgtgagaatcccacctgtgaagcagccagcagattctgagcccctcaagagggcaggtgggatcaaggttcagctagaagccccaactttcccctggctcttctgggcagagtgagtgatgccagagagcccaacttctcggaatgcctgggctgtgctgctaggaatcagaacaagtccttgggaaaggcagccaagatctggattctgccattctggttccactccctcctatgaccgtgacctgctgtggagcagcagaagttcccctccttgttcagctcctccattacaggtgctggttccaaacgtctctggactcaggatactgggtcagaggctggggctggggaggagcagttggatgcctggatcccaagaaggaggttttttgaggctagggtctctggctagggagaaccatacctgacattgccactgtgccatagctgcctagggccgggcaggcttcctcctgggatggggtggggtgaggaaggggatagacgatcgtcctgactgggtcagctctaatacgttctttgctttcctgcccctacagctctggattcttcacaacctcattcaatagtagtcagtgtttttcaggtatccaaactttctgaggctcagtttcctcatgacaacaacatatatcgtttcttgagcatcaaagatgggtcaggcagtgtgtttgggacttcctataccatgcctttaatccttgcagaaagttgacacatacccattacatggcttcaaaggctgatggacaatctccattttaaaagcaggaaacagacttagcaagcccagtgcacagtcaccaagtgcagagccaggacttcattcctgacttcattccttcattccaaagccaagctgcctatgtccccatctgtgaagtggggccagctgaggagcagggttcaggagcagactttgtggagactggcacgtggctgatggatagtaggtgctcccatcccagaggtgtggcaagtgccaggtaagcctgagcactaagaagaaccacactgaagttgggctgagactatttcctgccctgccttcctttgtgaaaataaagccaagcaaagaggaagatgaaagaatccaccctagccttcctgagcccatttctcattcccaggggttttgaaccccaatccactgcccccattcccaacccacagtggtcctcaaggctctccagcacaggtccgtcacccaccctgcctcctctcaggaaacccagctccctccaaagcgccctctgggcctgggatgccctgagcaatgcaagctttcttgcctgctttcacgtggttcaattttcctttttttttggctcaatttttttctgcctcaagttttctacctcaagtatttcaaaaattaatttttttttcttttcttttttttttttttttttgtggagtgggtgttgaaagaatcctaaactttcttagccattctctggactgagctataaactcacaaagcaaggattgcaggctctgtgaggctgtgattgccagaggcaaggcaagagaaataacaagccgtggtcagtcctcagctggggcctctgatggatttcctcctgtcttgcactcataatttctttctgaagaccatgttttccacccacacaaacctgagcctgagtatcctcacaatggttataacaacatatatcaaaattgaacactaaatttgtgccaggaatttattaatggagaaaccccgcctctactaaaaatacaaaattagccgggcggtggtacatgcctataatcccagctacttgggaggctgaggcaggagaatcacttgaacccaggaggcagaggttgcagtgagccgagactgtgccattgcactccagcttaggcaacaagagcaaaactccgtctcaaaaaacaaaacacaaacaagaaagaaaacccaaaaaacaaaaaacaaacaaaaacccatagatggtacaaaaagtggaagaaaaaggaaaaaaaaacccatgaaactatctgcaatgcagtttcctagaatcaaccacagtaatcttttagcttttctctatctaaatgttatacatattttatatttatattaagtgcatttatatttatattaaaatacagatacaaatttaaaaactctttattattaaattttcaaataaaaagcaacttttcaaataaaagcagcgagaacctccttatacccaacacctggcttcaactattagcaacccatggtcaatatttcctctatttcccacttaatgtctctactgaattatttaatttcacccataaacacttgtgtgcatctctaaaagttaaggactcttttttgaaaaagactttaatacaatttctcatctcaaaaaattagcaataattcctcaacagcatccagatgcaatttttcatgcttttttcagttagtttaaaatcatgagcttttctccatgtctctaaaatgtaattactaatgcttctaatactattccaccaggttgagtgtattataaatgatctgatcaccccttgcctcccactcttccatccccttggacatatttaggctacaacatccccaggaaaatggtttccattgtctgcacgtaagcaaacaggcattattaacctattagctgtccactgctccaccccacccacaggtacccaactagtcctgtgcacctacctggcgtggactgccaagggaacctctggatctgccagtcagccaccctgtcctgctcagactttaccagagacgagtatttccctttccttccctctaagagcattttatttgcagagttagccaatagtatcttgtttcctgtaagggagactatctttagatgctgccacaggcaagctcagatactccagggtggaggccagctgccaacaggagggcctgactttataaacctggaagatctaaacctcagggaagactgcggagctggagggagagaggtgccacttaccccaacctggaggtggggggcagggagcaggccctgcagtcagcaaagcacagcacagtcagctctcattaatggggagccttcaggaagctgggagagctcatggggccctcagcttccctgcccacgagagggagcccagagtactcactggaccacactggggcacacacagctcttctcctcaaagtgcagtcccaggcactgggagcttattaaagacagcacctcaagccctgccctatatctgctgaattagaatctgcattttaatgaaattcttagaagagtgatatgcatactaagtttgagaagctttggtactgaaggcatctagtgagtaccttgcaccttgtagatgctcggtaaatatttttttcctcacctctctgccccaaggcatttagtggctccctatacccatcagtcaaggctgaggacacagctttcacccaggacctggcctatgctcctttcacagtctctccccctgccactcttgccctgcagtggggagcctggtgggctccggcatccagccatgcttctgctccctggcctggccagcttggggcgactgcaacgtgaatctcaactgccactgcctcatcaccttccgatcacttcattacctgcctgacccctggcatatgctatataattctgatccatccctaactagggcctggcccatggtggccttcaatacaccttcattaaatggtctgtgaccccttcaaggcccctctggccccttgctgcccacatcccagccacatccggtgctcccttacctctagtcgctgtggtgttccgaggacagcgggtgctctgtgtgctccccaccttgcccctcctcacctcccccaaccccaggacagagctgggggctgcagtgcagtgctgcgggcttggtggcctgctcatggtggaagaagtccaccagcagttttctttctttgttcttggtctcagtgtttggccacctttccctgcctttggccagaaggccacaggacaaaagcagagtcaggccgctccccatccactttctgacactggcccctccccaccccacaccaccccttgatacctctcctggggtccactcagctgggctggctgcctcagccccttccttgcctctgactcccctcctcttctgagggctcctttcttggatctggccaagactctccctctcttcctgtcccacactcttgacgacagtctcatccaccccacatcagtaatcccctccgtgttcatgagcacacatctctacctccatccagggcctggataatttcccaagcccatctaaccttctccgttctctgtctttcctctcaccacttaccccactggccattctccacccagaagccagagagctcttcctgaaatccaagtctgccaacttaaacgcctccaggggttctctcatcctggtttaagtccacggcctggtaagcacggcccgcccc

SEQ ID NO: 1656 - DNA, 16543 bp, Homo sapiens
tggaagttctataaaatatgtatttgctaaacattggaaacaagttaaatgtttatcaattgagtaatggcaagtaaattggggtacatgatcttgaaggaacatgacttattctctcattcattatacaaacatatagactgccaaagagctatcagatacacagcaatttaacagttaccacatctgacttcaatgaatacacagtctggtagagtcttctaaaatgataattaccaaactacatagaaagcgagcactatttgtggtctaacgttaagaggaaaacaaatcagattataaaaccatctgtacattacgattgcaactctaaacatgtgagagtgtgaacaaggtctggacgggtgaatacaggaatgacaatattgatgtggttagattggatgactttttctttagcattattacaattgttttcgagctttaaacttttagattgttccaaacgtttctaggggggaaaaaaaagctgctcccatagccctggctccccaggttggcagtagcatgaatgatggggtattttcccagatgggcaggggcttgccacaaggtgactgggaggggatattcaaggcagtccaggagagttgggttacggaaggctatcactctgtagacttgggagtgctcactgggtgccatcgtaagaaccagcctcttctgtgtctgggctatgccacgcagcagcacctgcaggctcttccaagctttgtcagcaccacaacttgggcacagcacagcagtgccaggtgtggaaagcagaagtctaagaggcagacaaaagggttgagacctgcaagagttggtggctagttcctcatgctggaaaggatgatctctatgtgaaaggtaccttatccctcttctacagaccaggaaactgaagcttgatttgtcccaagctactggagttggggttggaatccatcccttcttatttgggggcagggtttttctatttcccttactggcctgggagcaggtggagatgcatgaggtcatatggaagagacaggctgataggatgggtggagtcctttgggaaggaggaggcaatggggaatctattggtaggaccccatggtggacgtatgagaagccaagcatttgagttttgactcgatgcagtaggcagtggggagcccttgcaggtttggggacatgatggaagagggcttaatgaagacgaggctggtgtaatcaggggagaggctggatcaggcacatggtaagggtgatgtgtggcatttgttttgtgtaatcagaatagtacccacccatccaacttcttggaaatatgtatttctgcttctccatgagattggactggaagcttccatcttatatatcccttccccatggataacagcaccttccagggatgggcacctgatacaaacttggcctatcagagcacttccctgggaattttgcccttggggccagagaaacatgggtgtcagtccctctctggtgataaagctgtgtcatgtaaagtctgggggatctataatgactaaaagatttgagagtcagagagagggaattctagcttggctcaggccctggtttcccctcactttgagggctcagacacccttttgcttgtgccacaatatgaacaatattcaccaccctcatttaactaaactagtctgagttgaatttttgtcatctgcaaaccaaaaagttctgatgacatttgcagtaagagaaatgtctactctttgtcattcaaagagttcaatttgttcattcttcaaattttgagcacaattctcaacaacactctagggttgttttgtgtgcattgggtccatcattttgtgcctgtaagaaataacaacaaaaatctttcctcactagtcagcatcaggttcaggaactccaggttctctgtagacacaaggctttgggattcccttcagagaaggagcaatgcatctccatcactcgtgtggtaagtaaaattgctgctcagaacacttccatgcctgctcctttgtgattcagatgaggagaaatcaacgtggactgagcgcccacacaggacagccaggcatttcccatacaggtggtaaaggtatcttctgaacttctccccagcaaatgcatagatgagaggattcaggcaacaatggctaaatgcaaccgtctcagtcacactgagggccagcctcagatccttcctcatgtcacaactgggaaagaagtcatagagcttaagcgtctccaggaaaatcataacgttgtagggtgtccagaagaggaaaaacacgatgaccaccagaaggatcagtttaatggctttggctttcttgtggttcttgcaggaaaacagcgtctggatgattctgaagtagcaataactcataatgagcagggggagtaggaagccaagaaaatttgtttccacattgcggagcacgggccagatttcctggaggacctcggggtagtcaccaaggcattcattttctttctgctttgtgaacatgaactggggtgctgccaccaaaatggctgctgcccagacgcctaggctgatggtgacgccatgctgcacggtccggttgttcatggagttggcggccaggacgatggccaggtacctatcaatgctgatgacggtgatgaagaatatgcttccaaaaaagccgatgaagaagaaggcggtagtgaatttgcacatggcattgtggaggcccttttcatttatcaaatagtgagtccagaagggcaaagtggctacaaacagcagatcagacaaggccaggttcaggaggtaaatgtcggtgacactcttgggcttcttgctgttggtgagggcaaacactaccaacaaatttcccaccaggccaatggcaaagatgacggagtagaatatggacaggaacacagtcccaaagaccacgatgtccccaatataacaggcctcagccaaatcatcgtactcaaagttttctgtcactgattcagggaactgatccatggtgaaggcctggatcagaaagaaaaacaagtaactgtgttagttatcagagaaacaaagttggaattctgtgtggcctcatatgtaggcaggcaggaagaaacaaatattggttgggtgcacactacatttcccaacttcccacttgccatcttgtttaatccccacaacagtcttgtgatgaagactgcaacagactcttctgacaggagaggcggactcctttgacttgcccaaagccatgcagtaaatggctctgtgagcatttggctctaggcatttttttttttttaaatggagtctcgctgtgtcacccaggctggagtgcagtggtgcgatctcagctcactgcaacctctgtcccctggggttcaagcgattctcctgcctcagcctcccaaatagctgggattataggcgtgcactaccacgcctggctaatttttgtatttttagtagagatggggtttcatcatgttagccaggctggtctcaaactcctgacctcagattatccttccgcctcagcctcccaaaatgctaggattacaggcgtgagccacagcgcccagccagctctaggctttttgaagcttgagacagatctgttttacttttactgcccaaaatctctccaaaagctagctagtttgaccaatgtgtggatgagaaagggagaaccatgagcaggagggggaggggggtgagatggggtgaattgggggtgcagctgtaattcacacttccagtccaaacttccccaaagcaattctccatcctcttcctttgtttccaccttttccaccctctggccccttacttttccatgaagctaggcctggagagagaagcctcagacccagagccttgggcagaacagcacccggaagccctcatctttgttttttgagaaccatttcacctcctcttctccttataatcaacaagtccttctctttcttagcaggtatcagacagagtcatacactctagagtgactaccttgttttgggctgcccaggactttcctggttttagccctgaaagtcccatctattgggaacccctcagtcccaggcaaatcaggactgttggtcatcctacaacgctaagtgaagagaaggtgttgccatcattcaggactctgcagtcatagaggggctgactgattcaagatggaggatggggctccgttagtctgctgggctagtctccgggtgactaattccccctacgattaccagccctatagttcactttggtttggacttccccactattcttatctcctgtttccttctgagcaggaattgaaaaaagaagacacttctgcaggctgcactccccttcttttcgcagccaggacttgctgctcattcactccagagccggctgggaggcagccctttcacacggctcctctgggcgtctcctcgtgataccacagatgggtccctcagaaaccctcaaaacaggcctcctggttgtcactgcctccctccttaccacaacttacagcaaagctcacgctttaaccgagggagtttccacgccccactacaccctttccatgatggttttacccaggtggtgtctcaccaagatgagggcccacccagccagggtgtgtcacttctcgcttcccagcctctgctttggggcctgcatctcacccagactctcctgggataagtgggccggggctttacaacctaagctgtctcaggctgtgatgagttctcaaccccagggaacgtgtatgctttctctgcttcaggctacaatgcccttttctcagagaataatctctggctgtgacgttaattaataacatttaagtcaaatggtataaaatggctgacatacagctatttttgagccacatccatgtcagttttatatgactcaagctaatatgtgggaaacagaaattgctacttagtgcctgcagcttgtcacagagcatgatcttcccagacaagctgctgtatgagtaaaaatagtcaagtccttggtggttctatgttagggaccctggagctagctactttctccctccccttcccccagtgagaagagctggcaaagccgacctcgagaggtggccaaatccagtaaaaattgtctcgcatctctttatgtgcctgtggtcggtccttcagcacaggaacttctgtggactcgggcactcccgagattgaatcctgcatctgtcctctctggctgagtgatgggtgagcttgaaacctctgagcctaacattccttgtctgtaagatcgggattcattctcatgcctgcccacagaactgttttaaggggagcacctggcacagtgtgtcacatacagcaagcacttaatacatgttcaatttgtttcctgcattatgtgaggaagcaaaagccctttggatctttggaaacatccaggctgcctgtggactcccatgttccacctccaccctgggtatcctgggaatttggtctttaaaggtcactttatttttttttccccctgaaataagacatgctttcttttcagattattttgggggaggtaagccaccctttattgagcttttactaaactgtcaggctcattgctctgtttggattaatattgatctaatccgttctgcaattctgaaaaaaaaaagttctatatttaattcactgcactgctgaatgcctctggggatattcatgatgagaggaaggaatgggacaaatgtggagaaggaagggaaagttagaaataagcaactgattgcctggtggagtggcagaggggtcccaaatcaggccctttgccttactgggtgcttgggctcagggctgccacgtgcacaggggcatctctaatttgcaccaagtctccatataagctgggggtggtctggcttggcaaggagctcatgaaaagatcagtcaggtacagtctaagccaggaaggggcttgtcttctcaatggggaaaattcacataaagactttgattaagacagaatggaagaagtgggtgaatgtatcttctgcagatgggatgcaaattcagataatgctctgggcaggatggttttgcctgatacgtggtgatattatgtattgagagccaaatggctggttatgggcatccatctggcttgggactgctccctgccatccagggggtctgctcagtgagggcagacgaacactctgcagccctcatcctagctccctgctgtctcagagtccccagtgaagaccctagaattgctgtggctcccacaggagtctctcagtgctggcacagtgggtgcatgcagtgggtgctcacccagcatatcatggtccctgctatgagccatctggaccatgctacagaggaaagagcagtaccaatatcgctttctatgagttcccacgtgactctgaggaacagcactggtcattgagggacatttttgatcttcatgttcacatttccattttgcacacactgtgcctcacaggaggcacagctgggtgaagcacctggcccatcccacagctagaagcagggggagcaggactgaggccaaggcctgtgctgttcccactctcccttgaagatggaggagactcgggccctgggcttaggggccaaatcctggcaggggagaagagtcaaggactcgatgactatcaaacagttgagtcccaagtccagtggtaaaaaggcatcaaaacaacagccttagcttcctcctctaaaaaaataacctcttaggtttgttgagagcataagaattaaattactttaaattgcttattgggatttatcgtagacacacacatgctcaagcaagtgtgtacactgtcactgcaacaagcttcaaatataaatgaagggaaacaaccccaatgtccatcactagggacagatcaaagcacgataagtccaattaatggaataccaagcagctgcttaaaaaccaaacagtttctagctcttggaaacttgggaaaaacaacaaaaacaggcagatctgtatattctgtcatgcaacaatctctaagatatactggtaagtgaaaaaagctaggtgaggtaccatgtacatagtatgctgtcatttgtggaaaagaatgatgtgtgcgtattttgtataaagtttaaatatctcttaaggaatacactggtggtggtaattatccctggagagggattctgaaggattgaggatatgggaaaggagacagtttttatggtaaacttttggaaatgttttttaccatgtacacatactacgtattttggaaaatagtttaattaattcgtttggaattttaaaataaaaatcaacaaaaatatgagttatatgaaaaactaaaaaatgagtaacttagtacaataacaagcatgctgcacataataagtggtagccaacatataaaaggatcatctctatttttatgggcaaatagatgaattcagagagggtgaataacttgttcgaggtgatgcagtgtgtgtgcaatagggctgcagtgagggcccagatgtgttcggcctcagcacttttttttaacttcacattacagcccttccccattcctttttcccaagactaggagttcctaagagaagacccacgtcctcttcagctctgcaggccaatgttcaacagaaggcctggtacacagcgaatgccatatgaatatttgcagaaggataaatattatatcctagacctttgttccaaagagtttcatctagtagtgatgacagcaccctatcagtcaccctgatcccaggggtgctcatgagcacacaggtgtcctttctgatcataggctaggaagccttgaactctgagaagttagtaggtgcctgatgtgttaaatgaattaataaataagtgaatgaaagacttcaaggagcaagaaaagagattcgtcagctctataatatggagccccaggagatgagaagaggctcaccagctctccacagtcagaagacaacttggcaaacacaacctctcatttcaaccatacctctcacatgtggcttttgaacatatgtggtcatgaaatagatatcagcgtgggtaattgcagctctgtcttctgtgcaaatctcaagaaacagcaggagtcattgggcaacatagggttttgcctggttctgaagagacttgtattctgtgtgctggagctagttcaaaccgcccttggtagccaaatgccccagagcatgtgaaggcaccatttacataaaaaatctgacatcgctgaagctgtgtccttcgcagaagtattccagtgaacttgatagctttagcaaggcgctttttaaggaagactgagcctgagctgagtgtacctcctatttgtggatcctccaagatgttcaaggtttgggagctgagcctaagatagggcctcctggcagcagatgcgagtgtggccgtgccttgggggtggccctcagggtggtcaaaggcctgccagaggtctaattggttttcatcttagactggaccatggctttcctttgtccctgagggacactagaaaccaagtggaagaatcaaatgagaagactttgcagtgtctacccagctgggtttcatatccacaagggttgtaagacgcatgcattctgggatgttgcactaataaaggcatcatcaactaaggctgcactttacaacttagtgcagcagccagtaagaatttaaaccttctctgggccatcctcaggcctccttacccactattcagttaagccaaggttttactaaatggccttgagctgggagagtttcggtgaacctagacagagctttgagtgtacacatgtttcacacccaagtagaaatttgtaaaattccccactcacatccgtggctgatcctggtctacttcctctggcctacttccttttctcatgcctgctcatttattttttaactttttaggggagggacactcatcattacccattgtttccaatcagcttcccttttctatacttcccttcttctttaggtggccagaatccatttcttcttcaatctgacattcttttatgttgctttctccctctcttttggcttcacatccagcttactgttttctaaatccagtgtatcttctggtagtttttaccctcctggtctctgtttatggctttttagtaaaagtgaagactgggtttgaggttcagtctggtgccaagaaaattgtgaggcttaatttttttctttgtaccaaatgagagtagagaattgcttgaggagccccaacccaaactttccttatgaggatgccattgtgctgttgacattgtggaatctgaagtcaccctcagaaagccccagtttagaaagggaggaggctgccattcccggatgcctgctaagtgtcatgctccacacacaagatcccaccacattctcttcacaaccccactggagaaatgatgatccccatggtataaattaaccagcagaggcccagagatttggttaacttgttcaaggaagcaaaagagccaggatctcaaccccagatgcctctttccacaaagcctgtgctccttgcaccgcacaatgcttttctccctggaggggaaatctgcaggatattgcaggccacttctctcgaagtagaactgaaaatagtagacccaggccccttaagagaaactggtccatgatgcatctctgaattcgttggggttctccccctgtgggctcataacccagcaggctgcccctcagggattggtgagtggaaaatggaatgcgggatattatttgctcctctagccaccactaggtggtccacactgccagatccccaggaatctagctcccagcaaccatagtgaggaaactggggtcattttctctggagaggaaaagtctgaaggctgaaggtttagcctattttctgccttcaaatatatgatagtgcttttaagagccacatgtttcacaggagcccatacatttctgagcatgaatggctgagagaccctgggcaggtcactctgctctgcttcagtttcttgatgtatgaaattaaagcattggaccagaccacctctaagagccttgctagctctggcatgctcaatttttcagcaagaatcaaacagaaggaaactgtttgtttgagacaggatctcgctctgttgcccaggctggagtgcagtggcatgatcatagctcactacagccttgaactcctgggatgtagcaatcctcccacctcagtctcctaagtagctgggagtataggtgtgcaccaccatgcccagctatttttggtagatatggggtcttactatgttgaccaggctggtcttgaacatctggcctcaagagatcctcctgcctgggcctctcaaagtgccaggattacaggtgtgagccatcatgcctggccaaggaagcagtcttaaagagcaacatgagtcctaggtcagcaaaagtgtggtctattgtcaacagagaggctgcccagcagcctgcccagggaacatgacacttctacacttctggggcacagcctgtgagcattcagatgaggttctgtttggagatagggagctggatcagttgatcaagtcttggcaaatcttgtttaccttgtactagatagaaaggttctcagtcggctgccatgcccagacccctgactgtttgggaagccaagttttaccaggtcctgatggttttctcatttatgatggcagctatttttataacacatatcccttgggattcagagagagctaaggctgatggggagaggggtgctgaattccatgttaaggagctataaggaaacattttataccccatcccctatgcaagtaaattcagtgactatctattcctatagcaatgagcccatctagaacagcatggcattgtctacccaccagtttttcacacaggccaaatgcacacccaacccttccctccaaccaccaccaaaaaaaaaaaaaaaaaaaaaatagcaacaggagaatcctattgggtttagtgaattgcccctttacaaaacctgccattattttgtgtttgaagccccacccttccctttcctcttcaaaatactttatggtatttatttatttatgtcaaagtaaactgtgaaattttgaagggaaatacttcataatttttttaataattaggaaagagatagacttgttaattgtttaattattaattaagtcaatatttttgagcatctgtaccatattctagtctaagtagaaattaaaaataaaaacatttaattattcttgttaaaaataaggacagagatctcctcaccttctgtttttttctcagagcatttactttagaaaactttttttttttttgacatggagtttcactctcatcgcccaggctggagtgcaatggtgccatcttggctcactgccacctccacctcctgggttcaagtgattctcctgcctcagcctcccaagtagctgggattacaggcgcccaccaccatgcccagctaatttttgtatttttagtagagacaaggtttcaccatgttggccaggctgatctcaaattcctgacttcaggtgatccacccgcctcagcctctcaaagtgctgggaatacaggtgtgagccaccgtgcccacctagaaaacttttacatactttctcctctctttgaacatgtgtaaatccttttgaaactagataggctttttgtcagctttatgagctaagctagtctttcccaaggacctgggcgtcatctctttgaaatgtaaacaaacctaagggagatagtgcttctatctcttagtttctgtgggaaggtatgagcctaactgaagagccttgctcagtgctgcaaaattaccccttgtcttaaagataaatttgattttcctctgggtagagccagttagctaacacaagtggttaccctaattaccaggtaaatttagagtgaaccatgtacggcaaacggtgctggcaagacctcttacttgaggaacagttattgtttgccttgataacatgtatgtaacaggttgtatctacttggctatacaaaagggggagatttctttctgttcttgcaacctcttagtagatggcctataatgctctgcatattttggtttactgcttattccataataaaactgttctttctctactccttttgtggagagaatctctgtgttgaaagaagactttgttaattatatttcaccaatactaggcactgtgctagattctgtagaggcaaaagtgtttaagatacagttcctagaagtgtttattattgctcagtaacagaatataagaaaagtcatgggaagcccaaggattgaacctctatatctgtctccttaaaaactgggggagggtgatcaagaggatatcacaaaaaaaaaaaaaaaaatctgccgtttgagctgatgttttaaggatggggaaagtcttccaggttgaccaagatggaggtggcagtgaatagtgggtgggctttgaagacaaaggcacagagggtctgagcataggaaggtttcctggggccaaggccaggcagagggaaataggaacagaaggcagtgaagatggtggagttgggaggagcccacatgctcccagagtgttcaggaaagtcagtttaggctgagtgcagggcttcggggaaggatgcagagaaagccaaggctgaaaagggagaagagggacatagagaggggtctgaaattccacactaagtaactacaaggaaaaatgatgaaagactttgaaatagacacacactgaagattactgggagtcctttctggcatactctttggggctacctcccccttttattgcctgagctaattttacagcaccgtaggttatagcagatagcagtgcaaatgactcttgctcatggaaatacaaattttgtctagtggagatgcactggattaagtgccctgtagatatggaccaattgtgcctttatctctaaattcatctcagtatttctggaagcatctcacccatgctgttggtttggctgtagactgctaattctccttgctgcgtaggattccactgtgtgactagtccatgatttattgccatttctactgctaatgcacacataggtggctttcagtttgttgctagtttggacaatgttgccgtgaaaatttttgtgcatgtacatctcctacaacgtggatgcattttaaaagtttagtcttgagccaaaccaaaaagtatgaatccaaatatgaagatcaaaaataggcaaagctaagctatattgtttagggatgatatttagattcagtcaaactatagggaaaagcaaggaagtgatcaccatagaagtcagacttgtggttctttgtgggagaggaagaggctgtggtcaggaagggacatgagagaggcttctggggttctctttctcagcctggatggtagtaatgtgggaaattaaatctaatactttgctaacccagacattgttctttcagtgtgttgtattttgcaataaacaaaatacaacacactgaaaagagactttccattttctccttaagcacactttaaggggaaaacaaaggtggtctaggaagatgtttaaagacatatgatacagcttttcttccttactcacaagctaaaaagctgcactttggccaaacaagatgagggggtcgaagcatcagctgtggccagcgtgccgtgagaatcccacctgtgaagcagccagcagattctgagcccctcaagagggcaggtgggatcaaggttcagctagaagccccaactttcccctggctcttctgggcagagtgagtgatgccagagagcccaacttctcggaatgcctgggctgtgctgctaggaatcagaacaagtccttgggaaaggcagccaagatctggattctgccattctggttccactccctcctatgaccgtgacctgctgtggagcagcagaagttcccctccttgttcagctcctccattacaggtgctggttccaaacgtctctggactcaggatactgggtcagaggctggggctggggaggagcagttggatgcctggatcccaagaaggaggttttttgaggctagggtctctggctagggagaaccatacctgacattgccactgtgccatagctgcctagggccgggcaggcttcctcctgggatggggtggggtgaggaaggggatagacgatcgtcctgactgggtcagctctaatacgttctttgctttcctgcccctacagctctggattcttcacaacctcattcaatagtagtcagtgtttttcaggtatccaaactttctgaggctcagtttcctcatgacaacaacatatatcgtttcttgagcatcaaagatgggtcaggcagtgtgtttgggacttcctataccatgcctttaatccttgcagaaagttgacacatacccattacatggcttcaaaggctgatggacaatctccattttaaaagcaggaaacagacttagcaagcccagtgcacagtcaccaagtgcagagccaggacttcattcctgacttcattccttcattccaaagccaagctgcctatgtccccatctgtgaagtggggccagctgaggagcagggttcaggagcagactttgtggagactggcacgtggctgatggatagtaggtgctcccatcccagaggtgtggcaagtgccaggtaagcctgagcactaagaagaaccacactgaagttgggctgagactatttcctgccctgccttcctttgtgaaaataaagccaagcaaagaggaagatgaaagaatccaccctagccttcctgagcccatttctcattcccaggggttttgaaccccaatccactgcccccattcccaacccacagtggtcctcaaggctctccagcacaggtccgtcacccaccctgcctcctctcaggaaacccagctccctccaaagcgccctctgggcctgggatgccctgagcaatgcaagctttcttgcctgctttcacgtggttcaattttcctttttttttggctcaatttttttctgcctcaagttttctacctcaagtatttcaaaaattaatttttttttcttttcttttttttttttttttttgtggagtgggtgttgaaagaatcctaaactttcttagccattctctggactgagctataaactcacaaagcaaggattgcaggctctgtgaggctgtgattgccagaggcaaggcaagagaaataacaagccgtggtcagtcctcagctggggcctctgatggatttcctcctgtcttgcactcataatttctttctgaagaccatgttttccacccacacaaacctgagcctgagtatcctcacaatggttataacaacatatatcaaaattgaacactaaatttgtgccaggaatttattaatggagaaaccccgcctctactaaaaatacaaaattagccgggcggtggtacatgcctataatcccagctacttgggaggctgaggcaggagaatcacttgaacccaggaggcagaggttgcagtgagccgagactgtgccattgcactccagcttaggcaacaagagcaaaactccgtctcaaaaaacaaaacacaaacaagaaagaaaacccaaaaaacaaaaaacaaacaaaaacccatagatggtacaaaaagtggaagaaaaaggaaaaaaaaacccatgaaactatctgcaatgcagtttcctagaatcaaccacagtaatcttttagcttttctctatctaaatgttatacatattttatatttatattaagtgcatttatatttatattaaaatacagatacaaatttaaaaactctttattattaaattttcaaataaaaagcaacttttcaaataaaagcagcgagaacctccttatacccaacacctggcttcaactattagcaacccatggtcaatatttcctctatttcccacttaatgtctctactgaattatttaatttcacccataaacacttgtgtgcatctctaaaagttaaggactcttttttgaaaaagactttaatacaatttctcatctcaaaaaattagcaataattcctcaacagcatccagatgcaatttttcatgcttttttcagttagtttaaaatcatgagcttttctccatgtctctaaaatgtaattactaatgcttctaatactattccaccaggttgagtgtattataaatgatctgatcaccccttgcctcccactcttccatccccttggacatatttaggctacaacatccccaggaaaatggtttccattgtctgcacgtaagcaaacaggcattattaacctattagctgtccactgctccaccccacccacaggtacccaactagtcctgtgcacctacctggcgtggactgccaagggaacctctggatctgccagtcagccaccctgtcctgctcagactttaccagagacgagtatttc

SEQ ID NO: 1657 - DNA, 14941 bp, Homo sapiens
ttggtggctacatttgagtacagaactttattaggaaaattataagtgcatatacattttttcattggtatgacttcaaagtagaaattgttgtttctcaaagagttgtttcttatttattttttaaagcacgctgcgtataggaattggccttctcctggaccattttcacattatctgggagatgcaattgaaacaatacaaaatacagtattcatcacatttaacactgaatcattcactgctcagagactgagagtccagcgaggttgcaaaataacaaattttctacatggttttatcagtggtctgcttaggggatttggaagtttctagggaatatttcccaggaatggggctccttcagaatgagtcagggaagctctgtagagggatcagagcactcaaattctcatccagctggaaaagggtgtagcacctgggaaaggcgatcaactcccagtcagggagcccacggtgataacaccagtcagacgatcacaccatggaagggtccaatgagatccaatggaaagacttagaacatctaaggttgggggaggtgcaaccttctgctattcagcccctctgctccaagcggaaccttttttctcaggaggtaatctctaataacaagcagagtgccctctggagcctcctcgctggtatctcagtgcctggacagagggggacacaccacagcacaaacacgtggcacagactcaatcccaacacacagccagtcaacgagcctctggccccttcctctgggtcctgatacagagctggcagcgagggcctctgaagaggttacagggagcccaagggagtgtcaggtagaggcagcaccaggtcccggagggacagatgagggatccctagtaaacagctcgtggacgcacttgactagcagttcgaaagcaaaaagagattcggattacaagagacttttcccttgcaaatggaagactgtatttaaatgcatattgctttagctgggcagtctccaggaaggagctgattgttagtagaggaattgttatgcaaataattttccctgcagtttctactcttatctattttctcccatggaggagaaatagaaatgattcctttcctgactgtagtcaagatttagggtcatgtttgtttcctcaaccaagaattcaatggtcttggttcatggattgggggcaggtacatccaagttctacgtgacagattttaaaatatcttggattacctggataatgactgccccactgaaaactcaattatactggtatagtgagaggttaatttcaaaaggttttgaaagagttctgtatctttataactagtaaagatccctcaggctctattttttcaatataacatagctggattgaggattttaatttttgtttaagggacaatttttgttgatgggtttgccttctgccatgaagctccaatttgaaatacttatgaaaatacttaacacatgttactaattaccctacagattattaaattcaagaacagttacaattcaagattacatcactataatttacttcctacttcctacatgttacatagtttccttgctttgacttccttgttttccactttcttcattaaaattttttttaactggagtctttaatcaaagggcaaaagtattcgtaagactgaatgaaaaacaaaacaaaaacccacaagtgcttgcctttgtcaaaagtgaacattttaagtggcttaatacagctctatcgactgccctcagtggaaggggaacactccaaatgtcaggcaggttgacttactcttcacatagcacattgttctcttagagaaatgtcctgtgggaagggcccgaagcacaggtgacacgcagagcagagagggcccaggaggaaggcaggagatgatggcattgccaaatggtgaagaagatgaggttagatgtgaattgggaaagaatcttcatgtccaggattggttattttgtggactgggttttaaaaaccaaaaacaagttgtgaatgcttgttttcctcaagcagtgctgggcttggccctagtttgaaggtactgacatgtgagggagcactgatggggcagcaatcctctggggtcaaccctggtgcacaccgaattcccttgggctctgcccatggacccaccatgtttttgtgatcagtgggggaaccaaggtagttcaccccaaaggaccacggctctgatcaggactgcactcaaagggcccaaggagcatctcctcgctcagcggctgcacagggggaacagtgcatgcatcaagacattggtcacagaggaggacgctggctttgaacaaaaacataggattggacaatggacaatattccaaacaagacacagatgtgcacagtgttttcaggtaacacaagacattttcatttcctgcttggtgcacagtttacatgaaagctttggtcctgagagtccttttgcagggccatggagacagtcgtggacacacatgatgatggatgagacagagaatgatgagcagaacgtggaggatgtggaggtgctcgggatgagggctgggtctcactctgccctggcctcacactgctgcctcagctcagggtagccctgctgccctcccagaagaggcagacccggctcccatgtggatggagaagggggtgagcctcccatgtggccctccaccatcccatcccacagagagaagccttcactaggctttgcccaggttgactggtcctggcacccccaggcgtccctcttggtggctctccaccctagggctgaccatggggccaggctccctcagcccagtctccccacctgcacagctcagagaatacaaaacccaggagccctgagtcagaggagtggctccgtggaaagacactctaataaggcaagtacaataatggccttagtctaagctgctacgtgtcgccagtgacactgaataatcaaactaaatgaaaaataaatgtcatgtattttgctacataatcaaatggtgaaaatatggcaaagtgtgcaaaacaaagcccttggcaatgcctggggccctgccctggcaggggaggctgtggcaggcccttccctaacactggtttcagagctgggctcctactgtaagggttcctcaggcgtctgaccctctcacatcttgaacctcctgttgacaagaacagagggaaacaccattaaggcaggttccccccacacccagccagctccagaaggacagcggcctgcgcggaggccctggggccaatccctacttccaagttgccaccttggccatgcatctcccttcagaggccctgcgacaacagacgggaggggagtgcgagacgcagccaggctgaagcggagggacccatggatggcagaaagcagaggacagacacgtggcaagcactgggcgtggcagacgcacgaaggcacagagaggcccatcagagtggtcatacgacggggacagggcacactgcttacccggcaccggcgtggggctgaggctcaggatgctgctgccctgcatcctggcctcggctgtcccaagaggcactttcgtggcttccagtaacccttcgccctcggggcctctcagccaggggccatgccaccgtaggtggccccaggtgggactgctggaggtggcacaggggtgggtgcacaggtggccaggacctcccaggaggaacgcatgctggacagagcagtgaccatagcgcacccctcatttggctctgactggtgtgagcacttcctagtttcaacccaccaggaatcccggtcaggctcttcactcttccacggcgaccctgtcttcagcactgggtgtaccacctgctcccaggagcttcacaagccacttgtaaaccacagtgagcccccagggcacatacagtcacatcaagacatcaagacaggacggaccttgcatgcgttctcaaggtgggacccactctcagtccctgcagaccctgctccccaggagtgggatagcaagcagtttgtatcctcaggcagccttagctgggccctctgtccctagggggccaacagcttttcatactgaccaggacagactggccacccctccccaggcacaaagccctgctgcatgtggagtccgaagaatgcaggcgagtatgggggcacaggtttgccctctcggggcgcttttgtcaagagtcccatggactagagtggctactggcttccacgggaaggatggcagccccaggcagcccacccaacagctctgtgccttaagaggtggggagggcagaagactagggcacccctgtacccagggctcaggcctgtgacccccagtgctggcaagaggaacgtgggccaggagagttgtccaggtaaaagagatagcagcgggaaacaaaggtctttggctgaagcatcctaggacacctccccaacgaggagaaggcatggctgtgatcacagggagctcattaaagctcaaggggacaccacgctccgggacagggtgtgtctgacatgcaggggtctttgtgggttttctcctgaattccatgtgctccatcctccaaccactttctctttctgcatttattaaaattatgacccaggatccgggtgcagggtgggcgggtgtttatgtgaggtggagaagggctgagaaattcaacgcatcctttttccgagcactactgaaatggggtccttgctcttccatcctcccggtccagattagagaaacttgccaaaaaatctcacacatacatctacatgggcagggaaggagggtgcaggaaagttcctagagcttaagtggtatttgctttaggcagataaggtatttcccatgaatgaggacagaggcagctgtgccctgcagctggagcacacgccatcacgcaggaggcgggaggggacaggctgggatccccagggattcaggacccttgcaaagttccatagcacatctgtcctccacgtgggggacccgtttaaagactctaaagagaattgcccaaagaggagctccctgagaagtgtttccacatctgctctctgagaatgcagcattccctcgggctcaccccacacagtttgcagaaacccacccgggcttggggataaagccactcccacaacccaggaaggaggggctgaagaagccccttcccaggtggcagagtgctggagggaaaggcaatgggtatttggaaaaagccagggcccattcctaagggtcagtcagttttcacctttcctgagggccacagaggggtggcacacccccttcctggcgaggccacctctgctagcaggttgccctgcacactggccaggtggccacagcctggtctccacaggaatgcagactgcaagtgtgtggagctggtgagctccccagtgagcgcaggccttctaagagaggaagtggagggcgggctggggggctcagcaacctgggcattcctggagctcccaggctattctggacagagtcctgagcacacaggctccgcgtcacagacccccgccccagtctctgcacaactactttcttcataacttagcagaccaacaagggccttaaaaagcacataaatacagaagccggtgtggctggcagggcagcaaagcactgctcccccacggaagtctgagcccctgcccagtctgcatgggggtctgtcctggaggaggatcgagcaaatttacaaagcgccgagagcaagtgaactgtggtccatctcgaggtggcagataactagtttttccttttctgggcagcctttctcttcttctgtcgcttcttttttcctatcttttcttttttccccactttttcttctctgcgcccccttagataaaattagtagaaccattaataatgtggaaataaacaaaagttcgtctcagtctgcataagatttaacactggcccgtgtactggttaaactgtgccttcagtctcaggcctggaggcccctggtcaaagcactgtttatcagtaattcattaaaataaattggacatttccttccattcaaacaaatgttcaatgggctcctagaacacctttgtgaatgggttacagcgactgccaatctgccaacctgaacctgattcccactggggacaaggaatccacatctcagggtacacccagggccaggctggccatcgtggtccttgtcaccccaccctgccctgttctcatgggactttttcttcttctcaatgcagggctgaactcttagctttctctaagaaatgtctgcatttcaaattgaataacgttttggaggctgcaggccccaggttcagactgccattcagaagaggagaaaaaaggcagtggtcccaccttcccctttctagacgcctgtgaacactcctgggaatgaatgcgattgttctggagagcaagggagagagctggttagcagaattttattagagcaactggctcgtgactgtcacattaaaatgattcaagctgaatggtatttaatgatttatggggtgaggccacctgtccctgtgaaagcttcatattaaccatggcctggagtcatgggatttttacatgggaaaatgtaaaaggttgatattactagggttgagtctctggggattacatggggaagttaggagaaccaaggaggaggagggagggaagacgaattagtgagtcaaatattattcttcagaaaaccagcactgctatttcaatcgggttaaaaaaaaaaaaaaaagatccaaaaacttgagctgcagatctaatctgctcgtgagaaaagcccatacactgtcacacatgggctgtgagaaggggtctcagacacctgactgcaggcaggcttaactatataaaccagaaacgtctataagctccatcactaacaactaatgaattttatttcaggtaaataaattcccacatacagtaggacgtttataccatgaaacaattagcattttattgctagtgcatataatgtcacatttgatacaattttagtacaagtgaaaaaatacactgtggctaacattgaaaagctgcaatcacatttatatatcatatatatttctttacaaattgccagtagtttgagataatagagaagtataaactactgacattcatatggctccacttcaaatatatgaattgttcgactataaatatattttgaaatacatttgttttctaaagaaacgtaaaaaaaaatgtgcacaaaaatatatataaaaaaatgccttgcaaaaagttacaaataccaccaggaccttctgtggatcgcatttatgcatggaaatgtcaccttgccaacagttctgattggaacctgaaaccctgctgtggcttcaggagggggtagtggcaagatgatggtttattcactgattttttcgcttctgatttcggaaacctcagagtttgttagtgcctccatggcatacataggcttcagaggcaatcacaaaacccagtcactcaaagcgagctctcagatttaaaattgcatttgattctgtaaagacttgtcttttgcgggtaagcagggggaccattacacatccccaggagagggccagctccattctggaggaggccaaagacggatctcacagagggcccgagctgtggggcaggccctgggaggagagggatgcagggcacgagccccagcaatcaccctcttcccggctggtgcggcgctgatcaggctacagaaatgagaagcagaagcaagattaagcatgctctcggagtcggggagagagtaggaatagctgggagaggggtctctgagcacagtcccagtaatagtggcttctacatggagcccacagagccaatcactgaggttgaaagaggaggtgaaggcagtggcggcgcccagccccagtcggtatctgagtgccacagaggccttcctcttgggaggggcgctgctgcgggagcctcagtgtctgaagaaaggacactttttccagctccctgttaagccaccacctgactgtgcccagactccccaggggagcagaggagatgctccaaacaagccaaattcagatcttgaagtactcgttgatttaaaaaatgagaatgagaatgatgatgattgtgatgatcatgaaggaactaactgcttgaaaatgctgttgataatacaatttctttcttagaaaaaccccagtaataaaagttccaacgtgcacaggtacagggcatggatgaatataagctgcaatatcataccgtatgctataaatgcagggtctaaatgctggcaaacctcaggcccgatcccagatcaatgtgcccaccccacacacacacctggtcctcatggttaaggccccctcccccacgtctttgccctttcatctctcacaaggttttagttttcctcgagtgggtctagcggaaagtcctttttggctgttgtgcttacttgtttaaagctttctccaggtactcctgaatccactttagcttcgggtcaatgcacacttgtctgttgttgttcttcagccgggctctgtgaaaacagaatggcaacagtgtgcggctgcacaggaggaaggcgcggctgcaacgtgtgcatccgctcccccaacacccatctagggccctcgctggcaccccgtgctccacttggtacgctcaggctccagaggtgctcgcggtgtgctggggaaagctcagcgctggcagtgcaggaagttccattgcagagacatggaaatgtgaacagaagtctttccggggcagtgcaggggaattcatgtaagggagcatttgagctgcctttgaaggataagtaggagcttggagagtaaataaacgggaagggaaaatcaggagcaaatacgccaggggggtcatcaaagcatacagaggaaactgaggaaggggacgacaggatgctctaggtacctggggaggggagaatggagagcaacagagcagaggtttatttggatgggtcatcttgatagatatagggccgacttaaggatgggcatgaggaagcctggaggaaggaggcctgccagaagtcaccgcggtctgaccgggagggtgaccagccagggaggggaggggcagtgcaggtggcttaccagaaaatagtttctagaaagattttacaagttcactgaatgtttcttggtctcatttgttttttaaaagttcacactcttaaaagcttccctacatgcaaactcctggggaaggcctgatttcatctctctgaatctcttgccagaaagccctttggtgccaggtaatctcatgcagcccaagtacttaagggtcttgaggacagctaagccccagaacagtggttcaggggcacccagggagtcttcaagcagcctgtccattaggtgaagaggggtgcagagatgggtgtggctcggagcaacccacattggggtccaaatctggggcctattctttgttaatttagtgtctgctcagacctgagaattgtatttggcatcttcaacttcaaggtgcatttccaggccagtaaaccagcatgatcagtgctgtaaagcaggtccaaggtagctaaattgagcatctttaaaatactcttcacaagagataaagtatcatgttgtaggcaaagtacagaaaaaacattcattttctagggccctaaaacatactgtaaataacaaacacattcaaggcagtaaagggttaactcaaaactaaaaacagttttctaaaatcaaaagtaaaaacatttggtgttgggtggaaaagtcttgggaaagttgtagctttggttccaactgctgtctccccaccccatttttagcactagaacttctgagcaatcaaatcctctccaggagactccctgagccctcgcttccccgtgttcagacacaggacctcttgagcatgagagggctttcaagcacatggctttcttcccgcatttctcccggtcttctgtacccagctgagatcttcctgtcttgtggatgtgtgattttggtctttgtttcccaaatgaataaaatcaaatgttagtggctgccatccacaccaaataacaccaaaacctcatatgttgtacttgagaaaatacaggcaagtgagctgaaaatgttgaagtttcacccaatggttaaagaggacttaaactgcatttgggtcttgtgagttaatgtagggcatcagatccccgaaactggcaggccagttatcactgttattagctaagggctggctaatttactaggcttcagccaaaaccttggtgaagcccatagtttctccagcatccagctgtgctgtgctgaagaacacaggtttggaaagaagagagaactactacgagcacagcagggtgcccaggccaagagcggcttttaaaattaatgcctggtggcatactaaaggtcctcatgataagaatagctgccactaattatgccaagttcaaggttggacacttggcttgtcacctctacacctttaataagactcgggttagatgttactatgttcgttagatgcaactatgttcgttagatgatgttcaatttcaagacttacacaatctgaagggcacagtttggagtgttgagaattttgagatgcttgacgttggctctggcaacatggctttcgaagaatcggcatgggcatctgtagctcaggctgacgggcttccctagaagaggtaaggacaacaaggcactttactaccctgccagattttggtaatgtgtgtctgggctgcagcagttggtgcagcgattaaggatcaagagacggcatcactggggtaagttccaggttactggtgtatgttgggaaaggccatctcctcaggcaacacagtgagtgctggctgagctcaggctcagcttctacagggcaaggagcccaacaggcctggggagagccggagcctagatgaggcgggagtttaaattagaagccacctgctcagtgtctcaagataaaggtagtaattatagtagataacggtttcagtccaaggtactgaaatttccagttactctttgtaaaaaaaattcctcaagggacaactgagaaagatctccctactcagggaaaagaaagggggacaagaggctccaggctccctggcctctctcctctggcacaggcctctagccaggaagcacagtagtactcaggaatgctgccctcccccaccccagagacccctcctcacattcacctaaagctctggaaggcacaaaagaatcctggctggcttcctacctgtgagtcccctgagagcaggccaaggacccaccttctgcccagcactttccccaaggcttagagattagtggagctggagttaaatgtggttttcattgcctaggcagggatgctgtagcctcaggaattgtattaagatctttgcaaaatcaccaatttacaaaatgccataattgacactcattagtgtaaattagcaaggggctcctgcagaacccactgctcaccctttaaatataggattgcaagccctggagggctgggatttgtgtgtgctttttgtttttcttttttccttgaagattttatccaagccccacttaataccccaaattatttgaacttgtggatcctttcatcagagattaaatatatgtctaagaatatttggtccagagattttttttcttttttctttttttttaagtttgcctgtttacaaagttctgagagacctctgtggttctgaaattctgcacctttgggaaagaatgctggggaagtaggaggaaatcttgagtaaggggctcattttattttattttttctacagactgcaatcaattgagggatgatgtggactaggaattgcattgtgtattcagccaccaagttgcaggaaaagtggaccacttgtccccccacttccttgtccccaggaccaaatgcaactccctgaaaaccaggaaaaagccaagcatcagggtgctggtgactcatggcactggagagacctaaggcagccttcacagttacacctgatctaactccagaaaggcacctctggggccagcttccagcagctgcactgggaccctgcaggggaagtcagcactgcactgtaaccagatcacctgggaaagccacccccagggccggggcctgcagcctgggtaactgaggagctaaacgctcctgagtgttgtgcctccaggtttccctggatttcttttgggcccttccaagctgaggcagggggtgggttgggggtggagcaggagaataggaggccggtagtgaggcacaagccccctcccggcaacagtgagcttgaagatatgcagccaagggcaagtgctgcagccgcccccgctgggatgggtggggctgtgactctccagcgcccagaggagagaagctcctctggccccccaaccaagcagtggtgatgaggccagaaatcagagcctattcagagctcaacacacaggctctctctcctctccccctccaccccctgggattatccatttccttcaaaagcaattcttgcttctactcccaggacctaaggcccgcctgtcaagcagcgaatttcaacaggtctttttaaagtgacagagcccccaggtgtgcttaccaaaagaacatggtctcgtgtgtacctcatgtgctccttcctccagctttttgtcagtaagactaactttcccaaccgttctggatgtaaatccgtgtaccggcaagagtcctgactggctctgatggtaccccggatttgggaccgggtgagcttggctccaggagttttcagaaagccctccagtctaatgcagagacaggagcccagctggcccctccaagcaggcttgggaagggggcccaccctgagtttaagcccgggaaacccaagggcccagctgcctgacggaagtcagccaatgggggaggggcaggacccctggccaagctctctctgtagtgcagcttgaggactaagtgtggggatagggggcacataggcactgtgaggtgaggggaaaacaaaacaaaacaaaacattctggcgatgtgtgtaaggagcagatctgcctggagcccaggctcctgccctggttacttggctgccaatggggcaactctgagggccatgtcacccttcccaggccaggaggagtctgggatgaaccccacgtctctgtgcttcccccaggtcagttgcacccataactcaaagaccgaggttcctcattccaatcctctctccagccctccggggagggggcagcaccatttcccagagcggcgcactgtgacacctccgcgctcatcccaccaatcagtcaataactgcccaaaccagagaccttacaggaacagaagaatatccagcaataaaaactagaaacatgccccatgacttgcgggggggggggggggtcagtgtgcagacacagcctcagggacttttcatcaacgacgaacattcccaattgccttcagtctgtgtccttaacacttaggcagtccgccacgaccccaggctgcccagcttctccagcccgactcagctgcgctggtcctgctcacaccagcgcacagtccaagccagctaggacgccggggccacgtctgcaccaacccagccaagggctcgaggcgcgctgggcctgcacagcccgcggctgcaagagcactcagagtgtccttcaactctttgcaggaaacttcacagccaaggaagctcagcggcctgagccacagggttttgttttgtgtgttcagaggcaacagtttattttggtttgcatcggtgtcctgtgacagcgcagcgagtttctcttcagcgaaagaaaagaaaaaagccctctcccagtgaaacgggacaccacggttcccagtggcccagggccttggagattgaactttgctgcagctctcattctggggcaaagcgcttggccagctggtgacaaaagagcctgtctgcaggtgtgtttggggagctggggagggggcgtgtgaggctcggagggtccctgggcctctctcaggtgaacccgagaagagacaggaagacagcggctggacgcgcgcccaggtccgcgtcgctgcggaccgcggagctgtgcagaagcgcggcctggcgggtggcacaagcccgacagctgcgccgcgcagcccgcccgcgcctggccaagagccccgcgagggtgtggggagaggatcggcttcgcagggagcggaggctgcgcggctgcatcggacctcacagcctcaagtcgcggcatgaggcgaactttgcaaagcgcgctctcgccatgcaccgcccgacctccagcactgtgcgcagcaggacctcggagcccattcgcctgtggaaaccgagcccgcagcgggaaggcagtgggtggagggtgggcaggcaggggtctggggtccgcggctccccaccctcgcgccttcccgcgccagtcccgaacgctctcttggggcgttcctgcccagttgtcccggctgacctcgctctgcagccagcttgaggtcaggcggtcgctctctgcaggtcacaaaccctcggcgcaaaagtagggctttgaacgcgacaccgcaccagagcgcccagctaagcgagctgcctccacccccactgtgtcgggcggcgcaaactgcgggcgcaggcagaggagccgcggctctgcgccgggcgggagccgaagcccagagcctcgccagggcctccccgccgagcgcacttaccgtcgctgaggcagagcgcggtcagcacgaggaccagcacgaccacgaccttggcgttcatggcgcgggcgggcgggcgggcgggcggacgagcgcgggtcgggggccggacgccgagcgggcaatgcggctgacggagagtgaaagtgcggc

SEQ ID NO: 1658 - DNA, 9231 bp, Homo sapiens
ggaggaggatcgagcaaatttacaaagcgccgagagcaagtgaactgtggtccatctcgaggtggcagataactagtttttccttttctgggcagcctttctcttcttctgtcgcttcttttttcctatcttttcttttttccccactttttcttctctgcgcccccttagataaaattagtagaaccattaataatgtggaaataaacaaaagttcgtctcagtctgcataagatttaacactggcccgtgtactggttaaactgtgccttcagtctcaggcctggaggcccctggtcaaagcactgtttatcagtaattcattaaaataaattggacatttccttccattcaaacaaatgttcaatgggctcctagaacacctttgtgaatgggttacagcgactgccaatctgccaacctgaacctgattcccactggggacaaggaatccacatctcagggtacacccagggccaggctggccatcgtggtccttgtcaccccaccctgccctgttctcatgggactttttcttcttctcaatgcagggctgaactcttagctttctctaagaaatgtctgcatttcaaattgaataacgttttggaggctgcaggccccaggttcagactgccattcagaagaggagaaaaaaggcagtggtcccaccttcccctttctagacgcctgtgaacactcctgggaatgaatgcgattgttctggagagcaagggagagagctggttagcagaattttattagagcaactggctcgtgactgtcacattaaaatgattcaagctgaatggtatttaatgatttatggggtgaggccacctgtccctgtgaaagcttcatattaaccatggcctggagtcatgggatttttacatgggaaaatgtaaaaggttgatattactagggttgagtctctggggattacatggggaagttaggagaaccaaggaggaggagggagggaagacgaattagtgagtcaaatattattcttcagaaaaccagcactgctatttcaatcgggttaaaaaaaaaaaaaaaagatccaaaaacttgagctgcagatctaatctgctcgtgagaaaagcccatacactgtcacacatgggctgtgagaaggggtctcagacacctgactgcaggcaggcttaactatataaaccagaaacgtctataagctccatcactaacaactaatgaattttatttcaggtaaataaattcccacatacagtaggacgtttataccatgaaacaattagcattttattgctagtgcatataatgtcacatttgatacaattttagtacaagtgaaaaaatacactgtggctaacattgaaaagctgcaatcacatttatatatcatatatatttctttacaaattgccagtagtttgagataatagagaagtataaactactgacattcatatggctccacttcaaatatatgaattgttcgactataaatatattttgaaatacatttgttttctaaagaaacgtaaaaaaaaatgtgcacaaaaatatatataaaaaaatgccttgcaaaaagttacaaataccaccaggaccttctgtggatcgcatttatgcatggaaatgtcaccttgccaacagttctgattggaacctgaaaccctgctgtggcttcaggagggggtagtggcaagatgatggtttattcactgattttttcgcttctgatttcggaaacctcagagtttgttagtgcctccatggcatacataggcttcagaggcaatcacaaaacccagtcactcaaagcgagctctcagatttaaaattgcatttgattctgtaaagacttgtcttttgcgggtaagcagggggaccattacacatccccaggagagggccagctccattctggaggaggccaaagacggatctcacagagggcccgagctgtggggcaggccctgggaggagagggatgcagggcacgagccccagcaatcaccctcttcccggctggtgcggcgctgatcaggctacagaaatgagaagcagaagcaagattaagcatgctctcggagtcggggagagagtaggaatagctgggagaggggtctctgagcacagtcccagtaatagtggcttctacatggagcccacagagccaatcactgaggttgaaagaggaggtgaaggcagtggcggcgcccagccccagtcggtatctgagtgccacagaggccttcctcttgggaggggcgctgctgcgggagcctcagtgtctgaagaaaggacactttttccagctccctgttaagccaccacctgactgtgcccagactccccaggggagcagaggagatgctccaaacaagccaaattcagatcttgaagtactcgttgatttaaaaaatgagaatgagaatgatgatgattgtgatgatcatgaaggaactaactgcttgaaaatgctgttgataatacaatttctttcttagaaaaaccccagtaataaaagttccaacgtgcacaggtacagggcatggatgaatataagctgcaatatcataccgtatgctataaatgcagggtctaaatgctggcaaacctcaggcccgatcccagatcaatgtgcccaccccacacacacacctggtcctcatggttaaggccccctcccccacgtctttgccctttcatctctcacaaggttttagttttcctcgagtgggtctagcggaaagtcctttttggctgttgtgcttacttgtttaaagctttctccaggtactcctgaatccactttagcttcgggtcaatgcacacttgtctgttgttgttcttcagccgggctctgtgaaaacagaatggcaacagtgtgcggctgcacaggaggaaggcgcggctgcaacgtgtgcatccgctcccccaacacccatctagggccctcgctggcaccccgtgctccacttggtacgctcaggctccagaggtgctcgcggtgtgctggggaaagctcagcgctggcagtgcaggaagttccattgcagagacatggaaatgtgaacagaagtctttccggggcagtgcaggggaattcatgtaagggagcatttgagctgcctttgaaggataagtaggagcttggagagtaaataaacgggaagggaaaatcaggagcaaatacgccaggggggtcatcaaagcatacagaggaaactgaggaaggggacgacaggatgctctaggtacctggggaggggagaatggagagcaacagagcagaggtttatttggatgggtcatcttgatagatatagggccgacttaaggatgggcatgaggaagcctggaggaaggaggcctgccagaagtcaccgcggtctgaccgggagggtgaccagccagggaggggaggggcagtgcaggtggcttaccagaaaatagtttctagaaagattttacaagttcactgaatgtttcttggtctcatttgttttttaaaagttcacactcttaaaagcttccctacatgcaaactcctggggaaggcctgatttcatctctctgaatctcttgccagaaagccctttggtgccaggtaatctcatgcagcccaagtacttaagggtcttgaggacagctaagccccagaacagtggttcaggggcacccagggagtcttcaagcagcctgtccattaggtgaagaggggtgcagagatgggtgtggctcggagcaacccacattggggtccaaatctggggcctattctttgttaatttagtgtctgctcagacctgagaattgtatttggcatcttcaacttcaaggtgcatttccaggccagtaaaccagcatgatcagtgctgtaaagcaggtccaaggtagctaaattgagcatctttaaaatactcttcacaagagataaagtatcatgttgtaggcaaagtacagaaaaaacattcattttctagggccctaaaacatactgtaaataacaaacacattcaaggcagtaaagggttaactcaaaactaaaaacagttttctaaaatcaaaagtaaaaacatttggtgttgggtggaaaagtcttgggaaagttgtagctttggttccaactgctgtctccccaccccatttttagcactagaacttctgagcaatcaaatcctctccaggagactccctgagccctcgcttccccgtgttcagacacaggacctcttgagcatgagagggctttcaagcacatggctttcttcccgcatttctcccggtcttctgtacccagctgagatcttcctgtcttgtggatgtgtgattttggtctttgtttcccaaatgaataaaatcaaatgttagtggctgccatccacaccaaataacaccaaaacctcatatgttgtacttgagaaaatacaggcaagtgagctgaaaatgttgaagtttcacccaatggttaaagaggacttaaactgcatttgggtcttgtgagttaatgtagggcatcagatccccgaaactggcaggccagttatcactgttattagctaagggctggctaatttactaggcttcagccaaaaccttggtgaagcccatagtttctccagcatccagctgtgctgtgctgaagaacacaggtttggaaagaagagagaactactacgagcacagcagggtgcccaggccaagagcggcttttaaaattaatgcctggtggcatactaaaggtcctcatgataagaatagctgccactaattatgccaagttcaaggttggacacttggcttgtcacctctacacctttaataagactcgggttagatgttactatgttcgttagatgcaactatgttcgttagatgatgttcaatttcaagacttacacaatctgaagggcacagtttggagtgttgagaattttgagatgcttgacgttggctctggcaacatggctttcgaagaatcggcatgggcatctgtagctcaggctgacgggcttccctagaagaggtaaggacaacaaggcactttactaccctgccagattttggtaatgtgtgtctgggctgcagcagttggtgcagcgattaaggatcaagagacggcatcactggggtaagttccaggttactggtgtatgttgggaaaggccatctcctcaggcaacacagtgagtgctggctgagctcaggctcagcttctacagggcaaggagcccaacaggcctggggagagccggagcctagatgaggcgggagtttaaattagaagccacctgctcagtgtctcaagataaaggtagtaattatagtagataacggtttcagtccaaggtactgaaatttccagttactctttgtaaaaaaaattcctcaagggacaactgagaaagatctccctactcagggaaaagaaagggggacaagaggctccaggctccctggcctctctcctctggcacaggcctctagccaggaagcacagtagtactcaggaatgctgccctcccccaccccagagacccctcctcacattcacctaaagctctggaaggcacaaaagaatcctggctggcttcctacctgtgagtcccctgagagcaggccaaggacccaccttctgcccagcactttccccaaggcttagagattagtggagctggagttaaatgtggttttcattgcctaggcagggatgctgtagcctcaggaattgtattaagatctttgcaaaatcaccaatttacaaaatgccataattgacactcattagtgtaaattagcaaggggctcctgcagaacccactgctcaccctttaaatataggattgcaagccctggagggctgggatttgtgtgtgctttttgtttttcttttttccttgaagattttatccaagccccacttaataccccaaattatttgaacttgtggatcctttcatcagagattaaatatatgtctaagaatatttggtccagagattttttttcttttttctttttttttaagtttgcctgtttacaaagttctgagagacctctgtggttctgaaattctgcacctttgggaaagaatgctggggaagtaggaggaaatcttgagtaaggggctcattttattttattttttctacagactgcaatcaattgagggatgatgtggactaggaattgcattgtgtattcagccaccaagttgcaggaaaagtggaccacttgtccccccacttccttgtccccaggaccaaatgcaactccctgaaaaccaggaaaaagccaagcatcagggtgctggtgactcatggcactggagagacctaaggcagccttcacagttacacctgatctaactccagaaaggcacctctggggccagcttccagcagctgcactgggaccctgcaggggaagtcagcactgcactgtaaccagatcacctgggaaagccacccccagggccggggcctgcagcctgggtaactgaggagctaaacgctcctgagtgttgtgcctccaggtttccctggatttcttttgggcccttccaagctgaggcagggggtgggttgggggtggagcaggagaataggaggccggtagtgaggcacaagccccctcccggcaacagtgagcttgaagatatgcagccaagggcaagtgctgcagccgcccccgctgggatgggtggggctgtgactctccagcgcccagaggagagaagctcctctggccccccaaccaagcagtggtgatgaggccagaaatcagagcctattcagagctcaacacacaggctctctctcctctccccctccaccccctgggattatccatttccttcaaaagcaattcttgcttctactcccaggacctaaggcccgcctgtcaagcagcgaatttcaacaggtctttttaaagtgacagagcccccaggtgtgcttaccaaaagaacatggtctcgtgtgtacctcatgtgctccttcctccagctttttgtcagtaagactaactttcccaaccgttctggatgtaaatccgtgtaccggcaagagtcctgactggctctgatggtaccccggatttgggaccgggtgagcttggctccaggagttttcagaaagccctccagtctaatgcagagacaggagcccagctggcccctccaagcaggcttgggaagggggcccaccctgagtttaagcccgggaaacccaagggcccagctgcctgacggaagtcagccaatgggggaggggcaggacccctggccaagctctctctgtagtgcagcttgaggactaagtgtggggatagggggcacataggcactgtgaggtgaggggaaaacaaaacaaaacaaaacattctggcgatgtgtgtaaggagcagatctgcctggagcccaggctcctgccctggttacttggctgccaatggggcaactctgagggccatgtcacccttcccaggccaggaggagtctgggatgaaccccacgtctctgtgcttcccccaggtcagttgcacccataactcaaagaccgaggttcctcattccaatcctctctccagccctccggggagggggcagcaccatttcccagagcggcgcactgtgacacctccgcgctcatcccaccaatcagtcaataactgcccaaaccagagaccttacaggaacagaagaatatccagcaataaaaactagaaacatgccccatgacttgcgggggggggggggggtcagtgtgcagacacagcctcagggacttttcatcaacgacgaacattcccaattgccttcagtctgtgtccttaacacttaggcagtccgccacgaccccaggctgcccagcttctccagcccgactcagctgcgctggtcctgctcacaccagcgcacagtccaagccagctaggacgccggggccacgtctgcaccaacccagccaagggctcgaggcgcgctgggcctgcacagcccgcggctgcaagagcactcagagtgtccttcaactctttgcaggaaacttcacagccaaggaagctcagcggcctgagccacagggttttgttttgtgtgttcagaggcaacagtttattttggtttgcatcggtgtcctgtgacagcgcagcgagtttctcttcagcgaaagaaaagaaaaaagccctctcccagtgaaacgggacaccacggttcccagtggcccagggccttggagattgaactttgctgcagctctcattctggggcaaagcgcttggccagctggtgacaaaagagcctgtctgcaggtgtgtttggggagctggggagggggcgtgtgaggctcggagggtccctgggcctctctcaggtgaacccgagaagagacaggaagacagcggctggacgcgcgcccaggtccgcgtcgctgcggaccgcggagctgtgcagaagcgcggcctggcgggtggcacaagcccgacagctgcgccgcgcagcccgcccgcgcctggccaagagccccgcgagggtgtggggagaggatcggcttcgcagggagcggaggctgcgcggctgcatcggacctcacagcctcaagtcgcggcatgaggcgaactttgcaaagcgcgctctcgccatgcaccgcccgacctccagcactgtgcgcagcaggacctcggagcccattcgcctgtggaaaccgagcccgcagcgggaaggcagtgggtggagggtgggcaggcaggggtctggggtccgcggctccccaccctcgcgccttcccgcgccagtcccgaacgctctcttggggcgttcctgcccagttgtcccggctgacctcgctctgcagccagcttgaggtcaggcggtcgctctctgcaggtcacaaaccctcggcgcaaaagtagggctttgaacgcgacaccgcaccagagcgcccagctaagcgagctgcctccacccccactgtgtcgggcggcgcaaactgcgggcgcaggcagaggagccgcggctctgcgccgggcgggagccgaagcccagagcctcgccagggcctccccgccgagcgcacttaccgtcgctgaggcagagcgcggtcagcacgaggaccagcacgaccacgaccttggcgttcatggcgcgggcgggcgggcgggcgggcggacgagcgcgggtcgggggccggacgccgagcgggcaatgcggctgacggagagtgaaagtgcggc

SEQ ID NO: 1659 - DNA, 8036 bp, Homo sapiens
taagctccatcactaacaactaatgaattttatttcaggtaaataaattcccacatacagtaggacgtttataccatgaaacaattagcattttattgctagtgcatataatgtcacatttgatacaattttagtacaagtgaaaaaatacactgtggctaacattgaaaagctgcaatcacatttatatatcatatatatttctttacaaattgccagtagtttgagataatagagaagtataaactactgacattcatatggctccacttcaaatatatgaattgttcgactataaatatattttgaaatacatttgttttctaaagaaacgtaaaaaaaaatgtgcacaaaaatatatataaaaaaatgccttgcaaaaagttacaaataccaccaggaccttctgtggatcgcatttatgcatggaaatgtcaccttgccaacagttctgattggaacctgaaaccctgctgtggcttcaggagggggtagtggcaagatgatggtttattcactgattttttcgcttctgatttcggaaacctcagagtttgttagtgcctccatggcatacataggcttcagaggcaatcacaaaacccagtcactcaaagcgagctctcagatttaaaattgcatttgattctgtaaagacttgtcttttgcgggtaagcagggggaccattacacatccccaggagagggccagctccattctggaggaggccaaagacggatctcacagagggcccgagctgtggggcaggccctgggaggagagggatgcagggcacgagccccagcaatcaccctcttcccggctggtgcggcgctgatcaggctacagaaatgagaagcagaagcaagattaagcatgctctcggagtcggggagagagtaggaatagctgggagaggggtctctgagcacagtcccagtaatagtggcttctacatggagcccacagagccaatcactgaggttgaaagaggaggtgaaggcagtggcggcgcccagccccagtcggtatctgagtgccacagaggccttcctcttgggaggggcgctgctgcgggagcctcagtgtctgaagaaaggacactttttccagctccctgttaagccaccacctgactgtgcccagactccccaggggagcagaggagatgctccaaacaagccaaattcagatcttgaagtactcgttgatttaaaaaatgagaatgagaatgatgatgattgtgatgatcatgaaggaactaactgcttgaaaatgctgttgataatacaatttctttcttagaaaaaccccagtaataaaagttccaacgtgcacaggtacagggcatggatgaatataagctgcaatatcataccgtatgctataaatgcagggtctaaatgctggcaaacctcaggcccgatcccagatcaatgtgcccaccccacacacacacctggtcctcatggttaaggccccctcccccacgtctttgccctttcatctctcacaaggttttagttttcctcgagtgggtctagcggaaagtcctttttggctgttgtgcttacttgtttaaagctttctccaggtactcctgaatccactttagcttcgggtcaatgcacacttgtctgttgttgttcttcagccgggctctgtgaaaacagaatggcaacagtgtgcggctgcacaggaggaaggcgcggctgcaacgtgtgcatccgctcccccaacacccatctagggccctcgctggcaccccgtgctccacttggtacgctcaggctccagaggtgctcgcggtgtgctggggaaagctcagcgctggcagtgcaggaagttccattgcagagacatggaaatgtgaacagaagtctttccggggcagtgcaggggaattcatgtaagggagcatttgagctgcctttgaaggataagtaggagcttggagagtaaataaacgggaagggaaaatcaggagcaaatacgccaggggggtcatcaaagcatacagaggaaactgaggaaggggacgacaggatgctctaggtacctggggaggggagaatggagagcaacagagcagaggtttatttggatgggtcatcttgatagatatagggccgacttaaggatgggcatgaggaagcctggaggaaggaggcctgccagaagtcaccgcggtctgaccgggagggtgaccagccagggaggggaggggcagtgcaggtggcttaccagaaaatagtttctagaaagattttacaagttcactgaatgtttcttggtctcatttgttttttaaaagttcacactcttaaaagcttccctacatgcaaactcctggggaaggcctgatttcatctctctgaatctcttgccagaaagccctttggtgccaggtaatctcatgcagcccaagtacttaagggtcttgaggacagctaagccccagaacagtggttcaggggcacccagggagtcttcaagcagcctgtccattaggtgaagaggggtgcagagatgggtgtggctcggagcaacccacattggggtccaaatctggggcctattctttgttaatttagtgtctgctcagacctgagaattgtatttggcatcttcaacttcaaggtgcatttccaggccagtaaaccagcatgatcagtgctgtaaagcaggtccaaggtagctaaattgagcatctttaaaatactcttcacaagagataaagtatcatgttgtaggcaaagtacagaaaaaacattcattttctagggccctaaaacatactgtaaataacaaacacattcaaggcagtaaagggttaactcaaaactaaaaacagttttctaaaatcaaaagtaaaaacatttggtgttgggtggaaaagtcttgggaaagttgtagctttggttccaactgctgtctccccaccccatttttagcactagaacttctgagcaatcaaatcctctccaggagactccctgagccctcgcttccccgtgttcagacacaggacctcttgagcatgagagggctttcaagcacatggctttcttcccgcatttctcccggtcttctgtacccagctgagatcttcctgtcttgtggatgtgtgattttggtctttgtttcccaaatgaataaaatcaaatgttagtggctgccatccacaccaaataacaccaaaacctcatatgttgtacttgagaaaatacaggcaagtgagctgaaaatgttgaagtttcacccaatggttaaagaggacttaaactgcatttgggtcttgtgagttaatgtagggcatcagatccccgaaactggcaggccagttatcactgttattagctaagggctggctaatttactaggcttcagccaaaaccttggtgaagcccatagtttctccagcatccagctgtgctgtgctgaagaacacaggtttggaaagaagagagaactactacgagcacagcagggtgcccaggccaagagcggcttttaaaattaatgcctggtggcatactaaaggtcctcatgataagaatagctgccactaattatgccaagttcaaggttggacacttggcttgtcacctctacacctttaataagactcgggttagatgttactatgttcgttagatgcaactatgttcgttagatgatgttcaatttcaagacttacacaatctgaagggcacagtttggagtgttgagaattttgagatgcttgacgttggctctggcaacatggctttcgaagaatcggcatgggcatctgtagctcaggctgacgggcttccctagaagaggtaaggacaacaaggcactttactaccctgccagattttggtaatgtgtgtctgggctgcagcagttggtgcagcgattaaggatcaagagacggcatcactggggtaagttccaggttactggtgtatgttgggaaaggccatctcctcaggcaacacagtgagtgctggctgagctcaggctcagcttctacagggcaaggagcccaacaggcctggggagagccggagcctagatgaggcgggagtttaaattagaagccacctgctcagtgtctcaagataaaggtagtaattatagtagataacggtttcagtccaaggtactgaaatttccagttactctttgtaaaaaaaattcctcaagggacaactgagaaagatctccctactcagggaaaagaaagggggacaagaggctccaggctccctggcctctctcctctggcacaggcctctagccaggaagcacagtagtactcaggaatgctgccctcccccaccccagagacccctcctcacattcacctaaagctctggaaggcacaaaagaatcctggctggcttcctacctgtgagtcccctgagagcaggccaaggacccaccttctgcccagcactttccccaaggcttagagattagtggagctggagttaaatgtggttttcattgcctaggcagggatgctgtagcctcaggaattgtattaagatctttgcaaaatcaccaatttacaaaatgccataattgacactcattagtgtaaattagcaaggggctcctgcagaacccactgctcaccctttaaatataggattgcaagccctggagggctgggatttgtgtgtgctttttgtttttcttttttccttgaagattttatccaagccccacttaataccccaaattatttgaacttgtggatcctttcatcagagattaaatatatgtctaagaatatttggtccagagattttttttcttttttctttttttttaagtttgcctgtttacaaagttctgagagacctctgtggttctgaaattctgcacctttgggaaagaatgctggggaagtaggaggaaatcttgagtaaggggctcattttattttattttttctacagactgcaatcaattgagggatgatgtggactaggaattgcattgtgtattcagccaccaagttgcaggaaaagtggaccacttgtccccccacttccttgtccccaggaccaaatgcaactccctgaaaaccaggaaaaagccaagcatcagggtgctggtgactcatggcactggagagacctaaggcagccttcacagttacacctgatctaactccagaaaggcacctctggggccagcttccagcagctgcactgggaccctgcaggggaagtcagcactgcactgtaaccagatcacctgggaaagccacccccagggccggggcctgcagcctgggtaactgaggagctaaacgctcctgagtgttgtgcctccaggtttccctggatttcttttgggcccttccaagctgaggcagggggtgggttgggggtggagcaggagaataggaggccggtagtgaggcacaagccccctcccggcaacagtgagcttgaagatatgcagccaagggcaagtgctgcagccgcccccgctgggatgggtggggctgtgactctccagcgcccagaggagagaagctcctctggccccccaaccaagcagtggtgatgaggccagaaatcagagcctattcagagctcaacacacaggctctctctcctctccccctccaccccctgggattatccatttccttcaaaagcaattcttgcttctactcccaggacctaaggcccgcctgtcaagcagcgaatttcaacaggtctttttaaagtgacagagcccccaggtgtgcttaccaaaagaacatggtctcgtgtgtacctcatgtgctccttcctccagctttttgtcagtaagactaactttcccaaccgttctggatgtaaatccgtgtaccggcaagagtcctgactggctctgatggtaccccggatttgggaccgggtgagcttggctccaggagttttcagaaagccctccagtctaatgcagagacaggagcccagctggcccctccaagcaggcttgggaagggggcccaccctgagtttaagcccgggaaacccaagggcccagctgcctgacggaagtcagccaatgggggaggggcaggacccctggccaagctctctctgtagtgcagcttgaggactaagtgtggggatagggggcacataggcactgtgaggtgaggggaaaacaaaacaaaacaaaacattctggcgatgtgtgtaaggagcagatctgcctggagcccaggctcctgccctggttacttggctgccaatggggcaactctgagggccatgtcacccttcccaggccaggaggagtctgggatgaaccccacgtctctgtgcttcccccaggtcagttgcacccataactcaaagaccgaggttcctcattccaatcctctctccagccctccggggagggggcagcaccatttcccagagcggcgcactgtgacacctccgcgctcatcccaccaatcagtcaataactgcccaaaccagagaccttacaggaacagaagaatatccagcaataaaaactagaaacatgccccatgacttgcgggggggggggggggtcagtgtgcagacacagcctcagggacttttcatcaacgacgaacattcccaattgccttcagtctgtgtccttaacacttaggcagtccgccacgaccccaggctgcccagcttctccagcccgactcagctgcgctggtcctgctcacaccagcgcacagtccaagccagctaggacgccggggccacgtctgcaccaacccagccaagggctcgaggcgcgctgggcctgcacagcccgcggctgcaagagcactcagagtgtccttcaactctttgcaggaaacttcacagccaaggaagctcagcggcctgagccacagggttttgttttgtgtgttcagaggcaacagtttattttggtttgcatcggtgtcctgtgacagcgcagcgagtttctcttcagcgaaagaaaagaaaaaagccctctcccagtgaaacgggacaccacggttcccagtggcccagggccttggagattgaactttgctgcagctctcattctggggcaaagcgcttggccagctggtgacaaaagagcctgtctgcaggtgtgtttggggagctggggagggggcgtgtgaggctcggagggtccctgggcctctctcaggtgaacccgagaagagacaggaagacagcggctggacgcgcgcccaggtccgcgtcgctgcggaccgcggagctgtgcagaagcgcggcctggcgggtggcacaagcccgacagctgcgccgcgcagcccgcccgcgcctggccaagagccccgcgagggtgtggggagaggatcggcttcgcagggagcggaggctgcgcggctgcatcggacctcacagcctcaagtcgcggcatgaggcgaactttgcaaagcgcgctctcgccatgcaccgcccgacctccagcactgtgcgcagcaggacctcggagcccattcgcctgtggaaaccgagcccgcagcgggaaggcagtgggtggagggtgggcaggcaggggtctggggtccgcggctccccaccctcgcgccttcccgcgccagtcccgaacgctctcttggggcgttcctgcccagttgtcccggctgacctcgctctgcagccagcttgaggtcaggcggtcgctctctgcaggtcacaaaccctcggcgcaaaagtagggctttgaacgcgacaccgcaccagagcgcccagctaagcgagctgcctccacccccactgtgtcgggcggcgcaaactgcgggcgcaggcagaggagccgcggctctgcgccgggcgggagccgaagcccagagcctcgccagggcctccccgccgagcgcacttaccgtcgctgaggcagagcgcggtcagcacgaggaccagcacgaccacgaccttggcgttcatggcgcgggcgggcgggcgggcgggcggacgagcgcgggtcgggggccggacgccgagcgggcaatgcggctgacggagagtgaaagtgcggc

SEQ ID NO: 1660 - DNA, 8036 bp, Homo sapiens; identical to SEQ ID NO: 1659

SEQ ID NO: 1661 - DNA, 6019 bp, Homo sapiens
ctgattaatggtctatttattgataccattctattttaacaaagaaaatatttcaaattacaaggtatacaagtcaatactgttttgaagtgaaaaattatttgctttgagagtgtatgcatgtatgtatatatatgataaatgattataacgtgtgtgtcagtgacaatatgtagtctttggttgttagttatatactgtctacctgtgagatgcaaggtaagtgggtcacagactctcaaatttatgaaacacttagatttttcagggaagttacatgaaggaactagggagtttcatgattagataagacgttcgggtgggatctccaccggacagcactctaaatcatcagcagtgtgagcagtgattcaatttgggaaagtgagtataggtttaaattctggccacagacaacctctcctacacaattcactgaacctcccctggaaggaggtttccacatcctgcagaggctaactgggcaccaatcatgcttccactaaccgacttggctgcttcctctagcgcttagtacttcaccgttccctttcttcatgggagatggtgtggtaattgataatcacaatacaaactctgaaacaagtaaacggacaataaaactcatatttgcctaaaatgagtttcgataaggatctcggtggctatcttgttagatcttagaaagctgaggcttattgagaaagcccttttccttcgggaaaaggaatttttgtatggttgggaaaaggttggtcactggctgatctataaagtccttttcattgtaagattatatgattttcggtaaactgtatattttttaaaaacagtccagaatatccgcaagtgttttaccacgtgcttcttattgttggagaagctgagcaaacatcctgtcataaaaagacaaggatgttgcatcatccctggtccctgtagtgagtgtcctgaagataataagtaagaggttaccagaggctagccaacatggagtagccaggaaagagccagcacctgctctgagacaatggtctggttgccatcctgcccataacaacatcaattaaaaaattattaaaacctagttccacagtattattaggcactgtggaagaaacagggaaatatactgtggctcttgccctcaaggagctgacaatctggttggagagataggataaacacccaagaattagttaaccattgagtgttcacccatgtggtactgaaccaagtgaaacaggagttttaagataatttgtgtgtccaaaaaggtttatttaagaggcaggacttgaactaagctggactgagtgaggatgaattgggagaagaaagcacttctgtggggtgttggggacaagatgagaaaggagttgactcagataaatcagagcatatgacaggtgcactggagagaagaaaggcactgcattgtggtaggatggagaagagctgacttgaatgaagcaaaggggaacaaaaagaaataaagtggtcagcctgagcgggcaagatggaatcacatggcttccaaagccagaaaggaggctctgaaagccacacactggtgatctccagtggtgatacccaataacaatcagcatgaatctctcagacacattgtgtgtgaggcctgtaggctgattcaaatacagaggttgatggccacagcagcttggtgaggtccagctcaatttcaaactgcttggctcaccagcatgctaacaggcttaggacttgctgacatgtgcctcagatactctctggaggctgcagtacgtggaagcctagggctgctcttccaggcagctgttgtgagtgggatgtggttgggtgaacatctgtgtagacatgggtattgctaaaatcatggccttaagcatgatgaaattcaactggtgggtggtagaagaacaaagacaatcatagcctttaacaattcttaacgtttggattcttaaaatcaactttctaactttagttacaatttcagagtaatgttttaaattttctagtcaaattaataagcctttgtattatatgccatcctcctttggaatgatagcggtataattaaaatagaacatttttaacacagaatacttattggtgaagtggtctcttatgtagtcttcttttgacgagaacgttgagattttcgaactttcagaactttctttttttgatgttttttcccattcttttgctttttcttttggctgacctgtgagaagaaggggaaaaagggcaatgtttctgaatcttaccatttttacttccttttatttggactctcctgatcattgtctcatacccacatagtctcaaaaccacattaaagtcacttcactctcagaggggctcccttagattctctctactttgctcactttgaggaggaggcaacagccttcaaactggctgtcttttgtctattcttctggcttattacattctcctggcaaccttgcttaccactcacctgccccagctacaaccctctgaaggtggcactattatcatccacgttttacataggaggaggctgagttctggagagggtgactttcccaaatctagacagctagtatgtggcagaacctccagtctgtgagactccagaacccaatctcccacccacatattctgtggctctcttcaaatccaactccttagtatgccatgcaggattcctcccgctttgtcctgatctacttttctgcctcagtcccttcactctcttcacacaaactccagccacattaatggaggctccctgaacacagcaggttctctcatgattctactcttctgctcatgctgtccttaccttcctggcaaattatttatccttcaagacccaaatcaaatatcacctgacatgagaaatcttccttaacactttctcctgccccattcccccagcaaagttaagtactccctcctctatgtcgtcaagattcttgtgcatacttttatatttctcacattgtaccataattattagcatatgcactacaacaggaagggactataccttattatctttgtatcctgtgtctaccattcaattcattacatatttattgtattaaataaggacaagctctgtacccccaaggaacacacattcttccagtgggagacagagaggggatactatatgtaggaacctaattttgtcctaggaacaaaatagaagcaccataatatgaatgaaaaatgtattcttaaaagttatgtattcttatagtgttaatgaaaaagcagattctttgtcttctaaagttaatttctaaaagaaagaaaattttgatcttccttttcaccaacctgtttctcccactttttaatcagttccttcacatctgctgaatctgggtttagacatgtttgaactccattcttcagtgtagcactgccaaagaaatagcaatgagatagttttttctcattaataatttaaatgcttcttctcagaaataatgaaaatcagtatgaattgtgctgaattttctaatgaaactacttaaaattatttcctaggacaagatgagtcactggttgaatttttttttttttctttttttgagacagaatttcgctctgttgccaggctggagtacagtggtgcgatctcagcttgctgcaacttccaactcctggattcaagcgattctcctgcctcagcctcccgaatagctgggactacaggcatgcgccaccacgcccagctaatttttgtatttttagtagagacagggttttaccacattggccaggatggtctcaatctcttgacctcatgatctgcccacctcagcctcccaaagtgctgggattacaggtgtgagccactgcacccggccctggttaaattttaaaaattacttacagtagactgtctggaaataatttaaatgttcctttaatttttctgtatagtctgagaataagagtagtcaaggatgacttataaagacaaaatatgcacacatccttcaacctagcaatcctaatctctagaaaggaaagaattacagacacaatactgccacagtaagttttatttcagcagtaaaaatttggaaataatctatatttccaacaataatcctggtcatataaattatggtttatccatatgatgaaatacagtttggccattaaaaatgacattaagtaaaaatgacattattagagatttactgacacgagaaaatgttcatgatatagtgttaatgaaaaagcagattacaaaacagtgtatagtatatgatttaatttttgtgcttatatacgtgtatgtaaaaacatatctatgttatgtgcacacgaagcaagtaaggaagatttagaaaactgtatactaaggggttaacagtatttgtcactcaagggtagaattatgcgtgatttttattttcttctattgtgttacctgcattaaacattttgtacaataaacatgtgtcattcttggggcctaatctaccagaaattccttgcatttttaaggagaagaaaagaaaggagctgcccaaatttatggagggggtaaccatctgatttttaagtgtttgtatgggcaagcactccaagggtaaaactcatgctaaatttaatgttcttgccaatatggtgcatgcatgttagctgggttgttacttacatgatttcaattttctcgcaggaagggcttggggcaaattgtttaaggtctttcaaggattgtaggtggatagtcccttggttggtgctgatgcaggaacagcgaccctttctcactactggggttcctgagggaaagaaaaagatagaacacatcagtataggccaatgtttcagtttaggtgatctatcaaaatgatacacttgactgagtcatgattattgctatcatttaccgagtgcctaaaaataatcaccacaaacctttgaaggaggtatcatctctattttatacataaggaaactaaggttcagaaagattaagaacaaagtcatacagcttttagggagcaggggcagggttttagcccagatctctctgagtccaaaggcgttgctcttaactaccacaccgtaagtccgtgggagaaaaagagactttcacaatatttaataaatgcctatcacaagacaaacagataactaattcatgtatgctatgctgatcacagtttcttaagcaactcctaaaccatctattatttattatctgaccttaaggaatggaactggtgttggtgttgaatagaaagcactcctttgtaaccaatcaccactttcatcctcatcctctctcctccccactgccttgcttttcaatagtgttttaaatttttgaaaaccccttaaaatacattatcttaattcttaaattcatatatttacttggtacttattgtaccatatgccatacattgtgtagcagtcagaaaaggtataactacaaagttctattttacagatgatgaggaaactgaggtctagaaagattaagtaatttgtccaaggtaacaaagatagttagtaaatagattagggacaaattctctgattattggttggatccttaattggttagccacagatatacttagcaaaaaacagtatcagggagaagaaaataatttaggagatagagttctcattattacccagttcaatgaacatttattgaacacttactaggaattcatacacctagactacaaagacttgtgtttgacttggcagatcgaagttatgaactttggataactggtcatgtcactgagaagcttttatgactgaccaaatattactcttcaatgcaggcagaacattcacctttatctggctaatcaagattcttttacagtgaatcacttctcttactttacaacctaactcagaaccccttaccttgcactccaatcagaaccagcaagatgatgcccaagaggaaaagaacaccacttttcttcatagtgatagaatggagttccaagtcactcctgtattggat

SEQ ID NO: 1662 - DNA, 4149 bp, Homo sapiens
ttcctgtgatcattatttattgagcatttagtaggctccaggcaccaaggacatacagtgaataaaccgacagggccctgtctccaaggagggaaaacagactaggaaaaaactgcaactcatggaaagcatttggggagggactggtgagctcacatagcttgaggcagggctatgcctaggcaaggcctaacccagaagatgatgctcacctcagggtgaagctgagactccctggaggagcatttccttttacttgtggacaaagggatcttccttggccaggggtatgggcatgaacaggagtttctgtgcctcaagagactgttctagcaggagttaaagccccagggaacactgcccttcaacccagagaggtgccttcttaggaggtgctgcccccattctactgcaggaacagccaacaatgctgcacacacccttgactctgtcacaaccaagatacttccacagggacaagcacggaacagaagctttattaggaacatctgcctgcccaatggactggtggctgcacatggctttctagggatgctgatgctgcacgccagcctggaagctgcagaggggaagggctaagggctgcttgtctcgttccacttggggctcagcaggtggccagcacatgtgtctgcgatgttggtcatgggggtaaagggggttcttgtggcatagatctggcttccaaaccctctttctctttgttcatccaccacccccaaggggaacatgtgtttccagctcctcacaaggccagctggcaggttgatgttttggcagtgcctgcctcaatgtctccagcagacactgcaacacacctgagatgggaaaaccacccccctgagctcggatcagagcacacagagccaccagcttggtggctcaacgcttaacactcagagttgaggagatgctcctgtgagggtcaacgagagcatccagccctcatgaggacacagcttcagccctgttctctcatctaatgtcagattcggggctcagatgtggccatgctaattagccagttagtgggttaaagatgtgacgttcaacgggaatgatggtgcttcgtttccatggaggtgcaaaggccggtccttggaggtacctcaacagctcctcagaaggttggtgtggcccctgaagacaccagttcctaacttccccacatcctatagcgtccccccaaaacccagatagtgcctgtccagagccagatcaccttccacacacaacctcagggtgttggttattctttccttctgagaagagatattccttcatcgatggttttcagaggttggaagagacattgacagacgaagaagtgtaggaggtaacacgatgacgtgccaagaactccttgctgaccaggccatgcatagccaggatcttgaggaatccatggcgaaaattttggccgatgaaggcgtagatgatggggttgaggcagctatggagaaatcccagaatctcagtggcatccagggcccggccgatgttgttgcggcgctcacagctctcctggatcacctgggtcctcatgagggtgtctgccagcaggaccaggttgtagggcagccagcaaagcaggaagatgaggacgacagcaaagatgaccctcatggctcggtgcttctgccccatgtgggccttaaacagtgtacgcagggtgaatccatagcagaacagcatgacaaacagcggcacgatgaagccaaaggtgtgaggcaggatccgcaacaccatccgccattttgctgtgtcatttcccaggacctcatagcaaactggactggaattgtttggatggtaagcctggcggaaaaggaagaagggcagggacagattcatagacagtccccagcagccaagacaaacaaacttgaccaagtgacgcttctgggtcagtgtgcgtgtggcatggacaatggccaggtaacggtccacactgatgcaggccaacagcaggatgccactgtagaagttgacttccttcaggagtgagaccaccttgcacaggaatgtgccaaaaatccagccattcaccttggaggcggcccagatgggcaaggtcagggcaaagagtaggtcggccaaggccaggttcagcaggtagacatcagtgacggagcggccgaccctgctgtataagatgaccagcatcaccagggagtttcccagcaggctcagcaggaacactagggcataggcgatgatcacaacatacttgttgagtgtctcagtttctagcatacaggggctgtaatcttcatctgcaggtggcatgccagtgaaatttagatcatcaaaatcccacatctgtggatctgtaatatttgacatgtcctcttcagtttcagcaatggtttgatctaactggaaggttagaaggaaggaaatgtgatttagtagctcggattcaaggcattctcatcaatgatgtgagagcagttactgggatatccttggcttccctgttggtttggcaatgagagctctccttcctcctttgactccaacctggtcttcttcggaggttggcttcccagtgttctccaccttccacaactctaaggcctggcctgagtgtggggtaagatggaatatggggaaaacaccttagccctagctcaacctacaactgcctcctctcagcctatgtctctacctctgtccctctttagccttctccatcctcagctgtgtctgtgcatttggatgtggggaccaggttggtcttagacattcagggaagggccagcattaagcaaaatgcaagaaggcaaacctgttcccaggtgtccccttctactatttctattcctatgttctccctgattcttgtttaccctccttaaaatctactgggggaaggaagtgataacaacacattgcattaaactgtatattttaagccttctttaaatgaggagcacatattttgttcctctgtctaaaggagttttaagtatttgagaagataaagtctccatcttggtccctgaaaccctccacccctgaaaaaatccacagaatcattcaagagttttcaaatatatttcctattgtgaaatagtttactgaaataagatcttcccagaagcccagtatgtgaagcagataaaagctgagccactgtggggcagagtgtgctaatctccgaacccagatggcccctaaagagcccctcaaagctccaggactctccagagaagtctgaaagcctttggaaagtcaccgaggttggttgtaaagacacctagcatccagtcttcattccatcctgattctaccattaataagtttcgtgtgtaatcccagccctttgggaggccaaggcaggcagatcatgaagtcaggagttcgagaccagcctgaccaaaatgatgaaaccccgtctctactaaaaatacaaaaaaattagctgggtgtggtggcgtgcacctgtaatcccaactactcaggaggctgaggcaggagaatcacttgaacccgggaaatggaggttgcagtgagccgagatcgtgccacagtactacagcctaggcgacagagtgagactccatctcaaaataaataaataaataaataaataagtctcatgaccttgagtggggtctcgtacccctatagatttcagtcttctcatctgcaaatcgaggaagacagaatcatccacctctcatttgctgccaggcctgagggtgtatgatgagtccactcagatccacacattttagtgtgttccctccctaccagtatttgcattttcactgaagacaaagtcttaaggtgaagcaataaacatcaaattggggaatggtcagcctcttcccacaaaagggcaaggtataaaaagaggggatgaggaggctgtcctcttcacctgctaactccatgtatgagtggtggtcacaagagaggaagcgggcagcagaaatcctcagctcccacagaaatgaatacattttccaaaataaagtcaagccaagcagccctaccccacagaaagtcctagcaaacagaggtggcttcctacctgaagcaccggccaggtgtgtccaacagtaggagctgcagtcagagatcagagtgacttaacagctagagggcacttgatgaata

SEQ ID NO: 1663 - DNA, 1895 bp, Homo sapiens
taagtttaacatgtacttttattaacaacttaatacaagactgtacactgtaggtgctgaaatcaacccactcctgaaaactgaaaaaccagcatttctataccactttgggctttggttataagtgccatcttctacagcaaaatcacgtcttaagaacaggaaaaacgttccacgggaatggagagattatctatgcataaacagctggggatcatttctagctttacgtgattcactacacgctctggaatgttcagttcccttttctacagtcctaccacgagacatacagcaactaagaacttggccacaggtcctgcctagacacacatcaatatgaaacaaaaaaaatttatataaataagtcaattaaacttcacaaaaactaaagaaacacaagacaaaaatccaacaagcaataaaaactgtacaatattggtcagtcttttatatctgaaaaatgtgtaacttaaaaaaaagttatttatcgtataaaaaaaagtcttttacatctgtgttagctggagtgaaaacttgaagactcagactcagtggaaacagatgaatgtccacctcgctttcctttggagaggatcttgaggctggaccctctgctcacagaggtgagtgcgtgctgggcagaggttttaaatttggctccaaggaaagcatagaggatggggttcagacaacagtggaagaaagctagggcctcggtgatggaaatccacttgtgcacagtgttctcaaactcacacccttgcttgatgatttccaggaggatgaaggagtcgatgctgatcccaatgtagtaaggcagccaacaggcgaagaaagccaggatgaggatgactgtggtcttgagggccttgcgcttctggtggcccttggagtgtgacagcttggagatgataatgcaatagcaggacaggatgacaataccaggcaggataaggccaaccatgatgtgctgaaactggaacacaaccacccacaagtcattggggtagaagcggtcacagatatatctgtcatctgcctcactgacgttggcaaagatgaagtcgggaatagtcagcaggagggcagggatccagacgccaacatagaccaccttttcagccaacagcttccttggcctctgactgttggtggcgtggacgatggccaggtagcggtccagactgatgaaggccaggatgaggacactgctgtagaggttgactgtgtagatgacatggactgccttgcataggaagttcccaaagtaccagtttgccacggcatcaactgcccagaagggaagcgtgatgacaaagaggaggtcggccactgacaggtgcagcctgtacttgtccgtcatgcttctcagtttcttctggtaacccatgaccaggatgaccaatccattgcccacaatgccagttaagaagatgatggagtagatggtgggcaggaagattttattgaaattagcattttcttcacggaaacagggttccttcatggagtcatagtcccctgagcccatttcctcggtgtagttatctgaagtgtatatctgcaaaagaggcaaaggaatggacattcacttccaattcagcaagcattaacccagttaaaaaaaatttttaaagcaatttaaaaaaccaattcaggcttgctttcttcaggaaattctgaagtagtgggctaagggcacaagagaattaatgtagaatcctacaactctcctccccatcttttcccatagtgacttcattatatccttctttggtagaaccaattacaaaattctttgtttagaacaaaagggcactgagacgctgagggtttcaaagtcacatcttggctaactcctctgccccgcccactagagggaagaaaaaaaa

SEQ ID NO: 1664 - DNA, 3807 bp, Homo sapiens
taagtttaacatgtacttttattaacaacttaatacaagactgtacactgtaggtgctgaaatcaacccactcctgaaaactgaaaaaccagcatttctataccactttgggctttggttataagtgccatcttctacagcaaaatcacgtcttaagaacaggaaaaacgttccacgggaatggagagattatctatgcataaacagctggggatcatttctagctttacgtgattcactacacgctctggaatgttcagttcccttttctacagtcctaccacgagacatacagcaactaagaacttggccacaggtcctgcctagacacacatcaatatgaaacaaaaaaaatttatataaataagtcaattaaacttcacaaaaactaaagaaacacaagacaaaaatccaacaagcaataaaaactgtacaatattggtcagtcttttatatctgaaaaatgtgtaacttaaaaaaaagttatttatcgtataaaaaaaagtcttttacatctgtgttagctggagtgaaaacttgaagactcagactcagtggaaacagatgaatgtccacctcgctttcctttggagaggatcttgaggctggaccctctgctcacagaggtgagtgcgtgctgggcagaggttttaaatttggctccaaggaaagcatagaggatggggttcagacaacagtggaagaaagctagggcctcggtgatggaaatccacttgtgcacagtgttctcaaactcacacccttgcttgatgatttccaggaggatgaaggagtcgatgctgatcccaatgtagtaaggcagccaacaggcgaagaaagccaggatgaggatgactgtggtcttgagggccttgcgcttctggtggcccttggagtgtgacagcttggagatgataatgcaatagcaggacaggatgacaataccaggcaggataaggccaaccatgatgtgctgaaactggaacacaaccacccacaagtcattggggtagaagcggtcacagatatatctgtcatctgcctcactgacgttggcaaagatgaagtcgggaatagtcagcaggagggcagggatccagacgccaacatagaccaccttttcagccaacagcttccttggcctctgactgttggtggcgtggacgatggccaggtagcggtccagactgatgaaggccaggatgaggacactgctgtagaggttgactgtgtagatgacatggactgccttgcataggaagttcccaaagtaccagtttgccacggcatcaactgcccagaagggaagcgtgatgacaaagaggaggtcggccactgacaggtgcagcctgtacttgtccgtcatgcttctcagtttcttctggtaacccatgaccaggatgaccaatccattgcccacaatgccagttaagaagatgatggagtagatggtgggcaggaagattttattgaaattagcattttcttcacggaaacagggttccttcatggagtcatagtcccctgagcccatttcctcggtgtagttatctgaagtgtatatctgcaaaagaggcaaaggaatggacattcacttccaattcagcaagcattaacccagttaaaaaaaatttttaaagcaatttaaaaaaccaattcaggcttgctttcttcaggaaattctgaagtagtgggctaagggcacaagagaattaatgtagaatcctacaactctcctccccatcttttcccatagtgacttcattatatccttctttggtagaaccaattacaaaattctttgtttagaacaaaagggcactgagacgctgagggtttcaaagtcacatcttggctaactcctctgccccgcccactagagggaagaaaaaaaaccttccttaggaggaaaaaaaaaatacacacaaagaggccactcccaggcggcgtggggggtggggtgggtgctgctaggaggggcagtgattaactttttgtaagaagtttttcgcccagggagggaagaggggagaagggaggatcacggggggagggcgggggcgttgcaaagactcattctcctaaagcgcaaaaacttaattttcccacgcctgcctaaatacaaaccattctgggcttcaagcaacttgtagtgggtaaagagaatgcggtcttaaaacgaaggcccttcggtgcttggggtatattgggcgggagtgtcagaaaatgaacaaacggcacctcctcccccaagcgggcgctcctccggtgtgtgggtctcttgccatcctcgtgtttatcacttggcgcgtttgggacgttagggagcggggcattttcctgggtggagaaggtaacggggtctgcacccgtggtcctcgccccaagtttcatttcctcactctcccgggtggcttcccattaccccgccactgatccagttaacccggccggaggtgggcagctggaagcctccaggcggtgggcacgcggggggccgggtcgtccagccccgggccgccgcggctgcccactacacccacgccaaccgcccgcaagcagcgctgcaggggctccgctgggcgacacgccaggctctgtcccacagggtgctggggagcgactgggcggctccgccgcgagcgtctttgaattgcgcgccgctgcaggaaaccaaaaactccctagcaagagggtttcaaaaggtttctggaaaccaccgacggttaaacatcacaactggactcggagagagccaaacggtttccccacttgcacctgccagtcttcgcggcggcgacctggcagcccaggtgcggtcttaaccgcccccgcccctcaccccgtacccgctcctatccccggagcgcaaatctcagggctggcagctgcgcggtgtcaaaggggaggtcaaaccactccgctgacctctgcacgaccccaaactctcgaactgcaggacccactcgcggccgtggggaagaggcgcgcttcggacggcgggaaggttttccccctcaaacccaaagcgcgcgggcggatcaactcctagctgctgccaccactcgatcccctcagaggatcggcgcggtgggtccacccgcctctcccgccctctgcctactgtgctgggagactggcacagctccgtcggccgcacagagtttaacaaacacgcacccagtgtcaagaacagtcaccaggcgcttaaccccgaagttaaagcgggcgcaatctcctcctgggaactcagcccaggcacgccgccctccgcctctaaattcagacaatgtaactcgctccaagacatccccgcttccccaaggaagagaccggtggtctgagtcccgaggcagcgcgcacgccttctctgcacttgtgcacagaatgttcttacgtttgcaaacagcgtgcaagccgccgcgcgcggcgggactcaagggggagacacatgcagccactggaacgctctttccagtcgtttctcctcgactcacagagaaaaagattccaatcctgctccccccccacccacccgcactatataggcatggtcaagaaaactcctttcggtgacccttttttggagtacgggtacctccaatgtcctggccgcttctgcccgctcggagaggggctgcgctctaagttcaaacgtttgtacatttatgacaaagcaggttgaaactggacttacactgatcccctccatggtaaccgctggttctccagatgcggtggctactggagcactcaggccctcggcgtcactttgctacctgctgccgcagccaacaaactgaagtt

SEQ ID NO: 1665 - DNA, 6794 bp, Homo sapiens
gttcttcgtgaaagggatgacgggagctgtatgaaagcggaagagttatagaccgctaacacctgtcactggccactggtttcccggagttagcggcaacgaccttgcagcctggacactagccaggcgctccctcttctcacagcggcccacgtctccttgcttgggagcccatcgtcctggctccggtggcctcgctgggtctcggggaagcagaggactgttcattcctgtggcgaaaagccggagtcggccctagacacccacgactcgcagggtccatggttccggaggccgtgagacctgccggggctgacaggtgccagggcccatgctgcgggagcctgtgtgctcagccttcttgcggacggtacctgagggctggggtttccctggatgtggggctgggaactcgtgcggggcgcgaccgaggcgccttttcctgtcccctgctgtcggcagggtctcggctccgctccttctaagcgcgtgtacccgcgacgtgcgtctgcgagtagaaagcccgtgtactgctccacacacagcggccccacctcagtccggtcttccctgcctcccgttggcccttctgctgtgagctcgcctggacctgaggccgggcggtgcacagctctgtggcctgtggcgccgtgctcagcgtgacctacccagaattaagctgaggacaatgggatttagagtcccaaacactcgccccgtgacaatgggaggggaagtgtcatttttctcccttcgaatggagcatgcttggctgcaagaatgctgctcaacatggtgaaatgattttctgccctgcgggctggtgcaccctgtggtccttgacccagacaggtgcggagggtcccactgctgtgattagcagaaccaaactgtgatgtgcacatgtgtgttactgataagaccaggcctcccagctcttcttggtttccaatgcctgctaagtacatgaccttcttagggccattaaccagctttgctgtcttgcacttaatgacctttcctctttatcttccttgttgtgcaggtaaagaagctaagtggaagagtgtttcctcctctggccgtaaagcaggtactctctgcagcaccaggtaggaggggactcaacccccttcttgccttttcagttacatcagttcctactagggattccacatacacacagttggcgtctgttgtgattttgtggtgatgacgagaaaagggttggctaagaaactgggcggcagaaaagaggcaaacattcactgtagccatttatcccgatggaagtggccaggccctgtgggggacattcagcctccatcagaagtaatccagaaccaaggaacctggttatctttggtcactcatcagaagaataatcatgctcaggggccacaagtgtgtgaggaaatggcaccatggatgggttggtggagggtacacgggtgagtctttgtggaaagtcatttgctggcagatatcagcatcttagatgggcgtgccaggcggccgaggcatttccttcagcatgtcttcacacagcgagtgttagaggtaatgtcatttctagtggcaaaagtgggaagcaacttgtaactctccatcagtggaggaatggtcaggcaaattatgagacgaccaacaatgggatatcacccaggcagtgaaaaacaaggtagatgaagattgtcaggtggaaagaatgggcttgatgtgctgtcaaatggcaaactcgtgccctagcctgtgcagatgtgttgggaacagcagtttgccaagatggctgaaacaaaggaccataaaagggctggcttaaagaacagacaatcattgtctcgcagttctggaggatggaagtctgaaatcaaagtggtggccaggttcgtttgttctgtgggctgtgaaagacaatctggtctgtccctttctcttagctgcaggcggctggccggcaatctttggcactcattagcttgtagaagcatctcccttatctctgcgtttatcttctcatggtgttctccctgtgtgcgtgactgtctctcaaatcccccttttcataaggacgccagccacattggatgcgggtccgccctgatggcttcagtctcacttgattgcctctgtaatgactctgtttttatatataaggccacattttgaggtgctggggtttaggacttcaacatacgcattttaagaggacacaatgcaacccatcacaactgacaaaggctctgaggtagaaacaagcttggcatgttccctcaggggatggaaggcctgtgtggcttcagggtggtgaataaaggggagaggagaggacgtggctggggtgggaaaccagatcaggagggaccttgagtgccctgagaggaagtgtggattctgtgctagttggggcagggagcccttgaaaagtttcagtagaggagtgacataatctcattgtccctgtaccaagatcattccgatggcagtgtggtcacaagagtgcagaggacaagtgctgggggggggtgggggtgctatcaggagacttcttcagaaggcagggggttttaggggattggattgggattgtggccatagagattatggaaagggatcagattcaatgtcggttttggacacagtgccacgggatgtgggccgcagatgtgggaaagaaaggcagggcagagagcagctaggtctggggcaggaacgctgtagctggtgatgccactcacagaggtggaagggaggtggacttggtggtgatggttggggtcctgagtatgtacgggcctgtccacctaaggctgagtctgaaggggggtggcctgcaccacgggattcagagcaggacggtgagcaacgtgggggtcccagaaggagggaaggagtgttcccagccatgctggggctgctgagcatggactaagatgaagacaggactggcatgaggccggccatgggtgcttgtggggataggtcagtcagtggagtgggtggtggggggggtggggaataaagggagaaaggtgggggtgggggcagaaggttcagagaggaagtagagactgcgcatgtagacagctcttctgaggtctcggctgttcagggttgtagagaagggaggcagagtgggaggcgcgcgtgtgctcagagtagggatgctgagcgagcatagatggtggctggtggcacccagggcccggagtgagccagaggagcagggtccagagcacagcaggcaaccggctcagctgaggcagctcaccccagaggcgggagaaaagcaggagatctggagctcagaaggctgcagtgcagactgggaaaggagtgaataccaggcagctttggccctatcagggctttgtctcatgagggtgggtatattttcttaaaatcatagagcgtactagaggttgcgtttatgtgttgaaaggaaggacagagagaggagtaggggcagctcaagggtggagttcagggccgggggcggggccacgggcctgaggggtgagggcagccactatttctgactgttctattaggtgccacgtactgggctgggtgctcttggtgccttatctcccttcctcacagccatgtggaaactgaggcatctcaagagtctatgactgggctgaggttctggtttcgagcccagggttccttccaaggcacagggccgtcctccatgcaagaggaggggaccctctcccaagccagacacgcaggaggctgggcaagagttgtgggaagtcagagcccgtgtgactgtgggctggtgcctcattctcctcagccatagagtgggcctcacagtaccactgaccctgctgggttacttgaagattcaatttgatgatccgaggatcatgccatcccagaggctggcacgtggaaggcatgtgtgtggggttgctagttgttctgattatcattcttcttttctcagctcagattgggacaggggcatctgctgacagtggagagcagtggtgggggaaggggcttgaggaaggtggcacccagaggggtggagaggagatgtctgactgagggccatctgaggtcacggtgcatcctgaggacagagctgagattggatatcaacgatgtgggctcagcagccctggagtaggagctgggaaggtcagtgccttggtggcggcagggccagggcactgagagtattggcagggcacagcaggggaaagggaagagaagcagagggtgggactctccctctgtgctggaagagggctaacaccagcccggactctccactctggctaggccaagggggccctctgtcctctgtgttgccctagggctcggtgacctctgtcatagcactgaccacatggtatcctgcctgtgccttcctctagctgtccccgccctactccggaccgccccaaagactccatgggatggacctgagtcagccgaatcccagccccttcccttgggcctgctgtggtgctggacatcagtgacagacggaagcaggagaccatcaaggtcagtgcgatttaggccacctgagagacacggggggaaggtcaggccactgcccatgagcttggagggctggcgtgtgatgcgcttctgtgcttccgcaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggtaagtgacaatgtaccaaatgcgcagacaacgcctagggctgctgcccaagatcttgcttgggaatttgggggcttctcttgtcatctgaactgattggcgtgtataacacagtttcctttggcaacacaccttcaaaggggcggcaaggaccttgggctgggggttggtatggctggcttccacgagttctggtaaatcatttctccactctgggcctcagttcctgtttctgatctcagtgagaagcctggtcagggccatgtgcacatggtgtttgtggtgtttggctgtgtgtatttgcacatacatgtgtgagtgcacatgtgtggcagagaccatgaaaagcagcccagcccgccgaatgggtcaggtggcctctagagttgggctgcccgcctggcttcatgaacctgccccagccccaccactcacagcaccctgggaaagtcccctaacctctaggtgactgaggcccgacatcagcatctgtcccctggtgacctgctcaggcatcacctgtagcttcccaggcagtggctggtgcccttccaatctgcaaccgctgccctcagaagtctggcttggacctgcctcttacttgtgtggcttcatgaggacaaggccctctcctctgcctttctggagccctccccctgcctctcccagcgtttcctgaatcgggtttggttcgttatcaaagctacggaagaaggacttgactcccttcttgtcattttgctgatgctgtcttactctctattgattgtgactttgagtaactgtgttgtcacatgggcaggccttgggctatggaagtgaaaggcattcatgtgtatctctctttgtgtacaggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatgacaccttcaatttgccatcatgacgcagacctgtatacattaggttaaatctgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatgactggttagtgtttgaggctttgttctatgttttcccctgatttgttctggtcaaaactcatcaaatgtgtaactagcatccaggcgacaatacagaaagtctgggacctggcactgaatgtttgcctggtagtgactagccgttaatcaaccgactcatccaggatgaagaggacgtcagacttagagcagctgtctgtcctttcaggttactctcactcttctgaaagtgtctgtcagtttctgaagcatgtgtgttacctgcatcacacagctacttcctatcctagcaatacatccaaaatacagctctagtagagtgaggttaacttggaaatgtgatcagtagtgttgttttattttgtagtaatttttttttttttttggtgatttagcaaagtttctagttgttatccatgaggatgatgggcatttccccccaggtattgactgcagtgg

SEQ ID NO: 1666 - DNA, 6794 bp, Homo sapiens; identical to SEQ ID NO: 1665

SEQ ID NO: 1667 - DNA, 6794 bp, Homo sapiens; identical to SEQ ID NO: 1665

SEQ ID NO: 1668 - DNA, 6022 bp, Homo sapiens
attaggtgccacgtactgggctgggtgctcttggtgccttatctcccttcctcacagccatgtggaaactgaggcatctcaagagtctatgactgggctgaggttctggtttcgagcccagggttccttccaaggcacagggccgtcctccatgcaagaggaggggaccctctcccaagccagacacgcaggaggctgggcaagagttgtgggaagtcagagcccgtgtgactgtgggctggtgcctcattctcctcagccatagagtgggcctcacagtaccactgaccctgctgggttacttgaagattcaatttgatgatccgaggatcatgccatcccagaggctggcacgtggaaggcatgtgtgtggggttgctagttgttctgattatcattcttcttttctcagctcagattgggacaggggcatctgctgacagtggagagcagtggtgggggaaggggcttgaggaaggtggcacccagaggggtggagaggagatgtctgactgagggccatctgaggtcacggtgcatcctgaggacagagctgagattggatatcaacgatgtgggctcagcagccctggagtaggagctgggaaggtcagtgccttggtggcggcagggccagggcactgagagtattggcagggcacagcaggggaaagggaagagaagcagagggtgggactctccctctgtgctggaagagggctaacaccagcccggactctccactctggctaggccaagggggccctctgtcctctgtgttgccctagggctcggtgacctctgtcatagcactgaccacatggtatcctgcctgtgccttcctctagctgtccccgccctactccggaccgccccaaagactccatgggatggacctgagtcagccgaatcccagccccttcccttgggcctgctgtggtgctggacatcagtgacagacggaagcaggagaccatcaaggtcagtgcgatttaggccacctgagagacacggggggaaggtcaggccactgcccatgagcttggagggctggcgtgtgatgcgcttctgtgcttccgcaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggtaagtgacaatgtaccaaatgcgcagacaacgcctagggctgctgcccaagatcttgcttgggaatttgggggcttctcttgtcatctgaactgattggcgtgtataacacagtttcctttggcaacacaccttcaaaggggcggcaaggaccttgggctgggggttggtatggctggcttccacgagttctggtaaatcatttctccactctgggcctcagttcctgtttctgatctcagtgagaagcctggtcagggccatgtgcacatggtgtttgtggtgtttggctgtgtgtatttgcacatacatgtgtgagtgcacatgtgtggcagagaccatgaaaagcagcccagcccgccgaatgggtcaggtggcctctagagttgggctgcccgcctggcttcatgaacctgccccagccccaccactcacagcaccctgggaaagtcccctaacctctaggtgactgaggcccgacatcagcatctgtcccctggtgacctgctcaggcatcacctgtagcttcccaggcagtggctggtgcccttccaatctgcaaccgctgccctcagaagtctggcttggacctgcctcttacttgtgtggcttcatgaggacaaggccctctcctctgcctttctggagccctccccctgcctctcccagcgtttcctgaatcgggtttggttcgttatcaaagctacggaagaaggacttgactcccttcttgtcattttgctgatgctgtcttactctctattgattgtgactttgagtaactgtgttgtcacatgggcaggccttgggctatggaagtgaaaggcattcatgtgtatctctctttgtgtacaggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatgacaccttcaatttgccatcatgacgcagacctgtatacattaggttaaatctgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatgactggttagtgtttgaggctttgttctatgttttcccctgatttgttctggtcaaaactcatcaaatgtgtaactagcatccaggcgacaatacagaaagtctgggacctggcactgaatgtttgcctggtagtgactagccgttaatcaaccgactcatccaggatgaagaggacgtcagacttagagcagctgtctgtcctttcaggttactctcactcttctgaaagtgtctgtcagtttctgaagcatgtgtgttacctgcatcacacagctacttcctatcctagcaatacatccaaaatacagctctagtagagtgaggttaacttggaaatgtgatcagtagtgttgttttattttgtagtaatttttttttttttttggtgatttagcaaagtttctagttgttatccatgaggatgatgggcatttccccccaggtattgactgcagtggcccttctcttctgagccaggatgttatggtggttgtacatcccatggcagatggggtggcctgactttcaagtgggcctctttggaggcccctggatgctaggctagggatgctgagctgctgaccagacacttcctggcaacattgggagggacccatgaggaaacaatctcctgtttgaagatacaggaagatattgccggaatcaggcgtctattctttctcctgaccagcaggccaatctcaggggaccaggtcttcctgggcttggcctcgacacttcctagcaacatcctttgctgagtgtgtgaaaatgctgcttctccaaataaacaaggacaatggggaccaaagcctgtcttggacaggatttccagcctcccctggtttctgccaatgagatgtatataatatacaaggttaaaaaaaacacagacaacagttctcatttaaattgtttattatttatttccatggaattttgtttttctttattaagaccaaaaatgtgtttctcattaaaaaatggcaacttttatgggccattagtggcctgtgacttcacgaatttgcagtgtttctgaactgttcacagagtctacacttgtaatctgaggagccttcctactcctcctcatcgtcagagggctcatttggagacatgactgagagggaggccaacagagcatagtaacagatattgtacaaagacattacactaccattatctgagtaaaccagactactaagaatccctgtgccttccatccaggtagtagccgaagatgtaaatgtgacattcccagaggtgccctcccaacttgggccatttggttcctgagggggcccatttcccaggggatgcctagtggcactcttcttggaccacatgccagagcgcctgaaggactgggtgccactgggcccctgaacactgggggctccctgctgacacattttgattgcttctttcctggcattgatgtgatagatacgtagggagcgtcttgtagctaccagattctttctctttggagttgggacacgggtcgcttgctgagcggtgtttctgagggcatcctttctctggatattctccaggagcctgggcttgtctctctgaaaattggagttgcagtagatctgaaacaaaatgaaacatgttagttgttctgggataaattattcctttcccacctctcaaaattatgattttgttttgcaatggagaaaagaatgctttaagtggcagcaagtgtggttatgctctacagcatgacctgactaaagataaacaattcatagatcaaggcagtaatatataaacagcatggattttgatattaaactgcaaccccgtagaggtaatatgcaggtctgcaaaatatgatgcttacattatctctaagggggttgtagtttaatatcaaaatccatactttttaagttctatacttttcatctttcaataaacaatatttcacattttcaaatgctatccttgacacttaagctcttacagtatattattcaaattggtgtcctatgaagatatgtttgagaaagagagaaaagggattacagaaatgctttctactttaccatcattttcttgtttcctggagagttgcttgggcgtgttttgcagaatccatagaggttcagctggcgaatgaaactcgtcaagctgtctgttttgaagatcctctctgcacctttccgttgaagaacctccctctggaagagatccttgtcgatgatcacggcgtctccatcatcgttccagctcacagacttgaatgtgtcttcctccacaatcgtccaaagctttcttgggaaggagagcctaaaaaggttgtggttgtcttccacgttgaccacgcgttggtttcggtcttctggtggtgagttatcttgggagcctggatcttggctcatggcttggtcctcgtgcctgtccaaaacctcgctggaatctggatttggatcaggtgaagaaccagatgggcccccgcttgttggctctccaccaacagatggggccagcttggcttcatattcctgttcagtgttctgactcgccatggagctacaccagaatcaggagcattttgtacccaaggcccttatcactgtcctagcaagtccaaaatgccttcagtcagagtaggcgtgcccaataaatactgtccacaaaattctagagtctcggtatcagggcaaccagtggcttaactcatcatctgctgtatttgtcacatgatgtcacaaaggtggctctcagccaatctggagagggggccctggccaggtgttgggggagtagacaggtggcatggccttcagcttctccctcttctaaaagtataaacaggcatggttcaagttcccagaaaagtctcccatcttctgacagtcacattgtgtcaaagggccaggccccagatgagctgagaaaccatggctctatggccactcccaaccctgaagacaggggaggccatttgctggcctctaatttgctcaagagccagcccctagttatccctagcttgggtttcaccaagactgcctgactcagatggacccctcatgggtgactgccttctaggagatggtggtccctaccaggctgtttggcctgatctgtgtggtagcacccctcttttccaatccccccatctcctttctgctttggtctcttccaggtactcctaatgattggttgcatgtgctccagtgggcccagataaagtgtttcttattccccttgg

SEQ ID NO: 1669 - DNA, 33445 bp, Homo sapiens
attggaagaagaagcatagtatagaagaaaggcaaacacaacacattcaacctctgccaccatggggaactgggctgtgaatgaggggctctccatttttgtcattgtaagtaccaacaagagataagttataaattctctgacttctcggggttatcttggaactaaaatagaccaaagcttttttgttcatttgaggaattgtgttgaaactgatttaccatgtgaacctatatctatctgtaaacagactgagtccattcttccaaattccttaatggaaagaacatatctgggggctcacttctagcttacttctgaattcctaggaggaataaattagccagcatttcgcagaaggagtagaaaatatttcatgctaatgatctctgattctgagttgtttagtaatgtttactcagacgcacatgtctatgtgtttatactactttaaaaatgacaaattgaaattttataccattttctaaataaaaaatataagattgactcatgtatgggaagtaggcctttatttcagtaattacactaaatataataaaacttctcaaatttattttcaaaaacaagtaccttcttttttcagagatctaaacttgagttatttataagatttataaaaattcaaaagaacagaattgaaataagtcatctagattcataaatatgtagtatgtatatttatatataattgtatatatatataaatcaatatagtctggagaaactatgtaagtaaagatatagctaatttacaagtggacagaatgatttctgtactttttaaaacaaagaaaatcaactgttctcttaaaatggtgttatcagcaaagcaataatggacaaattgggtagatagaaatacgatttttaaatagcctttctaaataaccaatagaagcattacacagatgttaaaaagtacaattatgaatggaatatgaatggagcttttgtaaaaatttatcatgaaaaataatgagtctttgagttttaaatatagaaagcaattagtggcacaaataaaaacaacaaatattttgttataaaaaatgtttacgccaaaccaacattctactgcaacagagaattcttccgagtattcgaagctgtaaacttaacttcttatcaccatttttaagggcaaataatttctatagaaagtaagttcaaattaaacttttagctctcgccacaatttttcccaggaaatgacctccttctaaattatatactcatgcacttgaaagtgaaaacacagcttggaaagtcagagtaaagaaagaatgacaagatcaggaaattgggaagttgctttagcacttttttctttgtaaagagagaatattatcaagtgtctagagcatataatagcttcaaagcatagttgagaaaagatcactatggagctgaaggtagagaactgggtagtgtgaccacttgatccagtcagtgcttaggataaaatgaactgtcatgatctagaaagctgtttttgttgtaaatcccaagcccctcactatgctcaatattctctccttgaagcattaagtaaaactaatcaaggaaaatggaaggcttggcattttagctgatgagaattcactagctggattactgtgtggtagagggaggtgattagcacctgtgagaacagaacgcagtgtcatactggtggagggaaagcaatagtaatatgttcccttcctttctcattttaagtggagtggcctgctatcagctacctatccaaggttaagcaaaagagaggggaaaaaaagggagtggggtaatgtaagactgataatttggtatactggccaaatcataaaacaatcatggggaacaacacagggtggagaggttttaattatagacaagtgtagtgacactgttgaggaaagagctggctctaagctggttatatccagctttgtcactacctttgtcaaagttggacttggggaagtcctgacccttatctgactccagtcttgtgtggaatctactgtggaaatgcggaaacttcatgcaattatttctgtttgtgcagctggtttggctggggttgaacgtcttcctctttgtctggtattaccgggtttatgatattccacctaagttcttttacacaagaaaacttcttggggtaagtataaattccatcccatgcaatattggctggttcacatttctcatcagacattcttgttcatcttcctgttagcattttaaatacatattctgaccaacccaaacagtaccattagcctcactccctccattgcaacttcctgggcaacagtcacttaaagccttccagtctgggaccaacaaaagtggggcagagggccccagtggcatccttccccaaccaagaaccatgtgccattgtttagcttaaaggagaaatctaatactcactctgaaatggaagggcaggttggagcaatccatccaggagtgacacatgtgggacaagtgggactttccatattttctaagtcacctaattcctagtacttttttgcatgaagagctctgctcctaatcacatgttatgaaatgatcttcagaaaataaatctctctctacatataaagactcgaggaacttgctcaagggccacatctgttgactaggacagtagagtgaaggcccttcagtttccttgggtcctttagtattctgagtttccttgaactgtcaggcctcttgcctccagaagacatctgttacatcatgctgaaactatgaattaattgcttaatattaattattataagtattataaatcataaataaataattttagcatataattatgctagatcattataattgttgttagcttattcacattgatgctttctcccgccaaaatatgcaacttctttagacattacaaatataataattataatgccaaagcattataccataccaatttaagatactgttaagatcaatttaagtgctaagaaaatatttaaaatctttaaaagtcttgatacttaactctagttaatgatatgcaccttaagtgttaaagagaaagtgaactgttgtctgtaacttactttgaaatgcatcaaaaattagatgagttgatggatggatacaggaatggatagatagaatgtgataaagcaagcataaaaggtataatctgggagatgaataaacaggtatttattgtaaatttccttcaacttgtctttatgtttgaacattttaataataaaatgttgaattagggcaaaaggtcaatttcagatgaaaacaaagggtcctagctagccctaaaggaaaaccgttggctctgaaggaccttcctgtacagatcacttggtgtctctggtgtgtggcctcatgctaagaaccttggggaagtggggacagggcatattctgtgctcaaaaaagtcactctgctccctttcccgcctcttctagtcagcactggcactggccagggcccctgcagcctgcctgaatttcaactgcatgctgattctcttgccagtctgtcgaaatctgctgtccttcctcaggggttccagtgcggtaagagaaaatgttttactaagttcctctaattttcaaaggccatcaagcaaaatgcccttttttaggtaaaaacaaatgaatgatttgggaggattccagcttctgtagaatactcatgagccaagccattatctagtatatttctgtgctatttggggatggagctccctaagacaactatttggaaaacaaattttgaaaaaacacacaaaaccacctatacctcaacagtagcaatgaagtagcacacacgtacacgtttacacacacacacatatatatatgatagatatgcatatatacagagctttaggaagttgacatgtgatatctgggagttaatctttcagtgtcattcaaaaaaatttaagtcagaggaaatatcttctgtggataatatctcaaggagatggagtcaatggacagagtcacactataatgaatgtaaccaagaagtgttggcttcatggaactggggagcatagagctttctaaatgtccagaattcctttgactctcactccaacaatttagtaagccactaaatgtactgtgctagaagggggaaaaaataagtaggaagaatctctgtaacccataaaatggtatacaaatttcttactagtattattgtacaaagatgacaaacaaggaacttaaaatctacaagtgtactcaaataaatattatacaaagcaaaatatgatgggttccacaaagctttacaaataaaatactatggggaagcaagagagaagttgtgtcaggtggggcagagaatgaagaagggcattttagagaaggtgacattagagatgagtatataaaaataagcttctaagaggtgtaaaggagagagaaaggcattctatgtggagaagatggcatggacagaagcacaggaaatagtgaggaaatcgtattcttgaaggccaagaattggcatagccttggcttctctttgtattattattataaatatttttttgccacctgtgaccacaccaaagagggtagctgggaaaaaagtagggattggtgtcctggtgggaccaattccgtggttcattaatgactagtagcttctaggttttttttaaaaaataaaaggtatagtaagctttttgaaaaaaatacttattaagtagagatcacttatggaggacagcagaaagcaaactacttttgtgggaatgtagggattgtacagggcagatgcctgacataaggctggagaaaagaggtaggattttactggtaaactagaactgcatatgtatagttgaggagttcatgcttaatttggcaattacagaatatttgaaggaggcagtgaactaaactgtaataacaagcataacttgccttgaactctgcctcatttttcctagttacactaaattcatgctgatccagagaatttttttctttaagaacatataacattcaatttactaatataggactagaggctataatttagcttttattttatgacttaactatttacaaaataccatttcatcttaaaccaactgccaaaattgggctctcacaaatctaaagtacaagttggcagaaataactgttacaccttcgcttcctcagaaaaagaagaatgttgataaccaatttaagatgttccagaaagagtcgtgatatcttcctctgaaaaattctgtgatgaggttcctttccttaagccataaattctatgctacgcaatgttgtcttgcaaactgagagctaaccaaaaccaaaaactaacaacagtacttggtattaaacattgattacaaggatttccaaaaaatcttccaaatttaagaaatcacagaggtaaaattacactcaattgaaagttttattaatgagccacctattgtaaagtataacgtttaatatatcgtaagtgcccagtgaacatttgctaaatgaagcccatgcactatagcttatttttgagttgggttctctatcacccaggctggagtgcagtggtacgatcatagctcactgcagcctggaactcctgggctcaagtgatcatccctccttgacttccatacatgtggggattacaggcatgagtcacctgcctggcgagttccttgtttctaaggagacacaattcatttttattctccctacccccattagaatagtttctatttagaggaagtaaagcctgagaaacaggcaatgttttcaccaagatggcctgttaagaaatcttggttagtctacaagtccaaatttcactgccggtgagcaccatgtcccatgagcagcacatgttgtaatgccagcttttatgcctcctgtgacccaggagggaagatctgcatgagagtctctaaagacagggatgaaatgagactgcccttcaaatcgcagagaagcttggctgtataactacatagatctttatataaaagaatatgttttaaaactatcagcaagcaacattcttttatagatcaagcatgtactttcttctgggattcctaacctgaaatgtgaacttttctaataaaacttcttctgtgattgtgattaaaatgagtgagtgtgctgtaactaatgttggaaatcatatagctgccactcattgaagcttaatggaattcaccgcatgaaatctgcacatcaaaccagtaaagtgggaacaaaattaaatggaagtgttggcattcaaacccaggtcattgtgtccccagagcccattcactttaaatcatgctgccaaaacttcttgaaattgtgctgttgcagtattatgatcctagaaagccattatatatatgagtgtttgagcatgccaagtaacctagactagaaatgacaaggatgttataaatacaaggacttaatagtaggacactatataagcaaaataaccacgaacttgcattcagtttctagaggtctcaatcattgaaactttgctttgtaatccttctggttacctagagaaagaaagccccagggttgcccaccccaccactccaggaaaggtaggggtaaaggctctcagactgctttgttgagaaaaatggagaatgggtgaagctcagcacacaaaaatctctgaggaagccttaaaaacccccaacttgccatgcagaaactaatttctgtctggatggcagtcctagtcttaagatcagaaagaaacaggaaggtgagagggtgaggttttatctgttaccttatatagtctgggagtcagaggcactcagtgtgcctctatctttaatcacgtggtctagcactagtctcttgggctttctgtctcatagtttttttttttagttgaaaaacaggtcaactaacacaaatgtaagaaggcatatgttggtctaaaagtatattaattgtttaagtctgtcaattagtgagttgtcagtcaataaatatttgttgagtgccatttatgtgctaagcactggggacatgtggtaagtaaagattaagttatagataggccatgagcttaaggagcttagagtgttaacaggagagacagagaataaatatggaacttccaaattataaacagtgctatgcaaataaggtagtgttattcatatttatcagatattctactgccagcaggtgtggatattactgtcaacttacttgcctgagttctgtagattcaaagttggattttgtaatttctcccagttgcgtataaatatctaaatcagatacattgatggtgcgtgtggtgagatcaagtgtacaaaaagtagagcttttgagtttctgtaaagtgttacaccccataaaatatgtacttctttttagttccacttcccattttcttgaaatatttttttcttactcagtttcaatagagcatagaaatctgctgaagtgactcaataatctcccttgcattagaatggtagtttattgaaatcgggcaaggcttccggtgacagtaacagagaaacttccctttagaagtcaatggcagaaagtaaagtaagttagtaaggaagctatggggcatgatggcaacgtggataattgggaagtggctggcaataatttagaagtaactcaaagcatataaatgcaatctgcctgatgatggggaacaaaaaattatgggcagtcacagacagtaaagtccttccttcctatgccaccaaccggttgtctcgcctccttttttaaggaagtggtgaggagatggtattcttaaaagcccagtatcagcatgacttgtggcttctttttggatttgtttgccattcctgtccacaccaaagagggtaggtgggaaaaattagggatttgtgccctgatggttggacccactccactgatccattagttactagtaatctcactttttcctttcaatataatatatgtgttttacattaactagctttttaaaaattacctattaagatgaaacagagtatcattgaatggacaatgtatttcccaatcacatctctccactgttctggctttcagttaatttttctctaaggatctacagttaaagctatcagggggcatcaacatatattattttacattttttatgatccatggtgattatgatgataaggataggactatgaagacagtgtatgttccacaacaaaaccatattcgtttgctttaaattcggcgtgcaggagccagtgaattttccccaaaaaatttcaaaaggatttgtcaacaaatagaaaagaacagtgtgtggcaagtatagacatgggggtaaattcatctctataggtttagtatgatcatctccagttccagggcatgaaaatgtacttcatttatgcagccaaataatgattaaaagatttttttaagtacatgacatactgtttttcacacaggaagcttacctgctagctggggagtgcagccttactaactgaaaacttaaataatgatactaaataacatcaaatattgattaaatacctgtcaatgaatatatgcaatagggatttgagggactaactatgataattatacaggtgaggaaactggagactgagtatgttgttcgatgtcacacggctaggtgggaggactgggacccaacataggtatatctgaagacaaaacttgctctgaaatgtgtaattcagtactgctttccaaccctactaattctcattctctgattctttggactccaacctagtttcaccactcctgtaaggactgtatcaatcatctatcgtgtaacaaattaccacaataacttaaaacaacccctgtttattagtttacagttctgtaggtcacaagtccagcacccagttgctgggttctctgctcagagtatcataagactgaaatcaaggtgttttctgggctgaattcccacctggaaactctaagtaaaaaccctcttccaagctcattcttgttggcagaattcagttcattacagatgtagcactagaggtccctgtttccttgctggtgatcatctagggtccactcaaatcctagatgttcctgcattccctgccacatgccctcctccaccttccaaccagcagcagtgcttcaaatctctgacttcctccatctctgacttctaaacccagatttaaagagttcatgtgattgggtttgttggcccagataatctccctattaaagtcaacttgggactttacctctgcaaaatcccttttgccatataatgtaacaaaatcacagagtgatgtctcatcattttcacaggtccaaactcaaggggaggagattatataagtcattgggggtcattctagaattctgtctaccacaaggactctcagaaactatagaggaaattaagttgaaatttaagaagccaaagaaagaaagaaggaaagaaagaaagaaagagaaagaaagaaaggaagaaagaaagaaagaaaataaataaataaataaataaataaactataaaggaacatggcaattgggaaacaggaaaaagttatttcctcaaaattttaaggaatacaaagtagaaaataattttcagcacttgtaatgaacacaaaagacaaggaggctatataagaaaacaaagatggtcaacttttcaacaacagatcagtaaaatgtattttacaaataaatttttatttcaaaaacattaagtttgaaaatttgtattttacaagtttttatttcaaataggaaaccattgttttgagagtctgagtcattgctcagctccactggtgaacatttaattataaccaatgcattggtgctccaccatattccctaagcactggcacttccaatccatgcgacaactgccctttgcaagcatcattcactctctgcctggggattttctttcagctttctcctggggcaagcctgaaatcccaggggattgatgtcctgagagcatccctcagagcagccctcagccaatcatggatggcagttggtggttgaacacccaagcttcttaacccgttaggtaaaaaccaaagaacgaaacaaacaaagtaaatgaataaaaaaccctttgggataagttctacacagtctcccagagttccctggtgtgatcgagcccaatgatatgatatgatcatggtagctgatataataatgcactcttcattaatttccttcccagtctcatttttaccctcgttttctatgaccaccttccggatagaatacttacacttaaattcttgtcacaggtttctaggcacttagaataatagtgactatattcctgcatttggtttggtagaaaagggcattaaccttttatagacaaatagacttggatcccagccaatgtgcaattttagctttagttttcttacctgtaaaatgaggacattaagatttaccttgttgcattaaatgagtaatgattatgggtaaactacctagttcacagaaggaattcaataaagcataatttttttatttttcctttttctggaatcctcagtgtcttccttgctactatttctgtaatttcaagaacctgacctcatggtttaaacttcctgccctccctagttatggctaactgagagatagatggtggagtaagcacaattttctgtgcaattatattttctacaaaatcagagtattttattaaaaataagtaagccaaatattaaacacccctatatttaaattgaataaaacatttagaaccaaatattttaagtacataaattttctttggtacttcactctcttgttcttaaagttccctgaatctctgtgacagtgcatttagactatggaacaaagcaaccagagcaagacattggccagttttcaggagagccaagctctaattcaaccataaatcagtttaaatcagtttttttctttctttgagcattggcacgaattgagattcaaactcacattttctaacatatgtaggttcgtcaaatacactaaaatactgagtacaatagtatttttaatgccaaaggaaatcatgtaaagtatgaaatatcagaatgtttatataaactctagtatcagatggcctgagtttaaatcccagctctgcaacttattagctgtgtgacctaaggctaggtaaactctctatccctttgttttctcatctgttatgtagtaataataatggtacctcccttgtaccattattgtaagaattaaagagttaatttgattattacattaaagattaaattaaattaaatattacatcaattacattaaagattaatgtaagaattaaattagtcaatgcatgtaaaacagttgcagaagctcttggtaaatgttagctattgttattttggctattagcatttggtcaatgatctcccctgtgatgttgttcacctacatgggcaggtgtacccttctttctcctctcatagtgtgtatgtcctagaacagtgttgtttgaaaactattcacttgttctagaactgttcacttgtctgtgtccccacttgactatgaggtatgtgatgttaatttctacatcctttgtttaatgagtaaattaatcagaactagaaactatgtagctagatatgttttttgtacaagtttatatttttatacagttaagcaatggattccagaggagactttatgtcaccagtatgagaacagaaaacataccagttaagccagccatgtcacttactggctgtttgacctgaggaagatgactgcatctctctgaacctcagtttcctcatttatcaaatagatataatgatacagtttgcagggtggtcatgaaaattaaatgagataatatgtatcaaatgtttgacacatagcaagctttcctgttaacaattactattccattctttcccccttaatccaaagtgctgctcaacaagagttcgaagacaactggacaggaatctcacctttcataaaatggtggcatggatgattgcacttcactctggtaagtttattaaagaaaacttggaaccagggagttccctctattcatagatacctttttatataggagatcaaccagttttatagttagattaagtggtggttggatatgttgtatttttttaatgagttttgctcaaaagtatttaccacactttctgccacttcaatattaggatttattcctttaggttttaaagcatttttatttcaggattttcctataaaaatgaaaatatgccatcagaaaagtcaatcctagtgtcctcaccctttgctattctttctagtgtcaaaaatgttaattcactcatgaaaacttatttattctaaaaaaagttcttggttgcacgtgtgaatttgtggactttttgcagcaaacctacaggagccatagcccataaattgagaatccctcaagacggtcattatcagctaaataccttcattattattattactattgttattgttattgcatgtatccatacaatggatatatatgtgtgtatatagatattatatgttattattaaaattattagggtggtagtgtcagtgcaagaagggctgtatttgggacccttatctaattccactaattcactcaacaaatcattcatgtgccagagaatatataagcacagtgataaagcagacttgtactctgcccttaaaaagtctgttcctagcctgagtaaaataggcttagattacaggcatttaactgagtttctcttctactagtagatctggcaggcttttttagcagtggcaaataaatagttcaaaagaaatatatgataaaatcttgttagaaactggcatagtgtacggattaagagcacatatttgcgtgccagaggtactggatttgattcttaactctgctgcttcctagcttgatgaccttgaacaaggttttaaagcagtctatgtcccagcttcctcacctgtaagatgagctgatattaatagtacctacatcattgagtcaatgtaaggattaagtcattgtgaagtacttataacagtacttggcatctagtaagccctatgtaagtgtttattaataaagaatgcaatttttaagacagagagattcataccttatggccataggtttgtatcaattcaatcaaatttgtcatctctctctggaggtaatttcagagtcaggttaatgggccagcaattaggcattcattacatgagtgttttcttgtttgagcccaaatatattatggagagagataatgagagcatatctaaacaccttcagaaactaaggctattgtgtagaatcttataacttgattgagtctttaggagcatatagctcaacatcttcatcttacaaattaggaaaccaagaccagagagttaagtcattttcccacaattacacaactagagaggatcttacccactagaattgccttgtctccttggttctggagacccagttcttgtctataagtgtcctgggcctccctttgtctccctgtggcttatcatagagtcagaggctgtcccagaaacccagcttacaataaatttgttcatacccttcattctctttgtttctcttctctgcccttttcagcgattcacaccattgcacatctatttaatgtggaatggtgtgtgaatgcccgagtcaataattctgatccttattcagtagcactctctgaacttggagacaggcaaaatgaaagttatctcaattttgctcgaaagagaataaaggtaagcctctcattatctgacttagatattctctaggccattacaattgaggactagatttcagtgagtgaagacctctcctttgccaaaaaaaaaaaaagttggctaaccatcagagggacaagtctgtaggttacaataatgggagtatagaaaaaaatgtctcccacactcctcacctcatgtgtggaggtctctagatgttttccaggtctttaagctcatccatgagaatgtgtgcatgtgaagcctggagtaactcaggcttacctgtgactatgcccaccagtcaaagaaagctgggaacacatgtctagtcgaacaaggtttggtttattacttgctacagcaaaagaaatctcacaccttgaggaactctgggcatctcaaggggatgtaaagtggatttagaatttaggattctgttagatggtttgggggaggatttaagaatgcaaggattttctctggatcagttatggtcaggaattgggggtagttctcagataaggtatcttaattattttttctaggaggcagagggaacagaataggactaagtctataataggcaaagaagcagtagtcattgtctaggctcagacatgattttggagtggttttgcttttatctcactccatcacagtcacagagtgacctcctcagaagctggtgttttgtgaaattatttatgtgaagtagggaacatcctggcctaagtattagtgtaaggccagccaccagctgacagttgtgtgatgcctttttcttttcttaccaacaacatctgagggatggcctgtgtctacagattgtcattccttgagaagcacatgtgcactgggagtaactcagcatttctctaggggtagccaggagggtatccagaagtaagaacttcttctatcccagcagttgttgaagcttcctacactcaaagacagaagctccaagtcttcatgcacccaatgacttgggaagatgactaaatcacattaatatgcactgaattctaaaaatgttttcttgtgtttagaaaacatccttagttttggaaaaaataattattattctcagacttacatgagaaaaacttgcctgatatacttagggagggaattaaacagcatcataaaaaacagattttttctacaatatattgggtaatttttcttttacattattcattgtttgcccaatgatatatgagggtggcaacattaacataactaggtaaatctacactatcatgctctattcagttgttcctggatcacttttactgtatctatgctctcctactcttctaaatgttttcattttcaataacctgtaactgtttcctcctcagaggactgccctggggctactaaagtcccttttctcacaggctcagagatcttggaaggttggtggggggtggctgaatggttacctgttcctgtgcaaaccgttagccaataactggtggatgcagactatgaaacctggcttccttgccttgagacaggataaactctaagttgtaacttaccctccagagttgccttgcaggatcaggctgaagctatcccctgtgagactgcctgatttcacccccttgcttgacttgtttgtcttttctatcctattccctactctcttaccagtttctcttggagcacatgttttctaagtcacttgcccatgaagtctcatctcaggatctgcttctggggagcacagctgatgatgttcagcattcccagaatatatttgcaaactaagcactgtggccctttcaaaatcaaagggagaaagagccttcagacacttttaggacatcctgtagttgattgatttcctttattttctacccccttagaaataactatttaagtacatcagttcacatttcctatgacatcttaaccatgtaagacattttaaaatttagaaacatctatttcaaatctatatctgtctgtgagggatgattaggattattcaaagagggggtgaaaatatctattgttctatacattggacactttataatagtcctgcatttgagaacctataatattgtgcttgcgcacatgtgtgtgtgtgtgtgtgtgtgtgtgtgtgtgtgtgtgtgtgtgtgtttatattttacagaaccctgaaggaggcctgtacctggctgtgaccctgttggcaggcatcactggagttgtcatcacgctgtgcctcatattaattatcacttcctccaccaaaaccatccggaggtcttactttgaagtcttttggtacacacatcatctctttgtgatcttcttcattggccttgccatccatggagctgagtgagtgtttaaattctgaagtgaaggatttcatgtccctcaatttctaggcaggatgctccattagaggcacagtgacctccttgcctgtgtgtggttagcctgtctgctaagggaatgtgagaggatagcagaggtcagtttgatagaaaccagtcaacattggcatttttgtttcatgcacccatgtaattgctattcatggtgaagttatatatagcaagcttgaaaaatacaccaaagtctgagtatctttgcaaatgtataaaacatattgagagcactggtaggatctggaacatctgcaatgatatcctctatggtttaatcactagtaaattaaacaaacctccagactagaagagttaatgattaatcagttgaagaggtttgttatagttcaataagttttgatttaagcccacagtcatttatttgttgtctaccatgtatgaggacctatctcaggcactgcaggaaatacaagcaggaaaaatatgtggttgttgccttcaaacattctaatataatgaaagtagcagctaacttctattaagggtctgtgctaagggtttgacatgatatatttcttttaacccccaaaatgtatagatttctcactatcaccatttcttggggatagtaattgcagacaagaaacctggagctaaaatgttaaaatatgcagcctaagccacctctctggtaagtggcccagctgagattggagccaggcagtctaaagcaggctgtgataaatgttctcttagagacacacagttcctggctatgtggttaggagagtttgcctgattggagatcctctttcataccaagtttccttttttgtgcagtttcataccacctgcacacaaaggcaggcctggggaagttccctggtgggtatagggctccaggaaattagggttggaggaagtagaagctcaagactcactctgcccagagcccagttggtggccaagacatgactgtgaaaaaggggaagggtggggaaagctgcattgggcactgcattcttaaactacttgctgactgtgacccctgataaactctttgtaagcatggagaaatcaatggagaccaagaatctgatgactctcttaaagcactcaaatatctttaaatgggacttagtcataatcccgtgtttcaggtaatcctagagaagagaaataatttcttcccctctccaatttagtaattccaccactttctgtttgtatggtttcgcagatactcatcttcctttgaagcagacagaggagatatgtttatctccttctccacttgaagagaatctgctctttacactggttaggtgatttctcacagtctcatggctccgtagcagctgaattgggtttaaaatgcaggtttctggactcctggtcctggcattgagaagagaaggagaaaatcagattattttcctatcatttacttaccatgggaacttaggcattttgaactttaatagttattttttggactcttactttgtgtctggcattttttatacatcatgcaaattgcttattataatgaacctttaatgaggtactattacatctgttttacagctgaaggaactgaggctcagaagaagttaaataatttgcctgagtccaccaaactagtaaggggtagaaatgagatttgaacccaagtctgtctgacacaaaacacaattgttttcaccaaaacattctgctttgagttactaaatcattctgatttacattctcatgtaaaatgggggtaataatacttgcctctcaggcttgtcatgaggattaactgagataatttgtgtaaaatgactttccccaagcctggcacatgataagtgctcaatacatgataattctcttccccaagacctaaggatagaaaggagtggttaatgaacttgaattaaaacattctcagaatacaccaaatgacacaataaattttaggtctccaaaacaaacctttacaatgggttttctgtgtcttttcttcttatatattctgaagatgctgtcatttatgttccttgaagtctactcaacgttgggccttcctctctctatcaccaataattgtcttatgatttggtagttgctcaactagcatttattgaattgaaatgaatgggctctgagcaattcaaggtacacactattagtgttgatgtctgtgagaatgttataatccctatatagttaagtatctcaaactggtttcaaaatttggtttgatttagataatttccaaacccacaaataaggcacttcttgtaagcttcagggctactgtatatgactgtctcagttgtctactatagtgggtgcctggccaaggacaataaagttagcccacactttgatgattgagccctttgcttatatcttcataggaagggtaccattttctaatttgcacaaaggcactgtaggggccagcagtcactctgttagatttgcaatttttctgcttttgtttgtttgtaaatgaaaatgatacttgagacagaagtagaaattctcccttaagagaatttgatccaacacttaccctctataatgttacatgtaaatatccctttggtaattgcacatatattttttctgttgctgagtgttatgcattttctttcctttcatctattcagagggagcaataagctatcgcttttaagtgaaaagtacagggcctacatcagagcacttaaaatatatgcagaatcttttaataaaacaatttaatttcctattactaaatgatctggacttacatttttcacccagacgaattgtacgtgggcagaccgcagagagtttggctgtgcataatataacagtttgtgaacaaaaaatctcagaatggggaaaaataaaggaatgcccaatccctcagtttgctggaaaccctcctatggtatgtacaattcattgttgttattacagtttcattactgacaatctttaacctgtgtctaagaaacatgtacagatgttatacatctatatagatgtccattacaaatgtcatggaacagctaaaacatgtgtctacttttctctgctatacttattggatagaattgtttcttgaaaactaagctttgcattgttctgttattaacatcctgatataaaacttgggaaaatagtgtttttagaagtgctgttttggttcaagaagttccatctcttttcttcatgacgacgccagctaatgatttttagggggacacttgggattccatcttgagctgagttggatagctcaaataaatcacttataaggagcaaagggcctcttcagataccagcacataatactttctatacagctttccaatttgaaaaggaaattgatgaggtggtacataaggctacctttaggcattaggagttttctgtttatgaggcataaaggaggctggacggcgaggttcataccaacatcccaatggcatcatgtggtgggcagaagtgtggcaagggtgaccaaggaaatacatggtgaaatactttcttccttctattgggagctctgaagggttccattttgtgtattctcataacactgctccatagagtaagatgtgggccttgtaatcttcatatcattttccccattggcagatggtatactttgttggttattgtgctagccattggtataaaactaggcaaaaatcaacatttgtgcagggcttctgaagaggattatttttttttccttaggcacagtataacataaaggcaaattttccattccattttctcctttcttttttcctactctcttagcataggagcactcttactctagacacagcatactatatgaagacgtaggatctttaagcatcttttcccattaatggaagcaaccagacatatcagtgaattggctccactacatgcagacatcaatagaaaggataaaaagggaactgtattgccaatcctcttgtgggcaggggaaggcacatttcctcgatgacagctggagtcagagtactagtaccttagcagaaacctacctcaaagaatttctaggtatactagcagcaatatccaaatctggctccattcagtggggctccatggtagcactcaggaaacagatagatgatttgagactgttttatatatctatcccattaaaacaaaggccaacaacagaacattgtttatatttggggcaaatattcttcaagtttggctgaagatggagagattcaggtgctctcaatttccaacagtaagtttcctataaaagtaatctagtagaaagattatatgtgagactatcggaagcactctcttatcttttcccccttagaatacattccggaaagtcattttttagataatattgctgtctaaaattctttgctagtttaggtattaaactagaagtccaattggctgagtttcaggatggatctgtttgacctcaatgtttttatatggccaataatgctacagagtaattccagtgttcagaaacactgcatgttctgacccaagaaatagctaaagaagtctgaaaagctctaggtttgtctccattcagcaagtgcattgcatactcccagaatttctcagaatattggagaaacagccaaactcttgcataaaatttgtcatcttgcaaatttgtcactgtgactacataactaagagaaagcaatcacagtgttgcattaaaaatattgtgttgctgaaatgttatcctttaaagaaatgttaattctgaaaccaaccttgctttgttatagggttactgcaactgtagttgcaacactgagaggaaatcccattcttgtgaggagttcctcttgggaaagttttatcttgtcagtacagttccccattgtgactaaggagaatgtttacttttactggctcaaaattatcttagtttcagatattttcatatattccattgtagaagaaatttatttatctaatgtcaaatatttaagcaagcctacaaagattaacttggcttctaaaatttttctccctctgaatattttgttatctattaccacttaatgtatctcattttcatttttgctctgattacagacttggaaatggatagtgggtcccatgtttctgtatctctgtgagaggttggtgcggttttggcgatctcaacagaaggtggtcatcaccaaggtactgattggtttagtaattactagtggtcagtgtctaactatatcatggacaagtcttcccaactcctctatatcattgatcagatgttacaacagagagaagacctacaatttatttcaatttacttagctcaataatcaaatgtttgagcctttaactggggaaactacaagttaccatttttgatgttaaaatgaagccaagttctttctggacatcaatctcccccacccattgtgtgtgtgtgtgtgtgtgtgtgtgtgtgtgtgtgtgtgtgtgtgtttgtgtctgtgtgtctgtgtgtttgtggaggggaaggcgacagaggcattatttggttagttaagagcagaaaagaaaaagaggtgagttcaaaggggcataaattgagtcttaaaattttcagatgccaaaagaaccagagatctaagggtaggtctcactgaggctgagctagtttttcaggttgtctttaccaccttttctgtgctgtgtatgtaataatctaataggaaagttgaagtgcccaaaatttcaacaagttagtaaataagctgcctctcaaatttgctctcctaattccaagtctagagtggcttttcctgaactctaatctgtttctcatcacaaaataaataaatatccaactaaataaatgtaaatggaactccttgttataatttcaggaaacactaggaaagtctatctttatcaaataaaatttaattcaattcaactcagttcaaaaagtatttgccaaaaccctactgtgggttatttttgcaaaacacacaaattcttcctgtcctccaccctatctttcctcatttgctgtctatggtgggtcatagtaaagttagttcagctggctttggaagtcttgaaatataggaaaccacaacagttctccttttgtgatatttatattgcattataagaacaatcccacagatcagcaaaaacagttgctgcaaaatttcccttactagactagagatgactgagtcagacaagtatttttcttaaacatacttttaaggaaaacttgttttcctttgaagaaaatagatatttgttttcttctcatataaataaatatgagaaacaagatgttatccaaaagtattccaatgagaatgctgtccacttatttagttacatctcatttgtgcctatgatagcaaaattgtaatatggtaaaaattttttccacaacacaaaattgcaacatggtaaacaattttcaacataattttaattttctgttttcaaaatgaagctttacaactccttatttcagaacagaagggaagtttgttatagtttttatcatgtaagatgcatttaaatcacaagttctggaaacgtttgacatttttttaaaaaagaatttttcactcttccacaactccctgttcgagaaaagcccagcaatatcagttaacattaggaagctgctattttatttctattgatttttctttcctttgatgtcccttggtttgtctttaattatacatataaggttcttctagaagtcttaggaatcatcaaagaaacagtatattactttctgtattgctcttcactgtgttctattttttaaaaaaattatccagtcaatagttgatggacatttggattgtttcctgttttttgctattatgaataaagctgttataaacgtgtgtacgtagacagatgaggatggcaatgggtgggtagaaaagatggtgtactccccaggtagggagaaatgtagaaataacgcatggaatcaggcagattcaaggtgtgattcaggacaaagatagaccaacttagttagtcttgttttggggaatgttgctacataactagtcaatgggatctccttcttctggccagctattaggttggtgcaaaagttattgcggtttttgccattaaaatatggcaaaactgcaataatttttgcaccaacctaatactaaggccctctctcatcctcttgggggataggaaggctgagcaggaaacatcagtttttgtaaattttttagcacttttttgacttctgagaggaaaaaaaaatcacaataggctgatttcttatgttggattccctggtaaagactgagaaataactgcatgcagaaggtttctaaggaattctataagagataaacctggaaaggaagtaagaaaggcaggaatggggagagagaaaagctgatcctctttctagttgtaactgtggcctcagctgatactacagggagtgtggaaattgagatggcctcttggagttaacctaagttaaggaaaagggactaggccttagtatcccttaatcagcccatcattagtaatgggctacaactgagggcaattccctgtgacagacacatctgctggaggaactcctgtgttgtccctaaagcagagatctaagtgggccaatttagctcagttttttatccatatggacactaaaaaggcaagtatttaggaaaaatgtcatttccagacatatgttttattctataggtggtcactcaccctttcaaaaccatcgagctacagatgaagaagaaggggttcaaaatggaagtgggacaatacatttttgtcaagtgcccaaaggtgtccaagctggagtggcacccttttacactgacatccgcccctgaggaagacttctttagtatccatatccgcatcgttggggactggacagaggggctgttcaatgcttgtggctgtgataagcaggagtttcaagatgcgtggaaactacctaagtgagtaaaaagtacatattaccaacgtatatgagttcaggaaaaatggcactaaatagctcctcttcctccatgttttactaagtctccaacaaaacacacaggttctaagaatataggtagctatttctgtggtcaccgtttcatatgtgtagtgtgtttatgcatattttcataaatcttatgtgaaatatgaaaaccttgaatcaaatattagaaataaatactcccaaattcctttaaatatgtaagggtcaaggccaagttatattaactttcctaacaaatataattgtagtgtatcaaaaatattcttaaattttcattggcataatttatttgaggttaaatgccatatattagcccctttgcctccttttccctgcatgcctaacatgctataaggcacttagtaggtgctaaagaaaggtttgagagtttgttgaataactcaatgaatagataaatgaaaagtggagacattaaatctacaagatgtaatgatgcagcaaatcctcacttcagggtgcaccgtatgcaagaatttcaagagtgggatgtcctggcaagacatagggtgtgtgtggagggggcgttgttgtgtgtgaagaggggtggggagattaaaaaaaaaaaaaacttgttctgagttaccgaatgtttttggttagccaaatatttctctttttacttccaaacccaacgttggcactaagtttggttacttgaaagctatttcatagaaggaagcacccaatagatacattattccaatttgaattaacatgttgcacatccccaataattatgggtgccccatctcactctgaagagcaagacatctctgtaactatctcctccccatttcccttcaggatagcggttgatgggccctttggcactgccagtgaagatgtgttcagctatgaggtggtgatgttagtgggagcagggattggggtcacacccttcgcatccattctcaagtcagtctggtacaaatattgcaataacgccaccaatctgaagctcaaaaaggtaagtcctttcatttatcggagggccttagagcagtaaccatactctgccatgtgaggcctgagagtgctttcagggctaaggttggcagagaccatgggaagtgaagaaaagcttccggtggttccagagagacaggcttttcttcaaaagaatatttgttaaatctaatgtgcttctagataagtaggcctattagtgaagggaatatattgtatttgtatagtgttgctggaaattcagaagaaagaaagttgggaaagtattcacagccccaacttaatagctgtaatttttgtatattctcttctaatattttccatgtttacatatttttagaaggttgtaaatattaagtatgtataatttcatgtcctgcttttaaaaaaacattatagaaagtgtttttcaatgtcttcacaggctttataatgatgactttaaatgatctcttcatgttctattgagaggatattgaataatttttctttcatcttgtgttagatactgagattgattcaatttccagccgcgccccaccccctccactcacccaatactttttttgcaaagggaggagaggagacctgaaactctacttatgaatatctcctcaggatcaattcacaggagattttttggttacctataaatttggttttattgtgtaataaagggcatcctaaataaacctcaggccattctaataactgtaaagataaactctaatagggacattaagcctaccttgacttttcattctccctgtacctcttttccatgtggaggagatgtgcatagaaccttatttttcccctcggaactcatgaatgtctggcagtagcagccagggaagaatttctgtggcaatccctgctagtctagattccatcaggctttctgagaagaggttcgaaggaagccagagattctgggagagtaagagcagactcagagggaaatttggtgggctaatagttttttcttaagttgtgtatttctgaggtcaagttacttatttactgccctgctagagtgaaggccagagcaggttcatgtaaactaccctgtgaaatgtccagagccttctgaaaatctatgtttctaggcattctgagcatcaagaaaaagtttaggtgacagaaagtggaattccacatggtaatgctgatagggcctgccaaatataatctgcttcatgatccaccccattttcagatctacttctactggctgtgccgggacacacatgcctttgagtggtttgcagatctgctgcaactgctggagagccagatgcaggaaaggaacaatgccggcttcctcagctacaacatctacctcactggctgggatgagtctcaggtaaggacaagactccaaggctcaggtccttcccatagtgtacagggcttacgaacttccccttggttattggtgtgtcttgtgtactattttttctaagtatgtttagtggatttggtgatccggtccattcactctcatttagtatcgccacattatatttagactgctcagattagaatcaaagccaaggagcctgtgagggaataaaagccatcactttgacattattagagcaattctcccaccaggcactctgaaaccaggtgattgagatgatgcacagggttattttggggaaaatttagctttctctttctctctgtctctctctctgtctctctgtctctctctctctgtctctgtgtgtgtgtgtgtgtgtgtgtaaaacagacactccccaacttaataatggttcaacttatgatttttcaactttacaatgaagtgaaagcaatatgcattcagtagaagccatacttcagtacaagccatacttcagtactgtattcaataaattacatgtggtcttaaaccttttattataaatagggttcatgttagatgattttgtgcaattgtaggctaatataagtgttctgagcacatttaaggtagtctagactaaactaactatgatgtttattaagttagatgtattaaacccattttagacttatggtattttcaatttagtgatggttttatcaggatataacaccattgtaagctgaggagcatctgtttatataacatacataagcatataaaggattctgtatatatatattttaatatgtatttatatatgtatcatatatatttatatgtactatgtatatatgtatttataaaatcatttaatttatatgcttttgtatgttttataatatactcactacatttataattattatgcatatatattgccaggtattattcttatgtatctagtcacatagattgtctaattttatcatgtcaccaaccctatgaagtagctcttattattttccacactttacagatgaaaaaactcagaccaggttaggtcattttcctaagagcacccaacaagtaagtgacagagacagaatgtgccagagcctgtcctttcagcatcttgcagtagttcatgattatcatttataaataaattactatatatctaatgaatgtgatatatatgcatgtatgtgtgtgtgtatgtgtgtgtacaatgagagtgctctttcaaaaatgtttggagaccactataataaagtagccaatagttctcaactgggacaattttgctctgctcctccccaagacacacaccagagacagttggcaatgtaaatatcctacaattaaaaagacagccccccacaacaaagaattatacagtcccaaatatcaacagtgctgaaattgacaaaccctgaaacaaggtaatgattcctggagtggtaacatctttgtaagtaagcaaacgttaatgacttggcctggaagcagcataagctatcaccatgagtgaggagctaaggcaagagtctctgcatatttctgtccagtgtctcagctggtgtcttagtccatttgtgctgctataacaaaacacccaagactgggtagtttgtaaagaacagaaatttattttctcaaagttctggaggctggcaagtccaagatcaagacaccaacaggtttggttgtctagcaaaggctgcatcttctgggtgggagaaatactgtgttttcacatggtggaaagaaaaagggaaggctcgtcaaatactgtgtgatgactcttttccaaagcccttaactcattcataagggatgatccttcatgtcttaatcacctttttaaggctccacttcttaatgctatcacataggcaacatctgaattttggagaggatacattcaaactgtagcaactgggcatacatagacattgactccacaaccctgggaatcttccatgtgcaccctgtcactgtgaagactgaattcccatttgggtttcaacatattgtttatcacagattctccaagtcttaaaggaatcttgtagcaaatatagattagggaaacataacgataagaattgttgctccataaaaagtggtttcaaaatgccagttctgcaatttaaaaacaaaacaaaaatgctttgataaaaataaaactcaggaaaaaaatctatagtatataaattgctttactgttctgttattttaaaagccatgcacaggtttcttttttaaatcagttatttatttgtattgaaaaagtaattattttgctttgcaaaactgatatctatagaattattaaattggagtgcccacctttcttaacctcctctatgaccatcatccatctagtgaatttcaaatctgatttgctttttaaaaataaatttaattaaccacttttatgaaaaatacctgttgctcaaactgaagcctcctagaatggtagcagaaaaacagtatgtgactatatacacatatgtgcgtgcacacacacacatacacacacactagctttaggcttgatttgatgtcttatgctaccaaagtattgctgcattttagtctaaaattgttacatctcttagtaattctcccaaaggagtggaagtatattagggtggagagaaaaagtcaaacatagagcagagagaaaaacagtgagacactattcatccatcaatgcctgactcaaatactgcggccctaacccttcccctattcttccacttcaccttccttctttgttctcattaggacgcttgtgcctccttcatgacacacatcataccctgttcgacatatgggattatttatatttatacttcgaagtctccctttctagactgtaaattgcttgagagagatccagtttatttatctttgtttacctttcagcatccagcagggtgccttggttagaatagcttgtgaaggatgtaaatacattgtatgtgcttttacagaatgtctcttttttttctgaattcatgtcctttcctgtaggccaatcactttgctgtgcaccatgatgaggagaaagatgtgatcacaggcctgaaacaaaagactttgtatggacggcccaactgggataatgaattcaagacaattgcaagtcaacaccctaagtaaggagtctgtcaccaagatgtttttgaggcttgcatctgcctaaagcggcagcccctatacatatctaaacttatatattttagaaactcaaatatgtatattactatataaagattgaattcatgcccaacagaagattccagatatcttcaactttaagaaggatctttaaattataccaaattacctggagattaattaaaaacaagtatttccaggtccccatctcagattttctcaacctgcctgtcccaagtagggccacagcttagttcttttctttagtcacctaaatttcattagtgtatctacttcttttaaagattcaatataatttatacatattgttaagaagacactgtccccactttcagttctaaaagcttctgggtctaaaatcttaagttgacagatgtctcaaggtgctttctgctctcactaaaactttagtcattataaaaccttgagggggatcccttatcttgctagaacacctaagaaactcaagagatcaccatacgtgtacccttcagactattgctttttgcactgtaaggagcatacaaagtgcctggggatctctttaaaatgcagataccaatttagaagatttgaggtagggccaggtaatctgcattttttaaaaagctgacgccaaggctactgatcagaaaccacactttgaacagggcttcagactctaaaatttagagaaatgaagccacactgagtggttggcatagttagcttgttcctaatttcaagatgccagggggcacagagccctgaaggaaagtagcccacggactcatgaattcaccaccattttctctgtgatagaagtttccaaaaaccttggttggattttacttttgccagggaagtcaactaccttttgaactatccagatgctcacacaaacaggctgaaccacactccctctgagcaatatgatccctttgctatttgtggaaaagaaaaaggagcagaggggactctgccctggggcctcaaattaacgggaaattcacctacctgctttgtagacatctcatcccaaagcttgaaattgtctttttttttctttcccaaaagtaccagaataggagttttcctctgtggacctgaagccttggctgaaaccctgagtaaacaaagcatctccaactctgagtctggccctcggggagtgcatttcattttcaacaaggaaaacttctaacttgtctcttccatgaggaaataaatgtgggttgtgctgccaaatgctcaaataatgctaattgataatataaataccccctgcttaaaaatggacaaaaagaaactataatgtaatggttttcccttaaaggaatgtcaaagattgtttgatagtgataagttacatttatgtggagctctatggttttgagagcacttttacaaacattatttcatttttttcctctcagtaatgtcagtggaagttagggaaaagattcttggactcaattttagaatcaaaagggaaaggatcaaaaggttcagtaacttccctaagattatgaaactgtgaccagatctagcccatcttactccaggtttgatactctttccacaatactgagctgcctcagaatcctcaaaatcagtttttatattccccaaaagaagaaggaaaccaaggagtagctatatatttctactttgtgtcatttttgccatcattattatcatactgaaggaaattttccagatcattaggacataatacatgttgagagtgtctcaacacttattagtgacagtattgacatctgagcatactccagtttactaatacagcagggtaactgggccagatgttctttctacagaagaatattggattgattggagttaatgtaatactcatcatttaccactgtgcttggcagagagcggatactcaagtaagttttgttaaatgaatgaatgaatttagaaccacacaatgccaagatagaattaatttaaagccttaaacaaaatttatctaaagaaataacttctattactgtcatagaccaaaggaatctgattctccctagggtcaagaacaggctaaggatactaaccaataggattgcctgaagggttctgcacattcttatttgaagcatgaaaaaagagggttggaggtggagaattaacctcctgccatgactctggctcatctagtcctgctccttgtgctataaaataaatgcagactaatttcctgcccaaagtggtcttctccagctagcccttatgaatattgaacttaggaattgtgacaaatatgtatctgatatggtcatttgttttaaataacacccaccccttattttccgtaaatacacacacaaaatggatcgcatctgtgtgactaatggtttatttgtattatatcatcatcatcatcctaaaattaacaacccagaaacaaaaatctctatacagagatcaaattcacactcaatagtatgttctgaatatatgttcaagagagagtctctaaatcactgttagtgtggccaagagcagggttttctttttgttcttagaactgctcccatttctgggaactaaaaccagttttatttgccccaccccttggagccacaaatgtttagaactcttcaacttcggtaatgaggaagaaggagaaagagctgggggaagggcagaagactggtttaggaggaaaaggaaataaggagaaaagagaatgggagagtgagagaaaataaaaaaggcaaaagggagagagaggggaagggggtctcatattggtcattccctgccccagatttcttaaagtttgatatgtatagaatataattgaaggaggtatacacatattgatgttgttttgattatctatggtattgaatcttttaaaatctggtcacaaattttgatgctgagggggattattcaagggactaggatgaactaaataagaactcagttgttctttgtcatactactattcctttcgtctcccagaatcctcagggcactgagggtaggtctgacaaataaggcctgctgtgcgaatatagcctttctgaaatgtaccaggatggtttctgcttagagacacttaggtccagcctgttcacactgcacctcaggtatcaattcatctattcaacagatatttattgtgttattactatgagtcaggctctgtttattgtttcaattctttacaccaaagtatgaactggagagggtacctcagttataaggagtctgagaatattggccctttctaacctatgtgcataattaaaaccagcttcatttgttgctccgagagtgtttctccaaggttttctatcttcaaaaccaactaagttatgaaagtagagagatctgccctgtgttatccagttatgagataaaaaatgaatataagagtgcttgtcattataaaagtttccttttttattctctcaagccaccagctgccagccaccagcagccagctgccagcctagctttttttttttttttttttttttagcacttagtatttagcatttattaacaggtactctaagaatgatgaagcattgtttttaatcttaagactatgaaggtttttcttagttcttctgcttttgcaattgtgtttgtgaaatttgaatacttgcaggctttgtatgtgaataattctagcgggggacctgggagataattcctacggggaattcttaaaactgtgctcaactattaaaatgaatgagctttc

SEQ ID NO: 1670 - DNA, 14330 bp, Homo sapiens
aactagcccagccgcgcggagcgcctgggagaggagaaggagccgacctgccgagatggaggcgaccggcacctgggcgctgctgctggcgctggcgctgctcctgctgctgacgctggcgctgtccgggaccagggcccgaggccacctgccccccgggcccacgccgctaccactgctgggaaacctcctgcagctacggcccggggcgctgtattcagggctcatgcgggtaaggggctctggggacgtcctggctaggggtgggaggattcctgggagagaaacccgagtgccagggtgaggggcttttcgggtatcctagggaggaggcaggggcaggggtcccaaggcaaaggggctgctgctgtcctggggttgggggcaggagcaggttgtccagggctgagaaggggagaggtgcccgggagagaggatcgtggggtgggggaccagggctaggaggggcagagacctctgcctacagaatcctgggaaggtgatgggcagggaccgaggctgaaagagacaggagtcctccagccgaggagaagctgatgcagctgggcttgtcccagagggagaggtagctggagccatacaggtggggcatgctgaagagggcacaaagaagaaaagggggaggcgtccctgcggggagttggaggcagagaagaggctggagggttgcaggctcagagagggggtcccgctgaaggaatctgccagcagagaatgcaggatgggaggatgggtggagctcagttgggagttcctgggactggggaggaaggagagcaagaaagaaggcagaggcagccccagccttaggggatagcaggtgggagtgggcagaggcctgaagtttcccattcaaaaggattctgggtgacttcaaggacgtagaaaaaagggtggggtcttgggggagagatggggcggatactcagcagtgtctgctccagaatttcagggttttgtggtgactgaaaggggtggctggatatttggggggcagggagggccctaaggaattaagggagacccaaactgcttctggattgcccagcgtcagaggttagggttcagcaggaagcaagggaacgacaggaagttgggggatgccactgaaggatgtactgggggaggaggcccgggagcctagtgcaaaaagagaactgagcctcagctatttctgctgggatgggggcaggttcctggtagagggcgtagaagctagacccggtggctcctcaagtgacaggggccatgatggagacaccttggatcgaagaggtcacagcaccctcctctttcttcctccctacccccagctgagtaagaagtacggaccggtgttcaccatctacctgggaccgtggcggcctgtggtggtcctggttgggcaggaggctgtgcgggaggccctgggaggtcaggctgaggagttcagcggccggggaaccgtagcgatgctggaagggacttttgatggccatggtaagtcaagggctgctaggccctccgctcacagcctgccaccacttactggtgtgtgacctttgcacatggcttagtccctctgttgcctcatctgtcaaatggagtgataacagtgcccatcagccgggtgcagtggctagtgcctgaaatcccaacactttgggaggcggaggtgggtggatcacttgaggtcaggagttcgagaccagcctggccaacatggtgaaaccctgtctctactaaaaatataaaaattagctgggcatggtggtgcgtacctgtaatcccagatacttgggaggttgaggcaggagaatcgcttgaacccgggaggcagatgttgcagtgaaccaagactgtgccactgcactccagtctgggcaacagagtgagcctccatctcaaacaaacaaacaaaaagcagtgcccatcatgtaggattgagtgattgagtgaggactgagccttgtgcaaagtgagcactcactaatcaccaggttgtagtatcagtgataaccatcaatgatccaggtaaagccctgagggttcagaaagatgccggagcgctttcaaggtgctggggattggtgggcaagccctcgaataatagaaacagttctctgtattacaacagaaagcaggaggcccatgctgggtgctgccaggaactcagtagtaactaagacagcaccggtgctgcttccccagcgcacctaggccagtggggaaacagactcaccacacagtcccagcccagagtggtcagggccaagatggggaagcacggggagaaaggtcagggtgggatggggaggggtcagggcaagaggggtcagggccaggctgagggaagccctgggactgtaggaatttagaggaggtacctgacccggcatgtttggtgagggagcttcaggaagtcttcctggaagagaggctgtcggagctgagactcataagatgagtggggagggtgttccaggcagaaagaccagcacctacaaaagcatgactttgagagaagcattcatccattcaactgatgaattttcagactgggcacgctggctcatgcctgtaatcccagcactttggaaggctgaatggggaggatgacttgagcctaggcatttgtgacaagcctgggcaacatggtgagaccctgcctccacaaaacaaacaaacaaacaaaaaatcattatacctggtaccatgggtaccaggtacatagaaatgactcaggcagatatggtgtcctctcctactgtgggagaggcgggcttatactgcagtaagacaatagagggagggaatataatcctaaaatgagaggtacagatttgagagcaaacacagggcacaggcatatgtacgagggtaaagagggaatcagggaaggcttctcagagaaggtgacatttaagccgggacatgaaggatgaacgagttagttcaccaaggatgggatggaaaggggtgagagtgatggaggcagagggaactgcaggatcataggcctagacaggggatcctgacgcccttgaggaagtgagagaagaccagcgcagtcgtagtgggttaagtaacaaagctgagaagccagggaaatccctggtcatgcagggcctgtgagtcacgtcagagtgtttgggcttttgtttttcctgggagcagtcgattttaagcagggaacagctgtattcagagttgggaagatcctgtggttgctgcctgaaggggatgaaactggaggctaggagcccagggtgatagggaggatccagggtgatggggaggctgggaggtccgcggtgatggaccagggctggggccaggggatggggaggaaggagtaattgggagaggcctggggctctggccgaggaatggatggtgggctgaaacagggagaggagagatgcttaggccactttggaacacagtagggcaaggacaggagacacccaaggggaagtgcccaagagaccacgacaggctggcattggacagggaaggtctgtctggagcaggtgtcttggataagggaggaaaatggtgcagttccatcctcctccctctctgttcaacctctaaactacatggggcacaggacccagtgggactccataaatgatgggatgggtggatggaaggaaggaaggaggaaacaactcttcattcatcctggttatttacagaacaggccaggtgcggtgctcacgcttgccattctagcactttgggaggctgaggtgggtggattacctcaggtcaggagttcaagaccagcctagacaacgtagagaaaccccatctctactgaagatataaaattagctgggcgtagtggcatatgcctgtaatcccagctagtcgggaagctgaggcaggagaatcgcttgaacccgagaggcagaggttgcggtgagctgagatcgtgccattgcactccagcctgggtgacaaagcaagacctcgtctcaataataataataattacaaaacagaaggagcctgggtcatcccagctacctacttttcaggagaatgtactcccttacccaagggcaaaggatgggagaaccagtttgattatgcatttattgagcacctactgagtcctcatccctgggctaggctggaatggactcagatggagcctgaagagtccccctcagggaacctcactagaaagaaggaggaatcggccgggcgcggtggctcacgcctgtaatcccaacactttgggaggctgaggtgggtggatcacaaggtcaggagatcgagaccatcctggctaacacagtgaaaccccatctctactaaaaatacaaaaaatgagccaggcatggtggcgggcgcctgtagtcccagctactcaggaggctgaggcaggagaattgcttgaacccgggaggcagaggttgcagtgagacgagatcacgccactgcactccagcctgggcaacagagcgagattccgtctcaaaaaaaaaaagaaagaaaggaagaagggggaatgggggagaggggccggtccctttttgagtctagccttctgcgcaggggttttcttctccaacggggagcggtggaggcagctgaggaagtttaccatgcttgctctgcgggacctgggcatggggaagcgagaaggcgaggagctgatccaggcggaggcccggtgtctggtggagacattccaggggacagaaggtcagcatggcggggtcaccccagggtctccagccgagtgaaagggaaaactctcctactgtggctgggggtggccccaacccaggtcctggaatgggcaggaggggaagccttgaactctagggctggcctgggggttctgttcactgccaccttctgtctctgtcccactgtctctccgaggctgtcatgacatctctctgtgtgtctctggtgctatcatcccattcttcctgggtctccatctctctctctgtctcttttctttctctctcctttcctctattttttgggccctcagtctatctctgtttctgtctccctgtctgtgtgatggtcactctgtttctttctccctgtctgtttctctgtccctatctgtctgtatccttctttgcctgtttagctctctccctgcgctgtccatccatctttccctgcctccctgtctctctctggttgggttcagctccaacctgctcccctctgcctggctccatcacagcctacctccctgcccccattccccccaggacgcccattcgatccctccctgctgctggcccaggccacctccaacgtagtctgctccctcctctttggcctccgcttctcctatgaggataaggagttccaggccgtggtccgggcagctggtggtaccctgctgggagtcagctcccaggggggtcaggtgagtgggtgggacccctctccaactaccttccctgaaggttcctgccaaggtcccatgagaactagctgcccttctccccacagacctacgagatgttctcctggttcctgcggcccctgccaggcccccacaagcagctcctccaccacgtcagcaccttggctgccttcacagtccggcaggtgcagcagcaccaggggaacctggatgcttcgggccccgcacgtgaccttgtcgatgccttcctgctgaagatggcacaggtgtgggaagggtgcagggaccccctctctgaatgggcatggtgacctggcaggtccccagccaggtgtccctggggacctcaattgggttcctctctctttctctctctgcatgtctctgtgagtatgagtgtctctgtgcatgtgtgtgcatcccttctctgcacatctgtctgtccctttcagggcgttgctctcactgcctctcccgcccccgacctgggcatttgtgccgggctgtctgtctctccagcatctctcctctttctccctcccacctcggcccttgtgttcaggccccatgcccagggtcctacaccagcaatccccaggatcacttcatcccatcccctgcagcctccccagacttttatgtaaattcacaattttatgtgaattatggtcatttattaggaagccttgcaatatcaagttatgttaataaagtccactttattaattatataagaacaatatttcttttccttttttttttcttttctttttaaagagacaggatctctttctgttgcccaggctagagtacagttgcaaaatcatagctcactgcaaccttgaactcctgggctcaagcaatcctcctgcctcgggctcctgagtagctgggacaacaggtgtgcaccaccacacctggctaaattttttttttttctttgtagagatagactctcactatgttacccaggctggtcttgaattcctgggctcatgtaatcctcctgctgccttgaactcccaaagtgctgggactataggcataagacatcatgcccggtcgggcacagtggctcatgcctgtaatctcaggactttgggaggccgagacgggcggatcacctgaggtcgggagttcgagaccagcctgaccaacatggagaaaccccatctctactaaaaaaaaaaatacaaaattagccggacgtggtggcacatgcctgtaatcccagctactagggaggctgaggcaggagaatcgcttgaacccgggaggcttaggttgcggtgagctgagattgcaccattgcactccagcctgggcaacaagagcgaaattccatctcaaaaaaaaaaaaaaagaaaaaaagaaaaaagacaccatgccctataagtaaactagaattaaggtgactcctaaggaaataaatagtttttaactgtacgaacttttggaagaatggggccaattctttaattaaatgcagcctccctgtttgtggagaaagaaaaatttttcttaaccctattgccccatttcttttctcttttattgaatattttttagttttaactatagtaaaatacacataacgtttaccatcttaaccatttttaggtatacagtacagtagtgttcagtacattcatactgttatgcaatcagtctccagaactcttcatgttgcaaagctgaaactctatacccattaaacaactgcctgttcctccctcctccaacccctggcaatcacctttttttttttgagatgaagtctcactctgtcacccaggctagagtgcggtggctcgatctcggctcactgcaagctccgcctcccgggttcatgccattctcctgcctcagtctcccaagcagctgggactacaggtgcccgtcaccacgcctggctaattttttgtatttttagtagagatggagtttcatcgtgttagccaggctgatctcaaactcctggcctcaagtgatccacccgcctcggcctcccaaagtgctgggactacaggcgtgagccactgtgcctggccaggaagtagactcttgatattagttctctctggttgaaatgtttttaaaaatgaaagagaatgactaataacaaaaacacagaaagttataaggattgatgaagatgtggagactttgaaacccatgtataccattggtgggaatgtgaaacgacgcagccctgtggaaaatggtacagcagttacctgaggtcaggagtttgaaaccaacctggccaacatgcagaaaccccgtctccattaaatgtacaaaaattagccaggcatggtggtgcgcacctgtaatcccagctactcgggaggctgaggcaggagaattgcttgaacccaggaggcggaggttgcagtgagccgagatcgtgccactgcactcagcctgggcaacaaagcaagactctgtctcaaaaaaaaaaagtctacttcccaaccttcccaaaaatttatctaaaccccgtgacaaaactttaacttgtgtttccgaccccaggcttggctgttctggacatttacttcccaaaggctgtgttctctcagcccctctgcctggtttctttcaggaggaacaaaacccaggcacagaattcaccaacaagaacatgctgatgacagtcatttatttgctgtttgctgggacgatgacggtcagcaccacggtcggctataccctcctgctcctgatgaaataccctcatgtccaaagtaagagccttttccacttgccaggccttgggaacagaagtcagggttctaggctgagcaaggtggctcacgcctataatcccagcactttgggaggctgaggcgggctgatcacttgagaataggagtttaagaccagcctggccaacacagtgaaaccccatctctactgaaaatacaaaaattagcgggtgtggtggcatgcacttgtaatcccagcactcaggtggctgaggagtgagaattgtttgagcccaggaggtagaagttgcagtgagctgacatcacaccactgcactccagcctgggcgacagagcgagacactgtttcaaaaaaaaaaaagtgagaattctagagggaagagtgggtgggccaagcagacaggctgagttagatctttgaggcatcgatgggcatggcgtttgagatgtcgaggagccagaagaggttcaggagttgctgattgcagtatgaggcacagtgaaaaacaaggcaggtgtctgtgggcctcatcgccttagtgatacattaggtgccttatcctgagccatggggagcaatgcaatgactttgagcaggggagggcaaggtcaaattggttttttatttttattttttttactttttgtgggggatagactctcactctgttgcccaggctggagtgcagtagtgcgatctcggcccactgcaacctccggcctcctgggttcaagcaattctcctgcctcagcctcccaagtagctaggattacaagcatgcaccaccacgcccagctaacttttgtatgtttagtagagacagggtttccccatgttggccaggctggtcccgaactcctgacctcaagtgatctgcccacctcagccttgcaaagtgctgggattacaggcatgagccaaggcacccagcccaactctagcattttcgggtcaggcagctgctgtgggccatggggacgggctgacctggaatatgggagtggaggtcctggtagtgttgcaggagtggaattagctgtgacttccagcagtgacttgggttctctgagtctgtttcctcacctaggaaatggggatggataacaatatgtacctcacaagggtgctatgggaattaagaaagtatggatgagccaggcatggtggcttatacctgtaatcccagcactttgggaggctgaggtgggaggatcacttgaggctaggagttcaagatcagcctgggcagcataatgaggccctgtctctaccgaaaatagaaaaattagctgggtgtggtggtgcgtgcctgtggtcatagctactcaggagactgaggtggaaggatcacctgagcccaggaggtgagatgaaggctattacagtgagccgtcattgtactactgcaccagcctgggcaacagagtaagaccctgtctcaaaaaaaaaagagagagagagaaggccaggtacggtggctcacatctgtaatcccagcactttgggaggccaaggcaggtggatcacctgaggtcaggagttcgagaccagcctcgctaacatggtgaaaccctgtctctattgaaaatacaaaaatgagctgggcatgatggcaggcgtctgtagtcccagctactcgggaggctgaggtgggagaatctcctgaacccgggaggcggagttgcagcaagccaggatcgcgccactgcactccagcctgggtggcagagcgtgtaatcccagctactcaggaggctgaggcgggagaatcgcttgaatccgggaggcagaggttgtggtgagccaagatcgcaccattgcactccagcctgggcaacaagagcaaaactccgttgcaaaaaaaaataataataataaaatgaaataaaataaaataaaataagagagagagaagatagatggaacacccaacacacaagatgtgtggtctttgggctcagtgagggctgggggaccactcctccccacctgtcagcctcaccccaaactacagctatgcaagcagatgggcttctgagaggaggatccctgggccctacccccgtctgactcctgccctcctcttgcttgcagagtgggtacgtgaggagctgaatcgggagctgggggctggccaggcaccaagcctaggggaccgtacccgcctcccttacaccgacgcggttctgcatgaggcgcagcggctgctggcgctggtgcccatgggaataccccgcaccctcatgcggaccacccgcttccgagggtacaccctgccccaggtgggtatgcgtatggctgccacccatggttctctgcctcggggcctgagcccgggtggtttgctgtcagtgtctccctgactttttcttgatcttagtgtctctctctctctctctctgtctttatctccctctctttctctgtctctgtcttcctcctccactcctacccccctgcatctttcttctccttctttctctgacaccccctccctttctgcatatattttttttctttttttgagacagagtctcgcactgtcgcccgggctggagtgcaatggcgtgatctcagctcactgcaacctccgcctcccaggttcaagtgattctcctgcctcagcctcctgagtagctgggattacaggtgcccaccaccacgcccagctaattttttgtatttttagtagacacggggtttcattatgttggtcaggctggtcttgaactcctgacctcgtgatctgcccgcttcggcctcccaaagtgctgggattacaggcgtgagccaccgcacccagccatgctttctgcatcttttaactctttctgtttctttttggtttgtgttttcttcccctttgactctatctctgggccccatctgccccacagatctcccaattctacctccttccaaggtggttgggacaatcgaatgaggtaacatacagagaagcagtttgaaaactgaggagcaagtccaggactaagggaagccctcttgacccttagcccctgctgcagacacattctctcctctgtctctctctctcaatctcagtgcccttcactggagagcagctccgatgcagaaccaaaagggggcgatgtttccccagaaaccccagcagtttatgcaagcagctccctcctccaccttcactgcagaatcaaacctatggcagttaggatccagtgctgctatgctgctattttctttttcttcttcttctttttttttttttttttttttccgagatggagtctcgctctgttgcccaggctggagtgcactggcgtgatctcggctcactgcaacctccgcctcccaggttcaagcaattctcttgcctcagcctcctgggtagctgggattacaggtgtatgccaccacacccggctaatttttgtctttttagtagagatgggttttcaccatgttggtcaggctggtctcaaactcctgacctcatgaactgcctgcctcggcctcctaaagtgctgggattacaggcgtgagccactgcacctggcctaccccctcctgttttgtagatggggccttgggcaaatcacttccccccctgaacctcaatatatccctcctctacattagaaacaataatagtatcaacttgaagctgtaagataatgcttgtaaaacaaacaccaactcaactcttgggaaccggtcctgtgtaccaggcagcaacaatttaatgatgataatgacaggtatccaggcttgaggacctgctctgcaccaggggttattctgagtgctttgcatatctattatctcatttaatctttaaagcaaccctataccattatcatgcccatcttacagataaggaaactgagagcttgaaaagtttttagaggatttgccaaggtcccccagcctgcaaatagtagattcaagatttgaactcagagactatgccttaactactattctttgcctttctttctttctttttttctttctttctttctttctttctttctttctttctttctctctctctctttctttctctctttctttctttctttctctctctctctctttctttcttttctttttctttctctctctctctctttcttcctttcttccttcctcccttcctcccttcctcccttcctgtcttcctctctttctctctttctttcttgacagggtctctctttgtctcccaggctggggtgcagtggtacaagcatagctcacagcagccttgaactcctaggctcaagtgatcctcccacgtcagcctcctgagcagctgggacaacgggctcataccaccatgcctggctaattttttaatttttcctagagacaaggtcttgttatattgcccaggctggtctcaaactcctgggctcaaatgcttctctcacctcagcctcccacgtggctgggattacaggcatgagccactgcacgccactcaacactccacaaatgttgatgccattaggttttgtgaactagtgtccctggcacccgagacttgtactccacactcgaggaccaaatggactggggtgggaaggggtttatagtttcattattatttcccctcagggcacggaggtcttccccctccttggctccatcctgcatgaccccaacatcttcaagcacccagaagagttcaacccagaccgtttcctggatgcagatggacggttcaggaagcatgaggcgttcctgcccttctccttaggtatctgctgcagccctgggtatcacaagcaggtgctggcgaactccaggcatctgtgccagctgggggcacccttctgcaccctgggcttactgttggctcctccacctgctgttccccccgtgggcctgggtgtgaggaatactgactcagccctctctctctctctctcctcaccagggaagcgtgtctgccttggagagggcctggcaaaagcggagctcttcctcttcttcaccaccatcctacaagccttctccctggagagcccgtgcccgccggacaccctgagcctcaagcccaccgtcagtggccttttcaacattcccccagccttccagctgcaagtccgtcccactgaccttcactccaccacgcagaccagatgaaggaaggcaacttggaagtggtgggtgcccaggacggtgcctccagcctcaacagtgggcatggacagggttaatgtctccagagtgtacactgcaggcagccacatttacacgcctgcagttgttttccggagtctgtcccacggcccacacgctcacttgactcatgctgctaagatgcacaaccgcacacccatacacaactacaagggccacaaagcaactgctgggttagctttccacagacataaatatagtccatctgcaatcacaagcacatagccaggtaacccaccaactcccctggatctgcagcccacacgtgggagtctggctgtcaccttcacaagccacagaaacggccacacatgttcacagctcacacgccctctccattcatcgaacttctcagtgtccctgtccctggtgcctggcacagggaacagcatgccccctccggggtcatgccacccagagactgtcgctgtctatggccccaactcatgctccctctcttggctacaccactctcccagcctgtgaccaccgatgtccacacacccccaaccacttgtccacacagctacccacgtacgacatcgtcctggctccccagagtatcttcccactgagacacgccgcccccacagaggcacagtccccagccacctctgcaactgcagccctcagtcacccctttttaagcaccctgattctaccaaatgcaaacacatctgggtctgcgattatgcacagagactttggacatacgaggaccctcagaccggaggaacacctgcccaaccccaacacgtgcttatgtaaccacgtggaaagcggcccctgctgcccctccacacacacatacacactcactgatctacagcccctgttcggcgtcagagtccccactagacccagtggaaggggttagagaccaagtaggggccagtttccaattcaccctgtcagggagtgagccggatctgacgttccttgtgacttaagggtccggcttgggaattaaagtttgtttctggcctttagccta

SEQ ID NO: 1671 - DNA, 47224 bp, Homo sapiens
ttagttttttttaatttatttttcttgagatggggtcttgctttgttgcccaggctgggcacaatcagctcactgcagtttcaacctcctgggctcaatccatcctgccacctaagccttccaagtagcgaggactacaggtgcacaccaccatgtctggctaacattttgtggagacagggtctccctgtgtgttgcccaggctggactcaaaaccctgagctcaagcgagcctcccaaagtactgggattgcaggcaggagttactgtgcctggccaccatttaattcttgagcattttcttttatattctaattgtccgcttctaatttggccaccgtattcacatcaaggttaagtgacttaacatctttggggataaataaggtgctgattttgtctatagccatcagtttatcatactagatccaagtttgtcaatttaaatcaggtgtgtttatgagcaaagatatgatcatgctgaatgttccatgtgtacttcaggagatacattctgctagtttggggtggtgtgttctataaatgtcaatttaatccagtcggcttatgattttcagttctatattcttactgattaatgtgtatatactagttctgttactaaggagggatgttaaattaatccctagctgtaattgtgcattagtttgtctcttttcagctgttctagcttcataaatttttggagctgttaggtgcatatacgtttaggattattttgtcttcttggtgaactagaccttttatcattaggaaactgtccatataaccactccatttttaattgtttacatggtttttccatccttttaacctatcaatcacttgaattgactttctttatagacagcagatcactgggttatgttggttttttccgtgtctcttgtcattgatgcacttagaccatttacatttaatgtaatcattgatacgtatgggtttagttctaccatttttttttctttttttttttttttttttttgagacagagttttgctcttgttgcccaggctggagtgcaatgacacaatctcagctcactgcaaccaccacctcccaggttcaagtgattctcctgccttggcctcctgcgtagctgggattacaggcatgagccaccgtgcctggcctttttcttttttaaacagggtcttgctctgtcacccagactagaggtgcagtggcacagtcatggctcactgcagcctcaatctcctgggctcaagtgatcctcaagggcctccagagtagcccaccaccatgcctggcttttttttttttttttttttttgtaagtagagacacatttcactgtgttggccaggctggtgtcgaactcctgggctcaagccattgcccacctcaaagtgctgggattacaagtgtgagccaccacacccaaccaggttatttgaacatttttaagtactgtattttctctattgtaatattgactgtcatctctgtgcaggttttttagtggttgctctaggttgaaacgctttgaattcttaggtatctaagagtgagcattttctttttttgactgctatactctcaccagttgccagcttctcatataaatattgtaaatgctctcgtttaggtaactcagcttctggagttgagggaacttcaaaatcagaagagctctgggaatctgcatttgtgctaagatttagcaaacttttttcctcgggtatatgtgtctcactgcttagagtagttggttctccagtactaggaactattgtcacatctttatctctgcttttcaaatcagagtaagtatcctttgggcaaattacattttgttccatgagagaggcaggaatattctctttgattgttggtctgtagtcagctttgtccaaggaagtaatatccccactgtttctctcttgggaagataacaaaacagtatcagattggctgtcccagccttgacttccttgttctgttatgtgtgttgactgggaagaattctgggaggagatgtgagttgattctccatcagagtcactgaaaagctttggtgactgagatccccctgccactgtggaggaagggaagttttccaaactctcatctgtgatttcatcatttcttttaaagaatacttcccactggggtacatccccatcagccttttgcaggtgaagtacagagcccagatctccttgcagtgaagctgggattcctacttcttcttcactttcactgttggattcttcacaatctacaaagtttgtgaaacgagagctctgcatacactctgctctgcagcatcctggggtttgtctcagtttttcaggctgcttttctgatactgcagtcattgaaaatacctcagggtgaaaagtttccgggtatggaactttgtgccttaaaggtattggcagaggatcatcaaagagatagtcatcttcctcctctgtgggacaaacaaaacaggtttataggaaacaaggcaaagggagccaatttgtagtatttatctgtacttttaattcttggaattgcaaagaatagggaggccactcttcttcaaagggaaaagatattcttgggatatgctgaacaatttaactgccatccttcaactttttataataaatgccagagtatcagtggagaatatagagcagtcactctgctctatatgtaagcctggctgatcattacgatcatatgcaaaacttcaaaaaaagaaaaaaaaaaaaaacaggtttctgtatctcattccagacctactgaatccctgaggaagataggaccaaataatttgatttttaagttctacagctgatatctgttcagccaggtttgcaaagcctgtgtgctctgcaaatagtagatgctcagtgggttggctgacttaggaaaattaaattgctttttattaaggtttttcttctgtgagcatcttattgacatgttttatgcacaaggttgcaacaggttaaatcaactttaaagcaaaatactgaataatcaacgtgtcaagaacttaaaattcaaaacattaataagcatgctgtgtcaacaaatgttcttaaaatgaaaaaagccttacttagaaaaacaaatattttcccatcttgtaacagtatctaacctaggaagaaagttaaatgcacccaagactactgtgtatggcaacttcttgttctactgctgaatctggtgttataataatccacttaaatgatgtggctaaacactgcatttttaagacactaatataaaggaccatagagaccattatccagctcccatgttccccgtgtgaagctaggcccagagaaaagggtgtgccaatacacacgacccaacctcattcttaaaggttcagtgttatgacttgtaactgaacttagggcttaaggtcactaagatatctaacgactgtatttggaatcatcctagactgcagaatgtagattttaagccaaagatcatatgtatgttttaggtccctcactactatgccaaagttgttttttgagttttatacagtcacagttcagcctctacctctcaggctcaggagatccacccccatgcccagctaattttttttagacagtgtttccccttgttgcccaggttggttttgaactcctgcactcaggcaatccaccccctcggcctcccaaattgctggaattagaggcatgagccactttgcctagcccaaaattacctttttatgaaatatttttgtatgatctctaagttgaacagttctgcattccaaatcagtgactatgcctgatcccaaaagacatttatcaaaaaggagtgtggattgggtagatgcataaaaggcacaaaagattaaaggaagaaaggacttttgcttccaggtaagatggagtaacggactagatttaacctcccacttgaaataacgaaaaatcagaaactatctctcaagaaaatggacatcgagcaattaaggacaatgacatgagaaataagacacagatgagtcctatgattgcctgactccctgcttcataacagattccagtcagggagggaacatctggatagagcccatggacatccttgatgtgaggtggaagtggaacattgaagaaataaatgtacctggagtttacagagcagaagaccagagaggagagtgctgcacagaaactctgaaaagctgcagaggcgtccccaccacgtgttcagtgcactaagcagcatgtgcttgtaaggaaactacctgcagccaggcaacgaatcactcaaacaaaaggaaagaaagtgcccagaactcaccgtgccaggaacagtgtcttgtcctggtcccaacagccagagtggaaaacctcatgatccatgggcatttgtaaaagaaccaagaagagccttgcctcagtagtggggaaaattaaccatatactaaatgctactctgttcctgcataacaaaggtaaaagacacgaaaagatcaaactataaacatgctaaccacatgccagaacaaagctcaagaatgtttttagaaatcccaaaattatgcaggacctaaaaaggtaaaattcagaatgtatggcattcaaaaacaaattatcagaaattcaagaagcaggaagatacagtcaaaactgactgtaaaattatgtaacatgggagtcaattttcatgatcttggatcaaatagtttcttagatatgacaccaaagcatatgcaataaaagaaaaaaatagacaaatttaacttaaaacctttacgcttcaagacaccatcaagaaggtgaaaagacaagtctgagaaaatatttcctaatcatgtcagataaaggactgataccagactttaactcttacaactcaatacaaaggtcaataatccagttgaaatgggggcaaaagatcagaatagacatttcactgaagaagttacataaatggccaataagcacatgaaagaaagctcaacattagtcattagagaaatgcaaatcaaaactgcagggtaccaccatacactaggatggctatactaaaaaagacggaagtgttggctaatatgtgaaggaactggaatctttacatattgccggagagaatgtaaaatgtattcagtgtgggaatgtttggcagttccttggagtgttaaaacagattgaccatatgttatgaactgaacgcttcctgtcaaaattcatatgtggaagccctaaagccagtgtggctgttatctagagatggacctctagggaaataattaaaccatcataaggctggagacttgatctgcctaagtgctagaattacaggcttgagccactgtgcccagcctaatttttactttttttttaagcagagacaagttttcaccatgttggccaggttggtcttgaactcctgatctcaggtgatccatccgcctcggcctcccaaagtgctgggattataggcgtgagccactatgcctggcctcctgtttaagctacctagtatgtgttattttcttagggcagcccaagccaactatatgactccaaaattctaccccccacaagaaataaaacccaacagaaagatacgtaaagacttgtactcaaattttcatagcattattatttaaaaaggagaagcaacccagatgtccatcagctggtgagtggataaataaaatgttgtatgcctgtacaattgaatattggttggcaataaaaaggtatgaaatactgatatatgccacagtatagatgtaccttgaaaagataatgcgaaataaaagccaggcacaaaatagcacatggtgtataatttcttttttttctttttgagacagagtctcgctctgtcgcccacactggagtgcagtggtgtgatctcactgcaagctctgcctcctgggttcacgccattctgcctccgctgccctaatagctgggactacaggtgcccgccaccacacctggctaattttttgtgtttttagtagagacggggtttcaccgtgttagccaggatggtctcgatctctctgaccacatgatccacccgccttggcctcccaaagtgctgggattacaggcgtgagccactgtgcctggccaatagctgggactacaggcgcccgccaccacacctggctaattttttgtgtttttagtagagacggggtttcaccgtgttagccaggatggtctcgatctctctgacctcatgatccacctgccttggcctcccaaagtgctgggattacaggcgcgagccactgtgcctggccatatgagttctcttatatgaagtgtccagaaaacacaaatctatagagacaaaccatagattagttgcggcctaaggccgggaatagtaatggggagtgactggaaatagacataaagtttcttttttgggtaacaaaaaatgttccaaaattagatagtggggatgattgtacaattctgttatactaacagtcgtggaattgttcacctataatggatgaatttatggtgtatcaattatacttcaataaagcttaaaaaataattttgtattgtggagtttataaagttaataacagagaatgtatgacaataacagcacagactgggagaagaggaatggaaatatactgctggaacattcctataccatatttggagtaatatatcatttatcttttcactctgatatgttaaagatgtatacggtcagtcctctgtatccacaggttccacatctgtagatttgactgaccacagatcaaacatatttggaaaaaagcaaaaattaaaatacaaaaaacacaaaaattgatacagtataacaactagttaccaagcatttacactgtattaggtataagtaatccagagatgattttaagtatatgggaggatatgtgtaggttatatgcaaatgtaacaccatttaatatgacttgagcatctgcagattttggtactcttgggggggtcctggaaccaatcccccaaggatactaagggatgactgcattataagccactaaaataagaaatcagtgagttacacagccaataacccaacaagagattaaacagaatcagtcagtaattacttgacctgaaagaaggccaaaaaagaataaagaacaaatggaacaaatagcaagaggataaacttaaacctgaccatatcaatgggtaccattaaactaagtggactaagcactgcaattaaaagccagaaaataccaggttggccataaaaacatccaacaacatactgcttacaagaaacccactttaaatataaagactagttaaaaatacagagatggaaaaagatacatcaagccaatattaatgagaagaaattcaaatggctctagtagattgtagaactaagaatgttaccaggggatagactcatttcctaaagataaaggtatcaatccctcaagaggatataagaatcttaaacttgtgtatacctattaatagtgcctcaaatagatgaagcaaatgccaatagaactaatcaaggcaaaataggcaagtccacaattacaactggagattgcaacacccctctctggcaataattgatagaacaagaatgtagaagacctgaacaacattgtcaactaacttagcctagttgacatttatagaacacttcatccaacaacagtagtacatatatttctttgaagtacacattaaacatttaccaggtttaatgtgtaaattggtccacaattgatggtccgtaaatattctggaccataaatttcaaaagtaccaggccaggtgtggtggctcacgcctgtaatcccaacattttgggaggcaggtggatcacctgaggtcaggagtttgagaccagcctggccaacatggcaaaaccctgtggctactaaaaatacaaaacattagccaggtatggtggcgtgagcctgtaattccagctacttcggatgctgacacaggagaatcacttgaacctgggaggcagaggttgcaatgagccaagattgtgtgactgcactccagcctggggaacagagagaatccatctcattaaaaaaaaaaaaaatcatacaaagtatgttctctaaccacaataacattaatttagataacagaataatccctgggaagtcctccaaaattcagaaactagtaacaaatttctaaataacccatgtgtcaaagaaaaaaagtcaaaggaaaaatttaaaaatgttttgaatgacaatgaaaacaagacaaatttatgggatgctgctaaagagggaaaattatagcactaaatgcctacattagaaaataaggtctcaaatcaacgacctcagcttccatattaagaaacttaaaaatgaaaagcaaataaaattccaagtaagcagataaagatcagagtggaattcaatgaaatagaaaactaccccgtgccaaaaaaacaaaaaagagagaaaatgaaaataaaaccaaaaacttcttatttgagaagatcagtaaaactggtaaacctctagctagactaatcaagaaaaaaatgagagaagacacaaactactaatatcaggagcaagaggattaatatcagtagattctacagatagtaaaataataaacattaagaacaagtttatgccaaaaaattaagcaacatggataagacaaattctttgacagattcaagttaccaaagttaactcaataaaaaaaaaaataacctgaatagtcctgtgcctattagagaaatcacatttgtagttaaaaaaaaaaaaccttcccacaaagaaaactcctttcccacccagatggcttcactggtaaattctaccagtcatttaagaaagatataatgccaatcctcgaaaaatttttccagagactgagaataaacacctcacaacaatgaggccagcagtatcctgataccaaaaccacacaattacaaggaaaagacaaaactccagatcaatatcccttctgaaagtaaatgagaaaattcttaccataatacttaaaaaggataatatgccatgactaagtgggattagagaaatgcaagtttggtttaacactcaaaaatcagtgtatgtcaccatattaacagagtataaagaaaaacaatatgatcatctcaacaaatacagaaaaagcgttagacaaaacccattatccattgttgatatctctccacctaccaagaacagaagggaagtaattctgcctgacacaaagcctatacttatcattatacttaatggtgaaataatgaacttaatggtgaaacaatgaatgctttctccttgagattgggaacaaggcagtgacacccactcttgccacttgtttcacactgtagtggtagtctagacaagaaagagaaaaacatcctggctgaaaaggaagaagcaaaactgtctatatacacaaacaatgatgatcttatatagaaaccgcaatggaatctacaagaaaaggcactagaactgatacttgagattagcaaggttgcaggatacaagatcaaaaatcaattgcacaggttgcattgcatatccctaatccaaaagtctgacatctgaactacaaaggaaatccttattgcagcattttagattttctgattaaagaggttcaaccattaaatgcaaatgcaaatgttccaaaattcaaagaagtccaaaatccaaaacacttctgctcccaagcattttgaataagggacactcagcctatatttctatatactaacaacaatcaggaattgaaacttaaaaagtaataccatgtgcaacagtatcccccaaaatgaaatacttagggattgatttacacagacttatacgctggaaatcataaaacactgctgagagaaattagagcagacttaagtaaactgagaggtataccatgttcatggatctgaaaattcagtattgttaagatgccagttcttgccaaattgatcaacagatttaaaacaatcctcatcaaaacctcaggagaggacatttttgtacaaattggcgtatgattctaaaattcatatggaaatgcagaggacctaggataaccaaaacaactttgaaaatgaacaaggctggagaacttaaagcacctgacttcaagatttacaaagctacagtaatcgagatgggtgatattggtgtcaagatagagattatgaaacataagaaagaatccagaaaataatctccacatatcttgtaaattgactctcaagaaaagtgctaaagcaattcagtgaattaagatagtgtttccaacaaatggtttaagaacatttggatatccatacagacacacacacaaaattacctgggatctacatttgaaccatatttttaaaaacaaaaatgaatcacagatctaaatgtaaaacctaaaattgtaacaacttctggcagaaaacaggagaaaatatttatgcctttgggtcaaagatttcttagatatgatacaaaaaaaagtaaaaattgataagttcacttaaaatttaaaatttctgctcttcaaaatactctgctaaaaagattgaaaagattacctacagagtagaagaaaatctttgtatacacctgatatatttaaaaaaaaaaaacaaaaaaaacttgtatccagaaacttaggaaaacttagtaatatgatgggtgcagtggctcatgcatgtaattccagcactttaggaggccaaggcaggcagattgcttgagctcaggagtccgagaccagcttgggcaacatggtgaaactccatgtctacaaaaaatataaaaattagccaggcatggtggcatgtgcctgtactacttgggaggctgaagtgggaggatcacttgagcttgggaggttgaggttgcagtgagctgtgattgtgccactgtactccagtctgggtgacagcaagactctgtctcaaaacaaaacaaacccaacaatttaaaaatgagtaaagatttgaatagacacttcaccaatgaagatacatggatggcaaatacgcacattaaaagatgcacaaccttgctagtcattagagaaatgcaaattaaaaccacaaagagctatcactgcacacctattaggatatttaaaattaaaaagtctaaccataccaagtattggcaacgatgtggagcaactgaactctcatacacttctcctgggaacacaaaatggtcaaaccactttggaaaacattttggcagtttcttaaagatacagctaccatatgacccattcttaggtgtgaaagcctacgtccatacaaaagtttgtacatgaatgttcatggcagctttctttttaataagaaagacactggaaacaacccaaaaatacatcaacaggtgaatggatcagcaacttgtagtatatccctgaggtggcctactccttatcaataaaagagggtgaactattgatacatgcaacaacatgaatgaatctctgatgcactgagtaaaataacccagacgtactatatgattctatttatatgaaattctagaacatgcaaactatagtgacagaaggcagatcagtggatgccttggcatgggtgagaaccggagggaattacaaaggggcataagaaaacttgaaggtgataatttcagtatcttaattgtagtcatggtttctcaagtatatgcatatacaaaaaatttatcaaattgtacaccttacatgtgcagtttatatcaattatacctcaggaaagctgttttttaaaaaaaaaaaaaaagaaaaaaaccttagtaaatttgtaaggattagaggatgcattacataatagagttaacatctgaaattaatggaactgtttttctaaaaccttttaattattgaaacaaaaacaaatgtggttttttttgggcaccagttataggcttactatatcagtcttggaattgtcatctaaatgttttaaaattagattctccatgagcagaaatgcagaagcagagatgagacaggcctagattagaatcccaggcccatcacttacttcttgctagtccttagggacttaagtctctaaacttcagtttcctcatcattataattgggatggtaccccttgtaagtttgtttagaggcttatctataacatatgtaagggacctagcacaatacctgccattaataggtgttcaaaaaatagtatcatcattatctcgtgtgttttggtcaagtatttactgcatggcagagtaactgactttccaccaaaggaatgaaaatcaagaatcctaaccacgaaatagggctgctggaaagccccagagctttgctcagaatctaacgttctgattactactgcagagcttgcctctgtccttcactagaaaaatcaaagtagcaatgaaagaaggtacaaagtatagagaaaaatccttctgtataaacactactgatcaacttgatcagaaatgatgatgagaaaagtctattatcagcatttactagtatcttaagaaaatgttcaaggataacaaaccagcctctctatgtcctaagaaaatgttcaaggataacaaaccagcctctctttatggcctctactgatcttagggtgtatttccagaaagctgagaacaccacacacgatggcaccgttttcaccacttgttttaacccagagaaggagagcagactcctgattttacaggctgaagacaggaaggcaaagtacttcctgagaccatgtgtcaagtctgacctgtggtgggtcccaggtccactctgcccaaggccacttctcccagacccaagctccctggaaagcagtgtttgcagggagcccacccctctgaacccaggaccatttttcttacctgagtctcggtgaactgttctagctctcttcagttttcccagtggtttatactttggctccgtactttgggaagaccggcataaaggctttaagctgaaatgaatcagaatatttgatttttccttttgaggaagttgttagaaggtagacatcattgatagtattacaaatttttttgattttgttttttaatttcttggatccctgtttttaacaaaatcttgaccataagggaaatcacacaactactttggaggattgaaaagcagttctaaactgatttcatagttaaaaatcactttgatgtaataaagtggcaaatataagcaattaaatgcaacccggttgatgtttatcttattgttacatcagtagactaaggtaaaacttagatctttgctcttggaatgcaaaaaaagcaggtccctatcctgaaaacctatgaatacagtgacatcctctggcattcgggatacaatataactagctgcttctcctgccctgttcagtagggtttacttatatctcacaggaatctccacaaatttatcttgtcattctaggtccttaggctgaaagctaagacaaagtggagataaaatacaaaaaggcagagaaataagatttgaagacgtcctacccctttcgaaggcctcactgccaactgcctcctcctggcagattccgggaagcctttaggatgatctacaacataccatttgaacagggccatgaggtgcccaacctgaaacttctttacagccacccccattttacgtcctcacccctgttcccacagctgttctctggatccatccccttcaacctttccaggagttctgatccattactgtgtctctttacatcatttcagctattctcctgggttaacttttcaaagtaaggttgtcttcccccacctacctacaacagaattgtctgctagaaatgaaggatgggggccgggtgcggtggctcatgcctggaatcccagcactttgggaggccaaggcaggtggatcatttgaggtcaggaattcaagaccagcctggccaacatggtaagaccccgtctctattaaaaatacaaatattagccaggtgtggtggtgggcgcctggaatcacaactactcacaaggcttgaggcaggaaaatcgcttgaacccaagaggtggagtttgcagtgagccgaggttgcaccactgcactccagcctgggtgacagagccagactctgtctcaaaaaaaaaaaagatgcaggataaggaatgaatatgcattttaacaagcacctcggctgggcacggtggctcacacctgtaatcccagcacttggggaggcctaggtgggcagatcacgagaggtcaagagatcaagaccatcctggctaacatggtgaaaccccgtctctactaaaaatacaaaaaattagccgggcgtggtcgcgggcgcctgtagtcccagctactcgggaggctgaggcaggagaatggtgtgaacctgggatggggagcttgtagtgagccgagatcgcgccactgcactccaacctgggtgacagagcgagactccatctcaaaaaaagaaaaaaaaaacaagcacctgaagtgattcctaaacacatccaagtttatgtatattcaagtttagttctacaggcatatttaagtctcagctattttaagatcaagcctcctgattctgttgcctcctgttgccatcttgtctctaactttcccttcactgtcaaactttttatatagtctgtcctcagtattttccatttcctcactttttacctatttctcgactgaaatctggcttgtaactcacaagtctactgaattgctctcactgagcacacacaaatgacctaattaccaaggaaacgggacacctggtagtccccatattatttgacttctcaagacactccatgggcaccctctgcttacccttccctttgctctcatcccgctgtctgggccactctctccatcttggcccagcttctcctccttcacttctaccttgaatgtgctgcccagggttctggcctcagctctatgatccctcctcccactcctggtgacttcttcttttctcatggttttagttctcacctgcactgccaactccaattctgtgtctccaacccagacctctctccagagattctccatcctcctttccatcgacatctgcaagcctggtcctgtctgtccccatcggggtctgcgaagcagattccctgacacggggcctcattccttctgcacccattgagcttgtgtgctgcctttgcacccggcctctccgtgagactggagctctgctaggacaggctgtgtcttaggcaaattggaacccaagctccattcccaccatatggctggcactaaagaaatcattcatgggccgggtgcagtggctcatgcctgtaatcccaacactttgggaggctgagacaggtggatcacttgagctcgggagttcgagaccatcctggtcaacatggcaaaaccttgtctctactaaaaatacaaaaattagccgggcatgatggcatgcacctgtagtcacagctactcgggaggctgaggcaggagaatcgtttgaacccaggaggtggaggttgcagtgagccgagatcatgccactgtactccagcctgggtgacagagtgagaccctgtctaaaaaaaaaaaaaaaatcattcatgaatgcataaatgaaacccaaagaagaggtaagaaaatggtaatactgtagtaaaagacatccatgaatacgattgcacctctcctttggcttcagttatccattcagtagacacttgacaacctacttggcatggtgctaggtgcttttcttacactatctccctgtatcatctctttcttttttaagaagaccaacaagtaggcatcaatattcctattttgctgattcagaatgactagctcagagaagtgatctggccaagctcacactgcactgttagtaagtggcggagctgggttgcaacccaggagaagctgacaacactacctataccttctgccacactgtggaactaaaggaaacactccaggaaaaaatggaaatgagtatcagttcagaaatgtcccaaaacaaacagattctagacttgtaaacattcaggcaaactctcctttgtgtcctagccaagagccaccaagggggacaccaagtcccacaaccagtgactactcacatttcgacaactttatccatagttgtgccaactggaatgacatttggatatgcgttcacaggacagaggtagctcaagaaatctttaatctagaaaaaggaaaatcacatggatcaacaatctctacgatgaaacaggttgttaggggagataaagggaggctggggaaagagaagcagaactctcttatggctgtggttctcaatgctggctgcacgtggggatcaccagggacctcttgggaaaaaaatatccaatgcctgggcctcactcccaaagatctcctgaacactgagtactagtgggcctagaaatcagtacatttaaatattccccaggtgattctgatccacagtaagagctgagaatcaccaatgggactcaaagattcttttttttttctcttttttaatatattgctttccttgtccaagaaggtcagttgcttatgtttaacaaatcccttttcaaataagttagaatttagctgggcattaactataatatacacaaaaacccaaggtctcagaattgcatttcttagctgggcacagtggtacatgtctgtgatcccagctactcaaggctgaggcaggaggattgcttaagcccagggatttgaggccagcctgggcaacacagagacacctcatctccaaaaaagaacaacaaaagaattgcacttatttactcctaccaataatcattaacgatgccaagagaattacacctttgaggttacttgatttgttcaaatggttcattctcattgggcagaacaccatgcattcgtcactgattccagggaaggatccaaacactgcccattgtaccttggtgttggagtcaccaaggaaaacacaatgcagtcaagcactggagggagcaatgcttcacttactgagaaaagaccaagcaagatcaaatccaacaatgtgcactggtctccagtgaccagtgtgtctctccctgcagccaacacagggcaacctgcctacatgcaaccctctcctgccacacaggaaggaacccccatcatgctgtctgaaataaggacagctggggtgtgcctaagggccattgacacacaggcttaagtagaacaaagggacacacatcaagtacgaagcagagaaagatgtttccacacaaggtactgagctgccgcaggctgtgtgctcacgctaacgggagtgcttgctctctctcactcgcgtgcgctctctctcaataaggaagtgtcccattcttatgtggccagtgagggttgaaagactgtgcacatagactgcctctcccaatgattaattctaaacaaacaattacatgcaaaaacttcatgaataccttgactttttgcaaagttcagaatgctaaacagaggaactctgtcactattcctcaaaacatctctacaacctagaggaacttcagctttgtctcttattagacattggtgagcttgtgatctcagtcaagttacctaatgtctctaattttagattcttcatttaaaagtataaatgagattatgcatgtgaagtgcttagcttggtatctggtgaaacagtcaataaaatcatccaggccaggcgtggtggctcacacctgtaattccagcactttgggaggccgagccgggtggatcacaaggtcaggagttcgagaccaacctggctaacacggtgaaaccccgtctctactaaaaatacaaaaaattagctgggtgtggtcgtgggcgccgtagtcccagctactcaagaagttgaggcaggagaatggtgtgaacccgggaggcggaggttgcagtgagccgagatcacgccactgcactccagcctgggcaataaagcgagactccatctcaaaaaaataaataaataaaaattaaaaaattaaaaaaaaaatcatccattactaagttgataatgagaacacaaagacttttatgcccttctgcaaatggacagactagaacccaatgtaattattagtatcccaccaaactgaaagaggcagaaacccaagaattgccaataactctacataaaaataaaagggctactttaagacagtggaaaggcaggaagatctattctttaaatagttttcacaaacagtatcttttgtaccttcacaggaggcatgcaaatagaaatcattacctgcccgcccaacaccgatttgatttgcacaaagctgaggctggtagaaatctgagacttttgaagggaataaaggatttaaaaaaaaaaaaaaaaaaaaaaagtaaagtcaagcctataccagaaatggttcactactacttctcagagatgaaatggccccaaggagataagagacacccaataaaggagcaccccctctcatttatataagttgactcccttttatcaaatgcctgccttaaaataaggcatcaatagcgccaattctctttattcacagtagttatactctataaattatagtcaccataaatgctgaattagcaaatactgagccattgctgctagggaaaatacagggttcctgccatcctttggtgacatcgttttcaccagccaattaatacataaccttgttttatgtgtgtttctgttgaaagacaccttatttaatagacactttgatccattaacattgaactcatggtcaatagccctataacccatgcctatctaacatacatattttctctagaagccacgttacagtcctcccgtgcttaggaacactcgataggacttcagtattatgactggtcaccatttaaataagatcaccaacaaaaagcacaaaaatatgaaaaacatggcacttaatagatggcaaaaaggaaactttcgatatggtttggctgcgtccctacccaaatttcatcttgaactgtagcttccatcatccccatgtgtcggagggaccagtgggaggcaatttaatcacgggggtggctacctccatactgttctaatgacagttctcacgagatctgatggttttataaggggcttttccccactttcactctgcacttcttgctgccgccatgtgaagaaggatgtgtttgctatgattgtaaattccctgaggcctccccagccctgcggaactatgagtcaattaaacctctttccttcctcatacccatctcgggcatgtccttagagcagcaggagaacagactgatacacttgttgacagagtaagagctgaaagaaggcagagcattgccttgttctacctgagccgagaacgtgcacgtcaggtgattcaaaattttcaccactctccacaagtccacaaaggatcacaaaagcactgtaaatattgatactgaggtcacaggtcagtttcagtgagtaggccaacacataaaaatagaatccatgaagccaggtgcagtgacttacacgtgtaacccagcactttgggaggccaaggcagacggattacctgacgtcagttcaaaaccagcctggccaatgtggtaaaaccctgtctctgctaaaaatacaaaaattttagctgggcatggtggtgggcacctgtagtcccagctattcgggaggctgaggcaggagaatcacctgaacccaggaggcagaggttgcagtgagccgagaacacaccactgtaccccaacctgggcgacagagtaaaacactgtctcaaccaaaaaaaaaaaaaaaaaggaatccatgaataatgaggatgaactgcatttaggaaaaaaaaactaaaaggaaatgaaacttacatagaaacagagatgcttctgagagtcaggggactacctgtcaactaccaaggctgcagaacactgagcgataagggttatgagtatatgggatcctcttacctcactgtaggaggagtgaaaagaaaaacaagctctgtatgaactctctccagtcctaaagggaagtgaaaacacaaaataaaaagatcactgagcaaaactaaaactaagcaaagctggcccttctcatttaggctattctagcatgaaaccactctaatgggctcgcttcagcagcaagtgtcgaaatcaccctaaatcaggaatttcttcttgggatagcagggaaccttttccagaagtggaaacctgttgtagaccgcgtgtggtggctcacgcctataatcccagcactatgggaggccgacgcgtacggattgcctgagctcaggagttcgagaccagcctagcaaacatagtgaaactctgtctctactgaaaacacaaaaagttagctcggcatggtggtagtacatgcctgtaatcccagctactagtgaggctgaggcaggagaatcacttgaaccgggaggcagaggctgcagtgagctgagatcacaccacttcactccagcctgagtgacagagtgagattctttctccacacaaaaaaaaaagaagggagggagggagggagggacctcttgcagatattctgaacagccaaagttaaggaaatgttgctaaaatattaagatcattatagtcactcctctattccaccaagggttctgttctctctgacatcagtttttcctcttagccaagcactcagatgggagggagggagtggggggggagaaaggagagggagggaagaagggatggaggagagggagggagggagggagggacctgttgcagaaattttaaacagccaaagttaaggaaatattgctaaaatattgtgatcatgatagtcactcctctgctccaccaagggttctgttctgtatgacatcaatttgttactctaagccaagcactcagatgccttcagtctccaaccatctcatcaacctacccagagggaacctcaggatacaccagctgatgggagtgtaactggtttgggagtagcatcccctccatttaaataaaatttaaatttaagaaattaattataatatataattatattcttgggcttaggctagactgtgcttaaatgaaattaaatcagacaatttactcaaagtttctctcagaagacctatgatattgctctcttacctcacaattacatttgtttttctgctcctttctccaaaccacatggtggatggcttaatgctgattatgtggagtggaattctatttctggaagtaattccacagggtaatttgctccactgaaaatattcctctgcctaaaaaagataaaaagcatagaaaaacagttctacattttctacaaatctgttgtaggcagagtctcaaaaacaaaagtagaaaagtttccagacacgaaaaaataaaaaataaaaaaaaagcagcaaaacaatgtagacatgaagaaacaatcagataattccaaattggggaatattgtgcaaaacaactgggctggactcttcaaaaccatcaatgtgaagacaagcaaaaggctagacaaacgatctatatatcaaaggagaccctttagacctgactgaacgcaatggacgaccctcaaataaatcctggatgcccctgtccccctattctacaagctataaaggacactatgggaagaactggggacatctgaacacggactgtgtaacagctaatagtactatatgaacacaaaatgttctgaggaagggtattgtactgtggttatataggaaaatgttcttattctcaagagccacaggctgaaggatttggggtgacgtaccatggagtctgtaactactctcaattggtttggagtggggagttggttataagtacagagacagaggaagagaggtgcaaagtgttggcaacgcagcaaatccaaacgaagggtgtatggtgtttttttttttttttttagacagtctcgctttgtcactcaggctggagtgtggtggtaccatctcaactcactaaaacctctgccttctgggttcaagcaagtctcatgtgtcatcctcccaagtagctgaaattataggcacacaccaccacacccagctaaattttctatttttagttacaggatttcaccatgttggctgggctggtctcgaactcctgacctcaagagatctgcccaccttggcctcctaaactgttggaattacaggcgagagccactgggcccagacccttgtaccagtcttacaactttactgtttaagaagttttcagggccggttgtggtggcttatgcctataatcccagcactctgggaggctgaggcaggtggatcacttgaggtcaggagtccaagaccagtctgaccaacatggtgaaactctgtctctactaaaaatacaaaactagccaggcatggtggcgcatgcctgtaatcccagctacttgggaggctgaggcgggagaatcgcttgaacccaggaggtggagattgcagtgagcccagattgcgccactgcactccagcctgggcaacggagcgaaactctatctcaaaaaaccatttttttttaattaaaaaaaaaaaaaagatctcagcctgggcaatatagtgggattccatctctacaaaaaaatgtaaaaattagccaggtgggtggtacacaactgcagtcccagctattcaggaggccgaggcaggaagatcacttgagcctggggggtcgaggctacagtgagcaatgattgcaccactgcactccagcctgggtgacagagcaagactctataaaataaattcattaattcaaattaaaaagttttcaaaataaatttggagggaaaaaaactaacaaatacaagtgttttcaaaaggttgaaaaaaaatgggacaacttttccaaagtcattattttgaaatccagaaccttccaaaccattaacgttccatcccactcaaatttctttggggtgcctttggtgctgtttcttaggaaggtgcagattagagttaagagtggactctatgagctgtggacctacctgttaatattctaaaggagtgcgtgacctaaaaaaatcttttaagcggctagaaatagcatctcaaggaaagtagccctgacagcaaaggaattactaactaagctactttgtgggatgtgagaaaattcacagcaaaaagaaatttgccaattcaaggatttatggggcaaggggcccaatactatgagtccaacagaaaaagggacaaaaaggtgtatgttttatttatttacttgagacggggtttcactctgtcacccaggctggagtgcagtggtacaatcttggcttactgcaacctccacctcccaaactcaagcaattctcccacctcagcttcgtaagtatctgggactccaggcatgcaccaccacactcagcaccttttttttttttttttttttttttttgtattttttgtagtgacggggtttcaccacgttacccaggctggtctcgaactcctagactcaagcgatccacctgccttggcctcccaaagtgctgggattacagatgtgagccactaagtttatgggttttgtttgttttttttgaggcagagtcttgctctgtcacccagactggagtgcagtggtgacatcttggctcactgcaacctccgcctcctaggttcaagtgattctcatgcctcagcctccctagtagctagggctacaggcacacaccaccatgcccagctaatttttttatttttactagagacggggttttgccacactgagcagactggtttcgaactgctgacctcaagtgatccacacgcctcggcctcttaaagcactagcattacaggcatgagccaccacacccggccggtttacgttttatgtatacatttttatccatccaagaatccactggacgtgtctgtatatgtgaatatatatgtgtatttatatgtgcatacatgcacacaaagtgaagaaataaatccctgaatgcaacatagaatatgcagcttaccaatcagcaaaaataatttacactgcagctctcaccgtggcctacaggaaaacattccatgctgtggatcagaattctctcttgtttgaaattatgctttatcgtaagggctaggcaactaggcttttggctaatggaaccattattactacaataatagtgatctaaatgaataaatgcaatgtttactttaaaaattacacaggatttaatgctaaggtattttaaaatttagagaaaaataatgatcactcaaaccactacatttaaagatcactaattagccttaataattttaattgaaacaatattttttaaagcaaattcaaaatgaaagtcttgtactcagcgtttgacaagagaaggaggttctgtgttggcattagaaaacgaatgaggctgggtgtggtggctcatgcctgtaatcccagcactttgggaggccaaggtgtgtggtcacgaggttaggagttcgagaccagcctggccaatatggtgaaaccctgtctctactaaaaatacaaaaattacccaggtgtggtagcgggagcctgtaatctcagctactcgggaggctgaggcaagagaatcgcttgaatgtgggaggcagagcttgcagtgagccgagatggcaccattgcactccagcctgggccacagagtgagaccatctcaaacaaaaaaacaaaacaacaaaaaacaaaagaagacaaatgacatgtgacttgcaaagacactggaaacatccattagaaataggaccatcaagacatgaaactattttaaagtgtgaaaaaaagttatgtctagatatttatctcaagtagaagaaaaagtttataaacacgctcatgtcatgagtctcaaaaagcacaggatgggcgcagtggctcatgcctgtaatcccaacactttggaaggccaaggagagcagatcacttgagatcaggagttcaagacccccctggccaacatggcgaaaccccatctctacttacaaaaattagccaagcatggtggtgcatgcctgtaatcccagctacataggaggctgaggcaggagaatcgcttgaactcaggaggcagaggttgcagtgagccaagatggccccactgcactccaacctgggcaacagagcaaggctcgtctcaaaaataaataaataataaataaatcaataaaattacaaaaattagccagaagtcatggtgcatgtcggtggtcccagctacataggaggctgaggcaggacaatcacttgaacctaggagatggaggctgcagtgagccaagagtgggccactgcactccagtctgggcaacagaaggagaatgtctcgaaatatataaatacatatataaatagcacaaatgtttaagttataagctataatatattactgatttcattacaaataaatttgaattatcaaacgtgtatgaatagatttcatcagaaaactataaagatctggttgggggtggtggctcacgcctgtagtaccagcactttgggaggccgagggaggcggatcacgaggtcaggagattgagaccatcctggctaacatggctaacctcgtctgtagtaaaaataacaaaaaattagccgtgcatggtggcgggcgcctgtagtcccagctactcaggaggctgaggcaggagaacacgtgaacccagggggcggagcttgcagtgagcctagatcgcaccactgcactccagcctgggcgacagagtgagactccatctcaaaaaaaaaaagtacagatctgtgtctatttactagtgacgaaaagtgtggtcatggaatatggcaatgtacagttccatgaccttgagctaacaacttaggattgcagcctcaggttttacatttgtaaagcgaagagcctataaatggaagccctgacctttcttctttttcatagattacacaaacaatacgagaggaatcacttgcacacgtaccttgggatgccggcatgcatggatctgagtgttgcggtctgttgtgagatgatgaaggatctcaggcatgttcctaaacatgtctagcttattcacatgaacctaaggcaaataatacatacatgcaaattatgtgaaatgtatttcctataaattgttcaaggttaattactcagggcaaaacacccagttagtgaattaaccctctcttctttcttgaaaagtagtttttggctattcagtgcactctggtattccgccagcatgtcaacaggcacaaggctgactggccaggatcgctgccatcactgacgtcagtgaacaattatggacactcggctcagggatgtcatttaatgatgttaatgttgtccttcagtccttcaagagaaattcagttaatattcctcgtacacctactatgtgtcgagctttattctaaatgctgggaataaagcagtaatccacacagacaaaaacaatcaagaatcatctaccctcagccaggtgctgtggcttatgcctgtattcccagcactttgagaggcggaggccggtggatcacttgaggtcaggagatcgagaccagcctggccaacatggtgaagccccatctctactaaaaatacaaaaattagccaggtatggtggctcaggcctgtaatccaagctactcgggagtctgaggcaagagaatcacttgaacccaggaggcagaggttgcagtgaactgagaccgtgccactgcactccagcctggacgacagagcaagacagtctcaaaaaagaaaaaaaaaaatcaagaatcaccttaaaggcatatacatgatgtacaacagaggagcatgtactgcaaataatccactgccatatctccttgttcaaatttattttcaatgctggtcacaatcactaaatttatttcatgacccaaagtttgggaaaaatactttgtctatgcggcatttcactgaaggctcttgtaagccattttggcttctgtcaattttctcccaggaggatgtgactgaactaagatgatatattccttcagagggcccgcgaacctctgctgcagacacgtcttgttagggtgcttccatctgtccctgtttgcagttatttagcaggcgaggagggggaggaaaggtgagctgggaggatggaagggagcaagagaaaagaatgaacagactgggaacactggctcaggcctataatcccagcactttaggaggccgaggcaggcagatagcttgaggtcaggagttcaagaccagcctggccaacatggtgaaatgtcgtctgtgctaaaaatacaaaaattagctaggcatggtggctcacgcctgtaatcccagctactcaggaggctgagccaggagaattgcttgaacccgggaggtggaggctgcagtgagccgaggtcgcgtcactacactccagcctgggcaacatagcaagactccctctcaaaaaaaaaaaaaaaagaaaaaagaaaagaaaagaatgaacagtcaccatacctggactcctaattcttcactaaggttggtgaacagatattcatagccataagccgctttgcagttcagccacacaacatggtacgggctccgagtgatccagcttcggaccagctctaagactccacttaaacactcctcctagacaggattttaaagagacatttaacaggtggagagccgcacatagccttttccttcccaacagtcccaggtactcacacctacggggacagttaggatatgacctgtcaccctacaaacttcctactaaaaacacgggcacacccagatgataaccctgttcctccaggcagacttacccgacttggaatttggtaaaatcttggatcacagaacgtagtatccaaatatacactttggatgtctttgactctgaaaagaaaaaaaattgatgttagccatccaatgtgatataaattatgtgtaactttttttgttttttgagatggagtttcgctctgttgcccaggctgaagtgcaatgtctgctcactaccacctcctccacctcccgggttcaagcaattctcctacctcagcctcccaactatctgggatcatgggtttgtgccaccacaccttgctaatttttgtattttttagtagagacggggtttcaccatgttgaccaggctggtctcgaactcctggcctcaagtgatgcacccacctcagcctcccaaagtgctgggattacaggccagaactcccaaagtgctgggattacacccggccagagcaataaaactttattcagtcatacacagaagaactgtacaagaggccaggcacagtggctcatgcctgtaatcccagcactttgggaggccaaggggggcagatcacctgaagtcaggagttcaagaccagcctgcccaacatggcaaaaccccatctccactaaaaatacaaaattagctgggcgtggtggcacgtacctgttatcccagctacttgggaggctgaggcaggagaatcgcttgaactctgggcgacacagcaagactccatttcacaaaaataaaataaaataaaataaaacctatacgaggcccagtacctgcccccggagtgcagaagctccattctagcagcttctccttgcgccaatctgaagtctcctgtgtacaggacagttccattattgccctgaaataaaaacctgaaaaagaaatatatcccagtgacttctgagtctcatataaactcccaataaagcaaatacatgtgagctgcatactaaatgcttcctgcaaacatatccattacaatacaatggtaatggaattccacagtaatttgaaccacaccaggcactcagctgtcacctcttccctcgggtagaaaataacagaatggagatgctacccagtttgtaatagatgttccttgtgatatgttagcactttcaattatatgttgagatcattcttgctcatggagagagaaatacacgtgatgataaaatacaaggtcactggggaaacagctgctgaagacttccatttatttatttttattttgagataagagtcttgctctgtcccccaggctgcaaggcagtggctcaatcttggctcactgcaacttccaccttctgggatcaagcaattccccagtagctgggactacaggggtgtgccaccacacccggctaatgtttatactttttgtaaagtcaaggtttcaccatgttggccaggctggtcttgaattcctggcctcaagtgatgcacctgccttggcctcccaaagtgccgggattacaggtgtgagccaccacacctggccatgaagacttccattttataagaaacgtttcaaatctgatcttcacctcagtccccctagttcaatttgggaacaaatgtgttttaaatgactagaaaaaaaatcaaatctccctctatgtattctttctttctttttttttttttttttaaaaaaaaaactcactgcagcctccaactcccaagctcaagcaatcctcccgcgtcagcctcccaaagcactgggattacagacatgtgccactgcacccagccccctattaattttagaccctaaaaatttatttctacaaatacaatatgtgtctacatataataaaatgacaaaataaatgacccccttacataactgatcccggacagtgaccagctggtaagagagtcacaacaatctcttccttctaaaaagaaaataaagaaaaaatagtaatggaaagcagttatcattaggacctagctcaacaaagccctccttcacagaacacatttatgtaccttttaacaatgtgccttttctcccaatttcctcacactccaaatcctagaaacaagtggaatccttgtccactcaacaaacagaattcccatgggactgagcaatttcaccactagttatagaaccaagataagcgaaaaccgatggccacacaaaaatgtgtgcctgactgttcacagcagcattcttcatactagccaaaaggtggaaccagttcaaatgtctatcagctgatgcatcaatcaggaaaatgtggtctagccatacaatgaaatattatttggccataaaaagaaccgacacgtgctgcaacatggatgatccttgaaaacatcctcagtgaaagaagccggataagaaatgaacacatgttgtatgattccactcatatgaaatatccggaataggtgaacccatggagacagagagtccaatacagtagtggttgccgggggttggggaaggagagaatagggagggattgcgatcgctaaaggcttcttcccttggggtgctgaaaatattctgaaattgattgtggtgatggatacacaagtgtgtgactcgatttctatctcaataaagctatttacttttttttttttttttttttttgagatggagtctcactctgtcacccaggctggagtgcgatggtgtgatcttggctcactgcaacctctgcctcctgggttcaagtaattctcctgcctcagcctccccagctgggattataggcgcctgccatcacgcctggctaattttttgtatttttagtagagatggggtttcaccatgttcgccaggccagtcttgaactcttgacctcaagtgatacatctgcctcggcctcccaaagtgctgggattacaggtgagagccaccaagcccggccactatttaacaatttttaaagcctgagccaggtgcggtggctcatgcctgtaattctagcactttgggaggccaaggtgaacgaatcccttgaggtcaggagtttcagaccagtctggccaacatggcgaaaccctgtctctactaaaaatacaaaaattagctgcgcatggtggtgggcagcacctgtaatcccagctactcaggaggctgaggcaagagaatcgcttgaaaccaggaggtagaggttgcagtgagccaagatcgccctactgcactccagcctgggcgacagagtaaggctcagtctcaaaaaaaaaaaaaaaaaaaaaaaagattaaagcctggatgaggcctggtcccgattcacactgcacatcatactgttcggcaagggcaagacctgcaggcactactgcctctccagccatcagtaagtggggagagctctgcacacaccaggtcactgctcagtgacagggactcctcatggaagtctccattcattctggaggaccctttcgagtgggtctccccctggttggagctggataaacaatgcataaaagtcatggcacacaggaagaaacataaaaaatcaaagtggtggcaggactgctcaaaagtcagcctgctgtcggcccccagttcagggaatgcctttcaccaatatccctgattgtgacaaggccacagaccaccacagtattccccggaaaagcagttggcagagtccaggatggcatttacaaaggttcacctattttttttttcctttttaatcctcactaaactggctctgtagtcctccctcaggataatttgatgggaagaatacttcaacttcaactgtctgatcttcaccaaagaagaaatatctgaaaaggtcagtttctgttcaacaacacaacacaccctcaaagttaaacacggcaaagcagtgtgctataatcaagcaacaaagccaatattaaccaaaataggaaaatacctaccagctgtaaaggttaaaaaaaggggggctgtatgtctatagtcctacttattaaaaccatacattcacaaaagtactacctcaaaatttaatgatgaaaaataatttttttccacttggcagagccccttttctgaataagggttcagaaaaaaagtacaatattcatgaattacctgcaaaaatattaatcaccattttaaattctgagcattataaaactcagtaaatgtgacaataacatcatgtagtaatatcaacaccagggttcccatcattagcatgtaataaggaacaaatgtgacaaaaaataagccatgcccaatcctttacaacatgggaaataaatacatcactgttaaggactaaatgttcgtgtccctccccaaaattcctatgttgaaatcctaacccccaaagtggttttattaggaggcttttgggaggtgattagttattgggcatagaagccttgtgagtgacatcagtgcctttataaaagacacccaggggagcttgtctgcccctttactatgggaggacacagggaaaaagacagcatctaagaaccaggaagtggccaggcacagtgactcacgcctgtcaccccagaactttgggaggccaaggcaggcggatcacttgaggtcaggagttcaagatgagtctgaccaacatggtgaaaccccttctctactaaaaatacaataattagctgggctctggtcgtggtggcaggcgcctgtaatcccagctactagagaggctgaggcaggagaatcgcttgaacccaggaggtggaggttgcagtgagccaagatcacaccactgcactccagcctgggtgacggagtgagactctgtctcaaaaaaaaaaaagaaccaggaagtgggccctcaccagacacgaaatctgctggagactggatcttggatttccagtctctagaaccctaagcaacaagtgtctattgtataagccactcagtctacggtagttttgtgagtccagcccaaatggacttacacaatcacaaagggatttttttgcccctaaaaccccactcaatgactagatttttatttatggttaaatgagcattcaaaatcaaagagaaagattgagggtatagctgaggggtggagcatctgactgcaaaatcaaagagaaatataaacaatcattttagcaccacatttttttaaaaaaatcaatatttaatatttagttacctctcctgatgcttcatccactaaagatatctgggtaggagtctcgatttcaatagatatctataaaaataaaataagagaccatgtatatagcagtttttcatggctttatatgcctttgctgtctgaaacacagaaatggggcaaagagaagtttcagactctctatataaacaattccgattacattgtaataaatattttaacagttagaaaaaattgtaaagaaaataatacctgtcttgaggcagatttggtaatacggagtaaacgccttgtaaatgcatataatcctctgacacaattctgtttccatgaattcatttttcctccttcatctccccatccctaccactcccattcccctctctctctgaattctgagtctttgtaaaaacgtggtcctgtgtcctaacttttgtgcctcagaacacagtctggatgggtctgtgacatggatgcttcatacacggttcttttattttttttttttttctcagatgcattctcgctctgtcacccaggctggagcgcagtggtgtggtatcggctcactgcaaccaccgcctcctgggttcacgcgattctcctgcctcagcctcccaagtagctgggatgacaggcgcccgctactacgcaaggctgagttttttgtacttttagtagagacagggttttgacatgttggccaggctggtctccaactcctaacctcaggatcaactgcctcagctttccaaagtgctgggattacaggcgtgagccaccacacccagcctcatgcactggttctaagtgctgccgaacgctccctggtacatttccccctgccatcaaaacagagactagcacataagaggcattcagtaagtatctgatgaatagatcaatgtgatttttcacctttttagtccactaatgtcctaaaacttacagtgtctaaggtttgggtgttaaagtatttttgcatttctggaatgaaacatcttattcatgatgtactatttaacactgctagattcagttactgtctttatgaggattcttacattttcatgtatgaaatgggtttttccccatttattatttttgagatagggtctcgctctgtcgcccaggctggggcgcagtggcacgatctcagcttgctgcaacctctgcctcccaggttcaagcaattctcctgcctcaccctcctgagcagctgggactacaggcacccgccaccatgcctggctaatgttttgtagcagagatggggtttcaccatattggccagactggtctcgaactcctgacctcaggtgatccctccacctcagcctcccaaagtgctgcgattacaggtgtgagccactgagctagtcctcttttctaatatatctatttaatgctatcaatttcccttcaaggacaaatttagctatgttccacacattctgacatgccacatttccattgtccatcagctcctttatttatttatttattttgagacaggctctcgctgtgttagccagcctggagtgcagtggcacagtcacggctcactataacctcaaacttcggggctcaagtgatttttctgcctcagccttctgagtggctgggactacaggcacactctactataccaggctagtttttaaggtttttttgtagacatggggttttgcagtattgcccaggccggtttcgaactcctggactcacacaattgtcccaccttggcctcccgaagtgctaggactacacatgagagcccccaagcctagccatatcagttctacatattgtatgttttctttatcgtacaatttcctttttaaccaaagggtcagttattgtatgcatttagtttccacgtgtatgggaagattttagctgtccctttgtttctgatctccaacatcattgccttcttttgtgacacagtacatggttagtttttgtaagtgtcatgagcaccccccaaaatactattttcttccttgggtttaaagttctgttcattagtccacattcacacattttctgcatcctgtttcctgcctccttctttcagcatctgggaggggcatgttaagctcttcagtgacaattgttgatttcctatttcttgccctgattctgccgtggccttgtttgtactatgtcaactcacctaagctggaactgtttcctagaacccctttccatgttgttgcccacagtaaacattaagaaggcagatgtgaactagtagggattttttaatgctctgaagggcgccagaaatggtaacagctagtgaacattgctgaccttctggcttaactcagagtctggggcagggccgcagcaacatcagcttctgctgggtgcccgtgtgcagctcctccgagtcctggggcaggtgcatgtgcttcagagccaaagcgggagaccagcactattgaggccagaggaagtgagagacagaagtgggtttcggtctgtcctagtgggccattctgccttccagtttgtctctgttcccctccacttctcttccagctttccttcctgactgctggccgggctgacctgtagtaacttcaagctgaatgccagagacaacaggaacaaccctgctgttgtgactgctctgcagagggaggacaaatccccttctcaatcaaaggtcagatgtggaggtggatgatatcatgcacacaaacacacgtgcacacactatgtgtgcatactcacacacgcatgcacatacacacacgcgagcacacacacgacagagaatgagaagaaaacttcagtcacatcacaggactttcggggagggcagtgcagtccctgagctggggacagaagtgtttcctgtggcttaagagagagtaggagcaagtagccctggtttccactttggtgcgggttgggcctggacatgcctggtttgaacttcgccttagtgctaaggcaggcatgggcctttttgtcagcttgcccaaatgtgggtaggagggaggcactggctgcaagcagcttaagagcaaacagaagcccggcatagtggctcacacctgtaatcccagcccttgggtggccgaggcgggaggatcacctgagggcaggagtacaagaccagcctcgccaacatggcaaaaccccatctctactaaaaaatacaaaaattagccaggtgtggtggttcaggcctgtaatcccagccactagggaggcggaggcagggagaattgcttgaaccggttagatggaggttgcggtgagctgagatcacgcctctgcgctccagcctgtgacagagtgagactatctcaaaaaaaggaaaaaaaaaagtaaacagactctttgtgacactgggacaaattgctctgccaactcccacaatgatttaagaactaatccatgtaatgaacccacattctgttaagtcattgtggttctcctcagatcaagcactgggtgacaggttctcgcagtttctacttcagctggatgctattttgtcaattgcacatacgtccatatgacccatggctccttttaacagtgacaccctcttcaaaccttgtctttctttgccttctagtctactttctgatattaaaaactgccactctgacattttggccttctgattggttagtaattttttcttcttcccccaaaatttcaaatttcaacctgtatttatccttctgttttatctatgtctcttatagactaatactcatgaatttgtctaacttttttgtttgtttttgaagatggagtctcgctctgtcacccaggctggagtgtagtggcacgatctcagctcactgcaacctccgcctcccaggttcaagcgattctcctgcctcagcatcccaaggagctgggactacaggcaccgccaccacacccaattttttgcatttttagtagacacggggtttcgccctgttggccaggctgttctctatctgacctcaggtgagctgcccgcctcggcctcccaaagtgctgggattacaagcgtgagccactgggcccagccagatttgtctgatttttttaacttaaactgagaatttgtcttttgaccaaaggtacaattaaatcctttcctatatatagtcatatataattggactttttctgccttctttgcattttctattcaccagactttttcctccccttgactacctcatattggacagatgcattttattctgccagaccgaaagttacccattctatctgtattcttctagctgtcatcccttccttatgacagcctgtaatttgtttatttttcttactctatcccacaatttaaataaaaggatttagcaattatgttaatgaacactttacactctaaaatattaaaatgtggccaggcatggtggctcacacctgtaattccaacactttgggagtggatccacttggaaccaagtgggtggaaccaaggtgggtggatcacctgaagtcaggagtttgagacctgcctgaccaacacagtgaaatcctctgcctactaaaaacacaaatattagccgggtatggtggtgggattctgtagtcccagctacttgggaggctgaggcaggagaatcacttgaacccaggaggcagaggttgcagtgagccgagtttgagccactgcactccagcctcggcagcagagcgagactccatctcaaaaacaaaaaatagaaaatattaaaatgcatcttagcaagagggtcaatgagattaagcaaacaaaactgagacctagatctcactcttgaggaagaaggaaaacatatcaacaactaccaaatgttgacttctgccatattgttcaatgccaacagacttaattttttttttcttttttttttttttttttttagatggagtcccactctgttgcccaggctggagtgcagtggcgtgatctcagctcattgcaaccattgcttcctgggttcaagcaattatcctgcctcagcctcacaagtagctgggactacaagtgtgtgccacgacacctggccaaattttgtatttttagtagagacagggttttaccatgttggccaggctggtcatgaactcctgacctcaagtgatccatccgccaaggcctcccaaagtgctgggattataggtgtaagccaccatgtccggccagagactcaatattctaattaatgtggataactgaagtatgttacaaactgaggcaaagtttttgtcaatctacctctaaaaatacttcccacttaaaaaaaattaagttattaaaaaaataaaacttacaattcgtttcttccaaaatctgtatttcgggctcgttaacaacaactccttagtcacaggtgaacagtatagataaaccttcaagctgaaaggaaaaaagaaaaaaactttcagtacaatccaaaatgagccatcttggtgactaagaaatctatttcatcatacatctaataatttcatttgagaccagtctgaccaacatggtgaaaccccatccctaataaaaacacaaatactagcctggcatggttatgaaatctatttcatcatacatctaataattcagaaattacgctggcacaaaatctgttagagtcactctcaacatacctatgcacaccatttcagtgccaccaagagcacaaggtgggggtggaaacacggtgtccctggacctcctccaacagtggtccctcaccattgttacttggaaatacgcgcttgtatgtgatcaggtgtgtctggaaagataccgccacacattacactacctctggaaaaggtgtgttgagaacagaaacttctgctttttactgtataagtctattctttttttttttttttttttttttgagatggagtcttgctctgttacccaggctggagtgcaatggtgtgatctcgtctcactgcaaactccacttcccaggttcaagcgattctcctgcctcagcctcccgagtagctgggattacaagcacgcgccatgatgccggactaatttttgtatttttgtagagatggagtttgaccacgttggccaggctggtctcgaactcctgacctcgggtgatccacccacctcggcctcccaaagtgatgggattacaggcgagagccactgcgcccggcctattctttttttttttttttaatgaacagaaattaatttcataataaactttttttttctttttttttgagatggagtcttgatctgtcactcaggctggagtgcggtggcgcgatctcggctcaaagcaaccttccgcctcccgggttcaagcgattctcctgtcttagcctcttgagtagctgggactacatgcgcaccaccacgcccagctaactttttgtatttttaatagaaatggggtttcaccgtgttggccaggctggtctcgatatcctgacctcaactgatccacccacctcagcctcccaaagtgatgggattacaggcatgagccaccgcgcccagaccataataaacttttaaaacttaacgctatcattttgaggttaggaatatagtctacggtagattgtattttccaaagatggccacacaatgacatacaccatccatacatgctctccttacaaaatagatactaaaattcctccactgactggcggggtctatgttccctccccttgaacctgggcagttttctgtaattaccttcaccatagaatgcggtggaagtaattgcatggcttttgaggttagatctccaggtagtacaacttcctcctagctctctcttaggacatacgctttttaaccctgagtctccatttaacaggtctggccatcctgacagactcacgctaaagagatttttttttttagggggaggggagctcactgtcacccaggctggaatgcaagctatcctcccacatcagcagcctgagcacctgggactacagcacatgccaccacacctggctcatttttcctattttctgcagagatgaggtctccctacgttgcccaggttggtttcaaactcctatgctcaggtcatcctcccacctcagcttcccaaaggcctgggattataagcctaagccactacgcctggcctaaagagacttttagagatagagatgccgcacgcctgtaatcccagcactttgggaagccaaggtgggcagatcacttgaagtcaggagtttgagaccagcctgaccaacatggtgaaaccccatctctactgaaaaataaaaaattagttgggcttagaggcacgtgcctgtagtcctagctgcttgggaggctgagctgggagaattgcttgaacctgggaggcagagattgcagtgagccaacatcacgctactgcactcctgcctgggcagcagagttcgactctgtttcaaacaaacaaacaaacaaacaaacaaacaaaaaaacatgccaaatggttctagcccctagctgtgtgagttttcccagcccaggtatcagacatggataagggagtcttcagatcttaaggggctgacatctgaagactctgctcactgatgtttgatacctgggctgggaaaccattcccattctaccctgtcaatccctgatccacagaaactgagcaataagacatgatcagtgttaagtcactccattttgaagtaatttgttacgcagcagcagatgactgatacataggctctgcaatcagacagacctggctggaatcctggtcctgccacttactggctgtgtgacactgggcaactaatttaacctctctggttcctcagtttcctcatctgtaaaatagaaataatagtaggatctattcaaaaggttatcaagaagctctaatgacaatgtcaggtacaagtgtgcagagccttgcatctgtgtggctcactaatgcattctccacctccagtacaatgcccgacatgtcacaggtgaccaaaaaaaattactgaggccaggagtggtggctcatgcctgtaatcccaacactttgggaggctgaggcaggcagatcacttgaggtcaggagttcgagaccagcctggcgaacatggtaaaacccctctctaccgaaaatacaaaaagtagctgggcgtggtggtgggtgcctgtaatcccagctactccggtggctgaggcaaaagaatcactcgaaaagaagttgcagtgagctgagatcgtgccactgcactccagcctgggcgacagagcaacaccctgtcacaaaagtcaataagtaaatacaaataaagtaataaaaaattattggccaggtgcaaaggctcatgcctataagcccagggctttgggaggccaagatgggagatcacttgaagccaggagtttacaaccagcctgggcaacatggtaagtccccgtctctacaaaaaaaaaaaaaattgttgaacaaaaaatacacagtgccaagatacagtaagtattcaataaacgttagctatcattatcaagaagacagagtattgctatcaattagcagagaagcctgacatccactggcccttttcaaatatgtatcttgagaagggggaatttagatgtaggcaatggctgcaagagaagcatctaacagttcagctttaagaaaaaatccagtattatatgatcctttacaatggaacagccattctctctcatatactcttacagaaataacatggagtgagttactgctgtacctagcagcatagataaatcacacaaatacaaagttaagtaaagtaaaacaaatataaaagggtatatttggggccaggtgccagtggctcacatctataatgccagccctttggaagaatgaggcaggaggatcacctgaggccaggagttcgagatcagcctgggcgacatagcaaaactccatctctgttttttttgttgctgtcgttgttgttgttgttgtttttagagagtgtatttggtaggattatatatatatatatatatatcaagttcacaaacagccaaagctaacccatgatgacaaaagtcagaatagaggttacctttgggaggagggaatgagttgggaggtaagaggggtctgggatattggtactgtcctatttcttaatctgggtgatgcgttcattttgtaaatgactatatgcttggatgtatatacttttctgtacagttgttatctctcaattaaaatgtttgcttaaaaacacaagtagcaaaataaattacctgcactccaaccttcttttcaaggtaggggctcttaatcctttcatgtgatctaaaaacaaaagaacaaaaactcatgaatatgtttttccagaggattccttagcccaagggaaacagtcgtcttctttttcagcttcaagagaaaacccatgaggtttgcttttataagaattgattcacatgggctatgagctctttcttctgcaagtgaagaatcctcctcagaacaggaccggctgcccatttctgagccatccaagtcaatttaaaaggagagtgattctgtgcatcataggccagagtttaaatcactctgggcagccacagaagaatgagaactgcttctagccctccactcttacttcatttcaatccaaccatccttcgagccaagctctatgggacccattcactttctgccacttaaatcagtctatctagaaattcaagttcgtggtcatggagtctgctgggaaatcactcaggttcagagtaagtgtttcgtcatcttctcagcctactgtgatggattgaaaggggaatattactatccacaaagacttgctccacagcgctccacattaacagacacagacaacagaaaggtagcaattagaccgactattacattaagtatatcatgcattccaatatattctgaatctttagcaagtaaaggcccagacaacaatgatcaaacagctctaaattgtttaactaaaccagttggacatggtggctcttgcctgtaatcccaacactttgggaggccgacgtaggcggatcacctgaggtcagaagttcaagaccaaccttgccaacatggtaaaaccccatctctactaaaaatacaaaaattagccatgaatagtagcacacccctataatcccagctactcgggtggctgaggcaggacaatcacttgaacatgggaggtagaggttgcagtgagccaaggccataacactgcacttcggcctgggcgacagagtgagacttcatctcaaaaacaaacaaacggctgggcgcggtggctcatgcctgtaaccccagcactttgggaggccgaggcaggcggatcacctgaggttgggagttcgagaccagcctgaccaatacggagataccctgtctccactaaaaatataaaattagctggggctggtggcgcatggctgtaatcccagctacttgggaggctgagataggagaattgcttgaaccccgaaggcagaggttgcggtgagctgagattgtaccattgcactccagcctgggcaactagagtgaaactccatctcaaaaataaataataaccaaaaaaaaaaaaaaaaaaacaagaacaataaattgcttagctaaaccaaaccaattctaattaccacgagcaccaccacacacacacacaagcaccccctcaatttatatgtcgtgtggccatcattagacccagtgaaagcagagcagtcaccacatgtcacttggcagcccttgattgtatatatgcctccaggagagtccacctgtctcccactgggtaaattccctcaagggatatctggtccagtcttttagggcctatgggtatatccctgggcagcattctccgtaattggagtttccaaagagtttgcgccatggcaaagaggaggctgaatgcagactctgcatcctgctcccacactgactaagcaggcagcaccctgcatggtgcatcatggtcccccatcctcaccaccctgaggccccttccagctggtagtcacaagaactggatgggtttgctttgtgtggctggaactgcacccaggtctgcttttccagggaggttttccttttccttggcaaccatcataaattgtcccctctaggggatttccccaaccctgggccactatctcaggtctcaggggtcggggggccctctcatctttcagaacttactgatgatgcttagtaaagcccaccctgcacacagcattggcttccagatggcccacaaataagcatcaggtgggtccatagcctactccgaattatatcaaaatgtgatgtggggctgggtgtggtagctcacacctgtcatcccagcactttgggaggctgaggtgagtggatcacctgcacccaggagttcgataccagcctgggcaacatggggaaatcctgtctctctataaaaaatagaaaaattagccaggcatgatggtgcatgtctgtaatcccaactactcaggtgggagtacttgctgaggtgggaggattggttgagtccaggaggtgaaggctgcagtgagccgagatcgcaccactgcactccagcctgggtgacagagcaaaaccctgtctcaaaaaaaaaaaaaaaaaaaaaaaaaaaaaaaaggaagtgatgtggatgggtttccatgcattttttctagcaaaagagtccatacagtttctcatgtttgagctgctatcacaagataccatagataccatagttggccttcacaccagcgctgtaaggaaaggtagtgttttggttgccttcaacaccaaaaaggtatttctcacagttcaggaagctgggaagatcaagatgcggggcgatttggtttctggagagggcacttttcctaacttacagacagccgccttctcactatgcactcacatggctttcctaggccccgcatgaggacagagcgccctctctcttccttctcttgtaaggaaactaatcctatcagagtaggacaccacggtaggaccccacttaaacttattttcctcctaaaagccccagccccaaatacagtcgctttgggggttagggcttcaacatatgaattttgtggagatagtccatatcataatcaaagaagcctgtgtcccaaaaaggtgaaaagccaacagaaggcaatgtgagaaacctccaaaagcagaagttgtgttttcacccttgatgagtttatgtcctggttgactaagcagatccacatgtggtcagagaacagaaaaagttgttatagactgttcaacagtagggaagagtccatttctggcttaatgcacaaacttatgatgatttcaaattcctttagatttattatttctccaaactcagccatcctaaacacgaagtgcaagtttcggaagtatactttaatcctggctagcccattttgagttcagagactccagtgcggctctacacaaaaagtaaaaataggcatatcctcgtccagcagtggattctcaatgaaaaacaaaaccagaaatgtgtcaggcacagcggctcacacctgtaatcctaacactttgggaggctgaggtgggtggatctacctgaggccaggagttcgagaccagcctggccaacatggtgaaacatcatctctactaaaaacacaaaaattacctgggtgtggtggtgcgtgcctgtaactccagctacttgggaggctgaggcacgagaatcgcttgaacccaggaggcggaggttgcagtgaacagagatcacgccactgcactccagcctggtgatggagactccacctcaaaataataataaaaatacaaacattagctaggcatggtggctgactcctgtagtcccaactacttgagcagagagcatgtgccacactgtactccagcctgggcgacaaagggagaccctgtctccaaaaaaaagaaaaagaagaaggagatgctcaaagacgtgcacgatgcgaatacggcaacgcacgagaagaggtccagattttcccattaaagagaaatcactggtggctttgtggaaaaaaaaagcagagacatttcgcagaagcagtaacttcaacgatttatagtccaagtgattgattccacacacaaaacaacatagctggccttcacaccaaccctgtgaggaaaggctgtgtttggatacctgtaatttactttaaaatactttcctactgcgcaggtacagataggtttgttacgctgattgactccacagggtagtgggagcttcctgctccagcacgctgcaaggccacacagcaggaggcagcaactccagtgattccgtttatcattttctccaattaacactaatggctgggcgaattagcacaatgagcattaaaactgttttccctggtaaaagttagtgacttgttagcacaatagaagtgaaaatgaacaatggttgtcaagttagcggtatttaaactctggaacttagctccaatctctgcttggagcatcagcgacactctaaccttaatccctaaatcggcccagctgtgaaaggatccagctgtgaaatcatagtagcttttcaggttgcctgataccatctagaagggaaacatccctccaacctaaactagaacgaaactttcatattggatacggacagaacacccaaaggccaaggagcttgcacttcgtggagctcttaggcgggctgttccacagttgtgtgtgtgtctgagtctcctgcttgctgaccaatgtttgagggtgtggtcaaatggatctgaaacttgttttcttcatacatggtagcgaggctctgagggaagtactaaccctcgccaatctctgatcatcggccaccagcaaagctaccaagagaaactactagcagtgcttgaccaagccggcccggggcgcaactggcaggcgccgttacgccgcgttgaccacatccgaaaatagatgaagcctttgagaggctgaagagcccgactgggacaaggcgtgtgctggccgccccctcgctggcttcccacaggctgcagctccttgctccagggccggccccctcctgtcctctctccagcccccagcgccccgggagcgggcgacgcgcagccctcactcacctttgtggcagtgggacaggaagtaggcgcgggccctcaggttctccctatcgaagcggtctatggagatagttggatactcggccatctgcccctcgaaagaactcatagcgccgccgatcccagagtccgggaccccaaaaccgcagctgaagccaaggccagccctgaccgcgccgccacttccgggaagc

SEQ ID NO: 1672 - DNA, 47224 bp, Homo sapiens; identical to SEQ ID NO: 1671

SEQ ID NO: 1673 - DNA, 47224 bp, Homo sapiens; identical to SEQ ID NO: 1671

SEQ ID NO: 1674 - DNA, 47224 bp, Homo sapiens; identical to SEQ ID NO: 1671

SEQ ID NO: 1675 - DNA, 39491 bp, Homo sapiens
ctaatcaccaaacatctgcttccttctctgtagctgtgaccctgataccgcgtggtgtgctccgaacacatggtgcccagaacgaaggcggcgtccagaagccctaggtcccagaggtccgctcagcggcaggcgcataaggcggggccggcgcgggcctttccttccatcggaaccgttctcccggggctgagtccctgcccggactccgaacgccgaagaccaggggccggaagcgcgcgccgccactgccacgccgtgtcagtcgggagggagggagcgagcaggcgaagccgcggaggacggggtgaagatggcggccttctccggtgcgtttgtggaaactctgggggtggtggggcggcttgttgcacgcctcagccctggggccgcccgcggagagctaaaggggcgggagcggacaggggtcagggagacagaagggcgctgtccgctgcagtccctgatggacccgcgttgcgggatcaggggcggccgcggctcgggttcggaggacgattcttcccaggagcgggccggaacgtccctccccctgccctttcccttctaccagtctccacttggctttcctgccagtgcaccttcggctgcaaaatctaggcggcggcgttgctctggcggctcccagacgcctgggcctcctgcctcttaacgtggcagtgaccctttgggaacccttttctgcccgcggctcatctgggcttggccaggcagagaggcgagacggcgtggggaggagtcattggggaaaaatgacgatcctgcctctgtccagttttttcaggcccttccaaaacgtcccaggcataaacctgatctttatttgttcttaaacgttgttatatcaacattaatgttcagtgttgaagctaaagggaaagcattttcattaacgtacgcaccagtccaacataagtttggaaaattcatatttatttgccgtctgctaccctcctttattccaaatatgatttgatatggcttatcgaaccctacagttgatattttcgcctcttgctttatcatcctcctgttaggcatccagttttaggaagctgtaatcagccttaaatgcgctaaacgtgatacatttatgtagcacttatgtaacgtttattgctatataaatgtatcacgttaggcctaatgtcctttaatgttattaactttttaagatgacttcagatgtagtattttatattttttagttttcttctgtaagaatattaggaattccatatctccagtcatgtaagatattttttttcttttttgggggggagaatgggggggtggggggatgtagtctccttctgtcgccccagctggagtgcaatggtgtgatcttggctcactgcagcctccacctcccaggttcaagcaattctcctgcctcagcctcctgagtagctgggattacaggcgcctaccaccatgccctgctcatttttgtattattagtagagacgggggtttcaccatgttggccaggctggtctcgaactcctgacctcaggtgatccgctcacctcggcttcccaaagtgcaacagtcatgtaagatttctgactgtttcagttacatcttctaataggattcaattggaaactgctcagagttgttgctgtttttcttttcccaacattctcctaaaacgattttagagccaaggtctgtaggatagttctaggtagtcattttataggttcacatctttgggagtcatacacaaatttcatgaatgttagaggtaaaggactggaaaaagtctgtgatatgaaataagacaaaactggaatttcacgaatgtttctaatttttccttaactgttaaaagtattatacttaaggtccgctttcaaagaaaacttgcagggaacatgaccagaatggtacaagagattgtctggaatttactgaaaatgatatgttgtttcttgtataacaattttgcaaagagcttcagcttgcagtattccgtatgcagtaagaacacaccactcctttgtttcaagcagtttgcattttaggagagagaacatagactgtaatacaggttaattcttaggaaggtctgcctggatattcaactttagatcttcattagtttatctgtggcttttttttttcctgagattaagagctaggaaagtcgccaggtgcagtggcttatgcctgtaatcccagcactttgggagtccaaggtgggcagatcacgaggtcaggagattgagaccatcctggctaacacagtgaaaccccgtctctactaaaaatatgaaaaaaaattagcgggcgtggtggcatgcgcctgtagccccagctcctcgggaggctgaggcaggagaattgcttgaatctgggagacggagtttgcagtgagtggagatcatgcccctacactccagcctgggtgacagagtgagactgtctcaaaaaaaaacaaaagaaaagaaaaaaaagaaaaagagttaggagagccttctttgaaaatgatgatccttctcatctgatgcaaagaaaaagctacataattttatgaagaatattttcagtttgtatgtttgctttatgccttttcacaatggcaagaaatacagaatttcagaattggttatttctggggcttgggaatgtttgattcttgttcttttttttataggaatatatatttttatgataaagctatattttataaatacagacttaaaataaaaatcacttgtcttttggaaggaaagtttaagtaatccaactaactactccatatataattaccctctacagttcatatgagaaatgataaaatgacaaaacccggttaggagcaactcatctctattcatttaggatgggccttgaagtagaattattgagatatgtatacagttaagaactcagcagttcttcagctgacatttccaggtgcccacgttttcaccactgacccctccctcttcagttattcagaattttgattatggctgccaataaatgtgggtgctcgccacttgtctattcatttttttccaattgctgagggtattcacatggtcctagaatagccaaggcacataactgccacattgtctctaaatgcaacaaccctgtctattcttggcagacttttcacgagtcatgagaggtaaacaggcactgtagtggctacagtttattaggtgacaaccatgctccagttgcattacatgattatctctggtcttcatatagccctgcaaggtaggcaatatcagccccattttgtgtggagaaaacagatttatagctttgcctaaggtcacttgctaataagtgagaacttagatttgaactcaggtctttctccagaacttgtgctctttcaacagtgccacgctcagtagatttgatgtaactgagctatccttcaaaatctttaccctgttttatgaatagtaattttgagagcaatgcaatttatcatttcagtttatgtggtttttaaaattaatttttactttcagagatgggtgtaatgcctgagattgcacaagctgtggaagagatggattggctgtaagtacataaagcctaaatgtacctgggagaggatgttttataatttaaacagttgttagtgattttatcaaatatttttgtgtctagttgggtaagtgaaaatcaggttttttttgtgattttctaaattatggaaagtttcctttttttaaccttgacatatttctagtggaataagatggatcgtatttaccacgtaaaattttcttttaggcaaattaacgtgacttaatttgcttaggcgatttttttccccagtaactaaaattcttcaaatatgattcttttagcctcccaactgatatccaggctgaatctatcccattgatcttaggaggaggtgatgtacttatggtaagtttaaatttggtgaggtgattggtagctggggacacactctaagaattgcataggcttacaaatgctactttacctttattcacaaacatttatgatacatatactgtattcagactattaggtaaaagcttcaaacaggtaagtatttactcctgagaagcttaaacccactagggcaataagacatgtataagaatgaatctcgtatcagagagaatgtggcttcttcgtaagagatgcagagtagtatagaattcaagtgggaatccagttgtccttttgcttgaaggatcatagggactgcttaaaggaagtagatttctttttttttgtttttgttttttggaaaaggccaagctctgttgcccaagctggagtgcagtggtgtgtttatagttcactgcagcctcaaactcctcggttcaagcaatcttcctatttcagcctcccaattaggtgggactacaggtacacaccaccacatccagctaatttattgtatttttttgtagagacagggtctcactatgctgcccagtctggtctccaactcccagcctcaagcgatcctcctgtcttggcctcccaaagtgctggagttataagtgtgggccagatttttcgcaagggaagataaaagagaaatgctttttaggtagagagaatatcagcaaaacagcgaatagtagaatgtaggatatgaccctggaatatttcagttggttggtagcataaaatatgtgtctgaggggggataaacttgaaataaaattgtagagagataatgggtcagattatttgggctctttctcaagtgtcttgttaaagaatttgagtgttagtcttctatgaagactaatctgagtagcagattgtagtatagctctgggattagatgttgttcggatacttttataataatctagattagaatgatgagagcttccgtttgaatggtagcaatgggaaagggaagagaagattcttaagggtatgggaaaggtaacaagatgggctgtagttggagttgacagaggaaccctggatatctggaggcactgtgaaaataaaggtagccagtcaaatgttaaagatttctacatactatggtgttagtttgatttctttaatagacaacttaatctgtaaaatcaacttttttcccctcattcaggctgcagaaacaggaagtggcaaaactggtgtaagtaataaattatatttactttctctctaaaagttgaattttaaaataactttgaacagtagtttttactttgaaatatttaataaaatagcaacctccaaaaggtaaggaattaattacttgctactgaaaatgatatttttgttgccagctaattatgaagagctaaaaaaagtatgaccttaagaacatagttttaaatgggcgttagagagttacaatagctttagtgtttatactcacttctgaattttaatatgatgactcttaaaataaaaaggttacatacagaagttgatctcctactggcctggactagagaaataatttgtcggactggatggtatttttcctctttagtgtaggttcattctaccagtctccattgttctatctttttgtgatgttagctgcgtcctatttccttcattcagtccactctgtgttgtctgatgggtatttttggtttgggtaaatgaaattgtagtagcaatctggaatatgtatgattagttgatgtgtgtgcataacttttgtcatttatattggttattaaattgtcgttaatatgtgaatactaatatagataccttttgtttctttgataggcttttagtattccagttatccagatagtttatgaaactctgaaagaccaacaggaaggcaaaaaaggaaaaacaacaattaaaactggtgcttcaggtaatttttgtaaattgatatttccttttatataaatcattggttctcatcactgacagttaggaaagtgagatttgggtatgcatttttaaaatcttgtcagtatctggggggtggtattgggatctggaaccctggaaaccagggatgctaaatgttgttgagagcctaaacactgcaaggttgtccctcctaaaatactaatagtgttccctttgagaaaacactagcattttggagattacatttcaatattatagtgtttttcttaaccttataactttctatgcttaatgctaaaggaaaataggtacattttacaaaaatattaaggaaggattttacaaataatttatggagtaaaaacccatgctggtgggaagtattgccttacagggaacagaggcattttttttcctctaagataagaagggaaccacctaggaagttaaaatataaattttaaagttgtttcttatgtgcagtcctatctacatggaaattggtctttttattaggtttctgatactgtctctaccgtaatcaatcttaccgcagtttcttcatctttaaattgtgttgcttctgttgaatgttttctaaatttcattctatcttaattaatcttttgttttgttatattttaataatattttttccacattttaagtcactcttgtttcattatacaaaacaggattgttacaaaacagcaagttgaagaccagtgaacctgtcatattaacatattcttttcagttgtttgaaagtaatgttatacataaaatgtataatgtagaatctgtgaactcatgtaaattagagatagataattgatgtaactatttacactattggcctattctaaaatagtttcagaatttgtaacaactgtgccgtcatttatgagaaatggtggtaaaagaaaacactcctaaaggagaataaccatagtgataatggttctgaaagtcacatcctatgaggaataaagaaagtagaaatttaaacatggagaagaagtaaaaatggagatgggataattgttaaattattgaagagaactagagagaaagtaattattctagaaagtaggaccaggaccaattagaaatagtttagatgaagatttctgtttaacttaaagtacttcctaatagctacattgagccacaatgcaagggaaaacctcaaagttatttctacaatgttcaaagtgtttaagctgatgatggatatcttttgaccagaaataatctagaaaggatttctaccgtgagtggaaagttggtctagaaagcacgtagagctctctttattacaattcttagtttatacgtatacatacatcttaacaaactatcaagatgtgtcagaaaaggaaaatgccaatcttataaaaaggcggatgaaaaaaatgtgtgacttttgaatgtggtattgaattaagataaaggacttgctttttttttgatagttacaagataattagactctgaaatgttgatcagttatttcctttataattgaagtcaacttgtttggttacttaaacttctttttaatagtgacctaggagtaaggacagagatcagtatcatctgatagagagcacactgaagcaagcaagtgaggagaaaaggttttaggtccagatagaccagtgatgattatcttcaacatgtctgatttttcagttgcgtttttgcttttaataaaaacaagttttacttgtgtattctaaataatatataaaaccatattgaatctagaggaattaaggtacataaaatacttgtttttttttttaatagagcgttttattttatttatttatttatttatttatttttgagatggagtctcgctctgtcgcccaggctggagtgcagtggctcgatctctgctcactgcagtctccacctcctgggctcaagcgattctcctgcctcagcctcccgagtagctgggattacagtcacacgccaccatgcctggctaatttttgtatttttttttttagtagagatgaggtttcaccacgttggccaggctggtcttgaactcctgacctcaagtgaaccacccacgtcagcttcccaaagtgctgagattacagtcgtgagtcaccgcacccggccaagcattttaaattttatatatctgtgggtaacttttcttattttaatttgtttagtgctgaacaaatggcagatgaacccatatgacagaggatctgcttttggtaagtggatagactttccatcagctcatttgtaattcagaaactttaaaaaataatacatgagaacaccaagtaaataagattaagatttaatttaccagatattagaatttagtcactatcattaaacagtatagaactgacataggaatagacagtggaacataatggaaataaatctcagcacatatgagaagttatatgcaggaaaaataattatatttcatttcagtgagacaaaaggatggtttattaagtaaagggtgctgacacgatccatctggagcaatataaaattgacttctatctcatatcataattagaaataaattccatgtgtatttaggacttaaatatatatgtatgaatttgaatacagaaaactacatgtataatttagcagtggcaaaactttcctaacccaaatagaaaatgcagaaattataaaagaaagtatttataggtggagttggacagtcctccttcttggggttaacagaccttacagtggcttttatccaattcaccaggctggctgttcacttgggaataacctccatcatgcatagagccatctgtgattgttccatagtgagcagcgagacctgcatcaactcaaatatgcccttctattctgctgcatttaaaactaaggatactttcctaaagcagttactctcagaatgcattttagtaaagactcctcaggaagcttatgatactgatctacaaaatgtaacagttccttcacactataccctccagtttcagagtgttttggttttgctcttccccacatttactgccttcttggagaccacaggtcttagaagtactttttgttggccctgcataatttttcccttgggggtcagctttgaagctggtgaccaaagctcagatggactgaaatctgaatgtagtctcacatcaagggctgacccagcactcttttacttcattttagctattacagataatagtaaccaaaggactgtatactttttttcttatttgcattttcttttttttttttttttttttttttttgagacagagtctcgctctgttgcccaggctggagtgcagtggcgcgatctcagctcactgcaagctccacctcacgggttcttatttgtgttttcttatgcatccagtgaaccagctccccaggagttggatccaactctaaattccactgataatttttatcattagtaactgtgtgtagcacagctgtggctctgtaccataggtgatcttgtggccaccaagaaacctaaagttcctcatcccctacccttttatcctttttctttccaaaccacagttctgtgagccaaggcagttctagcaaaccctgattctgacaccaattctgagaatatagagaaataaataaactccattttccctgtatactctctcagcatgcttctgacagcagatgtgtggggttttttcccacaagtcaagcaagcagtcagttctcagcatttacgagttgagaactgatggagtaagtaacagacacatgtttgtttattcttggtttcccatactttcccattatggtttcttccagctgagaactgtaattcaattcaattctgacaccgtcttcatgaagatagcatcatatcccacaggttgagggttcaatcacacaagactgtcccccacatctgatgcccaggttgtggcttatgcttctaacctattggctataaatcagggttcctacaattccttcctcaggttcaattaatttgctagagtggctcacagaactcggggaaatatgtttactggtttatttttaaagctattataaagaatactgatgaagagatgcataagctgaagtacaggaaggggcttggagcttctcccctccctgggcatgacacccttcaggaaccgtcatgtgttcagctatcctggaagctcctagataactttttaaaagttcagttctacataattcagtacccatatgggtaagaattcatactttgaataattaaatttctgaaaagtgtaggaagatgtgtgttgaggtgcttaacagtttgttctactttcaagtacagaatacgagttggaaagatgaaccaggacagaaattatagtttttttccagtacagacaaaaagctgaatctttacttaaaaccatttagtatgtggacatcactgagactgatcatgatgtatagtatagaatatacctcatcttttagagcccttataatattagcaagtaacaaatacatgcttatttattcatgctttctcctagtttcccatatggtttcttccatggattgaggaacaagctagagacagttctgttatcttttagttatatagtcactcaagctctaatttaagtataaaatcaggacgaatattgatgagcgagttgtgcatcatccttgagtacgtttctttaaagggctccagagaatagttatctaaacacatttgtattgatggtgcaactactattagtgcaagtcaggttaagagctgtgttgaatcctttctagacttgttgctgtaaaatcttaccttagttaacagatggcagcatagaaaatagcccccaacatagccaaggacacccagggaatgaaatggttaattacacttgggaaatactactatcactcaggaatcagtaagtctcagtctctggaacattgcaacaaatgaaggaattatcttgttagtgagactgaatgattttttttggtggtagggggtgggaatgtatgatttataaaacctgtactgacgtgtttttctgtgttttcttctcaaatccagcaattgggtcagatggtctttgttgtcaaagcagagaagtaaaggaatggcatgggtgtagagctactaaaggattaatgaaaggtatttgaacagcatctgcacttgtataaacttttgaggcaaggtattaatacgtgagggtttttttgttgttgtttgtttgtttttgagatggagtctcgcacgtcgcccgggctggagggcccgggctggagggcagtggtgccatctcggctcactgcaacctccacctcccgggttcaagcaattctcctaccgcagcttcccgagtagctgggattacaggcgcccaccaccatgcctggctaatttttgtacttttagtagagatgggtttcaccatgttggccaggctggttttgaactcctaacctcaggtgatctgcttgccttagcctcctaaagtgctgcctgcaggcgtgagccactatgcctggcccatgagtttttaaaaatagctttaagtcgaggatctgggaaggtgtttgatggtacaaatatacctataattcttcatttggtacatacctgtgtaattcagaaacaatgggaagatgacttcatggtaaatgaatcgtgtgtgtgatttatataaatctcaatgtattttacccttgtagggaaacactactatgaagtatcctgtcatgaccaagggttatgcagggtcgggtggtctaccatgcaggcctctttggacctaggtaagtgtttctaaaataactgaattgattgatttacatttgggggataacattttattatttggggaagcaaaataataaatttaaccataaaaaggttttattttaaagacatggaaacaatatttatctgtaccccaccctgttccaaaaaggatttgaaggaacttacaaaaagtacagatattatagcagtatgaaatgagggataagaatatgaatggagtcagggtaaagttagtgtgtgtgaatctgtaccacacagtaccatatagatgcttcatgttattgtaaacttgcatctgaatttcttagtggacaaagcagagagggatgcagtatcactggtgtccctagtctcacacacgctctgtggcctaagcactgtttagttttttgcaggattcagaaacttagggaatagttttcctgtgggtttatgaaatggacatactatgtgaataaaattacttcttttagaggtcttttaattttatattttctcttaccagaaaagtaaaatattttttaaatctaggtactgacaagtttggatttggctttggtggaacaggaaagaaatcccataacaaacaatttgataattatggagaggtaagcgattatgttatgacttcaacatagcataagtaagttttcttgcatacttaatcactcatgacagaatgagggtatacaaatgattctcaaaatgagcagattttctgtatattttccacagaaagtttggatttggactttagtgaagaaatattgtcaagctagataaatatgtagtagttataatttttcttttatgccatttgtcatcccctccaaaatacattacgttgtcttctcttttcacctcattttgattttggctttgatacatgttattctcatttcttattattgatcatgatgagtctaaatatagttcgtctggtgagctgaaatctacagtagtgtgaatgagcctaaatatgttgattctaacaagcctgtcaaatgcttgtactattgtatatgtcatatgctctaataggcatttttgatttaaataattattttgaaacacatacttttgatgcagctatattttaactttatttaagaatttactttctattaatagcatttgactttctggtgttctaggaattcactatgcatgataccattggatgttacctggatatagataagggacatgtcaagttctccaaaaatggtaagctctatatggatcttagtagtgaaaagatacatgatattcaataattgtggtttttaaaaatccccccaccctgtttttcaaatccccgtccctccctccctgcctttacttgaactaatatttattgagcattgactatgtgtaaggtaccctggtaagtactggaggcacagaagaaaatggaatagacatttggggcttacacactagtggtgaaagacagacatataataccatgttaggtggtagtaagtgctgtgaaggagggtataaagcaggggaaggaagtggagagtcatagcggtttgggggtttgtgcttttgtgtagggcagtcaaaaggcttgataagggacatttaggtagagatccaaatgagttgggtggtaggccatgcagatttctgcaaagggaatagtaaatgtggatgccctgagatggaagcgtgcttgaggtgtctgagtcacagcgaggaagccactagatctggagtgctctggggataaaggacggtggtagaatgttagatgagtgaggtggtgaggccaggccatggagagccatatgggccatgatctaaactttggtttttattttgagtgaaatggaaagccatgagggttttgagcagaggggtggcatcatctgtctttagtttaacagtaccattctggctgctttgttgaagacacattggagggtggggtgagattgcctagggattgagggtagttaaagagaagaagagatctgaggcctgggttcctgtggttaggggtcagcaaattgaggagaatccagcagaggggaatgaggaggaaggccaggaggagaaccaagaaagcatgggtcctacagtcctggtgaaggaagtgtttgaaggatcagggagcaatcactgttcagtgctgcggatgggtctagtctagcaagatgaagaatgtgcattaactgctgcatttgacaagtggaaagcattagagagctgttttggtggagcaaaggggtgagggtggggagcctcctaataaggagccagttcaatagagaatgagatgaaagaaagtggatacagtgtaaatggaaatcggagtttcactacaaaagggaggagaaaaatggaaggtaaatggagggagaggtgagttcaagggaggttttcttgtgtgttttactgtgagagtatgtttatatgctttgaaatgtctaatggaaatgaacttgtagacagggagtaatgaaaaatgtagaggggtagaagtgacagtttcaggagtaaagtaaaaaaatgaagaagctggccttaggcagcacagtttatccatagtgacaggagagaggcatgaatgcaggtaagctggtagatttgacattgtcagcatgaggaaggtcttttctgattgttttaatctctctctctctcttgttttttaaggaaaagatcttggtctggcatttgaaataccaccacatatgaaaaaccaagccctctttcctgcctgtgttttgaaggtaattaggaatctagttagaaaaaatttgctgtggttgtaagctgcttactcttcattattttgtatacgatggttttcaattagggtaggaattttaattttctgttttattcaatgctagaatgctgaactgaaatttaacttcggtgaagaggaatttaagtttccaccaaaagatggctttgttgctctttccaaggcaccggatggttacattgtcaaatcacagcactcaggtattatacctgcaagggtaaggatttctagaatagtgagaataattgatgagaactccagtaagtaaggcgtctcatagtgagttacatatactttccttgctggtttagtcacacatctttttttaacacagcagtaaaattcatttttaaaacctaattcataaactcttaagtatttggtttcagtgtaggcattttgggatcgcaatcataacggtaatgatatctaatatttatagaatgtgtgcttattcagtgccagggcaccacattaagtgctttacatggtttagtcttcacaacaaccctataaggtagtagttttcccattttacagacaacctaacgaatagggactttaagtgatttgcccaaggtcacagagcaaataagtggtagaactgaattcaaatctaagcagtctgacttccaagtttatactcttatccattgtatatctaatatttaaagtatatttcataacttgtttgtcacaaaacaagtgagtcatttttgtagacatatcaatcaattagaattattccaagtagatttttattgttgttttaagagaggggatctcactgtgtcacccaggctgctggagtgcagtggcgccatcatagctcactgcagccttgaatacctggactcaagtgatcgtcccaccttgggccgcccaaagtgctaggattgcaggtgtcagtcaccccaccagcccaaatagttttaatttaaagtagcctttgttttagaaatctaaggtttattctgtttgactgtcttctctactttttgacaattattatgtaaaatgttgatattagaatatttgtcctaatgttttataagtaacagtattataaagtgtgctttgaatgtgttctcatcttttttattccctaaggtaatgcacaggtgacacaaacaaagtttctccccaatgctccgaaagctctcattgttgaaccttcccgggagttagctgaacaaactttgaacaacatcaagcagtttaagaaatacattgataatcctaaattaaggtaaatcttccttttgtgctgaaatgcttattgtcttttggtttgaagttttttggaagaagaataaggtagagaaaaatgaagtagaaattcagtgtgtatacataatacacgtgtgtgagtatgtaaatatactttaataatttccatatacaactcctgtttgtttgctaaatggtaagtatgatttttttaaaattgagattttttttttcctgtgtctcttacatgaaaagtcatggttagtcaaacagcattggagtaaaaatctaatttttggttttttttctgagaccgggatctcaatctgtcgcccaggctggagtgtagtgatatgattgtagctcactgcaaccttgacctcctggactcaagcagtcctcccacttgagtagttgggactgcaggcacatgccaccttagtagagatagggtttcactatgttgcttaggctagtctcaaactcctgggtgcaaatgatcctcctgcttcagcctcccagagtgctggaattacaggcatgagccactgtgcctggccctaacaattttttgaagagagcatttcattcactgttaaatttatttcttccctaaatctctatagaaaatgtgccactctatttctagcatgttagtaaacttggcgaggtttattctagactgcatcacggtggtggctttcttccatttggacattcagattggtcactgtctagttataagactctttccaccattggaaggataccataaattaaagtgaccttgctcagtagcaatccctttgactttgaagaaggctataccatataagtaatacactctgttagtcaatttgacacttgatttttgttaattttgtctttaattactttttaaacttgaaacattcacacaccataaaactcattatttgaaagtgcacaattcagccaggtgtggtgactcacgcctgtattcccagtactttggggggccgaggtgggcggtcacctgaggtcaggagttcaagaccagcccagccaacacggtgaaaccccatctctactaaaatacaaaaattagctgggcttcgtggcagagacctgtaatcccagctactcgggaggccaaggcatgagaattgcttgaacccaggaggtggaggttgcattgaggccaagattgcgccattgcactccagcctgggcaacagagtaagactccgtctcaaaaaaaaaaaaaaaagcaagtgtttcttggttcattggtttttagtatattcacaaggtgtgtaactgtcaccactatcaaatttcagaagctttgaatattttgacatcacaaaagcctgtgtttttttttaggttttttttttttttttttttttatgaagtctcgctatgttgcccaggctgaagtaagtggctgttcacaggttcagtcttcctacactgtagccttgaactcctagactcaaggaattctctctcttgcctcagcctcccgagtagctgagaatacaggcacatgccactgtttcaggcaggcctgtctttttaatattgatcttatttacaggttgaacaaacttatttagggataaattatgtaaaataattactaattttgttttgaagattgatgcatgttccttattcagcaaatgttcatctaccttccatatgtgaagttttaggctgggagccagggcttcaacaatgaaaattaatcttcctttcacagaattaagtgtgaaagtgtggggatagtgtggaggggagagaaacaaaacaaatacaataaatgccttgagcataccatgtaaccagggcatctgcttagtgtaagaaactcagggacgtctttataaaaggatttgggaagaatgtaaaatgctagtgtgaattgatttttgtgctgtgattatgtataaaaatgaacatgattatagacaaaagttagaggggaagatgaataataaaatcaatttattggttaagatggtaaagtcatgggccacttgtttggtattcggtacaaatggacattttctttcttaaaacccagctgaagtcatgatctttgaatgaagctaagctggctgtcccagcccagccatctgcccctcctctgatacactgactgtacatgcctttccctgatccttacatactgtcatgtgttacttttccttactttttaattttcttaatttttatttcctttttagagctatacttgctttaagtttcttgctttgaatatgcaaagcttttatctaactcagttttacattccttagtgcaggggtggttcttttatattcttcaaccctacagtgctttgcgtataagcatcaattatcatgtgtatgtgtgtttaccttctgccaagtttatagggataaatatatctgattataaatgtggataaaagtaaaagtattgttggaaaaaaaaatgatagtttaggacaatagtccaaacctaggaacttgaggacctcatttaaaaatataaaatgtattggttccctcccctggatatactgaatcagaatttccagagaataggaattagaatctttttttatttgtttgttttttaagaaaagcagctcctccaggtgattctttttggttttggttttatttttgagatgaggtctcactctgtcacctaggctggagtacagtggtgcctcatagctcactgcagtctcaaactctagggctcaagcaatcctcccacctaagcctccagagtagctgggactgcaagcaagtgccacagtgcttggctaattttattttttgtggagacatggtcttgctatgttgtgcaggctggtctcgaactcctggcctcaagcaatccttgtgtctccgcctccgaaagtgctggattataggtgtgagctactgcatctggcctttactctcctgatactgtcctttggaagtcttaattttgatgaaatccaatttatctgtttttctcttttgtcatggtgttttgatgttgtagttaagatagactatgcctaacccaaggtcatgaaaattttatttgtgttgtcttctgagttttatgtttaggttctacatttaggtctgtgatacatttagagttaatttctgtgtatggcatgagaaagggttttaacttcagtcttttgcatgtgcatatccatgtgtcccagtgccagttggccagtcattgaaatgagaaacattcaaacacaaaagggtactgtgaaaagtgagtcttctttcactcctttccccaatttctagttatcctttctggaggcaacgttttaaattgatttttgtatattccttcagggcattttatatacatacaagtatatatgtctgaaaacatagattgaaaccaggttttaaagaaccttgaattatcctaatgtagaagaatatgtagatgagaataattttttccatgttacaagctcacgcattctctttcgtgactttaccgcacttcagcaatagatacagctacggggatttaactgctttgtttcccaccttccccagacttgtttttttttttattttttattttttaatttatttattttttattgatcattcttgggtgtttctcacagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacctcctactacacaaacacggcaaccatccgatttcccactcttttccccacctctccccactttctactccacaaaaccgccattgtcatcatggcccgttctcaatgagctgccgggcacacctcccagacggggtggtggccgggcagaggggctcctcacctcccagtagggacggccgggcagaggctccccccacctcccggacggggcggctggccgggcagggggctgacccccccacctccctcccggacggggcggctggccgggcggggggctgaccccccgacctccctcccggacggggcggctggccgggcagaggggctcctcacttcccagtaggggtggccgggcagaggcaccccccacctcccggacggggcggctggccgggcggggggctgacccccccacctccctcccggacggggcgactggccgggcggggggctgacccccccacctccctcccggacggggtggctggccgggcggggggctgacccccccacctccctcccggacggggcggctggccgggcagaggggctcctcacttcccagtaggggcggctgggcagaggcgcccctcacctcccggacggggcggctggccgggcggggagctgacccccccaccttcctcccggacgaggcggctggccgggcggggggctgaccccaccacctccctcccggacagggcggctggccgggcagaggggctcctcacttcccagtaggggcggctgggtagaggctcccctctcctcccggagggggcggctggctggcggggcctgacccccccacctccctcccggacggggcggctggccgggcggggggctgaccccccccacctccctcctggacggggcggctggcctggcggtgggtgacccccacctccttcctggacggggtggctgccgggcggtgacgctcctcacttctcagacggggcggccgggcagagacgctcctcacctcccagacggggtcgcggccgggtagaggcgctcctcacatcccagacggggcggcggggcagaggcgccccccacatctcagacgatgggcagctgggcagagacgctcctcacttcctagatgggatggcggccgggaagaggcgctcctcacttcctagatgggatggtggccgggaagaggtgctcctcacttcctagatgggatggcggccgggcagagacgctcctcactttccagactgggcagccaggcagaggggctcctcacgtcccagatgatgggcggccaggcagagacgctcctcacttcccagacggggtggcggccgggcagaggctgcaatctcggcactttgggaggccaaggcaggcggctgggaggtggaggttgtagcgagccgagatcacgccactgcactccagcctgggcaacattgagcactgagtgagggagactccgtctgcaatcccggcacctcgggaggccgaggctggcggatcactcgcggttaggagctggagaccagcccggccaacacagcgaaaccccgtctccaccaaaaaaatacgaaaaccagtcaggcgtggtggcgcgtgcctgcaatcgcaggcactcggcaagctgaggcaggagaatcaggctgggaggttgcagtgagccgagatggcagcagtacagtccagcttcggctcggtatcagagggagaccgtggaaagagagggagagggagaccgtggggagagggagagggggagggggagggagagggcagcgtgtaacctttgtaacttcccccagacttgttttattgtaggcttttttcctcaattactttctcaaccttaatttccacctaaaataaatggatgcagatcaaacaatgtaaagcagactttaatttttttttttttatattatcatcttgatatttatttcagggagcttctgataattggaggtgttgcagcccgggatcagctctctgttttggaaaatggagtaagttgtagttttaatttttaaaacataatgtcatgggctgtcgttttagcaatacagctctgttttgtttcaagaaaatttaagtgaggctgaaattagagcaaggtcagaggagtatgtttgttcaaagacatcttgcaagtgcgccttttcttctcctggaagtatacaaagtctctcccagacctctcaagcaaaattccagcatacatgattttttgttgtttaccctctgaacatttgagaatttccttctggccttcatgggtaaagagtcattctttttggggagataagtgaaaaagaagaaactggagttaagaacaaaagtagaggtaaaatagattgcagagaaggatagaagttcctgcagtgactcttgggaaggatgaataatgataagacagtgggtaatagttccagtgaggagagacatgagttcaattatgtgtaaggggaagtcgcaaaggctgtgctcagccatgccattacgaaggacaaagctaagaggatctgatctccactgttggagaagaagtttaggaattttttttttttttttttttgagaaggagtttcactcttgtcgcccaggctggagtgccatgacatgttctcggctcattgcaacctctgcctcttgggttcaagcagttctcctgcctcagcctcctcagtagctgggattacaggcacccgccaccatgttggctgatttttttgtattttcaccatgttggccaggctggtcttgaactcctgacctcaggtgatccacccgccctggcctcccaaagtgctgggattacaggagtgaactactgcgcctggccgaagtttaggaaatttttaactgtttatcagttctgtgaaggtaggacttcatgaaatatttttcgtgtgtgaaataacttacagcttataaatttctcttttatttcctttcctaaatatttaatcattaaagctaaaccatccgatattgagtcatgacaagcaattgtgtcctttctccaattccattggtgctcttgtcaaactaaattttgtgccacacagactttacatttgacctggtatgccatattaagagcaaggaatcatattaccatacttgttaatactattctaagatgagtaatattgctttgatatgtttttatttagtgctatggttttaatgtccccaccaaaactcatgttgaaatttaattgcccatataatggtattggaaggcgggggcttttaacagatgattagatcgcgagggctttgtcctcatgaatgggttaatgcctttgctgtaggagcgggttagttattgcaggagtttcggcccgttttcctctctttgttgctcctttctgccatgagatgaccctcactagttgctgctggcactatgctcttgaacttccccaaacctccagaaatgtgacaaatattcttttctttataaattatctactttgtgatattctgttaaaacagcagaaaatgagctgaaacatttagtgtgttttattttattttagtggttgtaagagagatttaataagtttattcccaatcttgcttcctcaaacccatttttcccataagataatatgtttctcaattcctattttcctaaagcttatagagcttttagggaattaaatctgctttcatcaggatgtctcaaaatttggtactaacttgaagcaattggaaaggtagtgttataccagagcattctttgcagaattcaattctactctacttcttaggggatctaatatgatctttatctgttcttctctctgtcttacattctctgcttctgttatcttccaccacactctggttcagccttagccctgtgttgggtcttatgctggggcagaagtcagcttggcaatgagagtagaagaattttagttttctaatcttttagtcttacggtattatgcaacatgtgccactgaggtcatataaataaagatgtctcacaggcttttctgatctaactgacttaaaaaaacaaaacaaaaccctgagaggccttgtgtctgtcttcatgcccactttacctgctgaaattcggaaggaggaaactcacgtggttagaatactgtactaaactgatgtcatagaaccagatggtattttgttcactgctgtgtacagcacctgtctcagtgtttggcacatagtagattcttaatacattggacagattttatcttcacattttcagacaatattttctaggttgaacttgctgtaattatcagtgcagatgaaacaatagcttcagaaatgtctgctttatttttcatgggataataagtgcctcatattggatcaagttaaaagttctgtttattcgaggggtgagatattgaagtaatggaactagaggaataactttgctaatagaaaactatatttttagtacagggtggagaaaacaggtaaaaaagaatggaagtgttgttttttaatgcctgccaattaaggagtagaggttttgaattgtctgatttactgaatgatcttatgtaataccttatttgtgctcacataaatacatcatatacacactttatatatttttatttatttatttatttatttttggagatggagtctcgttctgttgcccaggctggagtgcagtggtgtgatctcagctcactgcaacgtctgcctcccaggttcaagcagttctcctccctcagcctcctgagtagctgggactagatgtgcacgccgccatgcccggctaattttgtgtgtgtgtgtgtgtgtgtgtgtattttagtagagacggggtttcaccattttgcccaggctggtcttgaactcctgagctcaggcaatctgcctgcctcggcctcccaaagtgctaggattacaggcgtgagccaccgcgccggcccatatacacactttaaaaatacctcatctttattgactgctttctagaaatgggtcaggcactgtactaaaaacataacatgttcttactcagtacttacaataatcctctgagatggtactcttccccatttttacagattaagaagagggcttatatcaaatattaagtaacttacctaagatcatacaactcataggtagaactttactctgaaacctgtgtgtctaatcaccatacctatggacttgactacaagatatgtgtgggagaatgcaaaatgttaactgtttgtactggcaccgaggctcactgttctcttctatgtatgtttgaaaagttttatttagtattctaaacttccgttttctcattgaatagggatgattatagtagtatttaccttagtggtaacatgaaataaaacatgtacttgtaaaacattttgcagagtgcctgttcattataagtacttgacaaatagtaactattactgttttcctggacagtctgatcaccattactattaactataaccaaatttattgagcacctgggacactctgcgtctagtgctttacgcatcttatctcttaattatcacaaccatcttgaaaaagagaaggtattcccccaattcaaaaatgggaaaattggtactagaggagattaaataaattaaggtcacagagcagagtagtggtggaactgggacttgaactctaggttccgttgagttccagtgaattcatcagatttttgcttggaaaatataaattttatgcattagaatgtatatcagttaaggatgtcaaaatcaattttggtcaaaatcttcacattaatttcaaaccaagtatcagttgaacatatggcattatctgtaactccttttttttttttataaatttagagttgactgactacttcaatatgcatgtttttattaaaaagacagttattggttgctattttaacgtaattatactgtttctttagttttcattaagtggttggtttgctttttttcaggtagatatagttgtaggtactccgggaagactagatgacttggtgtcaactggaaagctgaacttatctcaagttagattcctggtcctggatgaagctgtatgttgaaatataatcatactttttaaaaagtttacttatattttttgagataaaatatataaaatgaagaagaaatataattcagtcatgatcctactacctagagataatcattgttatcagtttggtatattttcatatactttttatttatatattattttatgtagttgaaatcaagatatgaggaatctgggaaaaattttaaaaatgtaatgtcataagtatttcctgtaattgtacataatttataaatgctgtctagtggtctattatatggctacttcatggtatatttaattactcttatttctaggtatgtaggcagatttgatttttgctccaaataaccagctttgtttgtacatacattttctacatactataaatttgttccttgtgtcagagatacaaaatgtagaccatctggaaggacataaatgtgtttgagtctcttagacatacttccaaatcattttcaggttgggttacctagttcctcagcactgagggtttttaattttttatatgaaaagtctgttgaaggatatatgttagaagctgttgactgaaattttcattctagattattagattatggttttggattgcttattgtcactttttcatattttagtcacaagaaacttaaaattgaatttataaattatctttatccaacaaaataattttgaaaatataggactatgtatatgcatgaattagtttccttatattttgtttgatttagaaaaaagatttttgatactgattaaaacttacgtttttttccatactgattaaaaacttaatttattctttgtttctcatgcaggatgggcttctttctcaaggttattctgattttataaataggatgcacaatcagattcctcaggttacctctgatggaaaaagacttcaggtataaaatttatcaatgcatcttaaaatgcatgtaaacaattgttatgtataatgttacgggatcccagggggtgttgcttttctggctggaaacctctgcggctagtgatgcccttgcccgggttttgctcagttccacccacttggcctggcaggctgtgctcagctctcactaccagcctggaccccatgcctcccaagggtgagccaggcgcggagtggtgaggcgtgtatgagcgaacgtggggtctggccatggcacacagccaggcacattggctgcggcagggcgggtagctccaggcactggcatgggcaccggctctctgtgaggctggtggccaggccccgaggcttcaggtcttccccagttgaaggtggggcttcaccggggactagcccccttccgcccaggagcctgtctgcctcctgctgctgttcatggtgcccagactgttcatgccaagggacacgtgcaggccagcactgggccgtcctcagcctgccttggccctccttccgtgttcgctggcgcccaaaggctggaaggggccaaagtggcagtgggttggtgtatcaatgctacctcaagtgtgcacacccagctggcccaagcttgagacagtgcccaacctcggccttaactttgttctgtgatcagagtgggtgttgacagcagggagaggccaggcagtggaagcagacatctccgaacctgtgggggcaagggagggccttttagggccccccgagtgcagagatgtctgggtccgcagccataacttgggcagctgcagccatgcctgggatggtggagctcctgcctgccctggctcccaccaccaccctgggcccagctccatctcagggctcctctctctctgcccctctgtgcccaacctcactgctccccctctggcaggcgactcggcccagccccattgaggtggctcccagggcagtgggctccagggtcctcccaggggtggactctagagactgtccgcctcctctctgtgccctccccgcagcagtggcgggcaagagcggcaacacggggccagggtccagagtggtggagactctgggcctgggagcgggtcctgcccagcttcgcgaaggttggggtggcccagtcagctgccttggggatgcggggcacagggaacccaccaccaccactgcagctcctgcagcctctcttgctgccgctgctcatgtctccccgctgcagccagcttgatggcagcagctgctcctgacggcctgttgctgccatcattaatgcttatgagcagggtcaaagggtttttgtttggtcccctctcattaaatttattactatgtaaaatgtttgctttacgttactggacgaaatagtatactcaaaggtaacagtcttaaaagctgcttttagaaatagaaggaaatttgaggaaattacttgggtgttgcagaaaactacaagtaaaaattcttagttactttgtcctgtagaccgtttagggtgtgtattccagattattagtactgttgcctgttcgaaggaaaaataacttcagctattgaaaaattgttgtcttctctgtagttatatccttctttcttaggaagcatttaagaaggacaagcttttgagagaaggggacagacagtaatacaggatttttggcttacaaaaatgactcattttacttagtttttgtagggacgtgaggaagagatggcatgatttctatgtgacagtgagggaactgaacctcagagaggttaacctgcccaaagtcataactctagttgtcgctacatagagtaaggtgttgaacttatctttggagtctaggctagcacactttgtgtttcatatcagtgtttgtgtgatttattaattattattataaaagttcatctcaatttggggtttcctcttcttaggtgattgtttgctctgccactttgcattctttcgatgtaaagaaactgtccgagaagataatgcattttcctacatgggttgacttaaaaggagaagactctgttccagatactgtacaccatgttgttgtcccagtaaatcccaaaactgacagactctgggaaaggcttggaaagagccacattagagtaagtggtttataatattaacatttatgtagaataaagcaatttataaactaggtcagccttgggctcttagtgatgcttaaggcaatcagttattgtatcaaagaaaagtccaatacatcgtaaacccttagacctttaaaaagcactgaataagtgatggactccatcttttgtttttctgtcttcgtaatattacttttgtgatcagcttccttgatacagtctttataagtaaataacatatatttatctaatttcagatacaatgatttccatttttagtagtattttagtaggagccctcatctgtgtcctcttgatgtactttgttctaaaaatcaatttcatgtggtcatcttgtcactttcttcactgtgattagatttgcctttatatagtaaggttatatttattataaatatacaatattttagaaaccacattttcattattattattacctttaaaagtggtcttagacctatagttaatgaaaggtttttctgaatctgaagaatgattttgcctacagattatattatgaagacatatatctgaaatacagtctaaagacaaatataaatctcccttttaaaacatgacatatattctgaatcattatttaaccactcctctatcctgtttttattccttgcttttgatagactgatgatgtacatgcaaaagataacacaagacctggtgctaatagtccaggtgagttaaaagagtcaaatgtgttgaaagattttgaaaatgaaatttataccttacctattctcatgaaggatgtgaggtgacctgcaaaattaaaacaggaaatttggaaataaaggcaacaaaaataataaaaaagaaatggggaaaagctgatactagtcaacttagaggaatatgaatcattgaatttatttttaattttttgagacagagtcatgttcttgtcacccaagctggagtgcaatggcacagtctcagctcaaggcaacctcggccacccgggttcaagcagttctcttcttgcctcagcctcccaagtagctgggatcgcccgccaccatgcctggctaatttttttatatttttagtagagatggggtttcaccatgttggccaggctggtcttaaactcctgacctcaggtgatcctcccacctcgacctcccaaagttctgggattacaggcatgagccaccatgcctggccttaatcattgaatttagatgttagtctcctggcatctaaatcactttttttttttttgtttttttgagacacggtctcactctgtcacccagactagagtgcactggtgcgattttggctcaccacaacctctgcctcccaggctcaagcagttctcctgcctcagcctcccgggtagctgggattacaggcacgtgccactaccacctggctaatttttgtgttttcagtagagatgaggtttcaccatgtgggccaggctggtcttgaactcctgacctcaaatgatccacccgccttggcttcacaaagtgctgggattataggcgtgagccactgcacccagccacaaatatttttgattatctaattctcatcataggaaaacagcgaatttttctagagagattattttatattgaccctgaattccataagaaatatcatgtaagtttctcatatcaggaatattgcataagaaagaaaactttctttagctatagctttgcaaaagatactgaaattgttttgaaatagttgttgacttttttgtgtgtggtagaatatacataacataaaacttagcattttaactattagtgtacagttcattggcattaagtacattcatattgttgtacaatcatcaccactgtccatctccagaactttttcatcttcttaaactgaaaatctgtatcattaaatatttatcaatttttaaaaagcctaacattaaattccgcctcaatgaagattcttctttgcagagctgagactctttgtttcaggttaaatagtgttttgaaaatataggaaggtacatcatgatacaaggttggtgcttagaaaacctagaagaatggatcttaaacccattaggctgcatgtctgacatgagatgtttcaggtggatcattcattggtgagggtcggactctgcttgcttcatggttgaatttcaactatatcaaaatggtgaattatctgaaatcttgattaaagatttgaactcagttttatatgtaggtctaaattaacaagacacatacttagttatccttattgttggagaagagcagagacactgtttgaaaatctgtcatcccaaatgcattttataaaattccagtttttattgcttcttatatttttcttgcataagttttgcttagtttagactaacaattagagatgatcagagagaccttagaaatatgttgggtcacagaattaaagtcttacattcagtggttgaggaataacaattatagcacagcttcacactgaaaaatagagagttggaggatggtgactaaaaaattactagagttttgtgttaaggtttttactgcgtagagtgaagtatgaactttctggtatttagattgatttagaaagtacattaattatttttaaaaggagttaaaataattgtataaagcatttattgagcatttagggaagttcatgcaaggcagaatatgatttgttcttcatgagagataacagttttgctgtatgtatttctgttaatttgtacgtgtgtatgtgtgtgttccctcataaggggtacggttatgggtgtttatataccccataaagtagcataaaaaatattaacagaaacaaaaataaatgaatgaatggtttaactcactgttttactctatctttacttcttgtccttatctatatataatacttttattaaaacaagtattcttttttaggaaaattaagcagtcagtctgtgactataattatgtgtattcatgacaagttcagattgaaattctgttggtttttgttgttgttatgatattcaagagatgtggtctgaagctattaaaatcctgaaaggggagtatgctgtccgggcaatcaaggaacataagatggatcaagcaattatcttctgtagaaccaaaattgactgtgataacttggagcagtactttatacaacaaggaggaggtaattttttctcacttgaaataaattgtgtttatatcctcttgtaatagattattaatctcatgttgatgcaatctagaacacatgcacagaatttaaagcagttgatggcatattttaagtatctatgcttattcagtacttttccatatgataagccctaggaaaaacaagagagaattttccacgtaggtacattttcattacagtaaacttgaatcacagcatcctaagagttttatattatatggaagaaggataaagtaatttattagtcttaaaatttaaaatatgatcactgaaataatagaatgtatgtcttttaaaccagtagatggggaaaggggaatgaggaaaaaaaacctaaacaagagcaagaaaggaaggggaataaaatgagaaaaattatggttagaaattatagaataagatcaatgttggaaaaatctgaatgtatgagtaaacactgtaagtatcagtggacacggtcttctgttataaagcatggattgttggactggatgaaatctagcaatacgctgtttacatggagcatacccaaaatctgaggacatagaaagatggaaaaggaatgaaaaaatattatgcatgtgtcagctaaaatattaaccaaaagaaagccagtctagctatattaataagagttgcagtagactttaagacaaatattactagaaataaagagtcactatgtaataaaatatccaagctacaatggaagtataagggttcagattttatgcttcttataacttcgagaatgtaaactgtattagtctgttcttatgctgctatgaagaactgcctgaggctgggtaatttataaaggaaagaggtttaattgactcacagttcttcagagctggggaagcaaacacgtccttctttacatggcagcaggaaggagaagtgccaagcaaagtaggaaaagccccttataaaaccatcagatctcatgaggactccgtcactatcacgagaacagcatgaggataaccacccacatgattctattatctcctaccaggtccctcccacatgtggggattatgggaactacaattcaagatgagatttggatggagacccagccaaattatatcataaaccaacatggaaaaattctcaatcagttgttatggaaatgcaaaataaaatgacagtataataccgttgtacatgctaaactaaaaatacaacaccgaattttggctgtggagcaactgcatacagttgttgagaatagattgttggtgagaatataaaatggtatgagcactttagcaaagggtcttgcagtcttttataaagctaaaaatgctgtcttatggcctagcaattaaactgctagatgtttacccaggataaatgaaaacacatattgacaaaaagatgctagaatggccatagcagctttatttataatattctaaaactgaaaacacactaagtgtccatcagtaggagaatggataaataaagtgtgaaatacagtggaatactactcagcagtgaaaaggaacagacttttccttgctgagtaaacacagcaatgatggatgaatctcagaaaccttatgccaaatgaaagaattcttactcaagaatatacactgtatcaatctatttatatgacatttttaaaaagtcagaactaatctgtgatggaaaaaatgtcagaacagtagtagtccccacaagggtggcagtagggataggctgggaaaggatatgagggtattttttggtgtgataatgatgttctgtatcctaatgggactttctcagcaaatctacttaagatttgtagatttcttgaatacaacttttacctcaaaagaaaaaactaaacaaatattgaattctagttaattatatgcatgccgaactctgtactgatgtctgcaatttacattgaaatgtacaaaaatatgaagatgagttgatggatggatacaggtataggtagatatgtggttaaagcaagtataataaaatgttaattgttgaatctaggtggtggatatacaactgttcatccttaaaattatttcagtgttgctacgtgtttgaaaatataaatattggaaaaatataaaaagtaaaaattggcagatatagaaggtaacatacaaatcccattattgtactgaggaaagactaacacattttgttataactgatgtacgtcaaggaaatagaaaactcaagaaggatatagaatatttgaactaatggtcatataaagaatacattacactgttcattacagtgagtgcttaagtaacacattttttttttcaagtcctggcaaacagacttgcttggttgttatagtgactgttttgtagtacttaattttcttcctgtctatgttttgaatggaggagttgattatgtagtaaggagtactgttgattaagtagtaatatccctttagttactttgatgctccttccctaaatattctggatgtagatgttacttctgcctagaaaacaagtttattacaccattactaacactcaaacacaatatataccagattacaggggtttaaaagaagggatcaaaggatccctctcccctccacacataccctaaccagagagttatagtgtgtatttgatacttccctaaaccacttgaatgcaggatgcaataaaatctcagctgtatacctctagaagttctggttagctgttatttcacctctgcataattaatttttgtgttattcattttgaatagatatctgtcaaaatgtattgtttccttgaattttcaagtatacttactgaacttaatttaccttggagaatagttaagtgccataattgttattttgttacatcccagtggttactctttttgttactgtgtctacttgaagagttttcttttggggggttggctaccactgcacttgcctctaaaataacacctctccatctttacagtttgctgctttgaatcttctgtggccatgaaactagataactatgttgcttaaaataccttgagaagagagcaggcttatgggcatggccttttaggaagcacattaacttgatgatgcttaattttggttcctccaagaatgatctcttttgcctactttttgagtcttagctttatggaggatagtgaggttcctggtgtacacataggcattttagttggtacactgcttgatccactcctcctacagattgggaagggtgacttaaaatgcccttaaaagcaggacaactttaatgctccgtagagttcattttaatggtacttcgtttgtgacataaattgtgttaaccatggtttatagcaagttggggcatagatttttatggaattgtgtggcactattgtagtctgaattttattggcttttttacatagtcttaggcagaagattttccaaggttaaatgcttaatgtgcttttcactaggacctgataaaaaaggacaccagttctcatgtgtttgtcttcatggtgacagaaagcctcatgagagaaagcaaaacttggaaagatttaaggtactgatacatagttgattgtttccttaatacttaagaggggcattatatctagttttaagcagttttaattaatattattaaagcaattattgtcctagaaatttcaaaatgtttctaccctaactaatgtgtcatcatcatgacaggaattagtcattgttgacactcaaatggtaaattatacattctctatcagcataacactactataacaggaattttcaatttcagaaattttagttaaattatttcaggtagatatttttaggagaagtatcattggatagttaagccatgtctatgtgccttaaaaacagtctccagcaatagccataaggaacttaatttgtagattaattaagacaggtatcagaatatggctatgtagaattaaaggtattttgatactgtttggggcagacctttccagttatatgcttgcagcacatgaacgggtcatatagctcttggtgtaagtgggtgggtaagtaaatggcttgagccatttagaactaaagatcggtaacctgtctacctgcaagcagtctcattaatttaataggccccagtgtatagcataagtatcattttctaagaaaaaagatgggaagtattgggttgaagaactttggcttacgtttccatgctgggcataattgatgcagatgtgaaaacacatcgcatggcctcgtttgaatgtgtgctacccttctcaaccgtaggcatttttctggaccataagtcagtatacccttcttccctcccccagatctctaattttgctgtgccttgaggcacaaatgacattgaaaggctaatttgtatttcttggtgagcaccaggggcctaccctcattttcctccccttgagaattttgtctgttacaaaaaatgtagcctccaggtaaaatatctagtattctgagtttatttgaatttaagagtaaagataatgcttatgtctgtacattgtattctgttttgtctttctcttcaatttctaaagatatttataaagattaagccaagttttagcaatagtttaatatctttgagtagaaaaagaaaagcaaaaatgaacccaatctctgatttaatcaccttaaatgtcatgtttcagcagatcatgacataaaacttcaagacttggtccagtaaattaggagtatgtcgacctctaatctgatagtaacacttgagtttttagaggtctcatttagtggaaggatagcatttgtttttattgtttagtatatgtgctaacaaactcctttctctcttcactgttctctttagaaaggagatgtaagattcttgatttgcacagatgtagctgctagaggaattgatatccacggtgttccttatggtaaaaagcaactttttatgcctgtagtgtgattgttacggaatctaaagtaaagccttctaatatgtttgaaaaatttagaaactactggcaattgttaataatggtttttatttatagttataaatgtcactctgcccgatgaaaagcaaaactacgtacatcgaattggcagagtaggaagagctgaaaggtacttctgcaattttttttcccccatttttaagcttgtatgctttaggaataaagtctaatagaaggcttttaaccatctttcaggatgggtctggcaatttccctggtggcaacagaaaaagaaaaggtaatctttgtagggctctattatattcattgtgtgtgttgtgattttagatgttggaaataaaagcagtttgattttcccatttaaatttaattcagctgcgtatggaatacaaatgaactttttaatgtcatcttttttcctatattcattgaatggacaaataatagggtgaaatttagaaaggaaaaatgcaaaatataatttttccaactagctttattgtactcatttccaccaaaaaatatttaaacattttctggcatggtgccatggaagacctttcatggtgaggggagatttattttgatataattacaaatttatagaaaagttgtattcataaagagctcccatatactcattgccaaattcagtagttgtacattttgcattatttgctttattattctcttatacaaaagatttgaacttatttttcttttgaacttttttatgttaatattgacatagtatgcttcaatatttactttttcatcctacttttatctgagaattccttttgatatctgacacccattttaggaaaacttttggattattctcaaaaagaactttttcagaagacctatttattcaatgagctactgaatagtagtggtaattggatgatatatcatacctataatctatttttctagtgccttgaggacagaaaacaattaaaaacaaatttagaataagatatttagcatgtctctatctccatgcatgttaatattttttcctttttaaatttaggtttggtaccatgtatgtagcagccgtggaaaagggtgttataacacaagactcaaggaagatggaggctgtaccatatggtacaacgagatgcaggtaagacttcgagttaggctcacaaataatgtattaaaatggtagaatagaaagcatttatcttcaaaaattatatcttggcttttatctgtttgtcacttataagggaaagtcgtagttggttataatgttatctgcactttgctaattgtaagttgtgaatttctctcttcagaaatctgacttccatttataccaagcattctggcctttccagctttatttaatgatgataaaatgcaactctttctaaatgaaatttttatttggaaattttctctccattacttagttactatctgagatagaagaacacctgaactgtaccatttctcaggttgagccggatataaaggtaccagtggatgaatttgatgggaaagttacctacggtcagaaaagggctgctggtggtaagctttgaattattttaaatacaattttaaatgtaaatatacctgttttgaacttcggtttgggaaggcagtactttcatttcattaggttaagagtatatttttagcgtgttaatcattccctccttattaccctcatagtactttgtccatacctgccttgtagcatttttaaattgtgtcatctttatgtgaatgaaagacttcagcttagctctttctcttgaagtgttaatgtcataagagtagttgaacattttgtggaattagtaggaaacaagagcataataggtgattttgaacaaggaatcagaagcctttgacttaactcaggtggtaattcagcatattatttcctctgcctgggatgcccttttgttagcttgttcctgaaaaattgtaagactcaggcctaactagttgtttccgagccaagggtgggtagaggtgttgggacagctgttagtgaggcctaattatttatttatattgaaataattgatttaacattttttaaagtcaaagttctggagataacttgcccagtagtacattttattgctgcaagcaaagtttaaagtgatataattgagccaaagtattgctgacaagttatttcaagcatgtcatttacattactttgttatttgtgtgtgatgcaggtggaagctataaaggccatgtggatattttggcacctactgttcaagagttggctgcccttgaaaaggaggcgcagacatctttcctgcatcttggctaccttcctaaccagctgttcagaaccttctgatttttacatttactgaataagatttgagtaatgaaagtctgtagtcttaaaactctaaaacagttgtactgcttccaagcagcagtatttatagtaacgtaagctattaatgctaactcttgcatgtcaagaaacattagtcttaggaattcttcaaaaaatggcatcccaatgaaaataaatttgatgactatattttcatgaa

SEQ ID NO: 1676 - DNA, 71023 bp, Homo sapiens
tcatttataaagaaaagaggcttaatagattcacagttccacatggctgaggaggcctcaggaaacttacaatcatggcagaaggggaagcaggcaagtcttacatggcagcagatgagagagagagtgtgtgtaaaggaggaattgtcaaacacttataaaaccatcagatctcatgagaactaactcactatcccaagaacagcatggggacaactgcccccgtgatccaatcacctcccgtcaggtccctcccttgacacatggggattataattcaagatgagatttgggtggggacatatagccaaaccatatcaaatagcaattaaaaaaaatcacataagaaaagacactcttaataaaatacaaatagaaaatgaaaaaaaaccaactcataaacttggtttaaataatccatttgtattgggtcttagtaagaatactactactagtaactattatcaagcaactactgtgtcatgtacttttcacacattcttttaattaaaaactctccactaacccttacagttcagtattatccttgttttacagatgaagaaaagccaaagagaagttatataactggcaagtttctctggctccccgcctgcaccactgctcaccagattgcatgaagagggaggcagctgtaacacctcatcccgttgatctccagggaactcagatacttgtttccacgtccaggaaaccgcaaactaagctctttgaagcatcagcaaaccttgctaagtgacacgtgaatgccatttggatacatattctaatctttcaagtagaaaggacagtcagactgcctcatctgtaacatccaagggatctgagaacagacattcagtccaggtgttgaacatcaacatcattataggaaaatggtcaaagagaacaatggcacacgttaagagaacatattaatagggcaagatgtatagtaaactaagttttcaagaagtattttatcatttttatgctctctactaaaagctgaccactgtagagtggatacacattgctacatacagcaactctacagtggacagcttttagtagtaagcataaaaatggctttatgttctcatgttctctgtgtagccataccacacgttgctacaccaggaacatgagtacatataaccattacatatacatacctgtatgtatgtatattagttacatatacatatgtacagtatatacatgtatatatattgaacccttggaagggatcagcaaagaggaggactcaataaaaaaagactagaatagaactagaagagagagaagcccagggagagcttcaagaagagtgctcaacagggccaaatgcgcagaggtcaaatagaaggttaagaagtgcccagtggatttggcaaccagagtcactggtaaccttcaaaagaacaatttcagtagattgttaagggcaaaagccagtttacagtaggttaaggagacaaagggagataaaaattcccaacattccattcattcatctatcccagtgtgtacagagtgattactgtgtgtttgttggcagttgactctaaaaagaaggctagaaatgaggctttttaatttttcccaagtactatgagctctgttggcctacaaaatactcagtgctgtgattcactcatttgtgctttgcatatataatatagtacaaactgctaaagatatttttaaaaaatatattttcacaggggtacaagcgatccatgattatacccactatgtttgtttcttctccactcaaagttactcattccctgtagctgaagattgaggacctgatatcatttggacatttctgctggatcaaatggtatcttctcaaaatgaaagtccttccacttcgagtacagtgtctgaactccagttgcaatatcctccaccacaaaactttcaatttttataactggaatctcaaatgtcttgtacttcacatggattccccagtcatggctgcagttctgtcgggcacagaatatctttgctcttttttcaaaacttgaaaactgctttggcttgggatgtggtctactcacaaagcattccttaaaagcatctccaagcacagtgtaatggcattcctacagatgaagggatggaataacacacaaaagagaacgttagaaccagtacataattgtgatttaaaaaaaaaaaaaagaaaaccccacaataatctgaggcaaagaacaggtgggtctcacttattttacaattggaggaaaaaaaaaaatagattcacccaaagtccagaggatccatgcacctgactcccctctacaggcagggtggggttgcaagtgaggacactgggcacctcataaagaagaagattaagaaggttccaggtaacccagcttctgaaggtagatactcattattcaaaaacagaagcgatgtttgctgaaaatttgtgaagctgaagttcaccagtggccctggcaggcacaatccaaaggatacagggaaaacgaccaaggtcaagatgcaattgaagaaggtcagggactaatgtgtccacaggccccacctagagtcaactttagagtaaacagctcagaaacaaatgcagatccaacatactagtccctcaggaaaacatagggtctaaaagggccatttttagtagaacaatcacccaaattggagctgaaaggaccttttacagctaaagaagcagacttagaaaggtaagggaacttagcaatatgactcctaataggctttttgcccaaacagctgagctgatgagagatttctgctttctgaagacgaacggaacatcctgaagtaataactcctcatctgagccagcccagcccctccactgtgccccccatgcaagagttataccccatatttctctttggagatttttctaaccctttctctgaaagttttaagaaagaaatataaggctgcaatagaaggctaatctgcagatgtcacattttacaaataaggagatattttgttttcattataaaagtgatccatagcccaaaaggaatgtttggaaaacataaggtagtaggaaaagagaaaaaaagtcatggaatctcaccaccaaaatattaatacattttggtatagttcccctagcctttgtttttctgtagcaaggtaggttttttgactttttctcttgacaatgacaatgaatgtatttgctgctgttgtttcacacagctacaaagtagcatctttacaattctgtgttctggttacttttttccttattaccattagtttgtaagcagtttttcattatactacataaacttcataattttttaaaataaactttactttggaacaattttagatttaaagaaaaattgcaaagatatcccagaaaatttctgcataccctttacccagtttccccaaatgttaacatctcatataccacagcacatttgtcaaaaccaagataattaacatcagtacattactattatctaaactacagattttaccactctttctctagttgtatcctttatctgttccaggagctaatccaggacacgtcattgcatttagcatgacttttttttttttttttttgagacagagtcttgctctgtcacccaggctggagcgcagtggcgcgatatcagctcaccgcaacctctgcctcccggttcaagcgattctcctgcctcagcctcccgagtaactaagattacagccacctgccactacgcccagctaacttttttatttttagtagagacggggtttcaccatgttggccgggctggtctcgaactcctgacctcgtgatcgcccaccttggcctcccaaagtgttttgattacaggcatgagccactatgcctggccaaaaactatttctttattattgaacatttagtatttttttttcacttcttagctttttttaaatacacagatcatggccacagtaacaatggaaataatagtagttttattataaatatttcaccaacagtaagctgtagctagtgctaaaacatgaccaggcactttgtaaaaaggcagcttacctctatcactcttacgtcagctgtgtaacatgccaaggctttgcactttctgcagagcagttttttattttccttatcaggtacaggttttggtttttcttgactatctctgatgaatttttcatgagtctgtatatgcagaatctaatgcaaaaagaaagaccgcaaatgtaatttgagtacaacatatatagcaagaaacaggcacagatacgtacaatacatatacatgcacgcacatgtataatcattcatatacaacttccatgaacatatggtacctgactttgtaaaatcacagattttattggttctcctaacttagtattagtcaatgcttaattgtggcctccaattagtctttcaatttcttcatcaaaaatgctcataaaagcactaaagatgtccatagaatagtcatatgaactatgctttctactttagtgtttggcaaaacttgggaaaaaaaacaaaacctgtaccagatatacaatatgcgctgtttcaggcataattatatccatttgcaggcacaaactcagtgagtgatacaacaggcagaagagcccctgatatggtttggctgtgtcctcacccaaatctcaacttgaattgtatcttaacagaattcccacgtgttatgggagggacccagggggaggtaattgaatcatggggggccagtctttcctgtgctattcttatgatagtgattgtgtctcacaagacctgatgggtttatcagcgtttccacttttgcttcttcctcatttttctcttgccgctgccatgtaagaagtgccttctgcctccctccgtgattctgaggcctccccagccatgtggaactgtaagtccaattaaacctctttgttttcccaatctcggttatgtctttgtcagtggcatgaaaacagactaatacagcccccaacatctaaaaccttttttctctctccccttcagccacagggaatattgttgcatatgtatagtatgattgtattctaattcaaaatctaggccttggctaagaacatggtccaacttagaaccatggacatgatattataaaactcttcataccaataaacagaaagatctcaaactgaatgaaaaaaaaagacaatcatagatgccaacactgagaagagaaagattttaaagcacctaataaagatgcttcgatgggcaattataaatacttttgaaacataaagagaaaacataaaggctcaacaatgaaatggaagacataaagtttagaactgaaagatacaaccaaaataaaaagttcaatggatgggctttccatagcagaatggaagggacaaagaaaagagtcagtgaactgaaagaacaacagaaattacccaatctgaacaacaaaaaaatacactggggaaaaaaaaagcgcaaagtctcaaggacccgtaggactataaaaaatgatgtcatggcactggagttctgcaaggagtgaagaaagagcagggcttaaaaagtattcacagaaatgacctccaaatatatcccaaatttaacaagctacatcaaccaggattcaagaagctgaacaagctccaaacaggataaaccccttcaaaaaacactctaagacaggttataattaaatttatgaaaactgaagaaaaaaatcttgaaagcagccagaaaaaaaaaaaaaaatgacaccttacccatagggggaaatcagtctgaataacaggagatttgtcattagaaacgatggaggctacctggaagtggcacaatattttttaaacgctgaaagaaaagaacagtccaccccagaaccctagactcagcaaaatgccaccttcaaaaataaaggagaaatgaagacattcttagatgaaggaacactgagaatctgtcatcagcagatttaccctaaaagaatggctaaaagaagttttctaaacagaggaaatgataaaaggaaccctgaagcctcatgaaggaagaaagaacacactgatttcctccatgtcttctatggaagattctgtccgtcccactggtttatggtttatggtggcgcctctccatatcagattatgctttcacgtgtcccaggtggatccagacagcctaggtgcaaatagtgtccctgtcacttagcagctatgtgatttggggcaagtgcctcgtttctttacatacaaaatgggacaatagcatctgcttcacggactgtcaggagataacatgagtttatgactgctcaggcctgcccagcacagggtaaatgcccatcaccgttgcctcttctctgttaggctagtcttatgctaagagccatgaaaatgttaatggggtggcttgtagttttgtattgataaggcaatctccattcattagggattgccttatcaatacgaaactactagctacccccatttttatttttctagaaatatagctattttcatctatttattattttatataaactctagaaccattttatcaagttaaaagtatcatttatgctttcaatatggtttgtgacacgtgaataagcaaatttggggtgaatgcacgtgtttaaaatattcagtcattccattcaagagcatggcatttcttttatcttaatatctcccagtaaaatttttttatttgtcctcatttctgcttcaaacttttctgattaggctggtagatgtaatggtgaaacagatgggttctaccaactctaccatgaactagctgtgtgatctactggcactgaagctattcaagtctcagtttcctgcctataaaatgacataggaggcactactgtatggattgctgtaaagcctattgatgtaagtaaagcatttgcagggactgttggagagtcagtgttctacatgcatgagctacacttattgtcactgcgaatggaaatctccctcccccttatatcttttaattggttacggatcatacatagataatatattgattaccataccacttcaaattcaaatttgctttatataaaaaaaaaattagatctagcttttttttttttttttttttttgagacagagtctcattttgtcacccaggctggaatgcagtggcacaatctcagctcactgcaacttccagctcctgggttcaaatgattctcctgcctcagcctcccaagtagctgggattacaggcaggtgccaccacatccagctaatttttgtatttttagtagagatggggcttcaccatgtcagccaggctggtcttgaactcctgacctcaggttatccacccacctcagcctcccaaagtgctggcattacaggtgtaagccaccacacccggcttcctttcccccactccccctttttgagatagattcctactatgttgccctggctggacttgaactcttgggcttaaatgatcctcccatgtagctggcgcaataggcgtgagccatcatgcccagctagacctagaatgttttgatttaaaaaaacaaatatactggctgggcacagtagctcacgcctgtaatcccagcactttgggatatgccgaggctggcatatcacttgagtccagagttcaagaccagcctgggcgacatagcaaagccccatctctactaaaactacaaaaattagtgatgcgtggtggcacacacctgtagtcctagctgcttgggaggctgagattgcagtgagccaatatcacaccactgcactccagcctgggctctgtctcaaaaaaataaataagaaataattaaaaaattaaaaaccaaatataatttccccttccccacttcttggccccatcccacctgaaattatcttcattatttttgtaaaaataaagggtgtccaggcctcctgtttttaatccaatttttcagttgtaaaactgttacattatatgtatttatcccattctttcctttggacaaatttctagaattgaaatccctgggttatatgatacacattttcctatgagcaattttaattttcttttttaatttctttttcagatatggttctaatcactacttaagcagaatagaggttaccaggaaagaaggtgaaaatataaccttgcctttcaggcatccaactttttaaaaaaattcacttataatggtattcaattatatactgaaattcaattaaatactaataatctcaaatattttaagtgttactctaggcaataggtataaatcctaataagttaaaactattacagctatacttaaaactaagtaaaaatcaataactgggtaaagaggctcaaccaatcataagttaagtctatggcatactgaccttcacccatgcaacctgtggctaaagaagcagcctagctccacacactgaggtggagaaaagcaaactatcttaattatgtgtagtcatgggtatgcatgttggaagttctttgttcagaatgaactttctttcaccccatctttattctctgctccatgaggaaagaaaaacagcttcctcctcattctgatttcaaataaaccttcacaaccacaactgtcataccgttcatcccttattcctccagaatgaaacaccaccaaatcctgaagcgtccaccatggaaatcagttcttggatacctctgggctgtctacatgttaagatggctgcagagtgaccagagaattctggggcgggggatggggagtgctctagtgacagcaggccacacacagacaatggacagtacagctggggcgctggggaagaaagcagtctgccagtactctgctcatccctctccctttcctgttcttgcagattgccctaaagagctccaagcttttgccctctgttctgcagagttccttccttccgttaaaacccatatacagggaccaggatgctcaaacccaaaccccaaacccttatcaaagcacccacaaaaggggggctcacccctagaaccataattccctttagtcttaagaatataagattttccctacctcgttatacttttactaagcctttttttgtttgtttttttgagacggagtcttactctgttgcccaggctggagtgcagtggcgcgatctcggctcactgcaagctctgcctcccgggttcacgccattctcctgcctcagcctcccgagtagctgggactacaggtgcccgtcaccgcgcctggctaattttttgtatttttagtagagacggggtttcaccgtggtctcaatctcctgacctcgtgatccacccgcctcggcctcccaaagtgctgggattacaggcatgagccaccgcgcccggcctttactaagcctttgaaagcaaatccttcccctttgagcagggcagctgggcctggtcatgtatgataggacagggataccaacacaactcaggcttcccagctgccagtaactcccagctacactggttatagggcttcttgttccctaccatctctgcctatctatctgtaagtgttacgggaaccccaaatgctattacatagcctgattcaacagatacttaacccatttcctcctcaccccactccttatcctggtgtgctggctacaaaagaatgcctacatctggtctagcctctctcttcctcaacagacttttactctgttgcttctgtcacatgagtctaagtagcttgtcacctaggagaagagataaaaattatgccatggctattaaaactcgtggttttaaaacgtgtattggcaatatattttacaaaatggaaaggtggctcagtgaagagagaatagagaatcccatccccagtaaaactaagggaggaactaaataatttccctgcaattcttctcactgaaaatgtggaagaggtggttctagataacttaatctcccagctttaggaagaaaaatgtttttagactagtaaacattgacaaagttttgatttgtgtcctaaaataagtgttaatctgctttagataattgatggtcaatactttttggagcacagagattatgactttttaaaattatagacactatggagttggtctattaaactgtaaggttcatcttcatgaagttaaactatgtctcacacttctgtccagtaacagctctcatttcttgggcacgtattttatgccaggcgctaagagatgcaatgcatacatctcatttatcctcatgaccaccctgggagttaaatactattattttccccactttttacatgaggagattgattatttaaaagacagagcaactgcctgaggtcacacatcttgcaactgatagaactgggatttgaaccatggattctagtgttaaagctctcccctagccctgcagtgatcatgcttccagagattctgagatgaaaatctctgcaatgggtctggagaaagtatgggtatgtgtttcttgactttctccaatctgatttcatgtttctgtgttacggaaattacaatgaaatgaaggtcattacactaagaggttgatctgaataggcatcccattccaaggtgtatatcattgtccacagctataaaaagacattccaatacctgcacagtgacctaggagcttttctctgaggactctttggagagagatttaaggaagagactaagaacagctgttttttccagtattaggatatagtcctcgagatgaactgtcaactagagaaatcctagctcaatttgccttttagatctgaaaacataacttcagttattagcactattaaatataatttaacctcattgacatttaaaaacagaatgaatttaatattcactaagtataaactttttgttgtaatataacactctaagcaatatgataaaagataccaaccatcctcctcacattccctgatagttatttatggtcagatgctggaagaataacgtagacttaccttttccctaaatactgcttcgtcccatgtctgaaggcgtaaaatagagtcattcatcattttttctttgtacatgtttatttgttctttttcaattacaccagcattactagtcagaaggaagcacttgctacctcttgctcttcctctgcctattagaaaataaatattttagttggtgtttttgacttaaagctctgatataatctgcaaataggtaaacaaatagaggtactcctaaaattcaactttggttcactgaatcccacttcccaggaaagttgagctgttaaagagtgaactcatgaggcaggattgcttgaacccaggagtttgaagctgcagtgagctaggattacaccactgcactctagcctgggtgacagagcaagacctatctcaaaaaaaaaaaaaaaaaaaaaaaaaaagactcaaatgcaggtgtgcacctgcatgttaaatatgtggaaaaactaggagcccaccttaggctggctttctcagggtctcaacaatgcagggtgattagacagccgtactgtcagaaacactgctttaaagatacctacatgaacccccagtatgacactgtgatggctctaagatgagcagtaaacaggccctccttcaagaaccttctagacaatgaggaaataagatctcttcataaccagcaaaacataggtggaaaattttaagtgctattacaaagacagatataaaaggttataggctttatatgttcaaaagagagatttttgccagctgggaggattagggtcaggtgatatggaggcaggggaagaggtaaaatgaagagtagcagtatctgagcagttccgtcaacaagcaataagtgaggaagtcaggttggcggaagtggataatgcacaaaagggaagaatgggaaataaagttggaatgaaataggtgttggattttggaaactctttagcatcaagtaaattggggaaccactggtgtttcaatacaaggaagtgacacgatcgagctgtttttcaggaaaagtaatatgatagctgtacttatggaattttaagaagaaaaggaaaaaggaggaaagaatagttaggagactagtcaagtccaggtggggcagaacaactctggagtatcccttcttgaatacagggggcccttcagcccaccagcaccaccatgaaaggtttacatgttgactggcaaagcttcaatccaagttggaattattcttccataaatatatcagtcaatgccaggcaagtgagcagcatcattgtaagaatcaaagtagagtttatgttagtgaacaaaactgtagccaccttaagggccaatgataccaaagtgcactgtgccattggtcacatactcaaccatggctcagtaaagagaaaggccagaatgacacatacacttataaatcagtcaaaacagaatccatgtaggaatggcctcaaagcttctcttacctctggtttggatcattttgatgacattgcccacatactcataaaggatgacaagattgcactgtgcaatgtcaatgccttcatcagcaactgaggtggcaatcagaatattgtgatctccactggctttgaatgcatccaatatacacttctgtgccgggagggtcattcctgtgtcagagtaagagggcattatacaactcaccaaagagggaacttcccccttgaaaaaacagctactaattatggaatgcttattatatgccaagtactgtgataagtactttatatccatgatctcacaacacacctaggcagtgggatctattcctatgcctgtttcagaaaggacatttagggtggcatctaacactcagactctgccacaagactgagttcaaatcccagctctgggggacttactagttgtatggctttagccatattatccaagaaatagacatttttgcagaaatatcaacacctaattgtaacacctttacatgtgtgtaagaatttatagctgacaaaacattttcacatcttctcactcaccagagcatcataaagccctataggtcaaagggtaagtgctctgattccccttaacaaacgagggtcgtgccaggcatggtggttcacgcctatagtcataacactttaggaggccaaggcaggtgaatcacttgagcctaggagtttgaaatcagcctggttaacacagggagaacccatctctacaaaaaatttaagaattagctgggcatggtggcacacacctgtagccccagctactcaggaggcttaggtaagagaatcacctgagctggggaagttgaggctgcagtgagccatgatggcactactacactccagcctgggcaagagaatgagactctatcttaaaaaaaaaaaagacacaaatgaggggcttgaggttccagaagtgaggtaaactgacaagctagctatcagcagtgttgggccttgaacttcagtttaagaccctaatagtgtgcactgttggggtgtctgcctccccatacacaaactaagaatcattttctgccacacccacccacaatacagttgtattatgtttctctatgaaagaggcaatgctatctgctcaccaatcttgtttctttctcctgctaggcacacacagctgaattatatttcgcaatctaaactgtcactaatggcatgtagacagaggtcatgtgtgtctcttccaaaccagacccctaaaaattgtccatgttcttgttatttctcatcaatggaccagataaggtcatagtggaggatttggagaccccctgtgatgacagagccataacaaggaaggagcctgggtccctacaataagtggaagaggatggagcagagcccccacccctacctatctacacttgggagcataagtgagcagagcccccacccctacctatccacatctgtgagtgtgagctataacttttattttgccctgcccctgagatcgtgagggttgtctgttagagcaattagattacactgatttatacacagcctgttcctggctgcagctactggactgaaataagcatttgaactatgttgggccaatccaattcttccctcttggaatctgaaattgggattggagacaggtagtaaatcaggaaggtgtggggcagtcatgaatggagaagcagagacagcaatctgtaaagggaaaactgtgaagcagatgtgcaggattcaggattgcaattgtccacaaagcccgagtgcacttccgaactgcgggttctatggtagacccaattatcccggtagcagccacacccccttctacttagactagcgtaagtgggtttctgttaatcggggaaaagaaaggatcttgactaagacaaccacatactgccttctaatatcctgcgatagtggaggctaaatttaaattgtctgaatacagtgtgaagtttggatgtgataatcacccagtttgtgtaatcatggcggacacccaaaatggtggctcaaacaatatgcgcacttcaaaccgtgtggatcctaaagacatctacgtttatctattagtagaatcacctgatctccactcactgctcacagggcggacccacctcaggcaggtagagcaaggtaatccatattactttccattacctagctggcagtggactcaagagtttgtggaaaaagatcccttgtggtttttgaattatttaccattcaaagtcatgaaaattcaaatgcaggcagctttattttcagaaagttgcttaaaaatcaatctctaaacattattttgattttacttttgagctttctttatccagaatactttttttaaagatacatactttctgttatttttgaatccatgtattctcagtaaaaccaaaatcaaacaaatgatgagcattgtggaccattacataaaagttctggatgtgaatagtaactaacatttaacatacattgagcactcaccacatgccaggcattgttctaaaccagaagtgggcaaactttttccataagggctagatgtatagtaaatactttaggctctgtgggtcatgctgtctcagctacccaacactgccattatagttggaaagcagccacagacaatacatacatgaatggtcatgactgtgttcccccaaaaagttattttatagacaatgaaatttgaattgcacaaacctttcacatgtcataaaatattcttttgattttttttcaaacaaaaatcattctcagctcaagagtcattcataagcaggcagtgagccagattttgctactgacattaaccctctcagctaggtactattattatttttccatttgacagatgaagaaagtaagtcatgaagaggttaggtaacctgcttcttcatgaaacaggaaattaagaaatggaaatgtggaaatatacaaatttagcaaactgaacttttgcttgtttacatgcagctttttgtaaaaaaaggtgttcacaattcttctagcttaactgtgcaaggaagaggatcagaccagaaacaaattcagctaaaattgtcttaatttactggtaaatcaagtttaacccattcgataaaagctatagagttcacactgataaactgagtgaagaaaatacttcagtggtctctacctcagggttaacagaatttatagaagctccaattggctaggcatggtgtttcacacctgtaatcccagcattttgggaggtcaaggtggcagattacttgaggccaggagttcaagaccagcctggccaacatggcaaaatcctgtccctactaaaaatacaaaaattagctgggcatggtggtgtgcacctgtaatcccagctacttgggaggctgaggcatgagaatcacttgaaactggaaggttgcagtgagctgagttcgtgccactgcactctagcctggaaaacagagcaagactctgtctcaaaaataaaataaaataaataaaagttccaattttttcctaatatatttccagcccaaatcttgagatatattttgctaaggccaaaacaatttcttttcaccatcatcatctactaaacaatgagcatctctggaacagacatcatacgtgattaatttcttagtttattcatctattcagtcaaacatttattcagcaattatggcttgtcagataaaaataatgattaaaaggtccatttttatccacaaggagctcacattttgtagaagaaaaatataaataagaagctataattgagtatgatgagcacagaaaggatgctatgcgaatgtggaagaaggagctctctaccagtttttggaggttggggaaggctacatggcagaagcacaatgcctggcacagcacaagttataaataaatgttgttgaatgaacggatgaataaatgaacaaaccaataagaaaatatttcctgagtgtctacttgtggaggaacaacaaagtttgaaaatcaaggaggactcatgttggagtcagatcgcagagaactttgaatcccaaccacaaaaatatggtgttagacttcatttggtgagccactttttaagatctgaatctacttttcatatttatgaagtttaaaaatgacatgaagggaaagtgcgagggtgataactagggactgacagggtgggtatgggagggtgcttattataaacaacactaaataggaagacttgtcagtgccagtcactgaggggtggggggcacagctgtgaggtggtcaggatgagggcgggccacctaggatcctcccagataataacacaggcagccttttatcctttgaccactctagctggatttcagaattgtctgcttggactttttaaaattgtaaaatacataatatacacaaaagctatgcatatctactgcttaaagaataacaataaaacagaaatagaacatttctatttctagacaatcttaatctattggttgaaaatttgagcaggatgataatgcgtgcaagcatgacttaaaaaacaaccctggctttgtctgcaggacatatgagaggaggcaatgtctacaaggaaagagcctggagtggtttttggcatttgagcattgtgatggctttttgatgcattaacttggctaggccaaacaacagttcccagtaattcatctaggtactgctctgaagagattttaccgatgggattcaagtccctaatcagttgactttaagtcagatcaaaagagagttcactccaggtgggcctggcctaatcaggtgagccttttaaaagacggcttaggccttctccaaagtcagagactccaaacagctcatgtctggggggttccagtctgttcctgatagtctcttcctgactacctgccctacacgcttcagacttgctttgccagcccaattgtgtaaaattccttgcaagaaatctctgtatatatgcatatgtggacacatatacaacacacacctctcatatatatgtataatcacctactgcttttgcttctgtggttaaaccttgactgatagaagcattaaaacagaacttgaaatatatattaaaacagaatttgaaatatatattatatatatacacacacacatatacatacacacacacacatattcttaaatgcataatccactaaatctaattcactatatataaatacctgtgttctgatttgttttgccacgtccagtcaatatgccaggttttagaaaactgagtttaggatttccttcaatccaattttttaaagcctgaaaatgaaaagcaattatcaattggacactccttataaatcatttgtattaattcaatattgaaatacatgcaaaaagaaaaaaatttaaagttagtacacgtacagttttcagactgacaaacctgagaaaaaaagcattttggaattgaactctatgtaataattaactaaaatggcatagatctctgtaacctgatatggtttaatctctaagactttttttttttttttttttgagatggagtcttggtctaccgcctaggctggagtgcagtggcacgatcttcgctcactgcaacctccgcctcccaggttcaagcaattctttgcctcagcctcccgagtagctgggattacaggcatcagcaaccatgcatggctaatttttgtatttttagtagagacaggatttcatcatgttggccaggctggtcttgaattcctgacctcgtgatccacccacctcatcctcccaaagtgctgggattacaggcatgagccaccgcacctggccatctctaagacatttttaaaagaaaaaacaaaagttcaaaaatagtgggtatgtagaataagtgagtttagcatgatcacaggacaggagatcaatatacataattcaactgaatttctacatactagcaacaaactattggaatttcaaaagtttttaagtactggacacagtggctcacacttataatcccagcattttgggaggccgaggcaggagagtcacttgagcccaggagttcaagaccaacctcggcaacatggcaaaagcctgtctctactaaaaatacaaaaattagctgggcatggtggcacacacctgtagtctcagctactcaggaagctgaggcaagagaatcgcttgaaccggggaggcataggttgcagtgagccgaggttgtgccactgcactccggcctgggtgacagaccgagactccgtctcaaaattaaataaataaaaataaaaattagctgggtgtggtggtttacacctgcagtcccagctactggggaggctgagatgggagaatcacctgagctagggaagttgaggctgcagtgagctgtgatcacactagtgtactccaacctgggcaatgagagtgagaccctgtctcaaaaaaaaaaaaaaaaaaaaaaggttttaaagtaccatttataatagcatcaaaaaattaatacctaggtataagtctaacaaaatatgtgcagaatctgctgaaaatgacaaaacactgataaaagaaaccaaagaacatctggttagtctacctctaaggtagccctcaatgatctccaccttctgtattcagatcctcatgtaatcccctcccctgagtgtgaaggggacttactgacttgcttctaatgaataaaatacaacagatgcaatgtggcatcatttccaagatgaagttatgactgtggcttccaaattagacaccctctatctcaatctctgggatcactctctctaggggaagccatctgctggtctgtgagatggacctgtggagaggcccacatgagtgaactcagaggctcttcagccaacagccatatgagaggagtttggaagttaaccttccccagtcaagccatggccagcaccttcactgcagcctcatgagagatcttcagccggaaacacccagttaaattgtttccagattcatggctcacagatattgtaagataatagatgtttgttgtttccagacactcagttttagggtaattgttcctcagcattatataactaatacggaagccatatataaataaagagatatactatggtcatggattagaacactcaatattgtcaagatgtcattcctccccaattttatctttatgtatttttaaaaatattttattttttcaagaccaagtctcactccatcactcggctggagagcagtggtgcaatctcagctcaccgcagccttcacctcccaggttcaagtgattctcctgcctcagtctcccaagtatctgtgattacaggtgcaagccaccacgctaggctaatttttgtatttttagtagagacagggtttcaccatgttggccaggctgatgtcaaactcctgacttcaagtgatccgcccgcctcagcctcccaaagtgctgggattacaggtgtgagccaccatgcccagcctcagttttgtgttcagattcaataaaatcccagcagattttttcatagatgtggaccagctgcctctaaaatgtatatagaaaggcaaaggaacatagctaaaaacaacctttaaaaaaaaaattggaggactcacatcaccccatgtcaagacttactatcaagctacagtgatcaagacagcatggaatgggtgaagaggtgtatgtatggatcaataaacaaaacagagaatccagaaacagatccatgcaaatatagtcaactgatgttttcagaagttacaaaggcaattcagtgaagaaaggatagtcttgtcaacatagagaactggaacaactgaatgtccatacacaaaaagaaaaaaaaaagaaagcatctcaaccaatacctcacgccttatacaaaattaatttaaaattgactgtagacctaaatgtaaaatgtaaagctgtaacgcttctagatgataacatagtgaaaatccttgtgaccttaggtaagcaaaggatttttagagataataccaccacaggcaaaaacccataaaagaaaaaactgatatactgaactttgtcaaaacttaaaactttccatctgcaaaagatactgtcaagagaataagcagacaagccacagaccagaagaaaatatctgcaaatcacatttctgacagaggacttttttgtcagactataaaaagaattctcaaaaactcaatcagatgatataccaatcttttcaaaagattggttttcaaagatctgaacagacacctcaccaaggcagttacagatcgctaacaagcagaagaaagatgttcagccatattactcattagtgaaatgaaaattaaaactctaatgaggtatcattacctactcacaaaatgactaaaatttaaaaagtaaaaaaaggaagaaatgcttgctctacaagtatcaatacttacaattagagtgactaacatagtgacagcatgaagccaggttccaaaactttgagagggcaaggtgggaggattatgtgaggccaggaattcaagaccagtctaggcaacataacaagaccccacctctacaaaaataaataaacaaattagctgggcatggtggcagatgactgtagtcccacgcatggtggcagagggtgatgaggtgggagaatcgcttgagtttgagaggttgagggtgcagagagccatgactgcaccactgcattccagcctaggtgacagagtgagaccccgtctctaagtgggggaaaaaaaaacaacacagtgaggcattagagtattagtataaggataaacatataatcagaacagaatagagaaactcagaacagactcacacatacacatatatggtttcttgaccgtagagagaaaacggctttttttttttttttagacacaggttctacctctgttgctcaggctggagtgcagagtacgctgtcatgatcactgcagcctcaatcaatcctctagccttagcctcccaagtaactggaactacaggtgcacagcaccagctaatttttcttttttaagagatgaggtctcactatgttgcccaggcaggtcttgaactcttggccccaagcaattctcctgccttgatttcccaaacttctgggattacaggcgtgagacaccatacccagcccaatcttttcaatgaatagtgctgggtccatttgttatctacaaggagaaaaaaagcttacgtccacaagtgctctggttttcacaaagagaattgttattgtctctgggtttaagtggtactcttcttgtaagatgaagcagaggtcttcaagtttaggattctcattgctgggatccctggaaacactttctagttcctgcagcttttctgcaaatgggaaacattttataaatggcttataaattctaaaaatttagaacacactgtgacctttagctatcgttcaaacagctgatctctaaatctttgaccagaattttatgagtagtaagtactgttttaaattggtacaaccttttaagaggtaatttggcaatatatatcaaaacataatacacacacatcttttgatccaataattctacatctaagaatttgagacacagttatatttagaaaattatggaagaggtctccaaggatttcactgtaccactgttcagggtgtaaaagaaaaacagaaaacctaagtacccaacaatagggaaacagttcaaaagatcatgggctatgcatctgatgttaatacaatgtggctgtgaaaattaataagggagctatgtacatgatatatatgataccaaaaatattttaaggttaaaaaaatcaaggtaaggacagtatgttcagtattatcccatctttaaaaatatagtcaggccgggtgtggtggctcacacctgtaatcccagcactttgggaggctgagatgggtggatcacctgaggtcaggggttcaagaccagactggtcaacatgctgaaaccccatctctacttaaaatacaaaaattagccaggcgtggtgatgggcgcctataatcccagctcctcaggaggatgaggcaggagaatcacttgaacctgggaagcaggggttacagtgagccaagatctcaccactgcactacagcctgggaaagagaatgatactctgtctcaaaaaaaaggaaaaagaaaaaaaatacatatagttataaaacaggggtgtgttacagccagatcataccggactatgggactatgggagtcaactgttgtggtttctgttttatcggtttttgtttttgttttttttcctgagatggagtctcctggcactcaggctggagtgcagtggtgcgctcttggctcactgcaacctctgctttctgagttcaagcgattcttctgcctcagcctctcaagtaactgggattacaggtgcgtgccaccatatctggctaatattttgtatctttagtagagatggggtttcaccatgttggccaggctggtcttgaactcctgacctcaggtggcccacccatctcagcctcccaaagtgctggcactacaggtgtgagccaccatgcctggccaattgttaaattttattactttttacaattatctacgcttttgaggttagttacacctattgttatctatatggtagaaatactatagaatgatgtgctgctgctcatctctttttaacactagttcaatgacatcatgttggtagcctggaattcactacagtgggagcagttataccatggaaatcaagaaaacacaaaaaatcagtgctttattgattgactgattgattgagataaggactcactctaccacccaagctggggtccagtggtgcaatctcggctcactgcaacgtctgccttccaggctcaggtgatcctcccacctcagcctcccaaggagctgggaccacaggagcataccactatgctcagctaatttttgtattttttgtagagatggggtttcgccatgctgcccagactgatctccagctcctgagctcaagtaatccacccacctcagcctcccaaagtgccatggtgacaagtgtgagccaccatgcccggcttaatttatgttgagagtttagacttatgaacatgatcaaaaaataataatacagattaaatttagctattacattgaatagcacaaaatattgagaaacattctcccagtttttgaaaaactattatacagttcagcaaaaaattgcttgcatcactggcaaacgagtgaagttccaacatacacctttgttgtttcatctttatcttctaacattaatgaaactatataccaacaaccatatcagaaagaaccacacttctttgtcattgcaacccttggttggccatggatacaaaaaatctgcaaaaaccaccaaaagcattctatgagaaccaattggctatgtggaatttacaataaagaatagtttatttttatttataaattgtggtttgtataactcctctatatcaataaaataataagcttatgtacatatatatgcatacattttttctctagtgggttgttaaatattaaccagcacagcactggttacacatatgtacagtaaatacttaggtagaggccaaaaaaaccccaaaattattagcactaattacctttgggaaagaattcaaaacagggagaaggaaaacttttttttgtttgtttaatatctattttttaatcatatgcaggcagtgagattatgtgccattttggtttcctctttatgtaaaaatatatataggccaggcacagtggctcatgcctgtaattccagcattttgggaggcagagacgggtggatcacttgaggtcaggagtttgagaccaatctggccaacatggcaaaactccatctctactaaaaatacaaaaattagccgggtgtggtggcgcacacctgcagtcctggctactcgggaggctgagacatgagaattgcctgaatccgggaggcagaggttgcagtgagccatgattgagccactgcacttgaccctgggcgacaaagcaagactccatctcaaaaaaaaaaaaaaagtatacataaattatggtttttttaatatcgttaaaacactttttcatatttttaaagctttataaaattactaaaaaagaacgttaaacaaaaagaatgctactgtctgtgaaccatatgggaaacaccctttgcaaatcttgtttttccttcttctaaatagggaatggtataagcaacagactcttcccataggtactagatttcattgaagctaaatagtcctaccatctccatcttcctacatccaggacaactccctaagcatccccaagtttatatatattaaatgcaatacatgtttgttttgccattccagtcaccaagaatgctactgtggcttcctcctctgaaaacaccactcaccttcaaatctctgagtaagatcttgctcaatctcatcgaatcctgctgctcggacattgctgaagaagtctttcaagtaatccagagcatctttcattcgtgcatgctcactgataatgagggcatcattatatttctgttgaaagtaaaaactgtctcaatatgcttccaatgtctaacacattcactgtatttaagttcaattcgttgtatttaacgaattgttttaagaaaacttttcttttcaaatctattccaacttagctttttaaagatgaatggcctctaacagttatgtaacaaaatctttgaaccaaatactgttaaaagaaaactcaattagctagtaacattaattatcatcactttggattattgaattttaccttagaaaagaaaaactgcacgaaaaacacatatcaaaatttaaaaataaggaaagtaaatcaacttccacatcaacctgcctcataattccaacatttcacttgatttctatatacatctgaagccatcactaaattgtcagtgtaccttccaaaatgatggccctgaccacatccatcaaatgtacaactaagctaactaaaattctacaaatgcatgctaattgaatgcattttaatatattttcaatggctggataagcagaggtgatagctgtcactatagttccttaacttcttggtgagccagagaacctggatttctgagcatggggcgtcaccaaaggtgaagaaatgtgtgcttcaggacatagcaacagaactttccacttgctgagctttcaagatgctgtcactggactggtcttgtatctggaataatgttctctcacaatcacccaattttttccaaccatgtcagttaatgctagaggcatggcatagaatctgagcctttatttcagtcctgttgcctgcagtatgaaatttcagaaaggaaatcgagatgatgttgaatgggacaacttttggagtttgcttcataagaactttctggaaaggttcctaagtgagctcttgaggacaggatgagaagttgatgttatcttggcttccacggtgccactcccagtaggtgctgtgaccagaatacgactcttaaaaagaggaacgtacccgcaaatgtgaagtgtataaaaacagggctttacaaatcctgctctcttcatctttgtctggcatctggaacaccatgcatgctttctgaactgtaacaatccattgttcatatttctgtgttccaaattccctattttgaatttgagataagttttctgttaaaaaaaaaaaaaaaagtttttcactgtctcatatggtcagtcatttagggttataaacaggcctcaccctctaattttctttttctttttttttttcctcgaggcagagtctcgctctgatgcccaggctgtagtacaatggcacgatcttggctcaccgcaacctccacctcccggattcaagcgattctcctgcctcagcctgctaagtagctgagactacaggcgtgtgccatcacgcctggctaatttttgtatttttagtagagacagggtttcaccatgttgtcaagctggtttcaaactcctgacctcaggtgatccgcctgcctcggtctcccaaagtgctgggattacaggcgtgagccactgcacctggcctaattttctttcttactctctgcaaacaggatattcctcctgaaatagtcttaagtcatctagttaaaactatttaactggattcagactggtgaaaaggtggaagcagggtacctgaggtgggaggagtaagaaaatagaaactcatgtgactccatcaccatctctccatccttctgctccttcccccattgagataacaccactgtgctgctggataatatgacaacctccaaactgttctccctacctcttgccttgttccctcccttgagttttaagcagtgcatctgtgtgtttgtttgtgtgtgtgtgtgtgtgtgtgtgtgtgtttgattgtttcttgagtactgtgtaccaagaatcaaagtaccttacattcataatttcatttaattttcacaacccatgagatacatattacatttcatatattgggaaactgaagttcagaaaagccaagtaataagtaatttacccatagtcacacagcaagtacgtggagaaagggcaggaattcaaacccacatgtgtcagatgcccaagctctactggctctatgagctgacaaccaaagcagcccagaaataaaacagtagacatgaaaaacccaactttgcctttaaaaatgaagaagtaaaaataacaggtctcaagagcttcatcagaggaggatatataaaagcaggagattggccggccgcagtggctcatgcctgtaatcccagcactttgggagccccaggcgggtggatcacgaggtcaagagattgagatcaccctggccaacagggtgaaaccccgtttctactaaaaatacaaaaattagctgggggtggtggcacgcacctgaagtcccagctacttaggagactgaggcaggagaatcgcttgaacccaggagacggaggttgcagtgaaccgagatcacgtcactgtactccagcctggcgacagagtgagactcttaaaaaaaaaaaaaatcaaggaggagatttaggactcagttcaccctatgttctgctttgctgtgaacttgggcctcctgttctccagagcagcattctcagggccaagcatagaatcggccctcaaaagacacttatcacacatgcatctgtctgtgtgcatctcctaggataagcctcagttgcttggttcaaagctggggcatctgctgtggtccaggctctgtgtagggtgctggggataagatgaggagactatggctgtgttctcaagcagctgagtctgtgagttactctggtatcagttcgccagggctcctcatgaagagcacagtacaacaaaagtcacaagcaagagctgtatttctgggttaaattcttcccctcactcattcattttcaataataggaacaaaggaggctacccaaacaagtagtattgacatgcttctttccaagttgcagctacagcgaggtggccagcagtaaagaagatgagccaacaggtactgattgaacctgggtaggtgtaaaaatagcctaagcagtttagagatgagcagctaactggattcggactggcaaaaaggtggaggcagggtacgggaggtgggaggagtaagaaaatagaaactcacgtgactccatcaccgtctctccatccttctgctacttccccaattcaaaccacatcagtgtgctgctggataatatgacaatctccaaactggtctcccttcctcttgccttgttccctctaacccatactctacccagtggttagagggagtttgcaaaattgcagatgagaaatcatcccaccccactgcttaaaagcctttagtggtcctgcagccaaaatcctgccccagctcacacactcctccccatgctctggcctctgcttgcttttgcttctcatttctggccactctcctttcagcattctacaggactaatggaagtccctatactctttctagtctcctggcctttgcatatgctattccctgtgcctgaaacacaccttatcacccccaccacaccagctgctttagtattagtattacttctctaattttggtcttaccatcagactagaaatgccctgaggccaggggctgtatcttagggttcatgctgtattcccatcacctagcccattccttagcactaaatgaatgaacatatgcatgaacacattcgggaaactgctaaatcaaaaggattcaggtagggaagtagtagaatataacattggaaagataagtagaacctgggtgttcaggcagggctcagactgcaggttagaggcgtgaagattatcctgtaggcaaagggtttttaagcaggacagggacatgataaaatgtattcatgaagactaactagttcatgagaggttgaatggaagagagagcagaggtaggcaaaatcagctagaaggctgttagaacaattataatagaaattaaactgtgaaagaaaaggggagagaaaagcaaaataagtgtgagaggagacactccatgaggtgtcttacagacgtcacatttaacatccctaaaactcaaaactcaaaaccttgtacctgccaaggctgcttctagtcctggtaccaggaccacccactggcattcatagaggtgcctaagccagatgcctggggggaaatcagcccctcctgcccctttctcatccccacccaaatccgtttagccattcaatcataacactcacagttggaagcatctcacatgtgtctccttccttctccaatccatctctactgcctctctttggtccttctcattcactggtatctttattacgtcactaatcagttttaatcttcacttttttccccattgtttttaggataaaattcaaatccaggcccttcactgtcttcccctggcccatctctagtcgcactcctttaatgctgggaaatgtgctgggtgattgtccctagatataaatctgagccagtagaggaatggtggtttcattcaggtgaacaggaaagtcaggagggaaagctgatttagaaggtagagaaagcaatgaactgacttaagtatggttatttttcaggtgcatgtgtctggatgaacttactttggatttaaaaggaaaaaaaggaagaaagaaagaatagaggaggacatataaggctcctaaataacctataatcaaggaagacaacctctggatatggtcttgacattgtctgaactaaggagaacacaaaaagacgatagtgaacaataaatggctattccccagtagagagaacacaaaatatgagatttatctcaccgaggtctttgcagattctctttgccagactctctgtgtccctcatcagctgagctatgatgtatttaaatttgtcgctaatccgtgattccactttcctgaaaactagagacgtcaaaaaaaaaagaaaaagaaaaaaagagtgagtatattttcaggaaggacagattgtagttcaaagtaggtatctctaaaacctttctctgcctttgatacttcctctgaaaaacctaaggttccaggctaactggcaggtggtccagatgatacaacaaatgctcaaaatgcaatggctccctgttgcttcttgtactgattctaacacctgtctttcatggtgtaggtctaactagcttctttttttttttttttttttttttgattgagaccaagtctcactgtgtcacccaggctggagtacagtggcgcgatctcggctcactgcaacctccgtctcccaggttcaagtgattcttctgcctcagcctcccaagtagctgggacaacaggcgcacaccaccatgcccagctaatttttgtatttttagtagagacggggcttcaccatattggccaggctggtctcgaactcctgagctggtgacccacccgccttggcctcccaaagtgctgggattacaagcgtgatccaccgcacccggcctaaccagcttcttactgtggctgtcctgttacctcctctctgatgaggcgggcatctctcatgtctctgcaagtgccacaatctaaccctgtctctgtgctttgatattctccctccccacacagctcccagcagtattcacactgatcctaccatttatcaatatattatttcagcctaattattaattgcctgcaatgtgccatgctttgattatagacagttgaaagaacacacttcatgctccatacagggctgtgatcttaagggagagaaatatacatggctaactaaccgtagcagttctctaacagaagtacatgtaaagtgtagccgggtgtggtggctcacacctgtaatcctaacactttgggaggccgaggagggtggatcacttgaggtcaggaattcaagaccagcctggccaacatggtgaaaccctgtctgtactaaaaatacaaaaaattagccaggcgtgatggcacacgcttgtaattccagctactcaggagactgaggcaggagaatcacttgaacccaggaggtggaggtttgcagtgagccgagatcgcaccactgcactccagcctgggcaacagcacgagactctgtctcaaaaaaaaaaaaaaaaaaaagaagtagtacacgcaaagtgtcacaaaacacagggaaagtaacacctaattcttccagggaagtcagagttgtagaataaatacaggaagaagaaagaagaaagcaagagtagtcatgtatattccatcacaacttggcaaagaaaaagaaaaaaaaaaaagagcagtgatgtacaaaggaagcacagacaaaaggtgggagagagaaagcacacggcatgattgaggagcccagaggaatgcaacatggttgggtttatgaatgtttggaggtgatgaagctcagagggcaggaggaaccggattgtaaagaaattcatatgtgacactgaaaagttgggatcaggtacatcaaaatccttacttacaagcagccttcaaaaaggaacttatctacaccactccctattacatgtctatttgttctacctcagaaatacagtcacatactactcagagagcaagggtgaagtcatatatattttctgtatccctctcttcctttcagggttagtgtaataataacatcaataaacaactgttagtcatattaaaaaatcatatctgatctttggaggagtgacatcatgaattcagatcattccatttcaactaaaatgatcaaatacatattcaaacagtgatgaccacacaggcacagagcatgggaaaaggctgagtgagcccagctcttggctatctgatgcctaaattctctcatcacctcttttgcattgctagtacatttataagaggtttttggaagcaaagaggaagaatgtttgctctctacaggccacttctgaggttcatccattgcttgggatgagagctcagttagagaggctaaaaaatgtgactgttactcaagttcaaggttaaatattttctactaaacagagagagggtcaaagttcagtattcgtctagatggctctgaactagaggtagtagagagtaacagaatctcaaaggcttgttattggatccaacttacacttctggggcttataaacaacttgctccagttcctccagattgtgtttgactgttgctatcactgacgcatcaagagaagcacacagcttgcagatataatccaaggcttcatctgtgtttttggcatccccaacaccaaccgaggcagtcagcccaatgacctgtaaggagcattcaaaatcattagatgtctgagaaatggtacaatgtttccacaacccctcatataactctttcctgctggggtagggcgtttttttgtttttactaacacacagtgtatggcacatggaggcacataatgcatatttactaagtgaacaaatgaataaaggaaacaaaattcataatgagttgtacaatatggacttgggacctgagaaggacatcttcagtgtggccataagagtaagaaaataggagttaggaagattatagctcttctgaagcattcgtctgactttggagatacctggggcagtgggcctgaagatcctccaagtttctgatctagataattaaacatgatcatattgtacgggtgttgtttactagtgttgtggcattcatcaaatatcatcaaagtaaagatggatagtgatggaatcgttccctttttaaggttgttcacaagaatctgtggagttaaaatgatgatgtcattgttctcaacaatctgttccactgggacattctcagctgttgctccagaaatgcctgtaactctatacctgggaaatgacagaaattccatattactaaccacgatgtggataaggaaccacaaagatgaaatgctagatcagaacatcaactgattaaattctccctgagtccaaaagaagaatagctgtaggcaagtccttagcacagagcctgacacatagtaagagatcaataaatccaagctagttgtaatttatagtactatatattattttaagtcactaagagagaaaagagtacgtaaaagaataatatcaaataaattataaaatcactaaagaagttaaatgtgccacgtaaacatcaaatttattcctgaagtcatttactccccatagaagggcaaaccaggggagtttaagttttctggtacatctaacaaaaaagacttgaatccatgaagggataacatctggattataaaaaagctgaatctaatataaatttttttaaatcatttgtcaaaaacaaaacagaaaacacatcaattacatgaagctggagaaaaagaagttgaagcaactattatacctacccatgtctttcaaagtattttgagaatacagatttctgctgttcatacactgggatctgattcgcaaaaaagacaactttccccttttgtccttgtgggaattttttaagatgatgttcacatataagcagtgaaacaaaggtttttccacaaccttttaacatgtaaggaaaaaagaaaacatgtaactcatatattagatatttctctggaaaggtgtttatttttggctcttctaataccactgagctgactaattaattgataatttaaatatgttaatgattacagaatttacactatgactaaaaaatatcaagctgctccctaagtagcatgccaacagccaggacccaaaagcaagctaaaagaggacacttttctttaccttctcatgaaaggtaaagaaaatacattaaatacattaatgtacataattaattaattacataatcccataaaaaacattaggattatattaggacagttttctcaaaagacacatggaacaaggaaaaaactgaaacttgcccattctgtcccagtattcaacaaaagaaaaaaaaggaagcaaacagaaaaactatgtaagtaatggcaataggcttacctgtaggagcacatattattgtgttttttcctttcatagcaggcaaagcaagctctaattggtaatttcttggtttaaatgggctgtacaagtttgtatcagacacttctggaatacaaaaggagcaaaattaccaaacagttcctgctctgaggaatcacggcaatagctacagtctaatgtccacaaattctgactccagcaagaagatcctcattggagaaagtttagaatcctttctcttggtaaccattctagcttttccactaatttgaagtacagaattctctcagtgacaaagtattgatggcaagaaagaaaaaaaaaaaaacatgaattattttttatacaatcatggaaggctaacagaaaccaaagaaagaatggccccattcagggtaagacaagctgtctactaaaggcaatgctgtatgtgaaaaaagcaacaaatcctcccacgatctttgaagaaaaccaaactgttaacattggattctcaaagcaatttcttattaaggagcaataatgctttgtcgttcttcaagttctcaaatgatattttctctcaacataaccagaagttttaaaaaataatcaaaggctttatctcaataacaggtaggcatataaatcattaagagctagcaaagactttggaaattatctactgagtctaacctacccattttagagaaagggagaatttctaaaaggttaagtgaattaaactcacacgaaagacatgtaaaggccaggtgcagtggctcatgcctgtaatcccagcacttgggaggctgaggtggatggatcacttgaggtcaggagttcaagaacagcctggccgacatgctgaaatccccacctctccaaaaaaaatacaaaaattaaccagatgtggtggcacatgcctgtggtcccagctacttgggagactgaggcaggagaatcacttgaacccaaggttgcagtgagctgagattgtgccactgcacgccagcctgagcaacagagcgagagactcagtctcaaaaaacaataacaacaacaacaacaaaaggcatgcaagaatcttcacgtgtcagaaaatttaaagcaactcatattcatgtatctgttttttttttccaaggggtaacagattttattctgaaatgaccaaaaaaacaaaacaaaacaaaaaaacttgtaacattcagttgcagacgtaatctgcacattttctctttatgatgttattctaatatcatttttcttctaccaccactattaatcccaatttccttcctgatactcttttatacataactttttattatggcatattatgcaacttgccggtctcataaaaccatcaagaaaatatgctttgagaagcataagggggcctcacagggccacagctaacttatacagtgcctttgtgtaaatgacaaaagggagctcctcttggaggacacagcccctcagtgcactgtgttgcaaacgacacaggctggatctcagcccctactcaacctctcagccaggcgcatttgggtagcacactaacttcatcaacttgcagggcagcccagggatcctaaaaggaaattgagcaagtgactcagaaatagaagtagtatttatttagaaagcaaggttgatttgggaattcatagacattgggttttggtgaagactctatttgcatttccaatatagacacgcccatactttcttagtggtagaagaagaaaaaaaagatagtaaaagaagaaaaaaagatagtggaagaactaggagagaatggcattctaaatatagaaaaagtatctattgtaacataaattctctttactttcttaattttccttacaaaacttttcacaaggctgtgactttgggtactgcaaaacaagcccccacaccaaataccagaagagcaccattatggaaaaggacaaacaataccaggtacctgaaggtggacatgaattctcactaagattctggcattctggatcttcttggtagaaaatctgtatgtcagaagtttccatcttatcctcaagatcttctgtttcaacatcttttatacctttttaagaccaaaaaagtcttagaatcttcacataatctgattatagttttgatggtgaaagctccacaaaatggtcataacactaagatttttaacttctattaaaatttctcacaaccactccccttcaccttttaaaacagttgaaagaatcattttgagtttaaaatctcaatttggcgttgacctccaatgtaatttagagctatattactcaaagtgtggaacgtattgccctactgaatcagaatccacattttaacaagacctcggagggattcgtatgcaccaaaaaaaaaaaaaaaaaaaaagagcatgatttagcagacattcatgtcttccttttctgactgactcttgacccattaaatcagatgtgtatttatacagtttctgaaacaacttatgatctaaagaagcctaggaaagctaagaccagatattcagatgtttaccaaactcagcctttgaaacaatgctgagtgtcagcttcaagaaaccaaatgatagttcagacacttaatgacaaccaattctttcacccgtcggattcagttccagatggcttccagtaagagaaccaggcaatgtctgtcaagaaatcaactctgaaaagggggtaagtcctggagtttgaacctttaactctagaattctcaagctatttctctgataatctaaacttagactgagagttcggattttgccttcctcaaatcctttgggccagatgggctaattctggatgagagtggttttccccagtccatttttaggggttatatgcaaccaaactaattttgtaggcaagtaactgcctccctcccagaatccagcttcctgctggtctcgcgttagagatgtagctctggctatctgaggggaaaaacgcctctgatgggatgtaaaagaccggttggaatgagcgagtcctaagtagagctgtgaggagggtacagtgtcttacctttctctacaatccacagttcactgaacttgttcctttctttctccaaagcaagtttcaaagttttgggccagttttccttgtctgatctgagaaggcattccaccaatttctctgcacctgccatcatccccttagtagagcaaatctaagcaaggtaactgtagtttattgatcaattatctcaaaagttttccctttatcaatttttactgaagaaatgtcagtcatgtactatctgatttaaagccattgtacattacagctcagtgggtcatatccatgacaatttttgccccatccaacacagtcttttaagatactttttccttcatctttgtcctttacacatgatgtcactatgtcaagccaagccttctcatcacctctaagttcttatacctatcctcatcagcaatattaagaaaataatcatttgacaaccattcccaatatgggtatattggcatatagcaatatttggaaacagataacaaaatattaacaaatttttcttcagggttgaggaatttgtatgacttttactaaccataataactaaagtttattgtacacatactctgtgcaagacatacatgagtactttacatatattatctcattacccttatgaaaataccatattataaggtaacattattatttccattttacacacaaggaaacagatagatattcagagaaactaagtaacttgcccaagatcataccgctagtggttgagctatgattctaacaaaattcatctgtgtccagagtctaaacacttaactgctagagtctgtagccctttctcatttgctcaactgttcaatttaaatttgcataaaatactattcacagactgtggtgattttaactgaaaatagggcaaacttcaaaaaaactttgtgacataaaaattactcagttcacattaaaagtactattctggctgagcacggtggctcacgcctgtaatcccagcactttgagaggccaaggcgggtggatcacgaggtcaggagttcgagaccagcctgaccaacatggtgaaaccccatctctactaaaaatacaaaaattagctgggcatggtagcacgcacctgtaatcccagctactcgagaggcgaggcaggagaattggttgaactcaggaggcggaggttgcaatgagccgagatcacaccattgcactccagcctgggcgacagagcgagactccgtctcaaaaaaaaaaaagtactattctatgagtacttttgtgggtttcaatgatctttctcaggtctaaaacagtatagaaaacagaagaccttcccatgttataattatttcccccaattttagtattttatattaacttacctgtagaatttcttcacattcctgattaattaaacattcagacagatcagaaatgatatcggttgggataattctggttttaaattctggttgtaaacgttttaaaagtaatctatactcctccaacttttcaatttttttgaaatcccaactttcaatggcttcataaagtccagaataacctgaaaaaaaagaaaaaaaatgtggacttttatgaaaccaactgaaaaatactttgagattagtatcatagaaatcatgtttgaatgtatggtggtagaattcaaaaaatatctgtaaattacccccaattgtcattgatttttcaaaaagaaaacagtattcattttagtcagccaacactttaggtcttctagcaatatttattatctattgggaaaaagtactaaggaaaactttgaagtcttacattttgatcttagtataaaatctttcttccaaagtgactcatagacttcacctacaatccctgatttgtctttaaaaagtcagagtcaacaggtttattaagtatcttctcagtggaaagcagtaaagaaggcaaaaagaaatataaaccttaattcctgcccacaaggaactttccttctaatttttctaagataatattaagtaaatgggaaatttacttaatattattctacatgcctttaaaagatatttatttaaaaatcatatttagaaagttcagagaaaaatactaatggccaagaaacatacataagatgttcaacctcattcttttttaaaattgtagtaaaaaacagataaaacatttaccatcttaactatttttaaatgtacagttcagtcgtgttaaattcattttgttataaaaaaaaaatccagacctttttcaccttgcaaatctaaaactctatgaaacaactattcctttttctctcctcacccctgctcctggtaaccaccactctttctgtttctatgaatctgactactttagataatctatataggtggcaaaatacaatatttgtctttttgtgactggcttatttcactcagcacagcaccctcaatgtatgtccattttgcaggatgtgccaggatttccttttttttttaaggctgaataatattccattgtatgtgtatatcacattttgttgatccattcatcactgatggacatttgagttgcttctaccttgtaagctatcacgaataatgctactatcaacatggatgtgcaaatatctcatcaataccttgctttcaattcttttggaaatacaccagaagcagaattgctggatcatatggtgatatatattttcaattttttgagggactgccatactgttttccatggctgttaacaccattttacaatcctaccaatcaggcacagggttgcagtttctccacatcctcacctatatgcattattttctgtttttattttattttattttttgaggcagagtcttgctctgtcacccaggctagagtgcagtggcacgatctcggctcactgcaaactctgcctcccgggttcaagcaattctcctgcctcagcctcctgagtagctgggattacaggcacccgccaccgcacccagctaatttttgtattttttagtagagatggggtttcaccatcttggccaggctggtcttgaactcctgacctcacgatccacccgcctcggccttccaaagtgctgggattacaggcatgagccactgtgcccagctttgtttttgtttttatagaagccattgtaatgggggtgaggtgatattgcattatggctttgaatttctctgatgattactgatgttgaatatctttccatatgctcattagccatttgtatatcatatttggataaatgtctattcaagtcctttgccttttttttttttttttttgagatggagtctcgctctgtcacccaggctggagtgcagtggcatgatctctgctcactgcaacatccacctcctgggttcaagcaattctcctgccacagcctcccgagtagctgggactacaggcgtgtgacaccacgcccagctatgtgtacttttagtagagacagggttttgccatgttggccaggctggtcttgaactcctgacctcaggtgatccacctgcctcagcctcccaaagtgctgggattgcctattttttaatttgattttttgtctttgagttgcaggagttcttgatatagtctacatattaaccccttatcaggtatatgatttgcaaacattttctctcattccatgggttgacttttcaccctattatgtcctttgaggcacataagtttcatatagtcccatttgtctattttttcacttttgttgcttatgcttctgatatcatgtccaagaaatcactgccaattccagtgtcatgaagtttttcccctatgctttcttctaggagttttaatagttttaggtcttatatttgctctttaatgcattttgatttgattttgtatatagtgtgtgatggttaattttctgtgtcaacttgactgggcttagggatgcccagatagctggtaaaacattacttttgggtgtgtctgtaagggtgttttcagaacagattatcatttgaatcagactgaataaagaaattcaccctcactgatgtgtgcagacatcatccaatccattaaagaccaaaacagaacaaaaagggagaagaagggcaaattctcttttcttgagctcatcatttcttttgcccttggacatcagaggtcctggttctcaggccttcagactctgaattacaccaactgctcttctgattctccagattgtggacagcagatcatgggacatctcagcctccacaatcatgtgagccaattccaaaaatatatatacacatacatgtaagtaacaatgtgtatacatatcccatcatatgtacacacacataaatatatcctattgcttttgtttctctggagaactctaatacatggtataagtgtcaaaattcattcttttgcatatggatatccagttttcccaacaacatttgctgaagagactgtcctttccccattgagtggtcttggtatctttgagcatatacttgagaatttatttctgggtgctcttttggcctatttgtctgtctttatggcagtgccacatcattttgattgctacagatgtgtaatgtgttttgaaattaggagaggtgaggcctcctggtttattcttcattatcaaaattttacctattcaagatgccttgagattctctataaattttggataattttttctatttctacaaaaaaaatgccattgcgattttgatagggattgcattgaatctgcagttcgcttttggtagtataggcaacttaagtctttaattcatgaatggggatgtctttccatttatttgtgttatctttcattctttcagcaatgttttgttgtttccagggtatgagtcttttatctccttggttaggtttcttcctaagtattttaatctttttaatgctattataaatggaattgttaccttaatttcttttttggattatttgttaatatatagacatgcgactaattttgaggtgttgattttgtgtcctgaaacttttctgaattagttctaatagttttttctaaaatctttagggttttctacatataagattctgccatcggctgggcgcagtggctcacgcctgtaatccaagcactttgggaggccgaggcaggcggatcacaaggtcaggagattgagaccatcctggttaacacggtgaaaccccgtctctactaaaaatacaaaaaattagccaggcatggcggcgagcacctgtagtcccagctactcgggaggctgaggcaggagaatggcatgaacccaggaggcggagcttgcagtgagccgagattgcgccactgcactccatccagcctgggcgacagagcgagactccgtctcaaaaaatgaatgaatgaataaataaataaataaataattctgccatctgcaaacagattattttccttcttcctttccaatttggataccttgtctttctttttcttgcctaactgctccagctaggacttccaatactaaaccttattcaatttttaaaatgaaaattaaaagtactgtttttacctgacaggttggtaaggattaaaataacttataatatccagattaatcatatccccaaagtggagaaacagtgctttctctgatgagaaacagaaaccagccctttggaaagacttgctccattgctgatttcaaccaacctcctgactgcccctccctttagcagtttcaacacaccaaccaaccagcacttcttcctgataagagaccaccaaccacagagtgggtctggccagtctatgaaggatgtgcagtgagagttttcatgtcctctgcttcaccttctgacatcagagggccaaaaactccacccttggatcttgctaacactgccagtttttgaacatgggtcccatagaaaggcatgaagctcacctgcccaggtgcatgcttctactttcatgactcctcctgtagcttactgaatatttggtcaccctattcagcataaatctctgttttactctccccaccctccaagtgcctgtttcctgcttctggcccgaggctacacttcccagcctgtcaaaatggccaccatgcagactgcaaccctttatgaaaaataaagctctcctttccaaatttatgaacttcatgattcttctgttgatagaaaacaccatagctctgaaaacagaaatgtaaaaattatgtaatatttgatgcatgtaccagaatatttgcaacatatataataaagagtataacaagaaaaggaacatatgtgaacctactatccaacttaagaaccaccatattccagctgggtgcagtggctcatgcctgtaatctcaacactttgggaggctgaggcaggtggatcacctgaggtcaggagttggaggccaacctgaccaatgtggcaaaaccccatctctactaaaaatacaataattagccagatgtggtggtggccacctgtaatcccagctactcaggaggctgagacatgaaaatagctcgaacccgggaggcggaggttgcagtgagccaagatcgtgccattgcactccagcctgggcaacagagcgagactctgtctcaaaaaaaaaaaaaaaaaaaaaaagatttccattaaatatcttctttaagccttagcactgttggacttcagttttgctattcagtagttataaaatgttatctcactgtgttcctaatttacaattcccaaattcctaattgggctgagaatcttttacatttattcacttttcattcttcgtattcattgaaatgtttgtccaaattttttgctctatgtatgttttctttctttttccagttgattttaagactttttttaatatattctagattctaatcctttggtgattatacattttgaaaatatcttctcccagagtttgtgatttgtttttttttttttttttttttgctttctttatagtgtttttgataaacatgatgtaaggaatacaaatgtatttatttattcgtacccacatgggcataaaagttagcgtttgttttttaaatacagggtttatttatttatttatttatttaaatttgagaaggagtttcactcattgcccaagctggagtgcaatggcgcaatctcagctcactgcaacctctgcctcctgggttcaagcaattctccttcctcagcctcccgggtagctgggattacaggtgcccaccaccacgcctggctaatttttgtatttttagtaaagacagggttttgccaagttgtccaggctgttctcaaactcctgacgtcaggtaatctgcctgcctcatcctcccaaagtgctgggattacaggtgtgagccaccacacccggcccagggtttgttttttaaatacaggggtctccctatgttgcccaggctggagtgcagcagcgccatcatagctcactgcagcctcaaactcctggactctagcagtcctcctgcctcagcctcctgagaggctgggactacaggcacacgccaccatgtccagcttgagtttgttcggcttttaatattattctgtttataaatgctattttttgaatagctcctcctttcccagtaatcctcttttctcagtgatgtctaatatatcaggtttccataaagatatggtcctaattagagggtctctattctgtttcaatggtcagtttgtcaatgccaaaaccaacatttcactgtctcaatgcctgtagctttctaataaatgctaacgtgtagaaagaaaagccccaatctactaaatttgtcttctttaggggtgtcttgactattgttgggtcgtaattcttccatatacattgtagaatcaacctgccacactcactgaaaaagtatgtaggatttttattagaattatattgaatatacagatcaatgtagggagaactgatatttttatgatctcaagcctccttctctatgtgcatgggtatgtttttccatttaggacttctttaatatcttttaataacattttatcattttctccattcagaccttatacatcttttgttagatttattcctaaatacattacaattgttattattaaaaatgatacttcattttggattacattttttgtttgcttccattgggcagaaatgcaactaatttttgtatactggtcttatatccaaataatcttgctaaactcttccattagtgacaataatctctctgcagattcttttgttggatgtttcaggtagacaattatatcatctgcctaaaaacagtctttacattgtctcagactaagaggcatgaactataagtggatacttcaaatttaatagcttttcacttttacagtattgtcaagcagcaaagtaatatcctctgatttgtgattaaaaagaatgaactaacctgcatggtctagggcatccaaaaagccacggaaccagccttcctcctggagctccaacaggaacttgagaaaaagtgtggcagcctccattgggcccttgttgtttttctcagcctgaatatactgcacctcttctacaaacagaagcaaaaatgactcatcaaactgcagaactattaatcattagaagaaaaaccagaaaaggatcaccagaccttcccaaatagggacaggaattgtaccaagtcacagcattggaagaatctttggagaagcagcaaaacctctgcccaggccgactgtgcccattcttcaccaagccactcttcccatcctctctggaaacctacagtttggtgtggaggtctgagcacacattctagaaaaggagtttcttgaagatgtgtaaaaaaatctccctgcaaaaagggagaagtcatggtggcctcaaactatcctcctccctcagcctctcaaagtactgggattacaggtgtgagccactgcacccagcctctacaaaaaaaaaaaaaaaaaaaaatttttttaattagttgggtgtggtggctcacacctgtagtctcagctactttggaggctgaggtgggaggatcacttgaaccaaggagttcaaggttcccgtaagctatggtggcatcactgcactccagcctggacaacagagtgaaaacttgtcttgaaataggacaaagaaaggagaaggaaggaagtaagggatacttccatggtccttttgggagaaaattatctaccaacctgctggtggtcattctaactttgtacactaatttcatgcccagggagtagtaataaaaatgctaccatggtatgacctgatacttgataattttctgggttttctttcccattgttgatggaatgcaaattccaagggagtaagcaagttgtcaggctggtgaaccactatattctcatagattagaagaagacctagcacgtaatagacaataaacaaaggtatgtttaatgaatgaaggaagagaagaaggaatgccttataatcttgctctacttaaaaggatctctgccaaggtctctgtcttgacaacaataaaatcaaccctttcaaaaaataaaattcaatggtttttggaactgtgaatccatgactactattttagtacattttcatcactataaaaagaaaacctatatccattagcagtcattccctactctccctctccttagccccaggcaaacactaatcaaattgagtctccatggatttgcctattttacacatttcatattaatggaatcatacaatacatagtctatgtctggcctcttactttgcataatgtttttaaggtttaaccatgttgtagcacgttattattcattcctttttattgccaaataatatcccactgtatggatacaccacattttgtttatccactcatcagtgggcatttgatttgtgtccacattttggttattacaaatagacatgctatgaacattcatgagcaattttatgtgacgatgtatatattcatttctcttgagtacacacataggtgtgagatttctagttcttatggtaactccatttttaacattatagggaattgtcaaaccattttcccaaggagctgcaccatcttacattcccaccagtaatctaagaggattccaatttccacacatccttgacagtacttcttaccatcgttttcattttagccttctgtattagtttcctgtggctgcaataacgaattaggacaaaccaggtggtttaaacaatagaggcttattctctctgttcttggaggccagaattgtgaatcatggtgttagcagagtcatgcttcctctgaaggctctggggagaatgcattccttgcccttccggtttctggtagctgctggcattccttggcttgtgacaacactccctccaactttgccttctgtttctctggcttgtggccacatcactccaatctctgcctatgttttcacacagcattctcgttgtctctatgtcttcacatggctgttttcttagagggacaccagtcatattgaactaggggcctgccctactctagtatgacctcatcgtaactaattacctctgtaaagaaacagtctcccaataaatcacattctgaagtactggggtttaggactttaacatatattttgggtagggggacacaattcaactcataacagcaacctatcttgtcacctatcccagcttccctggacccacaatcctaccgtattccattgagtcagttcattctgttcctaagcccattccttacagctgtacttttgttcccaggcctccctgctgcttgagcttcctttcaacatgctaacagccattacagatattccacgtggagatgcaaatttatcccagccacagctaccgccttcccagataaactgccttgcagtatgctgggcagttcacatttactttgcatgtggtcaggcccatccttctactacctggccccaatatctgctgctacagagtagtgacaatttcctcaaaagcaccaacaatgcagacaaaacttcatctttgacagtatttcccactgcctttgctgtcctggggcccattgtgatgtcaaacctcagcttctcaaggtagaatttcttgatcccttctctgctttctcagtctccttactgactaaagctctttattgactactgactaaagtacttacactgcatagtatatagtaaatgtgggcctgtcttccacctgaaactgtgacttggaacatttgtcttgtgatcatcagcacagtacctggctcacgcatgtgtccagaaagtgctaccaaaggaatggatactcagaatactgcccacctggtgcccctccagaatcatggttggcctttgactccaaaatactataaaaaatctgcagctgggcacagtggctcacacctctaatcccaccactttgggaggccaaggtgggtggatcacttgaggtcaggagttcaagaccagcctggccaacatggtgaaaccccgtctctactaaaaatacacaaattagccaggcgcggtggctggtgcctataatcccagctactcgggaggctgaggcaggagaatcacttgaaccagggagacagaagttgccatgagccgagatcatgccactccactccagcctgggtaatagagcaagactccaaacacacacacacacacacacacacacacacccaggtctgccttgaaacatcctggacaacctgtgagtgagaaaagtgctgcagcttccagggtaccatgcaagttctccaggagaaacatggcttcagtgctccttttccaagacgttactagcgtcaataatcacaatatctgattgcagagagggttagagtaaacgagatgctggatgtgggcacggggggaatgtggataagctccctttgctttccacggatggcaaaaaaatatgagtcaaaagttttatatccagccataacactcattagtgtctctggtccctgactgaatcctcactgataaagtatagttgtcacagcccggcacagtggctcacgcctgtaatcccagcactttgggaggccaaggtgggtggatcacttgagtccaggagttcgagactagcctggccaacatggtgaaaccctgtctctactaaaaatacaaaaattagccgggcatggtggccagtgcctataatcccagctactcgggaggctgaggcaggagaatcgcttgaaccccagagatggaggctgcagtgagctgagagctgagatcccaccactgcactccagcccaggcaacagagcaaggctgtctcaaaaacatatatatatatattatacatttaatatatataaaatatataaaatatatttaatacataaaatatataaaatatatttaatacataaaatatataaaatatatttaatacataaaatatataaaatatatttaatacataaaatatataaaatatatttaatacataaaatatataaaatatatttaatacataaaatatataatatataaaagtatatattatatctattatatatagatataatatatatttaaacatatatattatatatttattctatattatatatcatatatattttatatataatatatatgtttaaatatatatctattatatacaatagatatataatatataattttatacattatatattttatatattaaatatataatagatacaatatatatgtcacaattaaagttaaccaatgaatccagagcctccaaagcagcctagaaaaaaatagggaatagagaaaaactttatcaatctaatagaaaatagaaaaaggagttgaacccaaaaggtatgtggacagagatgcacattataaagtaaaaaggcataaataagaaaaatgtaaatcaacttcataacaatggttgcctctgcagagggaatcaaaagaagacctcaagggtatctttcacattaaaaattaagaagttcttcagggtgctttttcttttaacttactttccggtatttttattgtgattgtactctataaattagcatagggagaattgacatgtttacaaacctatagtccccaggcacaaacataggctgtctcttcctcactcaaatcagagacagatttctcttcagggacttcatagttttcttcatatcatttcagcattttttttgttaaatgtatgactatcttcaatcacacgtaatatcctctagaaaccatccttctacatatctaattatgtgtataaatatatagttttaaataagtaagatttaacaaatctgctcttttccactcagtggattacaggtgttgtttcctattaataaatatgtacctacatcaacttttagtggctgcatagttttatgtcacataaatgtagtataatttaatgtattcctttaacacgaaactaaaatgcgtttagtacacacccatctatgtctttacctgctttaccaacttttccctggaataagttctcagaagtataattcctcagtttaacagtatatgcttttaaatgtggaggccaggcgcggtggctcatgcctgtaatcccagcactttgggaggccaaggcaggcggatcacttgaggtcaggagttcaagaccatcctggccaacatggtgaaacccccatctcttctaaaaatagaaaaattagccaggcgtggtggcttgcacccgtaatcccagctactcaggaggctgaggtaggaaaatcacttaaacctgggaggtggagattgcagtgagctgagattgcgccactgcactccagcataggcaacagagtgagactctgtctcaatcaatcaatcaatcaatccataaatgaataaatgaatcaatgaaggaaggaatgaatgttaatacattttccccaactaccttccaaactgtactaaccctccatcgatagtgtatgaatgatatttccctccatagcactgaatttgctcaatcttcataacctttgcaaaactgagagacaaaaacagaccaaacaaacaaacttcactgtttttaatgatttcttgtgggatttcttccacctttggccagtgtcttttgttttggttatttcttaatacatttcctgttcatgtctcacagctagttttgagaggtcattcatatttttttctaaattggatttgtaagaatcttttatgcatttagggaaatgttatataatctggtttgtttttccagtatatgaaaatactgtttttccagtataatctcacttgttttccagtagataaaaatgcgtggcctccgtttttattttattttacgtatctattgcaacaagactgaatgaactctgttagttccagtaatttgggggaattttgtttttgttctttattttggccagtttgctttctttggagttaactggctgttctttttgcaattacttcagtcaaattaattaattcataagtgttcattcttttgaaataccaataaatccatttaggctataaattctgattaaaagcttattacatcttaaaatatataatatgttggctgattgccgtgcttacttttgaaagtagctatacttgtttagattttctcattctgctagaagttactcaaaaggatgctattttgaaattctgtgaaaatttttttaaacctatgattaatttctgggatatagaataatagctaacagtaatttaataccatgcagtttaatttccaaaacacccaaacatggtttttattctgattttacaaatgaggaaactgaggcatacgagagttaagacatttgcccagtatcacagagcctacaaatttgaaaataaaactcataaaagttatgctttgggaatttattaaatatttatctgtaactcatataggatcactttggcaaagctttttaagaattggaggagaaggatatatttgctatatgatacaaaatggaaaacatagacattaaatcaaccttattaaacagatcatttatgcttttattatcatttatctgacttagcagtactaataaagatatcttataattcccatatttcttgacgttttctaatatttaataaacaaagatttatgtgtaccaaatcttcactgatatctcaatacctttatcattttatcttaatactttccactagtgcaatttaagtataattcttgctttctttacgtatgcatttatttaatatatatttgtcccttctttatctcttttttatttatttattatttatgagacagggtcttgttccattgcccaagcagaagtacagtagcatgatcatagctcaccataggctcaattttcggggctcaagcaatcctcccacctcaggttcccaaagtgctggaattacaggcatgagctgccaagtctggcccccatttttattttttatgttattagactttacatgggtctctggcagatgaccaaaacctggattctgctttctgactcattcacacctatttaaaagatgtttgacctaattacatggccatagctgatataactagttttccttgtgttatcttgtttatatttccctttcctatattttctggttagcttaaattactagtttcttttctcctctcaagaacaacaaaacatataaaacctcatttaaatggtatcattatctgtaaccattcatatagctttttaaaactacagaagcaagtggaaaatggtaatattttaagtctcccccttttgaggcaagggatttaactcttatttatcataattttccctagctcctaacagactcaatctaaaattttaaaccaaagtatttacttaatttttttttttttttttttactatatgaaaatcctctcttaaaaaatgcttgactaggaaccagggcaagatggccaaaaaaggaacagctccggtctgcagctcacagagagatcaacacagaaggcgggtgatttctgcatttccaacagaggtacccggttcacctcactgggactggatagacagtgggtgcagcccacagacagcgagctgaagcagggtagggtgtcacctcacctgggaagcacaaggggtctgggaactccctcccctagccaagggaagccatgagggactgtgccatgaggaacagtgcaccctggcccagatactatgcttttccccccaagtcttcgcaaccagcagaccaggagattccctccggtgcctatgccaccagggatctgggtttcaagcacaaatctgggtggccatttgggcagacactgagctagctgcagttttttttttcatacctcagtgacacctggaatgccagcaagacagaaccattcactctcctggaaagggggctgaagccagggagccaagtggtctagcacagcaaatcccacccctacagagcccagcaagctaaaatccactagcttgaaattctcgctgccagcacaacaatctgaagttgacctgggatgctcaagcttggttgggggaggggcatccacaattactgaggcttgagtaggccctattcccctcacagtgtaaacaaagccaccaggaagttcaaactgggtagaccctactgcagcttggcaaagccactatagctagactgcctctctagattcctcactctaggcagggcatctctgaaaaaaagccagcagccccactcaggggcttacagataaaactcccatttccctgggagagggcacctggggaaaagggcagctgtgggcacagcttcagcagacttaaatgttgctgcctgctggctctgaagagagcaacagatctcccagcacagtgcttgagctctgctaacggacagactgcctccttaagtgggtccctgatacctgtgcctcctggtggggagacacctcctaccagggtcaacagacacctcatacaggagagctccagctggcatctggcaggtgcccctctgggaggaagcttccaaaggaaggaacaggcagcaatctttgctgttctgcagcctccactggtgatacccaggcaaacagggtctggagtggacatccagcaaactccagcagacctgcagctgaggggcctgttagaaggaaaactaacaaacaggaatatcatcaatatcaacgaaaaggacatccacacagataactcatctgaaggtcaccaacatgaaagaccaagggcagataaatccatgaagatgaggaaacgccagtgcaaaaaggcagaaaaaaaatgtgatcctcttctcctccaaaggatcacaactccttgccagcaacggaacaaaactggacggagaatgagtttgacaaattgacagaagtaggcttcagaaggtgggtaataagaaactcctctgagctaaaggagcatgttctaacccaatgcaaggaagctacaaaccttgaaaaaaggttagaggagtgacaactagaataaccagtttagagaaggacctgaatgacctgatgtagccaaaaaacacagcacgagaactttgtgaagcatacacaactatcaatagctgaatcaatcaagcagaagaaaggatatcagagattgaagatgaatttaatgaaataaagcatgaagacaagattagagaaaaaaagaatgaaaaggaatgaacaaagcttccaagaaatatgggactatgtgaaaagaccaaacctatgtttgattggtgtacccgaaagtgacggggagaatggaaccaagttggaaaactctcgtcaggatgttatccaggagaacgtccccaacctagcaatacaggccaacattcaaattcaggaaatacagagaacaccacaaagatactcctcgagaagaacaaccccaagacacataatcatcagattcaccaaggttgaaatggaggaaaaatgttaggtgcagccagagagaaaggttgagttactcacaaagggaagcccatcagactaacagcagatctctctgtagaaaccctacaagccagaagagagtgggggccaatattcaacattcttaaagacaagaattttcaacccagaatttcatatacagccaaactaagatttataagcaaagaagaaataaaatcctttacagacaagcaaatgctgagagattttgtcaccaccaggcctgccttacaagagctcctgaaggaagcactaaatatggaaaggaaaactggtaccagccactgcaaaaacataccaaattgtaaagaccatcgacactatgaagaaactgcatcaactaacaggcaaaataaccagctagcatcataatgacaggatcaaattcacacataacaatattaaccttaagtgtgaatgggctaaatgccccaattaaaagacacagactggcaaattggataaagagtcaagacccattggtgtgctgtattcaggagacccatctcacatgtaaagacacacataggctcaaaatacagggatggaggaagatttaccaagcaaatggaaagaaaaaaaaaaagcaggggttgcaatcccagtctctgataaaacagattttaaaccaacaaagatcaaaaaagagaaagaagggcattatataatagtaaagggatcaatgcaacaagaagagctaactatgctaaatacatatgcacccaatacaggaatacccagattcataaagcaagttcttacagacctacaaagagacttagactcccacacaataatagtgggagactttaacaccccactgtcaataatagatcaacaaaacagaaaattaacaagaatattcaggacttgaactcagctctggacaaagctgacctagtagacatctacagaactctccaccccagatgaatagaatatacattcttctcagcaccacatcatacttattctaaaattgaccacataataggaaataaaacactcctcagcaaatgcaaaagaacggaaatcataacagtctgtcagaacacagtgcaatcaaattagaactgaggattaagaaactcactcaaaactgcacaactacatggaaactgaacaacctgctcctgaatgactacagggtaaatatgaaatgaaggcagaaataaataagttctttgaaaccaatgagaacaaagacacaacgtaccagaatctctgggacacatttaaagcagtgtgtagatggaaatttatagcactaaatgcccacaggagaaagagggaaagatctaaaatcaacatcataatatcacaattaaaagaaccagagaagcaagagcaaacaaattcaaaagctagcaaaagacaagaaataactaagatcagagcagaactgaaggagatagagacacagaaaacccttcaaaaaaatcagtgaatccaggagctggttttttgaaaagattaacaaatatatagaccacaagccagtttaataaagaagaagagagagatgactcaaatagatacaataaaaataataaaggggatgtcaccagtgatcccacagaaatacaaactaccatcacagaatactataaacacctctacacaaatacactagaaaatctagaagaaatggataaattcctagacacatataccctccaagactaaaccaggaagaagtcaaatccctgaagagaccaataacaagttgtggcagtaatggcctaccaaccaaaaaaagcccaggaccagatggattcacagctgaattctaccagaggtacaaagaggagcttataccattccttctgaaactattcccaacaatagaaaaagagggactcctccctaactcattttatgaggccaacatcaccctgataccaaaacctggcagaggcaaaaccaaaaaagaaaatttcaggccaatattcctgatgaacattgatgcaaaaatcctcaataaaatactggcaaactgaatccagcagcatatcaaaaagcttattcaccataatcaggtctgcttcatccctgggatacaaggctggttcaacatatacaaatcaataaatgtaatccatcacataaacagaactaatgacaaaaaccacatgattatctcaatagatgcagaaaacgccgttgataaaattcaacagcccttcatgctaaaaactctcaataaactaggtattgatggaatgtatctcagaataataaagagctatttatgacaaacccacagccaatatcatactgaatgggcaaaagttggaagcatttcctttgaaaaccagcacaagacaaagatgccctctctccccactcctattcaacatactgttggaagttctggccagagcaattaggcaagagaaagaaataaagggtattcaattaggaaaacagaaagtccaattgtccctgttggcagatgacatgattgtatatctagaaaaccccatcatctcagcccaaaatctccttaagctgataagcaacttcagcaaagtctcaggatacaaaatcaatgtgcaaaaatcacaagcattcctatacaccaataacagacaaacagagagccaaatcatgagtgaactcccattcacaattactacaaaaagaataaaatacctaggaatccaacttacaagggatgtgaaggacctcttcaaggagaactacaaaccactgctcaatgaaataaaagaggatacaaacaaatggaagaacattccatgctcacgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccacatagccaagacaatcctaagcaaaaaagaacaaagctgaaggcatcatgctacctgacttcaaactatactacaaggctacagtaatcaaaagagcatggtactgctaccaaaacagattatcagatatatagaccaatggaacagaacagtcatcagaaataatgccacacatctacaaccatatggtctttgacaaccctgacaaaaagaagcaatggggaaaggattccctatttaataaatgttgttgggaaaactgactagccatatacagaaaactgaaactggaccacttccttacaccttagacaaaaattaactcaagatggattaaagacttaaatgtaagacctaaaaccataaagtccctagaagaaaacctaggcaataccattcaggacataggcacgggcaaagacttcatgactaaaacaccaaaagcaatggcaacaaaaatcaaaattggcaaatagaatctaattaaactaaagagcttctgcacagctaaagaaactatcatcagaatgaacaggcaaactacagaatgagagaaaatttttgcaatctatccatctgacaaagggctaatatccagaatctacaaggaacttaaacaaatttaaaagaaagaaacaaccccatcaaaaagtgggtgcaggatatgagcagacatttctcaaatgaagacatttataccacgaacaaacatatgaaaaaatgctcatcatcactggtcattacagaaatgcaaatcaaaaccacaatgagataccatctcatgccagttataatggcaatcattaaaaagtcaggaaacaacagatgctggagaggatgtggagaaacaggaacgcttttacacttttggtgggagtgtaaattagttcaaccattgtggaagacagtgtgggtgattcctcaaggatctagaaccagagatatcctttgacccagcaatcccattactgggtatataccaaactattgtaaatcattctcctataaagacacatgcacatgtatgtgtcttgcggcattgttcacaacagcaaagacttggaaccaacccaaatgcccatcaatgataaactggataaagaaaatatggcacatatacaccatggaatactacgcagccataaaaaagaatgagttcatgtcctttgcagggtcatggatgaagctggaaaccatcattctcagcaaactaacacaggaacagaaaacctaacaccgtatgttctcactcataagtgggagttgaacagtaagaacacatggacacagggaggggaacatcacacactggggcctgttgggggctgggaggataggggagggatagcattagaagaaatacctaatggagatgatggtttgatgggtgcagcaaaccaccatggcacgtgtatacctatgtaacaaacctgcacgttctgcacatgtgtcccagaacttaaagtataatttaaaaaagaaatgcttgactattgcacttacctttgtggacaaatttataaaattatttaaaatcaactctacatgcctagtttcaacattcacgaccaatccttgcattacaagaactcctttttttaagctaatttttttcagttcccattgtttggaatcacatttccagtaatttctgtaagaaatatatatgagaccccacatatataataatgttttcttcttgcttacatacataaatacctggctaaatataaaataggggcaactttgttttaccttttaaatgctgcacagagttttactctttagttacattagagttgcagagaagtcagagaccaacttgatgttgattccgttagaggaaacctgagtaatcttatttgtggccaggcatggtggctcacgcctgtaatcctagcactttgagaggccaaggcgtgcggaccacaaggccaggagttcgagaccagcctgaccaacatggtgaaaccccatctcacttgaacccagaagtggatgttgcagtgagccgagatcagaccactgcactccagcctgggtgacagagcaggactctgtctcaaaaaaaaaaaaaaaaagccacacgtttgtttttcctgaatgtttacatgattatttcttcatctgagaaatatgaaaatcctactaatgtattcccttctcaataaactcacatgcaaagtgctgtttctttctcagacaagtaaaattttctattttttccatttatctttgcttctgtcttctctctcctttcttggaacccacagtgtaaccaaattgtatagactggatttgtgtgaagatactattaagcactacctcccttgtaatttttcatttgtgaatcatattttcaaaagaactgcctacatttatcttctccacttccttgccctctatttattcctgagtctactcttgcagttagtttcccaaccatcttatacctttaccttcatccctattccacagaaactagtcctgtgggtggccccaaaagtcaataatgccaaagtaagggaacgtttttttagttctgacagaccttgggttctcagcatcattcagccatgttatccaccacatcattctcccttggtttccgtgatgcctccttgcccacatatgtggcactctttcccagtctcttttcctcctctgctcatctcttaaatgagtgcttgcacaggattccgtcccaggctctttctactcacactccaaaaagcaatcttgaaactgaccacagtcccacagacatttattccagaaaaacagaaattgacccttctggtctttaaacttgaagcttacacttgttttatctgagatcctttctcaggcaaaagaccaccaggcctctcaaaaagtatcaaactgaaattcaccagattatcacatccagacaatgaggccaggcccctcattcatcatgattgcttcctgagttcctgttttcccacacagttacatttcttccctgctatataaacccctaattttagtgggtcagggagatggagttgagactaatctctcatcttcttggctacagctcccaattaaaggcttcttccctggcaatacttgttgtctccctgtttggctttctgtgtggctaccaggaggacctaggccaaacccctggtgcttcagtaacagatttttgtggctgggttgctgtggtctaggagtctcagaagccctcctaagcaactgcccacccaattttggctggaagtgagttttggtctctctggccctgctgctgccagccccagctgagttcctgattgctaggaagaacagcctttgaaatgtgacactggcatctggataagtgagtgtcctttcttggcccagacagcaagatctgctcaatttgaaaattttaaaaggagcttccatttgcaggttaaaccagcccaactgactaagaaagggaagcaccctgactctcagtatgatactctagagagcgtgtttgtaatttctgtgtttgtgtctggccaagttagtgtcttttttgggtaccagacagtgggatcggcttctctcaatttggaaaattcctaagaaatttctgtttgcaggttaataaagcccgattgagagagaaaagcacctcgactgtttcagtttggacactgttcgggcttgtctattgcttcagcagtcggattgtgttttgttgattgtatgtgtcaatatagtaatgggaaattagaattcaacaaacaaatattcttttgtactacgtttgccccaatattctttggaatctggagttggctgttgaatgggaaagccaggtggagtcccatgtattctggcttttatgccgctgttttaagcagggttgggcctggtgagtagtttccacatgacgttcttctgtagtgctgtttggccccaggtttctttggaatctagcttctaaaaatcaaactgccatggaaactgctttacccaaaattctggttcacagccttcattggattaccgattggagcaaacaaattttagccatgtggacttggttgtagattcgtgagtttgtattgctatctcatggctagagttccaaggtaaaagctgttggatctttgtgtgtgtatacatgtttagatgtgtttatctagatgtacattaactatgttatacactatacctaccaaattggcttataaataagagtgctcataaattaagtccaaagtgtttttcaagttcacatgacttcagtaaatctttaataaacaagctgtctttaaaattattggtaaaataaaaatagaaatgtcttcagaattgtcagcatacatttttgtctcggctttatatttgtctcagctagataatttgaggtatcagagtttggcagcaggttataaagctataaacccagtgaatatttgtgtgaattctttataagactaatttaatgctgttagtttaatgaaaacagctgaatcttctgagttattgatcaaaatgcccacgtattaattttaaggttatttaggtgaacacctgacattcacaggttataaaatggttaagaaggaaatgatgcagaaataatctagataaactgctaaaaataaataaaatgtaaatggtcaaatgctgtaaatgaacttttggcataatcggaaatataatcattggatgtttgagtcatttccaattaagaaaaggttatgatgtggggaacatgtttctaaaaattgtggaatggttctcatctataaaatactaatatctgctaggcagctcaagatttcttgcttcctaggtttttactgaaatttaaggttgttactaaggataagaattctagttcatatgtaattctatatataaaatgtgcaaaagacaatgtgtttttattcagaaaaaaattttatctaactcagaagttatctaaagtttattaataattatggacttgaaaggttacttatgaaacaaggtagaaaagaacaagtagacgagagagatgtggagaaagttatgagtataaagatgtatttttggtaaggaaggttataaagaaaataattttgtatgacaaagcatcttataatggtattttttttgtcctaaagtaaaatgactgtttaaaaaaaaaaaaagaagaagaaaaagaacgaaaatccaggacaaatcagaaagtctaagcatatcatagatggtgtgtgtaagtcatgtagtttctttcctatttctttgtgtgtctacctttatgtacagacagagaaaatacaaagtataaaaggcttaaataatattctcttaaaaccagatagaatattggagaaatctggctaattaacactgctcatagttaaagctcttagtcttgatgaaagtaaaataagaaatattgtaaagaaacacattggcagtttggcaatcctttcttaatatagttaaccatgaagccagataaaagccagatatagcaacaaccaaatttcacctacatgcttgcattgcttcacactgtatttgctcttctgcatagatatactatcattacagtataatacttactggtcggcctcctccagagtagctgggattatagttgtgtgccatcatgcctggccaatttttgtatttttagtagagatggggttttaccatgttggccaggctggtctcaaactcctggcctcaagtgattcacccatcttggcctcccaaagtgctgagattacaggcctgagccaccacgcccagcctaaagtgaatttcttaattgcacaaaatatatagtggtattggtgaacttaaagacattaaattgtgcatcaggaacaaaatattcatcatgtgtttttttggctctgggtaacactatagcctccaagttaaactgagtagaaaattttcaggttggtttcctgtttgttttttcttttaatttgcatttatttgctgtttcttcttctttaggttttacttatatatacatattaataaaaccattgatggcttttagtttctaatgtaaggaaggcttttatttggttccatgaataatcattttgtttcctatgcatttccagtatctcatcatttgctctacttatccaaagttcctaagctacctttttcaagcttccaaaaattgttggtggacaccagcctttaaaatttgtttggttttgcttacctctaatgaactagagagctataagaactttaagattcctggcaaaaaataataaaaggtttattcttctaagttctgaacagaaatagtacattattattggttatttggaaaagtaggtgagagaaatgtttaagtggtgtttatttccaaggtaattcaattcaataaacaatagcggtttcagatcttttcctttaatgaggcaaaactgctatatgggtacaaagtcttaatattcagaaaaaaattggctttgtctttaaggaaattatattgattgggctttctctcaaactaatttagttgtgtttactattattaagattaaataacatttacttggattaagtcataaaaaaaattataagactttctagtgttttttttatcctaagccatttatcactgatgggccttcacatgtatacttgaaaacaaaatatgtacatacaagtgttatgccagtttgaagattctagtggtgtaagtcacttaaatcagttgtcagtactttatctagaaaccaatcttggaaatgtatgatgaggctctttcaaaatagctgaaaagaaattactgtgtgcttattgtcactttgtccttgttttgttgtatactttttaaatgaaagatttatcttcatattgaatttccaaaactgatacttgcatttaccatttttttttttaatgatggaaagaaaagttaactatcttactttggtaagtttggcacaggacttaccacatttttgaggctctaggtcacagttttgtcactagaatgctagcagataaatgcaaggagtaacctaaccactttaatacaatggattgtataatgggttgaagtgtttcagacagtaactactaggcaccaaatcccagggttttattttgtgacatattagagagaatgatgaggtttcctgcagtataaatatgctattaaataattcttaggaaacaattatttagtaattcaaaggcctttgactcctggatccaaaaaagacaccaatacctgctaaatcttgagcactgacaccaaatgaagcctcgtcttcagactcaggagaaggtgacaatcaaaatgaactgctttcatgagacatagggctagaaattaaaaccattcaatccctctacgcccaggaactattgcacaaaaggtgagcacgtgagcttgtaagggctgattttgagttataaaattagttcagggtttttctataaattaaacattaacatcaaaagcacactgatgcaaggccaatgtctgggcccctgtgtcataacagggttttcttggagcattactctactctttaataggaaatcgtaaaacgttataaaaagatggctgggtgtggtggctcaggctgggcgtggtggctcaggccggggctggtgactcaggccgggtgtggtggctcacgcctgtaatcccagcactttgggaggccgaggcaggcggatcagctgaggccacgagttggagaccagcctggccaacatggtgaaaccccgtctctactaaaaatacaaaaattagccaagtgtggtggcatggcctgtaatcccagctactagggaggttgaggcaggagaattgcttgaacccaggaggcagaggttgcagtgagccaagatcgcaccactgtagcctgggcaacagagccagacaccatctcaaaaaaaaaaaaaaaaaaaaaaacttcacagaaatcctatcttatagtcaaactgattaaaattcggcttataaggttttattaaaattagctttaacattaaaaatataccatacaaaggtaaaatttgatgttctcttttgaataaaatgtttgtataatattgacataaaatatttgtttaccttttgagtgaactgtggggggaagaaaaggaagagggagagacatttagttggcctcatgctgtctttattaggccttattgttgggaaactgagtcgcctatcaaagggtaaatgtgtttgttttatctttttggctaaatgaataactattttgtagcgacctgtgatcctattttgtgatatcaagtgtcttaaatctttgatactgacagacttcccaacagcaaatatttcaagttctaaattcagggggttttttttaacctcaaactaacttttttgtgtattagcttccttgaattccaatacagacagacatgttaggcttctttggtatattagaattatacaggcagcattatcaaatgtgaggtggtatttaacttcctttgggttatatttgtatagatgtgctattaatatgtgttgcaggactatatgagattcctaaaattctgatatgtcttaatatatggtgtcagtaatgatgattattatgttaaattgttgtatgccaacagaaaaaaaaatttccttgtcaactgtgtctttatggctctcctaagacttttgtcattgcaattgttgttttgcattgattcttttcaaaaagtgacttataatcagatatagtccagagcttgtttatttaggggacttcatgaaaaggagtcttgaatgcagatttctgataactttggagactgtgccactggaatacagaaaacttctaggactcttaattagagtccctcttaattaaaaggctgacatgtttataaagattactaacccaatatgaaacacagcaggagttgattgcatggactgaactaatgtgggactgaaataattttttatggttttgtttgaaaaagtctggagaatttttgttttttggaatctggagaattttttcttttaagctcttcataacctttaagaatacagtatattaagtagagtatacccttttaaacagaatttgaggcattttctctctccctaatttctccagaatttataaactatttgtgaatattcttagttcatggcaatgtgttttcttgcatacatttaataaaaatctgttttcttttataaggggacacagttggaggaacaagttattttcccagggctttgactgaaatggccttgtgagaggttccagcaaagccaattaggagagcccatatggacaataatttttgctgcactttgtgtgggtaaataagccaagtatatgtaactgaggcttattttgcaggtaggcccatccagctgtgatatgtctttggtggaagcggggaacagtaatgatacagattgtgtctcagaagaaaactatagtattagattaacttttgattcctggatggccacgtggtcacccatagtatggaactgcccaccacgccattcctcagcatgaagctgccagaaagattgaggatcagattccccatgatccaggaattgataaatagaaagagggggactgaaaccaacacaatagtcccatatacaattctttcgaataaacatggaaattgaccctcctgatcttaaagctgaaacttatatttgttttatctgagttccttccccaggaaaaggacccccaggcctctcaaaaggtataaaagaactgaaactcatcagaccatcacatccagacaatgagacaccaggcccctcatttatcatgattgcttccttacccctccagagtccattttccaacacctagttatatttctttccttctatccatacccctaatttcaacgggtcagggagatggatttgagactgatctcctacctcctttgctgcagctcccaattaaagccttggcaaaacttgttgtctcagtgattggctttatgtgcagccagcaaaagaacctaggctgaatccctggtgtttcagtaacaattgcacccactctcattgtttcagcaaggatctccacattaatgtctccccaactgtggacccttttcctgaactccacacctgtgcagccaacaatctgatgaacatctcttcatggatgtatccaaggcatacaaacccagcatacctaaatccgaatttttctcctcctcctgcaaacctgtccctcttcccacatttcctatctcagaaactaccatttattcacccaaggaccaaagccagagacctggaagtcatttccaccctgtcctcacccttacctcctcaccacaactccccaagagacctattgattatactttccaaatgtgtcttgaatccatccatttctccccattcctccggattcctattttcctaactggtatccttgcttccagtttttccactctgctgtcctggcatcattgcatctgccattctctctctccctgtcttgtacctattcaagccattcctcaaactgaagtcaaagtcgtttttctacaatgcaaattctattttggtcccctctccttatcacatttcagtggataaagtccaaaactgttcatatcccacttctgcttgcctgtcaagtttcatctctctgaactcctgcctctctctccacaatgccaccatactaatattttctggatacctggaacactctagtttctctttcaccttggacctttgcacataaggagccctctaactgcaatttattgtctccttccagctaatttttcctctttctttagacctcagttcaaatgccaaatatctgggaagctttggctgtgccctttggactctagtagacatcccagcttttttccatcaaagcactgctgcactttattatttactattttgttacctgcattcacatagacacactaatcactattagggcagggacagtttctactgtgctcatcattgcttcctcaactttcaatgacactattaggtaataggtgctgagtaaattacctccaatgctaacataatactgacacgagttgcttattttattccatcaaagtgtatcaaatcaatatatgagtgcatgaaaaaatggaattcacaccagttgttagtgtttcttccaagtacttcttcaggtgccaagctacactggtcactagaatgccattccacaacctttcttttagttttgtagagcaattagcattcaagttagttgccggtcttaacgccatttccaaaaactgcaataacatcaggaaagactggcacttggagacttttaggattcccaggccccctctcatcgacttttttttgtttttcggttttttttttttttttttttttttttttggagacaagagtctcacgatgtcacccaggctgagtgcagtggtgcgatctcaccataacctctgcctccctggttcaagcgattttcattcctcagcctcctgagtagctgggactacaggagtgcaccactacgcctggctaattttgtatttttcggtagagacggggtttcaccatattggccaagctggtctcgaactcctgaccttgtgatccacccgcctaggcctcccaaagtgctggctgcagggagccgaaggcccttgggatgtgaccaactcagcattccgctggaggctatatgatcaaacagcaaactgtttatcatgaatgcagcacctgggcaaactcacactgccttgccaccaaatggtttgctgagcgcctcactccctggcgccaggctccttgaaattatttattgagaaatctagcacctattgttcaaagaatgcagtcttgcaagcctgctgtgaatcaagcagccagccaacaagcacctccccttctcgctatctcttttgcctaataagaagggctgtgtaaagctcagggcccttgtccactagaggcaaggtgccccctgaccccttcttccagatatactcttttgtctcttgtcttttattcccgcgttcgcccctctttgttcagtcccctaggtccgtgcgggttacatagtggcaccccgaacagcaacagcatcgggtgctctacagctgggattacagcgtgagggaccacgcccggcctcatcgatatcttttaagtaccacctcctttcacctctttcccagaagcctctgctcatctccagcacaaagtaattcgatacaaatttacaaaatggtcattacccaggatcacctgtctccgaagttagatggaaacacctgtattaaagcctaaagctattcggtctggaaaagtccggctcctctccagcttccacttctttaggcgtgcaaataagattcggcagagtaagcatcaacttcctttaagctcagaccgcactttgtgctcagtactgtaattatctgccctttgtgtcccatcccttggactgtaatgtatactaaggaagagcccttatcttatttctcaatctctgtcagtacccagccaagcacacagtagactttaatattagtgaaaataaatgaaacaaaatttcttccccagctttgaacctaaatagatgagcacccttaagcaagtcacttcacctcgctggaactcagtttccccacctaggcctccgagggctcctcaaactctggcaacctctagcctaaaatgctgcggagatcttaccacaaacctggggagtctggcaggctctctgcattgattaaaagaagggaacgaagcaagagaaaaacaagtcctcaattgttttccgccgagaaggcgccgctggagacactcaccctccctaaaccagggggccatgtagctcaggatgtaggtagggtccagggtcttccggatataatcctggaaggcttgcaggctgcgtcgctgctcggtggtcatgccggcctctgcttgcagctagctacgttccccgcaggctgtgcctcactagctttaaagccgggtaggaggagggcgtggcgagcggggaaagcagggattttccgaggaaatgaggccggacgcgaggcggagctgcataggaactttaataacta

SEQ ID NO: 1677 - DNA, 11328 bp, Homo sapiens
ttctatcccattttttcatttatttttatgaggagcctcaaaaaatagaagtggccttggtagggaaggaatgtcgtgattctgagtacagtatggcaaattcttttgcctcagtttccctaactccatccagtgcatatgaaaatgtctatgtgcgtacaaggtaggtctggactaagctctggccctccggttgttttcccattgcgggagcctaagccagggtgcccaggactcctgtgtggctggtgggcctgatgcccacagctgatgattcaggaaggaggggcctggagtctgctgcagactctcccgccccctacagcccaaaccgggcactgcagcaatgaggtggtcagtccagggagaggtccgacaagttctcggcacaatgctgcaggaagtcaaagtcaggcacggagaagggcacgcgggaccactttttggcctggatccgcccctgaggggtctccagcagcatgctgcggactttgagcactggcagcttcactgacttgtagatcatctgcagaccccagacctggaggtgagacagagagggtagggtctgggtctctggcctcagactgggcttctctcctcaagttggaattccctgaatacagggccttttcctcccacctgagatgtcacagactgtgggctcccttagggaggggctggacctccctcttcagactggaggccatggggtgggactgtctcccgtgtcctagtgagggctccctgagggcctctgaagactggggctgaggactctggggcctgggacgtggcctaagctcttacctccccacagttcctgcagctgatgacacccccaggcttccagtccttgaagactttgttgatgaccacaggatccctggagacattatagtagttcctggagaggaaggggggtggccacagccctcattgaccctcctcagccccggatctcatgccctcctgccggccaagtctctgcctggaccttgggccttcctgctggttaagaggcacagacttcccaggccaggaaatccaatctttggtgagttctacctgtgtggcctccatcgcacgttcccttgtgcccaggttcaagcctcagcatcggttacctggtcttcacagtctccttatgggtctctctgcctccatttttactcccaatcccaagccatccttccaccaactgctagagggatctaaaaatataaatctgccctgacattctgttccttaaaatctatccaagattcctaagaggaacctcctggataaaggctacactttcacacctgacctttcaaatcttccacgggctagtctgtctttttctaaatctcattattcacagtcccttccactcaggtcaactggtgtcgcttttttttttttaaaggcagagtctcactctattgcccaggctggagtgcagtggtgcgatcttggcttgcctcccgggttcaagtgattctcatgcctcagccacccaagtagctgggattacaagcatgggccaccacgcccagctaatttttgtatttttttttagtagagaaggggtttcaatatgttggccagactggtcttgaactcctaacctcaagtgatctacccacctccgcctcccaaagtgttggaattacaggcgtgagccactgcacctggccctccatggttaccttctcattcgctcacattcaaaccagacccattgagacctagctgaaatgcaacctcctcaattgagaaaatctgtgtgaagatccttggcacagtggcccggaacacagagggtaacataatgaatggatggaggatgggggaaggttactctctaggagatagtggatggaggatggcccagggatggccaagctctcttgatatcttcggaataggtaggaccagagggtcaatgtgtggtcttttgacacttagtatcctgaattccagttcttgctcaaccagatagtggctgtgggaacttgggcaagtcacatagcctctctgagcctctatttccttgcctgtaaaatggagacagggataaaacctgtctaaccagattattgtgaaaatgcaaagtacttgctacaatgctctttagcttcccaaagcttcaaagcactgtctggatgggaaggattcccaggcccccatcccagtagccccttccacaggtctcacgagaagttggggttcacattgacatggtgggtgccctccaccttccgcaggtcgctgccatggcccacagccaccatgcagttgatgcagagtagctgcacgtgctccactgggaactgctgccgctggttctcccgctgggctgcctgggccgcccgcttggtcaaggctgcctgctgcagatcccggatctggggtgggaggagacaccaggcatggctggggcctaagagaacgttccttgggggacaaaaggttcccaaagaactaagatcatttgtacctggaagagactttccttaaccctccctggagcttaaaagaagctctattgctgtgatgatgcagtaactcatgcctgtaatcccagcattttgggaggccaaggcgggtggatcacgaggtcaggagttcgagaccagcctgggcaacatggtgaaaccccatctctactgaaaatacaaaattagccgggcatggtggcgcatgcctgtaatcccagctactcgggaggctgaggcaagagaattgcttgagcccaggaggtggagattgtgccatgcactccagcctgggtgacagagtgagactccgtctcggggaaaaaaaaaaaaacagctatggagaaaaacagtatgagtagtcgggggcaacagtgggaggggtaagctttcctgctcaatcttgaaggactttaggcaaagctgcttctgtgaatctgtcatggggcatcattaacaattatgctgggacaacagggagcaccctggacaaggcaggatggtggtggccctgcctcaggggaactgatgatataagtcctagttctgggcttatcttctgcacgtggacttatcttgtcccctctgcctggttccagaaaggctgtaatgcagctcttccagatacataaagtatctcatggcaaagataaataaagagccttggacaaggcctgttcccaaggccttctggagtccaggtactgccttccctggcagccccaccccggcccttatttaaaccttccctaggtggccaaagttagccccgagatgtagaggggacagggggacgtatgtgtgcagtcagaaacctgccagggaggggctccctcctccccatccctcccacagggcatgcaggctgcctgcagaccttggcctggtactcggcctggtccattttctgcacagcagccactgcctgctccatcagcgtctccagcgcctcgttgatcagctcccgcttcagctcccggctaccttcagttgctacaaacgcgtatacactctgatcggcccgggcacggcccctggcctgggaagagagacaaggggtgtcctgagttgggctggggccccacacaggatcctataagggcggctgagtggaggaggatgtgagtacctggaccatggagatttcattggtcaagagcccataacgcaccaccacattgcaatgtgggatgtccagcccctcctccgccacactcgtggccaccagaaggttcagggttccatcttggaacttctggatcacttcttgctggtccctctgcaggcggagggcagggaggagaaagaggctggtacatgaggaggctcagactgactccacctgccagagtagcctcttctggttcagccctcactcccaatcttggtccatctccctagagtacttgaatcccatctttatccccaggtacccccaggatcttgcccatcttcccaggtaactgtccaacccctatcttccctagggactcctaagggtccctgcccctctagtctaggaaaaactctcaagccatagtcttctgcaagggaccccagacctgatcctgtgccctgaggaactgcatcacccacctctttccctacggacccccatgcccaaccttctgcccccaaggacctccagactgggagaggctccagcactggggaggtcagtgtccgcccctctcccctagctccttgcccctctgcctggggatagtcaactttctctttccccagggtctccctgcccccacctctctgtgctgaagaccctgttccccgcacttctctcctatggaatccctcccagcgccagcatctttccccgaagcccacacctgggtcatgtgggtgctctggctgctgttcccagccccaatcagtagctgggcccggatgtccacagtctgcaggccctgctgctgctggagccagagcaggagggagtgtgcgctttggcgggtgcgggtgaagatgataccccgagggctgttagagctactgaactgcctttgcaggatcttttccagcatctccagttttggattctctgggccatgagttgccaagtgggccagctcattcttgcggtctgtcaaaaaccccaaaatttagctgggtgtagtggcacatgtctgtagtcccagatacttgggaggctgagggcagaaggatcgcttaagcctaggaggtcaaggctgaagagagctatgattgcaccactgcactccaggctgtgtaacagagtgagactctgtctgggaaaaaaaaaaagaaagcaagaaagcaagagaaagagagagagagaaagagagaaggaaagaaagggagggagggaaagaaagaaaaaaaggaaaagaaagagagagagaaagagagaaggaaagaagggaaggagggaaggaagggagggagggagggaaagaaagaaagagaaagaagaaaagccccagaggcagaggattcagatcttggagtggggagggcactggcggaggaggttctcacagcaataggactgtaggcgtgcagaaggtggggggtggggggtgggggaaggatggaactcctgctcaactcccccacagcagcaccaagaacatatttaaggatgccctggccgggtgcattggctcacgcctgtaatcccagcactttgggagggtgaggtgagcggatcacctgaggtcaggagttcgagaccagcctgacaaatatggtgaaaccccgtctctactaaaaatacaaaaaaattagctgggcgtggtgatgcacacttgtagtcccagctactcgggaggctgaggcaggagaatcacttgaacccaggagggggaggttgtagtgagctgggatggtgccattgcactccagcctgggcgacagagcgagactccctctcaaaaaaacaaaaacaaaaacaaaaaaggatgcctcctaccgagcccactctcaaggccagcctcacaccggggtcatacagtacagaacctcagaccagaaccctcttctccccagtgaccaggatgacccttgagcttttaactctgacctctgctacccagatctcttgagccccagcctgtgctgcgatttgcaaccttaaatttcaccctctgactttcagcttcactctctcagtctaaaggaaccactcctagctaatccttttaaaaaatctgggccgggcacagtggctcacacctgtaatcccagcactttgggaggcagaggcaggaggatcacttgagcccaggagttagagatcagcctgggcaacaaagcaagactccgcctcttcaaaaaaaattttttttaattagctgggagtggtggtgcccacctgtacgcctagctacttgggaagctgaagggtgagaattacttgagcccattaggtcgaggttgcagtgagctatgattgcacaactgtcctccagcctgggtgacagagcaagaccccgactattaaaaaaaaaaaaaaagtcaacaatgttaattaattttaacaactaagcaaaaaccttcacaaatgaggaaataaatcagtcctacccatggccttggattttggttagaaaaataggatctccaccagtatcctcacgggcaccttcccatccgaccttggcgcctgtgccctggcctctgacctcgcatccaggtcccatcatccccggccccgaagccccctcccgcccctcaccatcgaacagggccagcagccggcgctcggcacacaggatctgggttttagtgacgtgctccctgtgatagaaatcctgcagcgcagccaaggcatccacggcgcggacggtgtcatggatgagcagcgcgtcattgtagcgcctcaggtgaagcgcatacacccgttgctcctgaagcccagccaaagccgctgcgggaagagggcgcagggtctgagcagcccacagccccgccccctgccctgccccatagggccgtcccactcgactccacccctggggtggataggccccgccccaaaggcctccgccccggcaggccccgcccctgaccactcccacatcctcgcctccgccagaagggctgcccctctcaccagcctcactcagcttcaccacctgctgctcatacatttgcgtcccaaatttccggctcaactcaggcatctccaggtggtcatggatttggtccatgagcttcttcagcaagtccccaaacggatcctgagcaagaggagagttggaggggattcccatacacgttggaggatgggcacccagtgggggtgctgaccccggcgtgtagcacaccgcgactgcctcacccatctgtcttagctgtggtgtgagctccagagggaggccggctagggtgtgggggagtcctgccctgtctcacccgcgatgtgctcttaccctttggcctgggcacggtgatgcctagtgtaaggcacatggacgtgctttggtcaaggaataggccgaggcggacatccgggccagagtgactcagcgagtttggggggcaggcacgtactccacttgctatataacctgtttgtgtaagttcatactggactctactgtcagtagaaggtaaaactgccctgctgacgctgttcacggagcttggttcagctcggcacggcagggcacgcttgctcgcccagagagagaataatgctactaacccctgcaagggacagccggtcgccttgaaggtgggcagtggggagccaggaacccgcttgtgcccagagggaaagagttaagctgctgaccctgacagagctggccttgccggccagggagagcagctgcaggcgtgggggcagcaggagccacagggccggagcagacagcccagataaaggtggacagtgtgagagagccgctgctgaataaaactacatttcacctgcctatggccccccaagggttctttcagctatctgctcactcactccctccctccagaccacagcatgggctcaaacctgaccccaagtgtaacatttggtatagttatggacctgacacctagtccttgtccagtccagtcatggcagacacgaggccgtgtccacactagagagggctcagtagagcctcagcacaaagtatccctgctctctggtttgtagtgcactccccagcatgacagtgatgtgacagacaccagtggtgccttctgagtcaatccaaagagcgggctgtgggcatgggctgtatctgccccatttcacagaaaggagaaattgaggcttggatacatagcaagtgacctgaagtcacagagctagtgagggcagagtcagggcccaagcctaggtgtcctaacttcacaccggctcccgctctcgccgtgtccctgcccccgcgtacctggctgcgcctgtggcagaggttgtactgtttgcaaggctgttggctgtgctcctgcagctgggggcagcagttctggggtgacatgatgcaccacgtgtccaagttggcacagagctgggggcaacagaggactttactggaaagggagggtctgtggggacaatggtcaaagatttggggcaggatggatcccagctgaggacaggagaatgtgggcattcgtctactcaaatattgctcgccctctctgtgcccgtcttgttctaggcactggggatacaaaggaactcagattggagttggagaggcagataataaaccagtaaaagaataatagaaccggccaggcatggtggctcacacctgtaatcccagcactttgggaggccaaggcgggcgggtcacctgaggtcaggagtttgagacagcctggccaacgtggtgaaaccccacctctactaaaaatacaaaaattagccaggcatggtggcacgcgcctgtagtctcagctactcgggaggctgagacagaagaatcacttgaacccgggaggtggaggttgcagtgagccaagatcgtgccactgcactccagcctgggtaacagagactccgtctcaaaaaaaaaaaaagaggctgggcacagtggctcacgcctgtaatcccagcactatgggaggccaaggcaggtgaatcacgaggtcaggagttcgagaccagcatggccaacacggtgaaaccccgtctctactaaaaatacaaaaaattagctgggcatagtggtgggtgcctgtaatcccagctactcgggaggctgaggcaggagaatcgcttgaacctgggaggcggaggttgcagggagccgaaatcatgccactgccctccagcctgggcgacagagtgagactccatctcaaaaaaaaaaaaaaaaaagaaaacaataaaaccttgcagagcgcattaacaagctctgaagaggatagcactggatgatatgacagagagcagagatcagggaggactttcaagaggtggcattaagctgttcaatgaatgacaaggaggaggcagcaggaaaagttcaaagggaagcgcattctaggcaaaagaaatggtaaatgcaaaggtccccgagatggaacaagccctacatgttcaacatgcagaaggcaggccagtgtaactgtaggatgagctacaacagggagggcgcaggaaatgaggtggagaggtagatcacgtggaactttgtaaaccacagtagagtcgggagttaattctttgtaccataagaaaccattggaggctgggtcttaggtgaggaaggggccagaccctgccatggagagcctggtagggctggtggggacggggtagtggcagggcaggcagggagggagggaagtccctggtgggtctggcagtgggaggcccacaggggccaggctgacctgcaggacgtggttgatggccccatcgagtttggaggccccgccagtgcctggggaggctgtgagacccagcacctggggtagcggctgtgccctctggagtttaagttctaggtactggctcatgatgacgttgtagacggtgtccttgtgcgtgtggtggcactcatccaccacgatcagggagaagactgagggcacaggggggaaggctgtgacctatgtttgcaaagcccttcctcccatcagctttcaagtagtccccacaatgatgtaagaattccttcttcccttcacaacctgcagctggtcccaggatgaggagccaggcagggaagacttctttccatttcacagattagtaaaccgaggctcagctggggaagggactggcctaagatcctacacgatagcccggcctgtttctactagagtgcctgcaggggttttgtgaacaggcaacccctcactcccactaaaactcccaacaccttgactccaggaggtgccctggggttggcgaaaggaggtaccccagatgcgtatctttttcctcccggccatggccctcaccagtgagctccacgtgctcctcctcctcggggctggtcagtgccatctgcagaagctctgctgtgcagatgagcaggtcatggcaccgggccaggtggccaaagccagcacgtggtcccatgtccccactcagggttgtcacggtccagcgtccatccagcatgcgcctgaactcttcaccatgctgggtcaccaggtgcacctgggggtggagaatgagctgggaaaagagagctgaatctggggccaggggtagggaggcggtaaggtgacccgcaggacatggctgggtactgagccagggtggaaagacaggtgagcttagcgatggccacagcagctttggagttctggtggggactgggagatgcctgaagagctaagaccctgcttggtggtgggagagcggggtagggacagaccactcaccctgttgaccaatacaaccaccttggctccatccacagtctctaggtgccgcttggccacataagcagccgcccgggtcttcccggcacccgtgggcagccagatgatgatattcttgccctccagggcaggcatgatcacctcccattggtaggaccgaagctccattctgggaatggcaggggactcagacccaccgactcctccacccctcccaactcctggccagaccagtcagtacagagacctccctttgcccaggactccaccccacttgagggaggtggggcaggactccctcagaacccatcaggaccctgctctgcccaaaagggggaggcgggagtaacacaggctacacctgccccctgcccagcccaggactcacctgctctagtaggtaggtctgcccagggcagtcccacttaactcagcctggtgccactctgctcagctcagagacccaagatggaaactgaaactgagggaaggagccagctgagccgacttaggaatctcccatccccgccccaggaaaaagaaccaagagaaaagaaccgtttgtgctaacagtcatcgccaactgccgtgagtacaaactccggttaagtactgctgctgcgccagcgccctggcaggcatgatcacctcccattggtagggccacagctccattctgggaatggcaggggactcagacccactgggccctccactcatcccaactcctggccagagcagtcggtacagagacctccctttgcccaggactccaccccacttgagggaggtggggggggggacaccctcaaaactcatcagaagcctgctgtggccaaaaggtgggggtgggggggggtgggagtaacacaggctacacctgcgccttgcccagcctgggtctcgcctgcaccaccacgtaggcctgcccaaggcggccctgcttagctcagcctggtgccgctgtgctcagcgcagagagcagaaatcagaaatggaaactgaaact

SEQ ID NO: 1678 - DNA, 14934 bp, Homo sapiens
agcaaatcgcattgcgcagacgaccagcgggcgcctcggattccgcccccgggatggccccgcctcctcccgccccgcggcaaggcacgcacagggcagtgcgcgggtgggtgggtcctagcagcgcggcctgacgggaccaaggcggcgggagtctgcggtcgttccctcggctgtggaccgggcggcacgcacgcggtgcagggtaacatggcggatgcggaaggtaagggctgcaggcttccgggccgtgctaactccgggcgactcggggaacgggggtggggggatggtatcggggcccgcgcacgcctccctctggttcccgccggcgtgtcggcctcttcaccgcccggccttaagccggccttgtctctcggccctggctccgtggcaagggcgcgagagtgggagcccctcgcggtgacttggcatgatggggctcggccctctcacctccctggggtccgggtcgccgtcgaaagacatctgccgtgctgcccaccccgcggtggcgtgggacgtggcagtgtctgtgctgctgccagcccggacgccgccgttacagctccatgcgactaggggagcaagggtagtggaaacgggccgagaagaaaaggagcggagggaccccggagcagggatagagctccgagttgcaagaaagttctagaggccacaagcccgcggggacagtcgagtggtcgcttatggaactttccggccccctgcgtgagcgcttctgtgggatgtttaagctctgccatagccacgtggtgaaccggaagggaagccgacacgtgcagtagcctacagtcagttacccagccatgggacccatacatttggccttacacaccttgttttctcgcttacctacggatatacgttctaagaaatgggtcgttaggcgatttcatcattgtgtgaacatcagagggctcttacacaaacctaggtggcataggctactacacacctaggctgtatatggtgtagcgtatggctcctaggcttcaaacctggacagcatggtattgtgcggaatgctgtaggcagttgggacacagcgtcgagagtttgtgtacttaaacatgtctaagcagaaaaaggacagtaaaaatatagcacagggccgggcgcggtggctcaggcctgtgatcccagcccaggctggcggatcacctgcggtcaggagttcaagaccagcctggccaacatggtgaaaccccgtctctactaaaaatacaaaaaatttaggtgggcgtggtggtatacgcctgtaatcccagctactcgggaggctgaggcaggagaattgcttgaacctggagaaggaggttgcagtgagccgagtttctgccactgcactccagcctggggaaagagtgtgaccgtctcaaaaaaaaaaaattatatatatatataaatatgtgtgtgtatatatgtatattatatatgtatgtattatatgtatgtatattatatatatatagtacacaaggttataagtggtgcacccgtagaggagggcacttaccatgaatggagcttgctgagctggaagttgccctggttgagtcggtgactgaatgtgaaggcctcagacattacactactggagactttataatctgtacacctaggctacactaaatttataaaaatatatttttcttcagaataaatcaaccttagcttactgtaactttataaactttttacttcgactgttgtaataatacttagcttaaaacaaacacattatttagctgtacgtaaatattttctctgcttatctccttatttataagttttctattttaaaattttttaatttttttcttaaaaaatttttttttgttaactaagacacaaacacagcacacacagtagccttgacctacacagggtcaggatcatcaagacatcactaggagataggaatttttcagctctgttataatcttatgggggccaccatcacatacgcagtctgtacttgcaaaacattatgtggcatgtgactgtaattgtagacctaaaatccatttcctacctgccctaatttcggtctttattttaaacccttgtttcatttattcttggggaaaattcccaaatcctgtgtttgtttttttagtaattattttgccaaagaaacataagaagaaaaaggagcggaagtcattgccagaagaagatgtagccgtgagtagtaatgtgtttgacttcactttgactaaaaagaaagtttacttaaataacaaactaaaggaaagaagtgtttttaaaggtttccaaggaatgggccagcattggtagtcattgtgtagattcgaaaaagcactgaaatgacacagccccagacagtccaagtgtccttcaggcatagcttactaaatggtgctggccttaccaactgctgtctctgaatttgtcttccttatgccacccacagacccgccatccccctttctctttaaatgtttggacccatcttagtgacatttcacttcccctctgtactcctggttcatttcttctctctctttcccttggaggtcccagtgaaaaggcataggaagccttgttttctgtttaaaaggcatacatttccatggcagtaatggaattgttcaaaatcgggtgggaagtttaataggttatatttctgtcctgtcgaaggaaatacaacacgctgaagaatttcttatcaaacctgaatccaaagttgctaagttggacacgtctcagtggccccttttgctaaaggtatgtggttaaaatcgtgcatcagatgaatgcctgcttttacgttatttccaagtgttaaacaattgattgagaatgcttactgctggcatccttgactttgggaagtgcccactgatacagtttaaagcaggattccttaaggtatctgaaatgagaaccaagtttttaaaaaattggcagtgcactcaacactgttgtagaacacatgtccccacaatgttaaattgctgagtttgtcaacagttctcagtttttgtacttagtccatcttgcagacctatgccagtttgtgggccacatagtggtactgactctttttttacatgtgctcacgacatggtattttgttttgtgttgtgtcgttgctttgtagaattttgataagctgaatgtaaggacaacacactatacacctcttgcatgtggttcaaatcctctgaagagagagattggggactatatcaggtaagtgttgggaggaggcactgtgcaaacttactttcttttgaaaatgctttcacatcagctattcaggaaggcagtggcatgccagaatagctttgtcttgaatatataacctgtacccgcagtgaattatttttctttttaacttttcagatttgttgtttcactggagcattaagagtgggtgatacattaattttttttttttccattccaggacaggtttcattaatcttgacaagccctctaacccctcttcccatgaggtggtagcctggattcgacggatacttcgggtggagaagacagggcacagtggtacgctggatcccaaggtgactggttgtttaatcgtgtgcatagaacgagccactcgcttggtgaagtcacaacagagtgcaggtatgtgggagagggagggaaggactggctagagtgaaaagctttctgtatttcccttctatgttttgtctgctggaaactatttcttcattaagaaaaaaaaaaatcctaaagcaaggatattgttttggtttctgtgtacgttctgtcccctgccagatcttggtggtccgcgctttttggaattccacatactaagcatgtattcatcaagctgactggatccatttgtccgggttcagctctcagcttgtcactccaggcttctcactctgtgctaccgcttctgcctaaagtatccttcgttcatttttatctgagaaaagcctgcttatcttgcaaggctttttccacgcagcttctacactgagtactcccaactgtccctgttagtacattgaattcccagtgagaaagtgtcttcattctttcccacatcatcaccatgaaatctctcttaatgcaaattttatagaaacacaaggtcaaactgccgcttttcctgctgtgcaaaatgggagtgactgagcatataagaaatatggaaaacagaaaactcagtggccacacctgactactcttttgtcatttttcaggcaaagagtatgtggggattgtccggctgcacaatgctattgaaggggggacccagctttctagggtaagtctgcaattgtagggaggacaccctttgttgacttggatctctgagcccctaaacatctggagatgggttagctgtcctgactgactccttttgtccccttttcagtcggctgctgcagccagcctggaccagtgactgcacatgtacattctgatgaggtgtttgttttcatttgtgtttgttcttaggccctagaaactctgacaggtgccttattccagcgacccccacttattgctgcagtaaagaggcagctccgagtgaggaccatctacgagagcaaaatgattgaatacgatcctgaaagaagattaggtgagtcattaggcctgtgagtgggtatgaacacattcttcaggattctgttctcttattaaaagtagatgcccttgaagttgaagactttctaaaacctgccctacagctgggatattgtctgtgggcgatagtttttgttatcttttgttgaaaaagtgaacagtgcctagtaaagtgagatggcttttacaccttttatgatgactgcttctgctggagttgaaatgttttcattctgcatttgtgtagttcggtgctttgttcaaaggtaagtgttttcaccaaagtatgttttgcatgtgttttttatttgttgcaattttgactgcttagaagtttctgttgtcagaagtaaatttaagacaatgccaattttcctcccatccatgaaacataccatgctgaatatacctgcaacttaagtgttaaaaattctgctaatatcagaattacagatctttttttttttttttttttttttttgagacggagtctcgctctgtcgcccaggctggagtgcggtggcatgatctcggctcactgcaaactctgtctcccgggttcacaccattttcctgcctcagcctcccaagtagctgggactataggcgcccgccatcatgcccggctaattttttgtacatttagtagagacggggtttcaccatgttagccaggatggtcttgatctcctgacgtcgtgatccacccgcctctgcctcccaaagtgctggaattacaggcgtgagccaccgtgcctggccagaattacagatctttacagcaaatgcttatattttaagaagtgtgtctgtcacctctagtcttggtggctcagatgaaggataactgcatttctcaaccagtgatgtatttacagtaggtgctgcttttcttttgtgtgtgtgtatcttaggaatcttttgggtgagttgtgaggctggcacctacattcggacattatgtgtgcaccttggtttgttattgggagttggtggtcagatgcaggagcttcggagggttcgttctggagtcatgagtgaaaaggtatgtgttacggggctagaagttttagagctggttcttaccatctgccagcctttgatggcactccacttgcttcatgtcgtgggaaagatgctttccaaagtgttgagttcagtccagggcagcttccctgttctgttaattaaactttgggacattaaaatgggctaagggagatgattgggtagaaagtattattctattcatttgcctcccagcctacaaaaatgcctgcttggggtctaatacttcaacggttaaagatgcctggaagagggcgcggtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcccacctgggcgacagagcgagactccgtctcaaaaaaaaaaaaaaaaaaaaaaaaaagatgcctggaagagccaggactgaagaggctgaagacataatgagcttggactagtaaacaagtgacattcagttttaggaagtttggggtctgatgggctgagatacaaataaactgaattattttcatacatggctgcttttcaggaccacatggtgacaatgcatgatgtgcttgatgctcagtggctgtatgataaccacaaggatgagagttacctgcggcgagttgtttaccctttggaaaagctgttgacatctcataaacggctggttatgaaagacagtgcagtaagttccgggttaggagtttatatttggaaagaacgtactccaaagatgaggcttgctctttttattgttttccttgggttttattttatttttttcaagtccaaaccaagtatattaatttaaagtaaaagtttaatggtaggcatacttaaaaataaggcacattaggccaggcacagtggctgatgcctataatcctagcactttggcaggctgaggcaagaggatcacttgagtccaggaaggagtttgagaccagcttgagcccaggagatcaaggctgtgagctgtgtttttatgatgatcagagagttggccttttataaattaaaacattgtctttttctctaacttgagggataaaaatttctggatatttaaaatgtttgtagttggtaattatttatattcaaatcttgtatagatgttcacattttttgtatgtgtataggctgtaataaatactgaaagatggcaccataatagttgaaaaaactcagtcacaaaacagtggacaacataaatgtgatgtcctctccttatcaaaccattggcttctgggtgaatgtaaagggaggggagaatgtgatcaaaagaggtctaggtgagtggagatggtatgaggcagatgggtgcattgggtaccattgaacctctggagaggtagccttaacttgtacccactgacctataaattctgcaccaagacttttgtgtgattggttcaacagggctcagtaatcttgttttcaagttctttaagagcctgttattgcctggatctccagtaaatctgttctttctcctcataaggaggagagaggagtaattaaggaatgccaaggctatttttatgtttcaaatgaaaatatggaccacgtgcggtggctcacacccataatcccagcactttgggaggccgggccaggcaaattgcttgagctcaggagtttgagaccagcctgggcaatatggtgaaaccctgtctctattaaaaatacaaaaattagctgggcgtggtggcacgtgcctgtaatcccagctccttgggaggctgagaatcacttgaacttgggagatggaggttgcagtgagccgagaatgtgccactgcactccaccctggacaacagagggaggttctgcctgaaaattaaaaaaaaaaaaaaaaaaaaaagaaaatacttgtgagtctctagaacctgaaaacctgaaagtcttctttactacttttgagtcgtgtgtaatgtgcggagagtggtacctatagcacagtgaggtggctcttctgagtaccactcatgccccttgcagctagtgggctataagtgtcatccctgtttcctggtgtcaggccccactcccttgttgtcctcctttactctggtgtgggagtggggtggagggcagcagctgggccccttacacttggtgccatctctgcaggtaaatgccatctgctatggggccaagattatgcttccaggtgttcttcgatatgaggacggcattgaggtcaatcaggagattgtggttatcaccaccaaaggagaagcaatctgcatgggtaagaggggatgtttattttttaaattctaaatgtttgtggttacatactaggtgtatatatttatggggttcatgagatgttttgatacaggcatgcaatacataataatcacatcatggagaatggggcatccatcttaagcatttatcctttgtgttacaaacaatcctattttactgttagttatttatcaccttagttattttaaaatatacacttaagttattattgattatagtcaccccgttgtgctattaaatagtctcactcttcttgttcattcttttggttttttggtggtggtgttttttttttttttttttttttgagacagtcttgctcttttcacccagactgcagtgcagagacgtgacctcggctcactgcaacttctgcttcccaggttcaagcgattctcgtgcctcagccttccgagtagctaggattacaggtgcacaccatgacacctggctaattttttgtatttttagtagagacagggttttgtcatgttggtcaggctggtctcgaacttctgacctcaggtgatctgccctcccaaagtgctgggattacaggtgtgagccaccatgccgggcctgattttttttttttttgtacccattaaccatccctacctccctgccagccccccactaccctcccagtctctggtaaccattcttttactcttctctgtccatgagttcaattgtttcgattcttagctcccacaaataagtgagaacatgcaatgtttgtctttctgtgactggccgattacacttaatataacgatcttcagttccatccatgttgttggaaatgacaggatctcattcttttttaaggctgaatagtaatccatcgtgtatatgtaccacattttctttatccatttatctgtcgatgggcacttcggttgcttccaaatcttggctactgtgatctctttgataacactgatttcctttatttggggtatatacccagcagtgggattgctggatcctatggtagctcaatttagtttttcgaggaacctccaaactgttcttcatagtggttatactaatttacattcccatcaacagtgtacaaaggttcccttttctccacatccttgccagcacttgtcattgcctgtcttttggatataaaccattttaactggagtgaaatgatatttcattgtagttttgatttgcatttctctcgtgatcagcattgagcactttttcatatgcctgtttgccatttatttgtcttcttttgagaagtgtctgttcaaatcttttgcctgttttttgatcagattattagattttttttcctatagtgctgagttccttatatattctggttattaatcccttgtcagatgggtagtttgcggatattttctcccattcttatgcatatggatatctagttttcccagcaccatttattgaagagactggtttttacccagtgtatgttcttggcacctttgtcaaaaatgagttaaatgtaggtgtgtgcatttgtttctgggttccttattctgttccattggtttatgtgcctgtttttatgccagtaccatactgttttggttactgtagctctatactataatttgaagtcaggtaatgtgattcctccaggtttgttctttttgcttaggatagctttggctattttgagtcttttgtggttccatgtaaagtaccagtgttttttaacttgtgaaagcttagctactgttggattgtctcttaagactttaaatgctctgcgcaccctcttagtgaatgaaccttagagctattcatttaatgggtctaatttgtaccagaagtaagcatgtcatcaggattccttagctctgtgagcaggcaaggcagccacggcttatggacagcagcagaaaaggaatccttaaaacttcaaaggttctgtggccccaaagggagtgtgcatgccgttcttatagacgtcttgagctgcaagcctgttatgtgtatcgttaggtgctttggttaggtgttttttaacttcagaagtttaacgtcatttcaaaggcctccttctcataatggagtatttcctccatatgcacatcctgagcaaaggtaaccccaattaaagtagtagctcagagttttaaaagttttaaagtggcatacaacagtagaattggggctcatcaattatcaattctttcacccttcaaataattcttttctttattcaatgcctgtagctattgcattaatgaccacagcggtcatctctacctgcgaccatggtatagtagccaagatcaagagagtgatcatggagagagacacttaccctcggaagtggggtttaggtccaaaggtaagtggtactgggttgcgtgccctgccaggttcttttttttttttttttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtctgtgtccctgattacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagagtttttcttagtgcagaacaaaatgaaaagtctcccatgtctacttctctccacacagacacggcaaccatccgatttctcaatcttttccccacctttcccgcctttctattccacaaaaccgccattgccatcctggcccgttctcaatgagctgttgggcacacctcccagacggggtggcggccgggcagaggggctcctcacttcccagtaggggcggccgggcagaggcgcccctcacctcccggacggggcggctggccgggcgggggggctgacccccccccacctccctcccggatggggcggctcctgccaggttcttttgtttggcattgttgaatacttgggcagctcttggtgtgtttcaccaccacagccttgtattgtgctgggctctgggttgtcgatgagtggaaacaggccctgtcttgggccttagagatttcagtctaatgaggggaaacagttgggcattactcacgtaatcacacagtggaatggcgaatttcatgcacgttagtggctaccaaggagtgcagagaggtgtctgtcacctggagtgtccacagtggtcaaggagtctggtcaagggattgtctgttaagccacaccggtgtgaagagtgggttaggtgttggtgaagtgaagaggggaggggagagttcagggcattgggagcaagcagcatgtgcaaaggcaaaaaagtagagtggctgcggtggggacgttatgtctgcagaggctctcactaataagctttgtgatcttcaacaagtcctgtgtgtgttggagttagtgggcaaattctgaatgctctggagaggagtttgaggccctgctgagaatacaccagggaggaaccttgttctattctttgtagtcaccatgcccgcttccagcattgacaccattctaatgttgacaccttgatgttccaccaggcaagtcagaagaagctgatgatcaagcagggccttctggacaagcatgggaagcccacagacagcacacctgccacctggaagcaggagtatgttgactacaggtgagggcaggatgtttcagagccggggtgggtagagacggcacacttgctgccttgatgcaggagtatgtcaacaacaggtgaggatgggaaggtagagcccacttgccatctggacgcaggagtacatggacaacaggtgaggaacaggtgagcatggaggttgtagagcccaggggagggggagtcacttggtttggggcaaacttgctaaatgcaggaccacaggaaccagctcttcagctcccgtgagattttggctgcccaggccagttaggggtgtgggcctgcacggcagacagttatccctttctagtctggctcgtgggactctagagggagtcagtctgcaacagtaagtggtgagttcttctgtccagcgtcagtattttgatggtggctttagacttgccagataacactacataacatcagtactgccctggaaagccattcagtgaatttgacctattgctacctctttttcagtgagtctgccaaaaaagaggtggttgctgaagtggtaaaagccccgcaggtagttgccgaagcagcaaaaactgcgaaggtgagtggcatgctgtcctcagtttggaatgtgcttagggagataatcctaagaggcactggcattcgtcttactttgtgactgtccgcagtccagccatatacgctagcatcagaggtgcagcgcatacacaggtaatgctgcctcataccctggggtgcttgtttgggctctgcaggctcctctgatttgtattctctgtcctatctgctgggaggaggaatgtgggctcaggaatcagatgggcctcgactcctacctcagctatggcagcaacacagtgatggaatgggtggtggtgtgtgtgtcaattctggcccccgccctgggtcaaatggtaggacagatgtgttgaaatcagaggccatggctgttggacattcgaggccatacaaaattcagcagagagcagaattgcatcttaacctggcaccacccagtgttgaaagagtcagtcaagcatgggttggcaactccaccccatggagctgctggcattagagcacagaatgacaggtctgcactcagaaaccgggggcggtactgagtatcctgcacaggctgtgtgggaggagcttctgacttgtcagatgtgaattcctgctttgcctgctttctgtgagaggtccttgcagtcatgagagaaacagctcctccgggcctttccaccccaagccccgtgctgctgctgtgctccttctcttgtgcctgcctcaaggcttcttggatttgggggatgagactgtcttcaaatcctcagtaaactaaggccctgtccgggtttgtagtcagaaaacgtcctgttagattcagttgggatctttcttggtgccttgctaccttttgactcactgaacctttcttgtccattattgcccaagatctaacacttaaccaattgctttcatctcagcggaagcgagagagtgagagtgaaagtgacgagactcctccagcagctcctcagttgatcaagaaggaaaagaagaagagtaagaaggacaagaaggccaaagctggtctggagagcggggccgagcctggagatggggtgtgtggaaacacgttcaggttccttgggctggcttagtccctgcgtggggaaagaattacccaggtggtaccagctttgttactcttcttggaggagctgtggcctgggggtgggatgccaccgagtgcctttagtgcttccccatgttcctggagtgcttttgccctccctgtggaatggacagatagaggcacccgacctctaccacttatacttagagctctattgatggtgggtggagaggatgtgtaggatggtgatctgaatgtttccacttccaaaagtagaccactagggtgtcactgaaaggtttacagaactttgtgtcacatgcagcatttaacccaaaatatccttacaggtcctgaaaaaggcttgcttgactgtggacctttaccagatttccttctgggagagtcatagctttgttagtggatggtatctgtgagctttcattctctttctttctaggacagtgataccaccaagaagaagaagaagaagaagaaagcaaaagaggtagaattggtttctgagtagtgaaggccacttgaagctggaggagaaactaaagccttattgagaaaacatgttatagatccttttgttgctgagagagtggaacataggtcctagacagggtgaagagttctggcacattttagctgctactttgagacctcggtgatgttacctggtgtggtcatcccatcttgtcctgttttaaggatatgggtggtgaaagatgaaagaggcagagtttatcccaatgacttctctgtttgagttgggaagcctcaccttcagacccagtaactgtccgcagctgtctgctagtggttgtcttaacatcgtagtcctagtttgcattttttaaatcccctctgtttaaaaggtttgtaaaacaaaaacaaaaaactaagtctgctcagtgaaatgctgtagaaccctaaataagtggtagaagagtgtcactgaattttgtctctgaattcagtataactgagttttgtccatgctggtgtctgggttataggcctgatgggcctggtagttttccatcttgttctggcctagaggtcagtcctttgcacttcctcaaagcttgtgtacagtgctcacctaaatccatctgactacttgttcctgtgccctcttgttttaggcctcgtttacttttaaaaaatgaaattgttcattgctgggagaagaatgttgtaatttttacttattaaagtcaacttgttaagttttttatgtattcctgttgggttttcttgttgatctcatgctagcagagcaaaaattgtaaaatattttgattaaaaatctagggacctttatgtcctatttgaaatgtga

SEQ ID NO: 1679 - DNA, 14934 bp, Homo sapiens; identical to SEQ ID NO: 1678

SEQ ID NO: 1680 - DNA, 46972 bp, Homo sapiens
acccactcccgctgccccgtccggcccgcgccgcttcctcgcagcagctgctcccggctccgcggccgcagcccgcgtggacgctccgagcgccccccgacggacgggaccggctccctggcggtcgggcgagcgggcggcaacgctgcccggccggcagcgctggggttaagtggcccaagtaaacctagctcggcgatcggcgccggagattcgcgagcccagcgccctgcacggccgccagccggcctcccgccagccagccccgacccgcggctccgccgcccagccgcgccccagccagccctgcggcaggtgagcgccccggggccccggggaggctcggccgccagctgcttcgagggctgctaggggaggggacggcgggggctcccgaagctgccggggagagaccctctccagggacctcccgaggaggggctctcgccgggttggagacccggctgggtttgcggggtgaggaaacgtccacggaccctgcttggggtggaacggggacagcgggtgggacgcgggggacatacgtctgacggggaccggagatactagaggaagggacgcgtctgctgcctccaggagcccgaagaggagagaagcttgctcgcagggagggggacgcgctggcttcccggggtccagactcgaggaggaggaggtgcccgtcgagagcatgaacaggggctttgctcatgggcagggggtgtaattacctggcctctgccttgggaaaagttaaggggcagaggaggtgaggaggggtttctgccatgcaggtgggcgtccgccccttgcaactgggatgtggggtcttcaggcgaggcgctgtcccttcccccaatcccagctttaggaaagagctcgtgagtgtgggcttagactcgcgcgggctggggtgtgcgccgtggagggcgtgaggcagagggcgacctcccggggtgctcctgagctgagccatcaagcgcggggagcagcggggctgccctctgcctgtgcacacctggcccgggaggagccggccggaggggcggcgcctccctgtcccggccacgccgcctaccctggggtcttaccttccattcttagcctaactcccgtgtgcggctggccccacttcccagactcgcacactaaggcctcaaaacctctagcaccagctcctggaagataagcttcccggctcgtggttgcatggggagggtgtattgagctccactttatcggggagaaagtggaagcggagaaagacctaacaagttgtaagactgcgctgcccttgggcccaggcttcccgctggaggatctcacctgtggatggagttccgagcccaggtcttgcccgcgcctccagctttccctgctcccttttcctcccctggtctaggagagaggctcgctgggcctccgtgtttccaccctcccccgaagctgggaagtgtttgaattaaagggaattaagggcagagtatgaactttgagttgcctcctgagttctggatgcggtgggttgtggcagacgggtggcagtttttgggaaacagctgttatctcctctaccaggcctgctggggcttcttgttcacccaccttggaaacgccaggtgcggacttgatttttccagagttgagatgatggtacttagtttatagggttggtatacagtaagcactcaatacatgtttgccattgttggaatcactagctagcacacgggctaagcaagcttccttccttaaggaagcatagttcttagttcatcatgtgtttaaaccctgtctcgccaagttcattgctctccgtgccttaattattacatctgtgaattagcaatagtcctactaatagggttgtgtaaggatgaaaccagtcttatgcgtgaattaacctcttcagcccttgatcttcctcagatgtttaggcataatagcctctaccacattgggcctgggtaaagaggcagtgggatagtgcctgtgtagggtcagcacatggtgagtgttgatgtctgtacttaataacgaatagcccctcattttagggtggccattcctgagatttggggatggagggaggcacccctgccagcctctccttttcctgccttcatgaaggcagctctgaaagcttttctcaatcattgtccacgattagggagttggcaggaagaaccgcctttgttccctttcgaacggagtcttggttttgttttataagggttggggccgtttttaaagccctcccggccacgcatgggggcctactgcaaaggtgtaattgcagaactaagtgagatcctttaccttttcccattggggtggagagtgctgagacaaagggacaaggactggggccagtggcatcctgctcttaaagtcatagacataacccccaccccttgcaaaggatggggggaggggaagacggtagctgggagctgcaggggtctaagggaggagcaagggaggtggggttgagaggctgcttccttcccttcctccagccacgtggggcctgtgatccagaggcgcctgtcgcccctcattattgcagccccatggacctgctgccagtgggggcttgggcaagttcttcaaggaaaacttaccttgggattccttttcctagaccagctcttatgccggctgcctcacctccaggctcagacgccttttccagtttcagctaaatgtgaaacttttcagaggtatgaggttgtgtgctcttcctcacacaccagtccttagcccaggcacatactactaattgagtggagttttttcttttaaatcatgaattttcaggatgatttccagtttcacggaggaccagggctggtgaagtatggaattcatttcatgtgcaggccactcttgtaaaaagagactgagcagatatgtctcccctttgttggggggctcatgttctcactgggacccttttacaggtgatagaactgaggctctggaagatacaggtactattacgtcttggtggtgagcattttctttctctttttttctttcttttttttttttttgagacagttttgctttgtcacccaggctggagtgcagtggtgtgatctcagctcactgcaacctctgcctcccgggttcaagcaattctcctgcctcaaccttccgagtagctgggattacatgcgcacaccaccacgcctggctaatttttgtatttttaattgagacggggtttcatcatgttggcaaggccggtctcaaactcctgacctcaagtgattcacccgcctcggcttcccaaagtgttgggattgtaggcgtggctgttacacccggctgctttttatttatttatttatttattttttctttttttctttttttttttttttgagacggagtctggctctgtctcccaggctggagtgcagtggcgcgatctccgctcactgcaagctccgcccctcgggttcatgccattctcctgcctcagcctcccaagtagctgggactacaggcgccggccaccatgcctggctaattttttttgtatttttagtagagacggggtttcaccgtgttcgccaggatggtctcaatctcctgacctcctgatccacccgccttggcctcccaaagtgctgagattacaggcgtgagccactgtgcctggctatgcttttatatgggtgctgcctcacacccataatcccagcacatgggagactgaggctggaggatcacttaaggccaggagttcaagaccagcctggccaacgtgataaaaccgtgactctacaaaaaatacaaaaagtagccaggcgtgtttgtgcatgcctgtaatccgtgctactgggaggctgaggcacgagaattgcttgaacctaggaggtggaggttgcagtgagctgagatcctgccactgttctccagcctgggcgacagaccgagaccctgtctctatgtgtatatatctacgtagatatagatagcttaagtttttttttttataaggacaaggtcttgctgtgttgccaaggctaaccttgaaagcctgggtccaacgatccttctgcctcagccttccaaaggcttgggattacaggtgtgagctaccacacatggcctctaggtcacttttcactcagattttttcattcattcaaacaaaatagcataggtatgacctctgctctagtttattttttatttacttatttatttatattttgagacagtctcgctctgttgcccaggttggagcgcagtggcggttgctcactgcaacctctgcctcccaggttcaagcaattctcatgcctcaacttcccgagtagctgagactacaggcatgcaccaccatgcctggccaatttttgttttgtaaagatggggtttcacctcattgcccaagctagtctcctgggctcaagcaatctatcctcctcatcctctcaaagtgctgggattatagacatgagccaacacacccaaattcaatttttttttaattatttttattttttgagatggagtttcgctcttgtcgcccaggttggagtgcaatggcgtggtctcggctcactgcaacctttgcttcccgagttcaagtgattctcctgcgtcagcctcctgagtacctgggactacgggcgtggtggtgcatgcccggctaattctgtatttttttagtagagatggggtttctccatgttggtcaggctggtctcgaactcccaacctcaggtgatctgcccacctcagcctccctcccaaagtgctgggattataggcgtgagccaccgtgcctggcccaaattcaatttttaatggggtccttgtcttgttttatgggtacaacatcatttatctgcctgagaatattgtagggtttagtgttccctcgtgttcccgccaatattaagggatactcaattttccagtaccttgccctgtaggtctggctacagggccaggagactggtgaggtctcagtctggtatctgttcctccacttgtcccagtctgtaagctcttgtgtgtgttttttttttaattatttcttttgagacaagtctcgcattgtcacccaggctggagtgcagtggtgcgatcatagctcactgcagccttgaactcctgggctcattccagtatcctcccacttcagtctccaaagtagctgggaccttagtcacgtgccaccacgcccatctaatttttaaaattgtttgtagaaacattaaagtctcactatgttgccccagctggtctcaaactcctcggctcaagcaatcctgcctcagtctccgaaagtgctgggactacaggtgtgagcctgtgcgcccagctgtctcatgttcttgtccagagcctcagcctgcatgtctgaagaagagtggttgtctccagagcagcaggctgagggaggggacttgggagtcaagggtctaactcttcctttggaagaaggcctctctcttagtaggcttttctggattccagcagcatttatgtcctgttgtatgtgtgtgttctggggccagagctggggctggaacccaggctgccactgggccccagctcctgcagaagtgctgatgcctttgtagggcgtttgctgcagccagaacagtgatgggccctggcagcatggcaacatggctcactctgttgcttaggctggagtgcagtggtgcgatcacagcttactgcagccttgaactcctgggtcaagtgatcctctcacctcagtcacctcctgagtagctaggactacaggtgagagccaccaggcttggctaattttaatttttttttttttttttttggagatggagtttcactcttgtcgcccaggctggagtgcaatggcgggatctcggctcaccacaacccccgcttcccgggttcaagcaattctgactcagcctcccgagtagctgggattacaggcatgcaccaccattcccgactaattttgtatttttagtagagatggtgtttctccatgttggtcaggctggtctcgaattccccacctcaggtgatccacccgcctcggcctaccaaagtgctaggattacaggcatgagcctctgtgcctggctaattttaaaattttttatagagataggctctcggtatgttgcccaggctggtctcaaattcctaggctcaagtgtaatcccaaagtgctgggattacaggtgtgagccaccatgcctggtcccttgcctgcctttgattcctaattactatcatggttcctgaagcctagtagaactcatctgaatggatacaggaggctctggagatgggaatggggaggcactaactagggtcccactgagccagctacaggcccccgctcttttgtgaaaagatggttgtgatgaagacttaagtgttcattatattccaggcaagccattttctctgactctgggagttgtttggcaccatgggtaaggaagccctaccccgacaatggcactggaggaagagcctcaagcttaggcactggctttcccaagtccttgggtgaatttgcaaacctcacctgtgtcctcatgttgccctaggatgttacatgctgagctgtaagcaggatgctgaattaggggaattgctcagtactaaatatgattgttactacaaccacaaaactagcaaggagtagaactgcattaaaacactgttgcaaatttttttattttttgagacggagtcttgctctgtcgcccaggctggagtgcagtggcgagatctcggctcactgcaagctctgccttccgggttcacgccattctcctgcctcagcctccctagtagtagctgggactacaggcgcccgccaccttgcccggctaattttttgtatttttagtagagacggggtttcaccatgttcgccaggatggtcttgatctcctgacctcgtgatctgcccgcctcggcctcccaaagtactgggattacaggcgtgagccaccatgccgggcccactgttgcaaatttctttccaaaacctctgccagcacatggctgaacccacagaactggcaggacacacaagatgcgctgggttaagatgctttggtgctctctgtgggttcagctgactgttttacaggcctgcttcttgaccgttggggtgggcagatctgagcccccactaggtaattgtggacagtttttgaaaagtggtttttatgtgagatcatgggcttcttttaaagccatttgtatatatgcagttcccttatctgcaggccttaattttgacatttctgttttccttctcgagatttgttttctgtccctgcagtactgctttttccagaatgtcatataaatggaatcatacattattattatttttgagacagcatctcactctgttgcccaggctggagtgcagtggcacgatttggcacattgcaacttccgcctcctgaattcaagcaggaaccatacattatatagcccttcgagtctgggttcttttacttattgtgagatatttgagatttatttgtgttatgacacgtactagcagttatttcttactttttaaaaaattttttaagacaggtctctggagttcagtactacaatcacagctcactgtagcctcaactccaatgctccagcagtcctcccactgcagcccccactgcccagtagcttcgactacaggcacttgtgcaccactatgctcagttaatttaaaaaaaaattatttttgagacagggtcttgctctgtcactcaggctagagtgcaatggcatgatctcagctcactgcaacctccacctcctgggttcaaacgattcttctgcatcagcctcctgagtagctggaattacaggtgcccgccacctcatcaggctagtttttgtaatttttttttttttctgaggcagagtttttcactcttgttgcctaggctggaatgcaatggtgtgatctcagctcaccgcaacctctgcctcccaggttcaagcgattctcctgcctcagcctcccaagtagctgggattacaggcatgtgccaccaccaccagctaatttttgttggtttgtttgttgttgttgttttagtagagatggggtttctccatgttgatcaggctggtctcgaactcccgacctcaggtgagccgcccaccttggcctcccaaagtgctggaattataggcttgagccaccatgctccgccttactttttttttttttttccttttgagacagagtttcgctctttgcccaggctggagtgcaatggcatgatcttggttcaccacaacctccgcctcccgggttcaagtgattctcttgcctcagcctcctgagtagctgggattacaggcatgtgccaccatgcccggctaattttgtatttttagtggaaacggggtttctccgtgttggtcaggctggtcttgaacccctgacctcgggtgatctgcctgcctcagcctcccaaagtgctgggattacaggcatgagccaccatgcccggcctaaattttttttttgtaatgttggggtctcactttgttgcccaggctgatcttgaactcctgggctcaagcaatcctcctgcctaggcctcccacattgctggggttacaggcatgagccactgtccctggcatctttttttttgctgtgaatataacatttctagcttttctttgtgttgtgatttttaccttttcaatacatagtgtgcaaggacatattttctggttacgatagaaataatttatttgaaagtctatccatgttgaaacaactaaaaatgctgtgcctttatctgttggtagaagaactaagctcccttaaagaaatctagagagcagaagagaacaggaaatgagagaccacaaactaaagggagaaaatgaacttttcaataaggcttgcaggcttgctctagcagttgtagtgattaaaagtagtggcaatggctgggtgcagtggctcacacctgtaatcccagcactttgggaggctgaggtgggcggatcgcctgaggtcaggagttcgagaccagcctggccagcatactgaaaccctatctctactaaaaatacaaaaattagccgggcgtggtggcatgtgcctgtaatcccaaggaagctgaggcaggagaatcacttgaacccaggaggtggaggggttacagtgacccgagatcatgccattgcactccagcctgggcaacagagcaagaccgcatctcaaaaaaaaaaaaaaaaaaggagtggtaaaggataaataccaaacaaaagtgagcctcaaaacatattacatatatatgggaagttcaaataagagatagagttgggatgtattcataggtgtctggctttacttacggggaaaaatattaggtccctatctcataccatatacaaataatcaaataattatgttgattaaacctgagtggcctaattcaaataaatgtttctcagacaggcgagttatgttttccgattgtaaaagttacatgggcttaaggtagttaccccccaaaccttccttctgagtatgaatttttatagttagagaagaaatgctgcagagaaatggcttaaacatcaataattgatgttgcattatgcaggtttcttgttttcactttacataactttgtctaacaataagtactgcactctttgccccctattgtggaagcaggtaatttagtcaaccagtcctcttgaccgtgatttgattgcagtgtttgctatgacaaatgggactgcagcaacccccttgcacagaggccttggcgagagctttgaactgggtggtttctgagcagtagaatcctgtgtaacaggatatagacattaggcattttagatgacacagtgaagattactatcccaaagactgaaccagtatccctgctgtgtaggtatttaggcttaagatgactaaatactgtgtagataggtagacttgagatttaaggcgttcttagttgaagccacaggtgcagcctgctgtgagggaggggccaaggttgagggggtctctttccagaatattgacctcctttgcccccttgggaggggacagggctgttggctctgattttgccaaggggtaggtggccacaggaattgggcatagcagtgcctaggattctgctccaatgctgcccctcattctctgagttaccattgaccactccttggggctgccacacccttcaaggggttctcaaagtggatataggggaaggggctgggtgtttgtgatttctgtataaagggcaaaaagtttagactctaaagttactgtcatatcttttcagatctttatggtcctagttttttttttcctgttacttatctaaaaggtaatgacattattttattccagtgcgttgacaaacatctgagtatattttggtgtcatgcacagtctgcagatagccacttgtctggtttttccctgtttggacacattttttttttttttttttgagatggagtttcgctcttgttgcccaggctagagtgcaatggcacgatcccgagtagctgggattacaggcatgtgccaccaccccggctaattttgtatttttagtagagagcggggtttctccatgttggtcaggctggtcttgaactcccgacctcatgtaatccgccctcctcggcctcccaaagtgctgggatcacagacgtgagccactgtgcctggctttttttttttttgagagggagcctgagcctgtactgttgcccaggctggagtgcagtggctcactgcgacgtccacctcccgggttcaagcgattctcctgcctcagcctcctgagtagctgggactataggtgtgtgccaccacgcctagtttattttttgtatggacacactcttctgataattctgcttactatgccaagggcccagcttctactgtaggatgacagtggtacatgtactcatgacctagaggcactgagcaattccccaaacgcattctgaattgtggagggtgatggggtggatacttcttgattggccctgtggtgtggtgctgtggtgggtagccagatggcacatgagaataagtgacttcaggtatcatgactgtgtcatctatgtaggggtccttggtaccaacttcccagtgaattgggtgggttactttatttcacagattataaaactggggtttgagagaaatattgggctttttttttttttttttataacagggtcttgtgctgtcactgggcctagagtgcagtggcatgacgatagctttactgcagcctcaacttccgaggcttaggtgatcattccccatcagcctccgaggaggtgggactacaggcgagtagctaggactacaggggcaggccgacacattcagctaattttaagaaatattttaatagagaagaggttttgctgtgttgcccaggctggcgttgaactcctgagcccaagctcaagccttggcctcctaaagtggtggtattaacaggcatgagccactgcgcccggcagtggttttttttttttttttttttttttttacgctttcctgtaaatctgatgttttctggaatttagggtaagttccttatcagacagagcaaaagcacagtactgggaccttgtgttctgtcatgtgttctgctgccgccgccagtgtggacagcctgagtctggccccctttcctttggatgtgctgtccctgctgcctggatccttcccgctctctacttcacctaggtgtggtgtccctccctgggcttacttactgcattgttttatggtgtcttttttttcttttttttttgagacggagtctcgctctgtcacctaggctggagtgcagtggtgctatctccgctcactgcaagctctgcctcccaggttcacaccattctcctgcctcagcctccggagtagctgggactacaggtgctcaccaccatgcccggctaattttttgtgtttttagtagagacggggtttcatcatgttagccaggatggtctcgagctcctgacctcgtgatctgcccacgtcggcctcccaaagtgctgggattacagacctgagccaccgcgcctggccttttttttttttttttttttttagattcaagaagtacatgtgcttgtttgttgcatgggtttattacttactggtggggattgggcttctggtgtatccattaccgaaagagtgaacgttgtacctgataggtgatttttcaacccttgctccttcccatcctcccgtctttttggggtctcccatgtcttgtcttgtcttgtcttgtcttttttcttttctattttgagatggagtctcccccttgtcgcccaggctggagtacagtggcacgatctcaacctcactgcaacccccgcctcccgggttcaagtgattatcctgcccagcctcctgagtagctgggattacatgcgcccaccaccacgaccggctaatttttttttgtatttttagtagagactggttacaccatgttggtcaggctggtctcgaactcctggcctcaagtgatcaacccgcttcagcctcccaaagtgctgggattacaagcgtgagccaccgcgcctggcctaatttttttatttttagtagagatggggtttcaccatgttggccaggctggtcttgaactcctgacctcgggtggtccacctgcctcagcctcccgaagtgctgggattacaggcttgagccactgcacctggccctagatttctctaacataggctgtggaggtggaatttttatttattttttctttaaatcaatactctccactgaatgtaggattttagtttttaattttttactgcaccccaggggttggggcagataccaaagtgaccccccttcctgcattgtgaggtttaattaatgcaattaacatttacgaagtgctctgaaacagctctgctgctggtatcagcctggaggaagtgagtgacatcagttctcagcattactgctgggttggggcgagtccctgagcctcctctgagtctaattgggggttgccacctacccctctgtctgccacattgcatttgagtacatctgacctggttcagtcggggcacaggcaccctgctgcactaatgaggaaggcccctcggggagaagcttgtgggtgggcccacccagcactgctgcccactctgaatcacacgctggaccccagcctctgggaaagggtcagagttcacctctcatcacaaggttaggcagccacctcctgtgaagggaaacgctcagctggtatatcatgtcccagccacgaagctcccttcatccctgggatgggtgatgcattcattgttcataacttctgtaattcttgtctgtcttgtctcagttacggcaattccaggcacgtgccctggattgcctgggcatgagatttggcactgccacttctctgggtgacttaactcatctgagtctgttgaaggcagggggataataagacctgccccaggatggggtgggggttaaaggaggtggcagacaggctgggtgcagtggctcacgcctgtaatcccaggccaaggcgagtagatcacctgaggtcaggagtttgagaccagcctggccaacatggtgaaaccacgtctcttctaaaaatacaaaaattagccaggcatggtggtgcaagtctgtaatcccagctactcgggaggctgaggcaggagaatcgcttgaacccgggaggtggaggttgcagtgagccgagatcgcgccactgcactccagcccaggtgacagagacttgatcttaaaaaaagaaaaaaaaaaaaaaatccatggtggtagacagtgttcagcctacagtaagtagggccctgggaactgttagctacttaatgttacagtggcagtgtgggatgatgcagttctaaatccagcatgtctgccactctggataggtcatattagataaagcagttggcttgtgatgggggccatgttatctggaaatgccagccttgaatcatgaagtcagtgagatacatagaaaagaggtgggggagatttgtatccactggtacacacctgatgctaatttaatttctcttgtcctgattctaagaacatgtagttaaatttgtatgttatttactttccctatatattgatcaaggaggtagtatgtcagtctctgtcttggtttctccatctgcaaaacaggaataacagtacttaccacatttaaaggttaaatgagttaagataagtaaagccaaaacagtgcctgacacatagtaacactgaaaaaaagatgaccttattggggggatttttatatatttatatatgtgggaagaaaggcctaggagagaagcttttattcctggattttgagctgtgggttttgaggtctgagaaaggaagcaggaggtgtagggagttggggagggcttccaggctgagagaacacagcagcacatgcctcgaggctagattgtcttggcctgcgtgtagactgaagcggggtgggggaggaactgagctgggcatctttagtcatgggtgcaggttctgaagttggtgtgcgctgtctacacagctgtggctataaggcaatgagggtagttaatttcactacaaacgtagggtcgtgataaaaacagaaggaattttaaatgaaatcacattgaattatgcaacgagaagaaagcatatataagtgctcagcttgctcctgggggacacccaggtagctagtgccatttattgtgggttttcttcctggactgtctctccagtacccacaggtcttgttctaggggcttgaggcttttcctgaatgttgagatatgggttttggaaggtgtgctgcccacacgttgggtaggctggtggccagttggcactgctgaggccctgggggaaggcccagggtggttaatcattgtcagcctgggtctgtctaggaggtgagactcctgtctggcttcttgttgacccagttagggcctgtctgaggaatggggttcaatgttgcctgcgaaacccagcacacattagaaccccaggccctggatgaaggcgaaggaggtcacatccttcactccaggcctctggtctgctaccagctcctggccacaaacaaaccctgtgtgtcctccccccagagcactttggggaggtggaccctcctggagacaccaggtacaccaggtagccccacctcccactctatgccaggcccactaggttacttagttcactgatttggcctgaggtgaaacgcttgaaattaatgattattctgaaccgacaccgcagcagctttcctgggattctgactgctttgtctcataggaactggccataggtcagccagcctgttcttccgggtcagggcttgggagaaaaagggctgagaagcagctgattggtctgattcaggcacgtcccttgtccttggtaggggaaattccttaacaggtgctgatacacactctggatcatgtgaagcacagaaagcctatgtgttatgtatcagcgcacatgtttataatctgaacaatgctgctttaacatgcatattaatcacctaggcatgacttgtgtgtgttaaaatgtcttgtgaaaatcccgcttcaggccgggtgtggtggctcacgcctgtaatcccagcactttggtaggctgaggtgggcagatcacgaggacaagacatcgagaccatcctggccaacatggtgaaacctgtctctactaaaaatacaaaaatcagctgggcgtggtggcgcatgcctgtaatcccagctactcaggaggctgaggcaggagaatcgcttgaacctgggaggcagaggttgcggtgagctgagatcgtgccattgcattccagcctggcggaggtcgcaccactgcactgcagcctggcgacagagggagactctgtctcaaaaaaaaaaaaaatgaaaaccctgcttcaggacatctagcttagtggtggagatttctccagccagctcccacttccaacagttcttccaagcagctctcagttcatggtactgtagcctgcgtggctcctgggccacacagggagtagcagcagaggtccagttgccccatgccatgggcaggtgcagggtctggaattgggagctctcaccacagattgcacctctgcctgggggcgccactgggctcatcagactgagctcacggtgccccctggtgggcgatgccagtggcgccagtgcagcttggagcccgcaatacaaggtgtggcttctagaaggtaccctggtttgagatgctgaggtgggaggatcccttgaggccaggagtttgaggccagcctgggcaacatagccagactctgtttctacaaaaaattagccacacctggtggcacacacctgtgggcccagctggaggatcactgaagccctgggagttgaagcctacagggagccgtgatcacgccactgcactccagcctgggtgaccaagtgagaccctgtctctaagatagatggatggatggatggatggatggatggatggatggacagatagaagataaactgcgaggctagcacgggttgtctggcaggggctggtatgtctccacgatggagcccgaggcagggaggcccggtgcatatggcagcagcttattggggaagcttttcccaggcacggttccaggacacaagggtgtggtgtgagtgacctggagctgtttgtggttcagggatgggggcctggaggtctcattatgcctaggcttttataatatttttgccaaccaaaggtggaacaaaaagcaaaggcaagtgacttggaaaactcggtttcagcggggatttatgccctgaagttttttactcgttctctatctaatcctggccctacctcttagatgggctatatgaccttggagaataacctagtctggatgtcagttttctttttctagaaggtgagctccccagtctccctagggggagatacaggttgttgcatccaacaaaatctgtgtgcccataatgttgcaggcaatgggccagcccagaggttatagcctgccaacccatccgtatggccctggccctgtgtgttagctgatttacctgaccaggaggggcagcagtggggaggccaagtcccagaggtgagggtgaggctacaatggatctggggagtccccctcctggtaactgcccccaggctttctgcctgtgcctccatccttccctccttgggaacttgggactctgagccccagctggtgagggaggaggggagtgagcgacaggccagcagaccaatgggccctggaggatggggtgaggcggggcttgtgctgccatggagaggagagaagcggttctgtgggggaggagggggtgggtgggaagaggacctggagattgaggggaagggagagagcaaacaaaggggtcaggagggaaaataatgcactggcttcctgagcccctgcagaggctgagcagggagagggggccagggccagaggggacagaggctggcggcagacgggccgggacaggcaggtcctaaatggcattgtttgaaggggccggctaattgcacagagcagtctgagcctgagaccccagccctggcctccccactctgtcctgggtgctggcgtctgagccttcgggacagcctgtccacatggaaccaagtcctgagcctccaagcttggtgagggggaggctatggggggcagcctgggtggggtacttgggcaagagcatcaccctaagaatgcatcctggggccttggcctgagaacacagagcccatggcgggggaacactgtccctctcatgtccctgcttccctttcaccccacccattctggcttctcccacaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggtggctgggcagtggggactggggtggtgtcaggcgctgacatagtgagcggtcactgcagacaactggaggctttggggagagtctctgacaacctccaccacaattccccgggagggaagagagctctagcaaggagggatgcagggtcgagcccttcacacctgcccgcagcccttggcctcccctttgggactctcatctcagctgggactctgagcgtgacacaagggtgatggttccctgtcctctgccagtcatgacaggggtggtctcagcatgggcccttggagagcccttctgcagtgggaccctctccccactcagagctgggctggggttgggagggggaggtctggagtgtgcttcctttccaccctgccctgagcagctccagccagctcacttgggatcccgccccagctgggttggaaagccctgcattgtcctctcagctgtgccatcccatggaacttcctgcgagcgtgaaagggttctatttctgcattgttccccacaatagccacactctacatgggagcacttgagaagcggctgacacagcaggcagtgaattgttcctggaaatgtagttagtggtccctggatgggcagcaccctgctggaaggaatcggagggctccccttggtaacttcagtgttggtttgggtcctgtcacgtgcctggcccagggctctgttgtcttaggaataaaatcagtggagaagatgaacgatactgacggactgagagcaaatccctgtggctgacaatagtgtaggggagatcccaggccacgccacggagaaaagcccctattagcaaggccgttccccagactggtgcctgcccccacaaaacagactcctggctgtttcctctacaggccgaagatcaagctcgcgactctccaagagggaggtgtccagtctgctaagctacacacaggtatggtctctgctctccctttttcagggctcagggactttgtctttggctttcatcacgtgggctgcctgaggcccataaaaactggcatctgcaaatgtatggagggttgccgagctagatgctttctgcatatatttggcattattttttcaatctggacgatcagttacattgctaaatctctaatatggtagtcccctcttatctgtcattttgctttccacgatttcagttgcttgcagtcaactgccgtctgaaagtattaaatggaaaatattaaatggtaaatcccagaaataaacaatttatacattttaaattgagtgccattctggtagcatgatggaatcttgcactgtcctgctccgtcctgcccaggatcagtcctgtctttgtccaacatctctatgcttaggtgctacctgcctgttagtcacttgtagccgtctccgtgatcagatcagttgcagtatcacagtggttgtgttcaagtagtgcttgttttacttaataacggctccaaagtgcaggagtgatgacgctggcaattcagttatgccaaagagaagccatgaagtgtttcctttaagtgaaaaagtgaaagttctcaaaaaggaaagaagaaatcatatgctgaagttgttagatctgtggtaagaacaaatcttccagccgtgaaatcatgaagaaggaaaaataaatgcatgctagttttactgttgcacctcaaactgcaaaagttatggccatgttgtgtgataagtgtgtagttaagatgggaaaggcattaaatttgtaggtggaagacatgaacagaaatatgttctgattgacagcagtgctttgtgccagggagcattgagcctatagcaagggatcccctgacaccaaaccatttacttcaagtaagggatggttacatagattcaagaataggtttctactgaaaactataaaaatgactggagaggctgcatttgccaatgaaaaacctgctgctacattttcagaagagttgaagttgattgagaaaggaaacaatccaaaactaagactgcagtgaaaccagactcctccagaagatgatgtctaatagaacctaccttcataaaagtgcaaaggaggaagacactaggtcataaaccatggaaggacagattaaccctgaatagagtacaagaagatattttgagagagaaaccacattcatatggcttttattaacagtatattgtaattgctctattttattattagttgttaatctgtgcctaatttataaattaaactttatcataggtatgtagatatagacaaaaacagagcacatatagggttccatcttccaaggtgtcaggcagccatggggggtcttgcatgtatcccccctggataaggggagactactgtatagcaaactgtctttttattcctggaatgagtccaacttggttatggtgcattttgaagttgattttattcatgtattcatgaatgaaatgggtatttttttttattcatttatttttgagatgaagtctgttgcccaggctggagtgcaatggcatgatctctgctcactgcaacttactgcctcccaggcccaagcgattcccctgcctcaggctcccgagtagctgggactacaggcaatggaccaccatacccagccaatttttttgtatttttagtagagatggggtttcaccatgttggccaggctggtctcgaactcctggcctcaagtgagccacctgtcccggcctcccaaagtgctgggattacaagtgtgagccaccatacctggcccattttatttctttaaatatatctatggttttgatgttaggattaggtgggctcaaggaattttttttacaagctggaagaaacttgtctaagcttattttaatgaatttcaaacaattatatcttctaagacttgctacattatcaagctttctacttcatttacttttccaaggttggatctttcccatcttgttttgtgttccttcctttactgacaccgtctgtttcctaattattcttagtagagtttgtcaattgggttggttttgctcagagccagtatcagtcataaaagtcctgggcaatgaaaactcaccctcagcttccattctcttggtggtggccaacctacttaggggactcagaaggtggggaacctaagccctgggaggaattagggcagctgcaggatcagaggctcagcactgctgttttgtttctggtagctagttaccagaaacagtaatgaaatctcttgcccacacgtttctttttgtttgtttgttttgttttgagacagagtctccagtctgtcgcccaggctggagtgcaatggcacgatctcggctcactgcaacctccgcctcccaggttcaagtaattttcctgcctcagcctcccaagtagctgggcttacaggcgtgcaccaccatgcccagctaacttttgtatttgtatttgtatttttttttttttttgagatggagtcttactcttgttccccaagctagagtgcggtggcgcgatctcggctcgctgtaacctccacctcccaggtttaagcggtactcctgcctcagcctcctgagtatgagtagctggaattacaggcacatgccaccatgccctgctaatttttgtatttttagtagagacagggtttcgccatattggccaggctggtcttgaactcctgacctcaggtgatccacccgcgtcggcctcccaaagtgttgggattacacgcctggcctaatttttgtattcttagtagagatggggtttcaccatcttggccaggctggtctggtgacctcaggtgacctcagtctgccccagactcccaaagtgttgggattacaggtatgagccaccacaccctgcatattatttgattcttgatgtaaccctgttgtgctatgagggaagtactgttattccaattttaaaatgagggaaatggactcaaagccacacagttggtgagtgaaggcaagtgcttaacactccagccagacctagctgctcgctgcttcagcttttgtgtttggcttatgctgggttttggtgtgaggtgtgaggcctgcacgaggaagccctgatgacatggtgcaggtttcatgccattgcttccggggcatctgtcgtggttggtctgtgtctgcacccatatgcagtgtgttgtgatgagtgacccggtctccctgccaggcacaggcgatcagtctttcatattgcaggtgccttgtttctttgacttgctgataccctggggtcttcatcatgttcatcatgtttccttataaaggacttgacaggcgatggcgacggggaagatggggatggctctgacaccccagtcatgccaaagctcttccgggaaaccaggactcgttcagaaagcccagctgtaagtagccacacctcgagccaaagcacttgtggccaacactctacatagcatacatagcatgctacatacatagcatagctccttaggggagcttttaagagaaagtgatgaaaaaatgttttgaaactagaaaatataagcaaggctcttggactattgttggagggttttcttttttctttttttttttctgagacggagtctcactgtgttgcccaggctggcgtgcaatggcgtgatcttagctcactgcaacaacctctgcctccttggtccaagtgattctcctgccacagcctcccaagtagctgggactacacgcacctaccaccacacccggccagtttttgtattttcagtagagatgaagttttaccatgttggccaggctggtctcgaactcttgacctcaggtgatccacccaccttggcctcctaaagtgctgggatttcaggtgtgagccactgcgcccggctggaaggttttctctatgtgccatttctttcaggtggtttttaagttctttcttgtaacactcttggaggtgcctaggggtgatagagtttgcagggtggatggctcagctgctaatgacctagggagtccaccatttctgtgggtggattttgtgcctcagagttttgaggtatggcaatgggaaggcagttattgcttatggtcacccagccctttagagaccagactgacagttactatcccaggtgtgggttacagtcttcccttcccaggatatggtctgtatcatcccctttgtggagatgagagaagattccagcaacttaactgaggttaaacatcaactcttctatgcataatttggacacaggttctgcaacaaccaaattcatgccatttttgacaatgaacatggagcctaaggaattctattccatcttgatgatctggtgccttcctgaacccagtaattggccttatgcttctttgacataaaagtttattttagagtgaacacgaatttttctttctttctttctttctttttttttctttttttttgagatgcagtctcactgtgttgcccaggctggagtgcagtgacgtgatctcagcacactgcaacctctgcctccctggtccaagtgattctcctgcctcagcctcctgagtagctgtgactacaggcacccaccaccatgcctggctaatttttgcatttttagtagagatggggtttcaccattttatccaggatgatcctgaatttctgattgcaagtgatctgcccgccttggcctcccaaagtgctgggatcacaggcatgagcgagccactgcgcttggccagatttttatttttcaatcccaattggcaggtgccatttcagctggccatgtctgtctgctgtgacaggcagagcaggacctgctgggaattgtcgggcatcctagctggccaccctaccacctctattccaagaactggggaattctggctggactcagtccagagtcccacctcatcacctgttcacttccagttgtcctgaagctggctaccaggtctccttggccacctgaaggcctaatccttctggccccgccagaccccaggcctccagtcacctaaggcccagtgagtgtcctctcttgcttctaggtccgaactcgaaataacaacagtgtctccagccgggagaggcacaggccttccccacgttccacccgaggccggcagggccgcaaccatgtggacgagtcccccgtggagttcccggctaccagggttggttccccagatgcccagacccctgcccgcagtctctaactgggagatatgcctcactcactgcactactggttgtggctggtagataatctgtgtccttttttcacactgcttttcaggttcttgctttttcttttctctcctgggtaagcttcccgtaagcctgttggcttctctcctggtctgatctcagatgacactctgttgggaatggaagctttccctgttgacttggttcttgctctaacttggaaacaaggtagaaaacactgacatccagaactgtcttctccctcatgtcttcttcacctgtcttgaggcaaccctagcgggtatggcaacatttcactctctgagagtccctcgtcattacccatcatttgtgcctttgtcatctttctgtctctgggacagttacaatgactttctccccccttaagggatacgtgttcctggaaaagtttcttcagcggtctctgttctctttaacttcagtctttcctctttctttttgcctaggagccatatgggggtgccgttggtctctggtcaccgacatcctttgctctggcccaaactatgtgtccttctgtccacagtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggtatggccgagaggggctcctgcccagggtgactgaggaccctgaacacggggaaaaaccagttacctgctactgttggtaacagagcgacaacagttgttagaagtttcgtaattgtaataattgacatgtttgaattctaagtatcttccatatgcaccacggacctttctttaccttaatcctctcccagacataagtcaaatgccagtatttaccacgtgaatactgtggtttttcccaacatgacatttatgtaaggactgcaactgcgtacgttatacatttcatgtacgcccgtgtgaagagaccaccaaacaggctttgtgtgagcaataaagctgtttatttcacctgagtgcaggtgggctgagtccaaaagagagtcagcgaagggagataggggtggggccattttctaagatttgggtaggtaaaggaaaattacagtcaaagggggtttgttctctggcgggcaggagtgggggtctcaaggtgctcagtgggggagttttttgagccacgaggagccaggaaaagggatttcacaaggtaatgtcatcacttaaggcaaggaccggccatttatacttcttttatggtggaatgtcatcagttaaggtggggcagggcatattcacttcttttgtgattcttcagttacttcaggccatctgggcttaaacgtgcaagtcacaggggatgcgtgcaagtcacaggggatgcgatggcttggcttgggctcagaggcctgacaatacatattgtgattctgttcatcagagtgcacatactgtatatattgtacgtatgatacctttgtagacttgcttttttcttctattaagaactagagttgcctgaggttcatgtctggataataaatccagtggtctgggtcatagcttaattaaccgattcaggttgtttatgcttattcaagcattgctgcacgaagactccttacacatgtatgtatttatgtgttgttaggatcccttttttctatgtccattattacattttactttgtatagaagggatctcactatggtgcccaggctagtctcaaactcctggcctcaagcgatcctcctatctcagcctcctgagtagctaggactacaggcgtgcaccaccaagcccagctactttataaattcttttgtggaaatggagtcttgctgtgttgcccgggctggtatccaactcctggcctcaagcgatccccctgcctcggtctcccaaagtactgagaattacaggcatgaaccacggtgtctggctacatcttgcattttatggcaagctttttgttgccctcagggacagtggagtggacaggacttggcccaggatggcctctcctcactgggatttcttcatgtgggttttcttccaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtgagtccggggaagggcaaggggttctgcaggcctgaggctgtgcctgcctgcctccctttgaagacaaaggcctgggattgtattctgcagatgtgtgagcctatgccttcacactgtctgggaggaaggacaaaacttcctgtgttaaccagctacagcagattccactcacacgggggacaaaagtgctagaaagttctggatccatgggcagttggattttatgttatttcttagatttatcttttgggggcagaatcatcagtgtggactctgaggggccaggagtggccacgtgagcaagtacccaaaagtgttcagtggagaagcctggaagagaccggaagcatggccgcggcctcttgtcatttagccctggggagagaaaggcatggagttgggtttagggtcacctggtatcagttgtgaaaagggtttttagtagaattgggtatttcagagtctcttgatgattgattctagccttttaaaatctttcttggtaatgacatttagctggggaagagctgtgttgggcataactaggctgttttgattcttacactctttcaacaaagatttttttgggggcggtgagaatggagtctcactctgttgcccagactggagtgcagtggtgcgatcttggctcactgcaacctccgcctcccaggttcaaacaattctcctgcctcagcctcctgagtggctggggttacaggcacctgccaccgcaccctgctaatatttgcatttttagtacagactgggtttcaccatgttggccaggctggtctccaactcctgacctcagatgatccacccgcctcggcctcccagtgctgggattacaggcgggagccaccacgcctggcctcaacaaagattttaatcagacagacctatcctgtgatggtctcttagaagtaaatgttagtcctaccctcagagccctgagagaggctaagttaggtgcctaaggtcattgggcaagttgcagcagaagcaagccaggcaggattgaaggaaggactgtacattcctgggattcagctcaagcagagattctgtttttcccaggaattgagctaccatggggccatttgccatgagctaattgaagtttcccaagggctacaataatatattgggtgtggagtctcctttgtaggagagcccctgcatgcagttgcctgctgtgaccagcagagggaggacaagtcctgggcccatgctggcagtgaggcagctgcttccagggatgggagagcagtaactcaagtgaaggaagatggattgtttgcaattgctttgccccatcgagacataaaatgcactttgcaagatagagtctgaggctaatacaatgcagtgtggggctgtcagcattaggggatgagatgacaatatgggacctgggtctggcctgggcaagtgcctgctcagcatgtgtacgctgtttgggttgtattggagctattgggcgctggaaccagcacttgtgttggagcggtttccccccaccagagccacagtgttttctccccagtggtggtcacacccccatataggaaatcaggcattccgtgataaaatggaggtttgcatgagtgtgagcactctttacggagactagaacattccctgtgtctttcagttcctttttttttttaagagatgaggtcctcactgtcacccaggctggagtgcagtggcactgtcttggctcactgcagcctcaatcacctgggctcaagcaatccttctgccttaacagagcagctgagactgcaggtgcacaccactgtgtttggctcttaaaagtttttgtagagatggggtcttgctgtgttgtccaggctagtcgaactcctgggctcaagcgatcctctcaactcccactcccaaagtgctgggaatataggcctgagccactacgtctggcctttcagttctgattagcatccctgaatggccattttctctctcactggcaactcagtcagttcatgcttggtccagggacttggtacatcaggagacttgtggaatatggattaaatcacaagaactaaagttaaataatcacaacaagtgaaaggtgctgtgtcgagcactgttttctaaacacattcattaggtgaactcattttaataaaagggtaaagagtaaacaattatcatgcttaggaaagaaggaatatgtgcaaaccctcaatgctggagcagccacagagaatattaggactgagcctcaggggtccacaccagggacacctgcttggaaaatgtatacaaacacagggttcgcctaattgccttcattcagagtatcctccttttccacagtggaagtgtcgtacctaacaaggttctggatatctgtgtgttgagactctgccatttctatttttctgcttttttctttccttcctttcaaatagatgtctgtggactttatccccaggaatggtctcttggttaaagtgtgtgaaaatcttctgcatctgatggacaacattgtgatagacatggcacctgggacacacctgtaggtggatgttgatgatgtctttctcttttaggtctctgcagacaaactggtggcactggggctgttcagccagcactttaatttggccaccttcaataagctcgtctcctatcgaaaagccatgtaccatgctctggaggtaacatgggatgagggaatgagggctaagccctgagagcagggatgaagcaagagacccacagaaacctagctcagtgttgccaagggtggtttggaggggacagggtggccagggaggaggtaaatgacaacataacatgatggccaccggattgggcctcccaacaaagggatttgagacatcccagctgccacttattgggaccactaactgaatcagaaggaaagagcacgggcagttaggggtgcaatattcgtatcagtgaatgtgcttttccagagacctcagagccttcttatgagggttggagttcacagcaagacagcagtggaggccagctgtcttctatctgtgggccgtcttatcccctatgaaccattataccctgtttctcccttcaccttgattttttccccccacctttgttcagcatttaagagccaacctcttctcattgctaaaggcttcattagacactgaaatccttggtccttcatgtaggacacaagttaatgtccccatctttagggagataaaacaagaaatctagtgccgccttatataagatacagaggagatgagatagtgctggctggggcttctatatcttggtggtagagttaattctgatatgtctgccttttgagtgggaggtgaccactgacattccctagggggaagagatcctatttggtgcctgcatgaaaagatttaaccacaaccccccttccgaggcctctccctgcacaggcccctccttcctctgtcacataccacagcccaggacagctgtctggctatgaaagggcccagtgtgaaggggaatgtaggccctggctgggggaatccctgggtgtggcctggcgagcacctcctccccacccccccattcatcacagactctgcctttgcagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccaggtgggaatgagtccccatggcagcacccgctgcctctgctggtgggaccacttcttgggagagtcagccacccctgctgccccacaccccacccagctttctagcagctggtctcaactctgaatgttggaaaaataggagcaggcatacgaaggctgtgccagctctatctggcttccccggccactttcttgctgatggtcacgtgcatataatttgtattgaatctgacatctgtcttgaagtcaggatgcagtgttgactagcaccttttttattaaaggaaaaaatagttaagctatgctcatttgagaaaattggaaagtgttaaagaagaatatgccacctgctaacattttgaccagtaccatatttctcccattataagataactctggtttctagaaatccaggacttgtcttacaatccatagatttaaaggccaggcctagtggctcatgcctgtaatcgcagcactctgggaggctgaggcgagtggatcacttgaggcgatcacctggacaacatggtgaaaaatagaaaaattagcctggtgtgcttggcatgtgcctgtggtcccagctacccgggaggctgaggtgggagaattggcttgagcccaggaggcagaggttgcagtgcgccgagatcgcaccactgcattcaagcctgggtgacagagcaagaccttgtctcaaaaaagaaaacagtccatacatttaatgtaatgttttttctgttttgttttgttttcccctcaaaagtggttaataagtcgaaggtgcgtcgtgcaggcagtaggaaattagaatcaaggaaatacggtatttccttcctgtcttttgactgtgccctgttttctatgcactttcttctgatttctttgcatataaaatggtcactggaaaagaatcaaatttcttgaaaagtcaatctgaactccctccccactctcccctcacatcccaccctcacaaataccctccaggttaacgttgggttgcacatccttccagatttttctgaacactagttggattcctgctttcccctttattaatattaatactgtaagcactgtctgatgtcattttgtcactaaagggtccttaagatttttaatggctgtacaattttctttcctagggtcagagtcaaatttaaccatgtccattaagattttctgtgtagatggaatagaaatacaaatgggttttacaaaatcccatttatagaatgggagccatattatgtaaaattaaaaagtgctgggctcagtggctcacgcttataatcccagcattttgggatgcaaataaccatctcttggatttcccagcattttgggacgctgaggtgggcagattgcttgagctcaggagttccaagaccagcctgggcaacaggatgtaaccctgtttctaagagaaatacaaaattagctgggtgaggtggtgtgtgcctgtggaggctgaggtgggaggatcacctgagcccaggaagtcaggctgcagtttgctaagatcatgccactgcactccagcctgggtgacacactgagaacctgtctcaaaaaaaaaaaaaaaaaaaaaaaccaaaacagaaacaaaaaagaaagaaaaaaacgaggccaggtgcagtggctcatgcctgtaatcccagcactttgggaggctgaggcaggcagatcccttgtggtcgggagttcaccagcctggccagcatgatgaaaccccgtctctactaaaatacaaaaattagccaggtgtggtgctgcatgcctgtaacaggctgaggcaggagaatttcttgaatccaggaggcggaggttgcagtgagccaagatccacgtcattgccctccagcctgggcaacaagaaaggaacaggtgaaattaatacaaatcatgatttttttagcgctaaatttccaagatgttagcattttaatatccagctattataaaaactgagatagtctacatttatagtgctggtttcaaaatttcacttattttatatattttacatattacatattttacagatctcaattttgatgctaaatttgcaatgaaaatacttgatctgtattaactatatacagattcttgactaaatacagatgtagatggttaaacacaaattaactaaattcataaaacgtgcatttgagaaagcagactcatatgtctaggctagtcttaatgagccagttagttgacttacttgtcagtgttttaattaaccttaaatgcagaattcatttcctcaacagtttcaagttctcagtagccaccccctatgcctactgcccagcatgtcagatatcacagacatgggtatgccaggcttttagctttgaatcgagctttgctctctgagctgagtcatttttacatcctagttgtagccatttaaaaccttgtaaacatgtgttaaggatcctgggtgcaaggggttttgaatgagctcctgttgtgagttgcccatcaaggggccatatacattcagtgtggaccccctgtcatgccccaattgcagctggtacccaggcatagcatggtcttgtcctgggcccgcattctctctggaccctcctaccaagccacggctgcagtctaattacctttcacagagaacaagactcgaagacgcacagctgacgactcagccacctctgactactgccccgcacccaagcgcctcaagacaaattgctataacaacggcaaagaccgaggggatgaagatcagagccgaggtgattgttgggtacctgggatcatgggacagatgggaggaggacgctgcagatcaggaattgatctgtacccggctccctgacctcatctcatgccttcttcttttctcaatagaacaaatggcttcagatgttgccaacaacaagagcagcctggaaggtaacgttctctccctcccagtcatccccctcacaccctggctagggctctaggcctgccttgtcctggctcatccaccctgtcagggtttaacccagagctctgttccttaacctcaggccaaggcctatttctggaccctgcatcttagttgctagtttatggaatgagttgccaattgtgccccttaagagaaaggtacaggaagggtatggtgaggaacaagggaagctgggccattttggccgggagagccataacctaaaaccaagattactggtatcatgaaccttcccaaagaagaactgcaactaacaagcttttagtcacttgcctactgtcaggctaaatactctgcttgccctggctggggattgccactggattggatactctgatcagaatatacctcatggaatacagaatgtgtgaggatgaagtctcccttgcttccttaacccctagttactcaatgttgaataggaaaacaccacatccctgacccagagaacccggggaagagcttcggtttagaaatcctattccccaagactcactcccccatctggctaggtagggatgcttgtttgtgggttttataaaggtcctatctacccagccagggatgcaactccatgctgacctggtgatatgaagggaaggcagggttgcctactggttaaaggacctggattctgaaattacagccatttgctgtttacagggtgtgggcatgggcaagtcctatcatgagacaacaagccaattggagtcaccacaaaatccttagtgtcccagtatttaaagcttctcaaggattgtcacaccagggaggtccccctgctcagcgttctgcctgacatcatcctactggggcagccccttgcccatcttgatgttccccatctgtgaagtagggatgccacctggaagcattgttgagtggtagaagctgtgaggcatggcctgaggtgcaaagagtccttggcaagctgctggcctggagggaaatcttaggaactgagagaccccaggctttagcagctggtgtcagggcctcaactgccaaaagccacaaccctgtttttcttacagatggctgtttgtcttgtggcaggaaaaaccccgtgtccttccaccctctctttgagggggggctctgtcagacatgccgggtaagtcctcctactactgccctggaccttcctccccttgcctcctctaactcccctctccttcccaacagcacctgtgtggagactcagtgaagcccactcatcccagctgccttgcactctgcctctggggcaggatgggggacagctgtcacagaggccaatggcacgcaggtcacagccagttgtccttttaaaggacaccaagccaccagcagtgtgttctgcagctgtatcctagggcctccaccagcaagccggcagggcctgcccttctctggtctccgatttcactggtgtttctctctggctgccaggatcgcttccttgagctgttttacatgtatgatgacgatggctatcagtcttactgcactgtgtgctgcgagggccgagagctgctgctttgcagcaacacgagctgctgccggtgagcactgggccctgtggggtggatgtgggtgggcccccaaggctcctacgttcctgcagtctgcagacagctgtctgttgaatggaatcctaggcatgggaatagggagctaatttgccctggaagcagcacacagggtttatattttgtggtggctgtggttgtagcataattggagtagaactcatgtatagggaacggctcttttttttgagacagggtctccctgtgttgcccagggtgtacagtgacatgatcataggtcactgcagcctccaattcctgtgctcaagcaatcctcccacctcagcctcctgaacagcttgattataggcacatgccatcacacccagctagttattcttttttttttttgaggtggagtcttgctctgtcacccaggctggaatgcagtggcacaatcttggctcactgcaacctctgcctccagggtacaagcaattctcgtgcctcagcctcccaagtagctggaattataagtgcggagcaccacgcccagataatttttgtgtttttagtacagacagggtttcaccatgttgaccaggcttgtctcgaactcctgacctcaggtgatccacctgccccagcctctcaaatcccagcactcccaaagttctgggattacagtcatgatccaccgtgcctggcctattttttgtaataaataaaaagtgtaataaacgctgcctcggctggtctcaaatccctggggtcaagccattctcctacctcagcctcccaaagccccagagttgtaggtgtgagccaccacacccagctagaagtgctcttaataggccaagagcatgagggaaggggatgagtagggtgtcagggaaggctaattccctggtttgccagttggcctgtaatccaaagtgtccatggaatgaagtaggttgtcgggagagcatttctgatcagagagcctgtgggattaagggggttggggcatccaaggaagacgtcagggaagcccgtactgcacagggccccgcaggctatgctgttaagcagccgatcctaggtaagctttcaggagggggttggcatttccctgtggaagtggtaagggggtggcacaggagaccagctctgacaaaggcatcccttctccctgccactgggtccaggtgtttctgtgtggagtgcctggaggtgctggtgggcacaggcacagcggccgaggccaagcttcaggagccctggagctgttacatgtgtctcccgcagcgctgtcatggcgtcctgcggcgccggaaggactggaacgtgcgcctgcaggccttcttcaccagtgacacggggcttgaatatgtaagccacaggctcccgcctctaccaccacagatcccaggggcacagggtgttggaaagctctggaattctcagaaagagtaatagaagtaaagacacgttgtacctcttggagcctcaatggctgagagacctggcgaattgccagctcctctgcacggttttcagccgtgccagggttcattcactccctccttgccggcttctcagcgtatggattttcaggggcctgatgaagaaatggttgtatgtagccttctgagttagcagagctgagagggaaggaaacagtagaaatgaattttctagttcttagagggaagccctaggtcattcctgtctggggtgataccttttcatgtgtgcctctgtgcatacatatctggctcatgtccaaggataaattgaccattccttgccaaatgcaggctcgtgtggtacacacttgtctccccaatccccatcaagccttcagtgggctttttgcagtggctacggcaaggtttgaagccctctgagcagggtcagcctgcccctccctcagagcttgagtctttgccctgtgccttcaccaccatgacctccttccttacctggcaggaagcccccaagctgtaccctgccattcccgcagcccgaaggcggcccattcgagtcctgtcattgtttgatggcatcgcgacaggtgagttcggggaacacctggagacactgctatcgtgtcacaacagggtagccagggagtcagaaggcatggttaaggtgtctgacatcagtggcaagaaaggtccctggggattaccagccctgaaaaaaaccctgtctccttgtttctctccaccttctcaaccaccttgcagtcttggtcattgagttttatttatttattttttcgagatggagtctccctttgtcacccaggttagagtgcaatggcgtgatctgtgctcactgcagcccccatctccgaggttcaagtgattctctcctcagcctcccaagtagctgggattacaggtgctcaccaccacgcccagctaatttttatatttttcgtagagacggggtttctccacgttggtcaggttggtctcgaattcctgacctcaagtgatctgcccaccttggcatcccaaaccgctgggattagagacatgaaccaccgtgcctgggcagtcttggtcattttaaaaggacatacatcttagctgttacactttattttttatgtgcagttatcttgaacttgattttcattccacatgcataagtataattggagataaactagttaacaactactgctacctctggttttggttcccttcttttcctcctatatggagtttacacagccaatatgtgtggtgcgtgtacagcctttgctggattgaacgcatgtgatacagtcatgaggaactgttcattttaccatagcagggagtggaggaaatgagctgctgtgtgctcagcatcatttatgcttctgtgtctctctggcccccacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatgtgagggcagtctgtaccttgcgggcctcatctcttcctgtctttttccccagtcctccacaccctgaaacccacatgtaggccccatccctgagaccccagaaaaaaggattgaaatcctgtgggaatcttaagcattaggttagggtcagaagtggagttggtgaccaagcaagattctatttttttctggagacagtctccctctggagtgcagtggcatgatctcagctcactgtaacctctgcctcccgggtttaagcgattctcttgcctcagcctcccaaagtgctgggattacaggcacctgccaccatgctgggctaatttttatatttctagtagagttggggtttctccatgttggccaagctggtctcgaactcctgacctcaggtaatccacccccgccgtcagccttcctgggattacaggtgtgagccacctcgtccagccccacgcaagattctagaagtgggtccagctctctttccctctgtccacaccctcatcctgactctgtctctctctttcagattgaagaatggggcccatttgacttggtgattggcggaagcccatgcaacgatctctcaaatgtgaatccagccaggaaaggcctgtatggtgagcatccttctctctggcagtccctggagagcctatgtcacctgaccactggcccaggtgcagcagcctgagaaggagccacttgcttctggccaagttactggcagcatcaggggcctgttggtgctgcctacgctccatagtaaatcctcagcccacaagggaaataccctagtaaatagtgccctgctgctgcctgtgtccctgctgtcattcaggtggacatagactggtaggcatcaccctgaactgtcaggaggccattgggaacctgctggtctcagggaataaggtgggttgggctggaggtttcaaatgaaccctgcgctgtcatcttttctgagcacagagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggaggtgagggaatctggggacctgattgtcacagacagccagggcagggaaagcgctgctggcagtgatgattggtgggtgttgccaacattgggaatgactttcccgttcttggtctggctagatccaatagtgagggattcagtgggttctcttagtacatggaaaatattttttttgagacagggtcttgctctgtcacccaggctgaagtacagtggcattattacagctcactggagcctcaaacagctgggctcaggcaatcctcctacctcagcctcccaaatggctgggactacaggggcacaccaccgtgcccagccaatttttgtatttttggtagagacagggtcttggtatgttgcacaccctagtcttgaactcctgggctcaagcaatccgcccacctcccaacgtgttgggattggagatagagatgtgagccaccatcccctgccagtacaaggaaaataattgatctctaatctcagcccaactctttgaagtcagaaatgatgaaacaaaccatcatctgctgttaaggactcatgagatttgactcaattttttactctagagagttttctcatttttgatatgaaaactgctttagaccaggcacagtggctcatgtctgcagtcctagcattttgggaggctgaggttggaggatcacttgagcccacggtgtatcatattttgtaataatctggcgtatcccaggggataccgtctcagaatctgcaggtttgaccttatctctttagctaccattagcatagtatgagggcatttaccatgtcctctagccagcctcctgatggcagtaggtctttcctgttttggaggatccgtgcctcatccatagtcagggaatagccctgtcacctgcaaaggtctggttgacactgaaactctaataataggctcctaacagtaaccttctttctccccacagtgtaatccagtgatgattgatgccatcaaagtttctgctgctcacagggcccgatacttctggggcaacctacccgggatgaacaggtaacaaagggctcttagtgggtcaggtaacagccaagttaaatatgtgataacaagctctgacattcaagccttcctagaaagacctggctctgctgagaaatagttatacttggatttcagaccacctgtggtcgtgcgggttgatctctgttaagatgttcagcaagtacctgggaatctctgtaggagtcccactcttacctgttgtaagctgctgatggacctgatcctaaaagtcccacgtggctgggtgtggtggctcacgcctgtaatcccagcactttgggaggccgaggctggaggatcgcttgagcccaggagttctagactagcctgggcaacaaagtgagaccccgtctctacaaaaaaataaagaaaaatacaagtctcatgagctgtggccagactgtgtacctccttcctgccagggatctctcaagacttgagcttgttgatgctcctgcccttcacctctcctccccgttgatgtagtgacagccgtctggaaatggaagtagattgttgttaccggtgcctttcctcctgccctggagatgaagcgatcttggccaggctcatggtgaccaaccaggtggcagagctgctatgacaaacaatagcccaaagactatgtccctcagattctcatcaccaggagcatttcatattttgttatcgtatactaaaaacagtcttcttcagacactctgaaagccacaaagcagctttgctgaggattaattatttcttctatatgtggtttcaaggagaagaacttgctaattaagatgtaaaatgttatggtaatgtgacatcccagacttgcaaatgagttgagcttaaaacattctcctgtagaaggaggcatggaaacataataaccttctgccacttagtgaagtgtggacagaggtgagggtcctggggtagcttggaggatttttgttggtcaccttgcccgtgtacttggctaagcagccagtcttagggtgccatgtctgtgtctggaattaaatgggttaatgctttcaacatttgaactcccagtaggccaggcactgttacgctgttgccattttcatggttaaacacatcatgtcgatagtgacatgccgaagggggagggagagaagacaatgatttggggtttattgctggcggatggacattggaagggttgatggggaaggcttctcattctagcgaaggtcctaagtgaagggatggacccatgcagttattagagtactccaggtgggaagagggtctgggatgatgggaaacatccccagaccagctcagagcaccctaggtggggtggctgggagagaaggaccaagtaacttgggccttaatgtggtaccgctgaaatcactttggcatgggaagttacagatgagatgaattgtgctttggttcatggtagtttctgggtggattatagacaataacaggatggaggcgggaatggggagacaagtgaagggactagactgctcaaagaaggagagatgactgattatgatgttatgccccaggaggtgccatccatagagaacacagtgtgagtggtggcccctggggtttgcagcacagcaatcctgtgacttagcaaggacggatcagattcaacatatgtggagggtaggacatttgctgatgcattggatgtgtaggctatgaggtggaaagagcagtgagacctgatgcagatctgatgctgtgactaagctctgcaggcttataggatgggtgtgtcaggcatcatttaggggacagacccaagtcatctggcttgtttagagcttaatcttatagtcagcacaaggcggggctgtgcagtgtccttttcttctgggccctcagctcccctgggtccatgtcggaggtaggaatggggatagaggtagcatttgaagcctggcaggtgaggtcaaggaaatctatcagtctaggggaaatatgtgttgtgatttcctcagcccctcttgtaggcacggttcccgttctcatgtctgagttgtttggccttgacgttcctaacacaggttactatggccgtccctgcgtccagtcctcttgcaccagtttctgttctggagctgctcaactactttcagttctagcccttgcccttcttagtcatctgtttgcctctctctgcatttgcaaaataattttcaagggtgaaagttaaaagggtgcttagtctttttttttttttttttttttggaaccttaagagacagggtctgtctcccaggctggagtgcagtgttgtaatcataactcactgtagcctccaactcctaggcttaagcgatcctcctgctttgaactcccaaattgctgggattaagggtaggaaccactgcaggcggttgccattcacttttaaagcctcctgaggctgtatccccagcagtgagccaccaaaccgtgggtgtgatatgataattgtatcaggtagacccacaaaaatctattccaagctcctcactttaaaatagacaggaagcccaaaggggtagtgtgactcgctcaagctcagtcagtgagcagtgtggagctgggacctgaggtttctcctgccctaccccatgcagtgttcctgctcaatgggaacctgactttgaagtccaggcaggggagcattacctcctggatgctgggctgtcccctctagcccatccttggctttggcacacaggcttgtgctcatgccaggatcattttcatcatttatttgtagccaagttcactgccagggcacatctctgcaacatagaccctcactcccaccttgtgcctagcagaggaccctctatagctagtaagaagtaatgggttttggctgttcccaggcccgtgatagcatcaaagaatgataaactcgagctgcaggactgcttggaatacaataggatagccaaggtaagacgagctgtggccctctggaaaaatgcacttggtgacctccaagtggggacttgggagatgaccttggtgtttgattggttcctactcctccccccacgtgacttcctggtgttgggcttccctctcccacatgattgttctgtcccatcctcaaatacagagactaggagacattcgtgataagtaatcacgacgagaaaaggcaactagtctttttaattttagtactggatacataaagacaaagagtttcagctggccctctcagggagaaaggaatcattaatccttttgccaaaaaattaatttgctgtcaagtcatagaatatgaagacctccataaacctaaatctcaatgtttgcatcaagctaagatccattttctaaactccaattgagcattctctgtatctgggtggtttttacttttttacttaatcttgcttgatcaggaactctggtgtcttcttggccccccacgtgatctcgttcatggtcacttttttgtttatctcattttctctgaggctggtccttcctgttaacgtcttggcatttgtgggaagcacaaaatgttcttgtctctccaactctgcttttcgctccctgccctgccattcctctcccgcgcctgccctctcccttccatctttcccaggtacttttctctcccagccctgccactcttctgccgcacctgcgctctcccctccatctttcccaggtacttttgagccttgactccccaggtcccttcattctgtgctcactccatgatgtcattttgttctccagttaaagaaagtacagacaataaccaccaagtcgaactcgatcaaacaggggaaaaaccaacttttccctgttgtcatgaatggcaaagaagatgttttgtggtgcactgagctcgaaaggtgagcaaggctgcacttggagagggaaactgtgtagatcaaaacacaaatgggcagacatgggcaggtgcttaccttcattcttgatggcctcactgccctttggtgttactggggcgaggagtaataataccttttcatagttcgcccttatttcctgacaaaaatggcggagggggtgtggtggtggtgaggaatctgagacatgaggtcattaggccacaccatctgtctgttggctgcactgccgtgacatctgcctgtcccaacatgctgggacactacgatgtgtgagaagccagtgaaagaaaaccccacagacatgccattcttgaagacttcagtttgctcattctataaatgattccttcttagccacagtttatcctctccttccctttctttgggctaagtttgtctgttttgatgcaaataaccatctcttggatttcagttctgttctgttctgttttctttcactcctctattgtttgttcattttgcttatactattttttaaaaatcattatttgctatagtgattatggctttgaacattcctctttacatgtattctgtattctgaaggctttgatatagagtattttcattccagatatttcacttctataactcatttaatttcttctttgacttaccaacagttttctgagtataaaagtaacttctgattagtatttatgctgtagattattctgtatggacctaaacctaaaatggttggtgcagatggctgacattgtgtagacgctaagaccaagcaagacacaggcctgaggtatcacatctttggcatgtttctgaataacccacgcagccattggcctgttgggatgacttttagtattggattgtatacctgagtaacactgaggctcagcctctgtagcctctttccaggcctggtagaatcctatagaggaagcttttggtatatttgatgccatctgcctggagtcatctagcatggtccttcatccggcagctgggtttgaagagggaaggaaaactctggttgcctgagcctgtgatgactgaaaatctaggctgtttttgagtgaccttgttccttattaaggaaattgcttaacttctcccatcatagtgttttgaaaatggatacattgctggctggctgatttagtatgcatgcatttattctaggaaggtcctctgagcaccaactctatgccaagagtatggtgctaggcctgcacaaaacgggggactttcatttgtgagcaatttgtaagcaagtgttctgaattaagggctctgaatttaggtccttggggaccttactgatgggactgagggatggcgagggcagaaagagtgggacctggctggttgaggctgtcaacatcctggaggcacttctgacttgctgtcttttcactccggtacccccaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaggggtgtgctgagttctataatataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaattttttttgtaactggagccacgacgtaacaaatatggggaaaaaactgtgccttgtttcaacagtttttgctaatttttaggctgaaagatgacggatgcctagagtttaccttatgtttaattaaaatcagtatttgtcta

SEQ ID NO: 1681 - DNA, 46972 bp, Homo sapiens; identical to SEQ ID NO: 1680

SEQ ID NO: 1682 - DNA, 46972 bp, Homo sapiens; identical to SEQ ID NO: 1680

SEQ ID NO: 1683 - DNA, 46972 bp, Homo sapiens; identical to SEQ ID NO: 1680

SEQ ID NO: 1684 - DNA, 46972 bp, Homo sapiens; identical to SEQ ID NO: 1680

SEQ ID NO: 1685 - DNA, 29505 bp, Homo sapiens
gaagggagagagcaaacaaaggggtcaggagggaaaataatgcactggcttcctgagcccctgcagaggctgagcagggagagggggccagggccagaggggacagaggctggcggcagacgggccgggacaggcaggtcctaaatggcattgtttgaaggggccggctaattgcacagagcagtctgagcctgagaccccagccctggcctccccactctgtcctgggtgctggcgtctgagccttcgggacagcctgtccacatggaaccaagtcctgagcctccaagcttggtgagggggaggctatggggggcagcctgggtggggtacttgggcaagagcatcaccctaagaatgcatcctggggccttggcctgagaacacagagcccatggcgggggaacactgtccctctcatgtccctgcttccctttcaccccacccattctggcttctcccacaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggtggctgggcagtggggactggggtggtgtcaggcgctgacatagtgagcggtcactgcagacaactggaggctttggggagagtctctgacaacctccaccacaattccccgggagggaagagagctctagcaaggagggatgcagggtcgagcccttcacacctgcccgcagcccttggcctcccctttgggactctcatctcagctgggactctgagcgtgacacaagggtgatggttccctgtcctctgccagtcatgacaggggtggtctcagcatgggcccttggagagcccttctgcagtgggaccctctccccactcagagctgggctggggttgggagggggaggtctggagtgtgcttcctttccaccctgccctgagcagctccagccagctcacttgggatcccgccccagctgggttggaaagccctgcattgtcctctcagctgtgccatcccatggaacttcctgcgagcgtgaaagggttctatttctgcattgttccccacaatagccacactctacatgggagcacttgagaagcggctgacacagcaggcagtgaattgttcctggaaatgtagttagtggtccctggatgggcagcaccctgctggaaggaatcggagggctccccttggtaacttcagtgttggtttgggtcctgtcacgtgcctggcccagggctctgttgtcttaggaataaaatcagtggagaagatgaacgatactgacggactgagagcaaatccctgtggctgacaatagtgtaggggagatcccaggccacgccacggagaaaagcccctattagcaaggccgttccccagactggtgcctgcccccacaaaacagactcctggctgtttcctctacaggccgaagatcaagctcgcgactctccaagagggaggtgtccagtctgctaagctacacacaggtatggtctctgctctccctttttcagggctcagggactttgtctttggctttcatcacgtgggctgcctgaggcccataaaaactggcatctgcaaatgtatggagggttgccgagctagatgctttctgcatatatttggcattattttttcaatctggacgatcagttacattgctaaatctctaatatggtagtcccctcttatctgtcattttgctttccacgatttcagttgcttgcagtcaactgccgtctgaaagtattaaatggaaaatattaaatggtaaatcccagaaataaacaatttatacattttaaattgagtgccattctggtagcatgatggaatcttgcactgtcctgctccgtcctgcccaggatcagtcctgtctttgtccaacatctctatgcttaggtgctacctgcctgttagtcacttgtagccgtctccgtgatcagatcagttgcagtatcacagtggttgtgttcaagtagtgcttgttttacttaataacggctccaaagtgcaggagtgatgacgctggcaattcagttatgccaaagagaagccatgaagtgtttcctttaagtgaaaaagtgaaagttctcaaaaaggaaagaagaaatcatatgctgaagttgttagatctgtggtaagaacaaatcttccagccgtgaaatcatgaagaaggaaaaataaatgcatgctagttttactgttgcacctcaaactgcaaaagttatggccatgttgtgtgataagtgtgtagttaagatgggaaaggcattaaatttgtaggtggaagacatgaacagaaatatgttctgattgacagcagtgctttgtgccagggagcattgagcctatagcaagggatcccctgacaccaaaccatttacttcaagtaagggatggttacatagattcaagaataggtttctactgaaaactataaaaatgactggagaggctgcatttgccaatgaaaaacctgctgctacattttcagaagagttgaagttgattgagaaaggaaacaatccaaaactaagactgcagtgaaaccagactcctccagaagatgatgtctaatagaacctaccttcataaaagtgcaaaggaggaagacactaggtcataaaccatggaaggacagattaaccctgaatagagtacaagaagatattttgagagagaaaccacattcatatggcttttattaacagtatattgtaattgctctattttattattagttgttaatctgtgcctaatttataaattaaactttatcataggtatgtagatatagacaaaaacagagcacatatagggttccatcttccaaggtgtcaggcagccatggggggtcttgcatgtatcccccctggataaggggagactactgtatagcaaactgtctttttattcctggaatgagtccaacttggttatggtgcattttgaagttgattttattcatgtattcatgaatgaaatgggtatttttttttattcatttatttttgagatgaagtctgttgcccaggctggagtgcaatggcatgatctctgctcactgcaacttactgcctcccaggcccaagcgattcccctgcctcaggctcccgagtagctgggactacaggcaatggaccaccatacccagccaatttttttgtatttttagtagagatggggtttcaccatgttggccaggctggtctcgaactcctggcctcaagtgagccacctgtcccggcctcccaaagtgctgggattacaagtgtgagccaccatacctggcccattttatttctttaaatatatctatggttttgatgttaggattaggtgggctcaaggaattttttttacaagctggaagaaacttgtctaagcttattttaatgaatttcaaacaattatatcttctaagacttgctacattatcaagctttctacttcatttacttttccaaggttggatctttcccatcttgttttgtgttccttcctttactgacaccgtctgtttcctaattattcttagtagagtttgtcaattgggttggttttgctcagagccagtatcagtcataaaagtcctgggcaatgaaaactcaccctcagcttccattctcttggtggtggccaacctacttaggggactcagaaggtggggaacctaagccctgggaggaattagggcagctgcaggatcagaggctcagcactgctgttttgtttctggtagctagttaccagaaacagtaatgaaatctcttgcccacacgtttctttttgtttgtttgttttgttttgagacagagtctccagtctgtcgcccaggctggagtgcaatggcacgatctcggctcactgcaacctccgcctcccaggttcaagtaattttcctgcctcagcctcccaagtagctgggcttacaggcgtgcaccaccatgcccagctaacttttgtatttgtatttgtatttttttttttttttgagatggagtcttactcttgttccccaagctagagtgcggtggcgcgatctcggctcgctgtaacctccacctcccaggtttaagcggtactcctgcctcagcctcctgagtatgagtagctggaattacaggcacatgccaccatgccctgctaatttttgtatttttagtagagacagggtttcgccatattggccaggctggtcttgaactcctgacctcaggtgatccacccgcgtcggcctcccaaagtgttgggattacacgcctggcctaatttttgtattcttagtagagatggggtttcaccatcttggccaggctggtctggtgacctcaggtgacctcagtctgccccagactcccaaagtgttgggattacaggtatgagccaccacaccctgcatattatttgattcttgatgtaaccctgttgtgctatgagggaagtactgttattccaattttaaaatgagggaaatggactcaaagccacacagttggtgagtgaaggcaagtgcttaacactccagccagacctagctgctcgctgcttcagcttttgtgtttggcttatgctgggttttggtgtgaggtgtgaggcctgcacgaggaagccctgatgacatggtgcaggtttcatgccattgcttccggggcatctgtcgtggttggtctgtgtctgcacccatatgcagtgtgttgtgatgagtgacccggtctccctgccaggcacaggcgatcagtctttcatattgcaggtgccttgtttctttgacttgctgataccctggggtcttcatcatgttcatcatgtttccttataaaggacttgacaggcgatggcgacggggaagatggggatggctctgacaccccagtcatgccaaagctcttccgggaaaccaggactcgttcagaaagcccagctgtaagtagccacacctcgagccaaagcacttgtggccaacactctacatagcatacatagcatgctacatacatagcatagctccttaggggagcttttaagagaaagtgatgaaaaaatgttttgaaactagaaaatataagcaaggctcttggactattgttggagggttttcttttttctttttttttttctgagacggagtctcactgtgttgcccaggctggcgtgcaatggcgtgatcttagctcactgcaacaacctctgcctccttggtccaagtgattctcctgccacagcctcccaagtagctgggactacacgcacctaccaccacacccggccagtttttgtattttcagtagagatgaagttttaccatgttggccaggctggtctcgaactcttgacctcaggtgatccacccaccttggcctcctaaagtgctgggatttcaggtgtgagccactgcgcccggctggaaggttttctctatgtgccatttctttcaggtggtttttaagttctttcttgtaacactcttggaggtgcctaggggtgatagagtttgcagggtggatggctcagctgctaatgacctagggagtccaccatttctgtgggtggattttgtgcctcagagttttgaggtatggcaatgggaaggcagttattgcttatggtcacccagccctttagagaccagactgacagttactatcccaggtgtgggttacagtcttcccttcccaggatatggtctgtatcatcccctttgtggagatgagagaagattccagcaacttaactgaggttaaacatcaactcttctatgcataatttggacacaggttctgcaacaaccaaattcatgccatttttgacaatgaacatggagcctaaggaattctattccatcttgatgatctggtgccttcctgaacccagtaattggccttatgcttctttgacataaaagtttattttagagtgaacacgaatttttctttctttctttctttctttttttttctttttttttgagatgcagtctcactgtgttgcccaggctggagtgcagtgacgtgatctcagcacactgcaacctctgcctccctggtccaagtgattctcctgcctcagcctcctgagtagctgtgactacaggcacccaccaccatgcctggctaatttttgcatttttagtagagatggggtttcaccattttatccaggatgatcctgaatttctgattgcaagtgatctgcccgccttggcctcccaaagtgctgggatcacaggcatgagcgagccactgcgcttggccagatttttatttttcaatcccaattggcaggtgccatttcagctggccatgtctgtctgctgtgacaggcagagcaggacctgctgggaattgtcgggcatcctagctggccaccctaccacctctattccaagaactggggaattctggctggactcagtccagagtcccacctcatcacctgttcacttccagttgtcctgaagctggctaccaggtctccttggccacctgaaggcctaatccttctggccccgccagaccccaggcctccagtcacctaaggcccagtgagtgtcctctcttgcttctaggtccgaactcgaaataacaacagtgtctccagccgggagaggcacaggccttccccacgttccacccgaggccggcagggccgcaaccatgtggacgagtcccccgtggagttcccggctaccagggttggttccccagatgcccagacccctgcccgcagtctctaactgggagatatgcctcactcactgcactactggttgtggctggtagataatctgtgtccttttttcacactgcttttcaggttcttgctttttcttttctctcctgggtaagcttcccgtaagcctgttggcttctctcctggtctgatctcagatgacactctgttgggaatggaagctttccctgttgacttggttcttgctctaacttggaaacaaggtagaaaacactgacatccagaactgtcttctccctcatgtcttcttcacctgtcttgaggcaaccctagcgggtatggcaacatttcactctctgagagtccctcgtcattacccatcatttgtgcctttgtcatctttctgtctctgggacagttacaatgactttctccccccttaagggatacgtgttcctggaaaagtttcttcagcggtctctgttctctttaacttcagtctttcctctttctttttgcctaggagccatatgggggtgccgttggtctctggtcaccgacatcctttgctctggcccaaactatgtgtccttctgtccacagtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggtatggccgagaggggctcctgcccagggtgactgaggaccctgaacacggggaaaaaccagttacctgctactgttggtaacagagcgacaacagttgttagaagtttcgtaattgtaataattgacatgtttgaattctaagtatcttccatatgcaccacggacctttctttaccttaatcctctcccagacataagtcaaatgccagtatttaccacgtgaatactgtggtttttcccaacatgacatttatgtaaggactgcaactgcgtacgttatacatttcatgtacgcccgtgtgaagagaccaccaaacaggctttgtgtgagcaataaagctgtttatttcacctgagtgcaggtgggctgagtccaaaagagagtcagcgaagggagataggggtggggccattttctaagatttgggtaggtaaaggaaaattacagtcaaagggggtttgttctctggcgggcaggagtgggggtctcaaggtgctcagtgggggagttttttgagccacgaggagccaggaaaagggatttcacaaggtaatgtcatcacttaaggcaaggaccggccatttatacttcttttatggtggaatgtcatcagttaaggtggggcagggcatattcacttcttttgtgattcttcagttacttcaggccatctgggcttaaacgtgcaagtcacaggggatgcgtgcaagtcacaggggatgcgatggcttggcttgggctcagaggcctgacaatacatattgtgattctgttcatcagagtgcacatactgtatatattgtacgtatgatacctttgtagacttgcttttttcttctattaagaactagagttgcctgaggttcatgtctggataataaatccagtggtctgggtcatagcttaattaaccgattcaggttgtttatgcttattcaagcattgctgcacgaagactccttacacatgtatgtatttatgtgttgttaggatcccttttttctatgtccattattacattttactttgtatagaagggatctcactatggtgcccaggctagtctcaaactcctggcctcaagcgatcctcctatctcagcctcctgagtagctaggactacaggcgtgcaccaccaagcccagctactttataaattcttttgtggaaatggagtcttgctgtgttgcccgggctggtatccaactcctggcctcaagcgatccccctgcctcggtctcccaaagtactgagaattacaggcatgaaccacggtgtctggctacatcttgcattttatggcaagctttttgttgccctcagggacagtggagtggacaggacttggcccaggatggcctctcctcactgggatttcttcatgtgggttttcttccaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtgagtccggggaagggcaaggggttctgcaggcctgaggctgtgcctgcctgcctccctttgaagacaaaggcctgggattgtattctgcagatgtgtgagcctatgccttcacactgtctgggaggaaggacaaaacttcctgtgttaaccagctacagcagattccactcacacgggggacaaaagtgctagaaagttctggatccatgggcagttggattttatgttatttcttagatttatcttttgggggcagaatcatcagtgtggactctgaggggccaggagtggccacgtgagcaagtacccaaaagtgttcagtggagaagcctggaagagaccggaagcatggccgcggcctcttgtcatttagccctggggagagaaaggcatggagttgggtttagggtcacctggtatcagttgtgaaaagggtttttagtagaattgggtatttcagagtctcttgatgattgattctagccttttaaaatctttcttggtaatgacatttagctggggaagagctgtgttgggcataactaggctgttttgattcttacactctttcaacaaagatttttttgggggcggtgagaatggagtctcactctgttgcccagactggagtgcagtggtgcgatcttggctcactgcaacctccgcctcccaggttcaaacaattctcctgcctcagcctcctgagtggctggggttacaggcacctgccaccgcaccctgctaatatttgcatttttagtacagactgggtttcaccatgttggccaggctggtctccaactcctgacctcagatgatccacccgcctcggcctcccagtgctgggattacaggcgggagccaccacgcctggcctcaacaaagattttaatcagacagacctatcctgtgatggtctcttagaagtaaatgttagtcctaccctcagagccctgagagaggctaagttaggtgcctaaggtcattgggcaagttgcagcagaagcaagccaggcaggattgaaggaaggactgtacattcctgggattcagctcaagcagagattctgtttttcccaggaattgagctaccatggggccatttgccatgagctaattgaagtttcccaagggctacaataatatattgggtgtggagtctcctttgtaggagagcccctgcatgcagttgcctgctgtgaccagcagagggaggacaagtcctgggcccatgctggcagtgaggcagctgcttccagggatgggagagcagtaactcaagtgaaggaagatggattgtttgcaattgctttgccccatcgagacataaaatgcactttgcaagatagagtctgaggctaatacaatgcagtgtggggctgtcagcattaggggatgagatgacaatatgggacctgggtctggcctgggcaagtgcctgctcagcatgtgtacgctgtttgggttgtattggagctattgggcgctggaaccagcacttgtgttggagcggtttccccccaccagagccacagtgttttctccccagtggtggtcacacccccatataggaaatcaggcattccgtgataaaatggaggtttgcatgagtgtgagcactctttacggagactagaacattccctgtgtctttcagttcctttttttttttaagagatgaggtcctcactgtcacccaggctggagtgcagtggcactgtcttggctcactgcagcctcaatcacctgggctcaagcaatccttctgccttaacagagcagctgagactgcaggtgcacaccactgtgtttggctcttaaaagtttttgtagagatggggtcttgctgtgttgtccaggctagtcgaactcctgggctcaagcgatcctctcaactcccactcccaaagtgctgggaatataggcctgagccactacgtctggcctttcagttctgattagcatccctgaatggccattttctctctcactggcaactcagtcagttcatgcttggtccagggacttggtacatcaggagacttgtggaatatggattaaatcacaagaactaaagttaaataatcacaacaagtgaaaggtgctgtgtcgagcactgttttctaaacacattcattaggtgaactcattttaataaaagggtaaagagtaaacaattatcatgcttaggaaagaaggaatatgtgcaaaccctcaatgctggagcagccacagagaatattaggactgagcctcaggggtccacaccagggacacctgcttggaaaatgtatacaaacacagggttcgcctaattgccttcattcagagtatcctccttttccacagtggaagtgtcgtacctaacaaggttctggatatctgtgtgttgagactctgccatttctatttttctgcttttttctttccttcctttcaaatagatgtctgtggactttatccccaggaatggtctcttggttaaagtgtgtgaaaatcttctgcatctgatggacaacattgtgatagacatggcacctgggacacacctgtaggtggatgttgatgatgtctttctcttttaggtctctgcagacaaactggtggcactggggctgttcagccagcactttaatttggccaccttcaataagctcgtctcctatcgaaaagccatgtaccatgctctggaggtaacatgggatgagggaatgagggctaagccctgagagcagggatgaagcaagagacccacagaaacctagctcagtgttgccaagggtggtttggaggggacagggtggccagggaggaggtaaatgacaacataacatgatggccaccggattgggcctcccaacaaagggatttgagacatcccagctgccacttattgggaccactaactgaatcagaaggaaagagcacgggcagttaggggtgcaatattcgtatcagtgaatgtgcttttccagagacctcagagccttcttatgagggttggagttcacagcaagacagcagtggaggccagctgtcttctatctgtgggccgtcttatcccctatgaaccattataccctgtttctcccttcaccttgattttttccccccacctttgttcagcatttaagagccaacctcttctcattgctaaaggcttcattagacactgaaatccttggtccttcatgtaggacacaagttaatgtccccatctttagggagataaaacaagaaatctagtgccgccttatataagatacagaggagatgagatagtgctggctggggcttctatatcttggtggtagagttaattctgatatgtctgccttttgagtgggaggtgaccactgacattccctagggggaagagatcctatttggtgcctgcatgaaaagatttaaccacaaccccccttccgaggcctctccctgcacaggcccctccttcctctgtcacataccacagcccaggacagctgtctggctatgaaagggcccagtgtgaaggggaatgtaggccctggctgggggaatccctgggtgtggcctggcgagcacctcctccccacccccccattcatcacagactctgcctttgcagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccaggtgggaatgagtccccatggcagcacccgctgcctctgctggtgggaccacttcttgggagagtcagccacccctgctgccccacaccccacccagctttctagcagctggtctcaactctgaatgttggaaaaataggagcaggcatacgaaggctgtgccagctctatctggcttccccggccactttcttgctgatggtcacgtgcatataatttgtattgaatctgacatctgtcttgaagtcaggatgcagtgttgactagcaccttttttattaaaggaaaaaatagttaagctatgctcatttgagaaaattggaaagtgttaaagaagaatatgccacctgctaacattttgaccagtaccatatttctcccattataagataactctggtttctagaaatccaggacttgtcttacaatccatagatttaaaggccaggcctagtggctcatgcctgtaatcgcagcactctgggaggctgaggcgagtggatcacttgaggcgatcacctggacaacatggtgaaaaatagaaaaattagcctggtgtgcttggcatgtgcctgtggtcccagctacccgggaggctgaggtgggagaattggcttgagcccaggaggcagaggttgcagtgcgccgagatcgcaccactgcattcaagcctgggtgacagagcaagaccttgtctcaaaaaagaaaacagtccatacatttaatgtaatgttttttctgttttgttttgttttcccctcaaaagtggttaataagtcgaaggtgcgtcgtgcaggcagtaggaaattagaatcaaggaaatacggtatttccttcctgtcttttgactgtgccctgttttctatgcactttcttctgatttctttgcatataaaatggtcactggaaaagaatcaaatttcttgaaaagtcaatctgaactccctccccactctcccctcacatcccaccctcacaaataccctccaggttaacgttgggttgcacatccttccagatttttctgaacactagttggattcctgctttcccctttattaatattaatactgtaagcactgtctgatgtcattttgtcactaaagggtccttaagatttttaatggctgtacaattttctttcctagggtcagagtcaaatttaaccatgtccattaagattttctgtgtagatggaatagaaatacaaatgggttttacaaaatcccatttatagaatgggagccatattatgtaaaattaaaaagtgctgggctcagtggctcacgcttataatcccagcattttgggatgcaaataaccatctcttggatttcccagcattttgggacgctgaggtgggcagattgcttgagctcaggagttccaagaccagcctgggcaacaggatgtaaccctgtttctaagagaaatacaaaattagctgggtgaggtggtgtgtgcctgtggaggctgaggtgggaggatcacctgagcccaggaagtcaggctgcagtttgctaagatcatgccactgcactccagcctgggtgacacactgagaacctgtctcaaaaaaaaaaaaaaaaaaaaaaaccaaaacagaaacaaaaaagaaagaaaaaaacgaggccaggtgcagtggctcatgcctgtaatcccagcactttgggaggctgaggcaggcagatcccttgtggtcgggagttcaccagcctggccagcatgatgaaaccccgtctctactaaaatacaaaaattagccaggtgtggtgctgcatgcctgtaacaggctgaggcaggagaatttcttgaatccaggaggcggaggttgcagtgagccaagatccacgtcattgccctccagcctgggcaacaagaaaggaacaggtgaaattaatacaaatcatgatttttttagcgctaaatttccaagatgttagcattttaatatccagctattataaaaactgagatagtctacatttatagtgctggtttcaaaatttcacttattttatatattttacatattacatattttacagatctcaattttgatgctaaatttgcaatgaaaatacttgatctgtattaactatatacagattcttgactaaatacagatgtagatggttaaacacaaattaactaaattcataaaacgtgcatttgagaaagcagactcatatgtctaggctagtcttaatgagccagttagttgacttacttgtcagtgttttaattaaccttaaatgcagaattcatttcctcaacagtttcaagttctcagtagccaccccctatgcctactgcccagcatgtcagatatcacagacatgggtatgccaggcttttagctttgaatcgagctttgctctctgagctgagtcatttttacatcctagttgtagccatttaaaaccttgtaaacatgtgttaaggatcctgggtgcaaggggttttgaatgagctcctgttgtgagttgcccatcaaggggccatatacattcagtgtggaccccctgtcatgccccaattgcagctggtacccaggcatagcatggtcttgtcctgggcccgcattctctctggaccctcctaccaagccacggctgcagtctaattacctttcacagagaacaagactcgaagacgcacagctgacgactcagccacctctgactactgccccgcacccaagcgcctcaagacaaattgctataacaacggcaaagaccgaggggatgaagatcagagccgaggtgattgttgggtacctgggatcatgggacagatgggaggaggacgctgcagatcaggaattgatctgtacccggctccctgacctcatctcatgccttcttcttttctcaatagaacaaatggcttcagatgttgccaacaacaagagcagcctggaaggtaacgttctctccctcccagtcatccccctcacaccctggctagggctctaggcctgccttgtcctggctcatccaccctgtcagggtttaacccagagctctgttccttaacctcaggccaaggcctatttctggaccctgcatcttagttgctagtttatggaatgagttgccaattgtgccccttaagagaaaggtacaggaagggtatggtgaggaacaagggaagctgggccattttggccgggagagccataacctaaaaccaagattactggtatcatgaaccttcccaaagaagaactgcaactaacaagcttttagtcacttgcctactgtcaggctaaatactctgcttgccctggctggggattgccactggattggatactctgatcagaatatacctcatggaatacagaatgtgtgaggatgaagtctcccttgcttccttaacccctagttactcaatgttgaataggaaaacaccacatccctgacccagagaacccggggaagagcttcggtttagaaatcctattccccaagactcactcccccatctggctaggtagggatgcttgtttgtgggttttataaaggtcctatctacccagccagggatgcaactccatgctgacctggtgatatgaagggaaggcagggttgcctactggttaaaggacctggattctgaaattacagccatttgctgtttacagggtgtgggcatgggcaagtcctatcatgagacaacaagccaattggagtcaccacaaaatccttagtgtcccagtatttaaagcttctcaaggattgtcacaccagggaggtccccctgctcagcgttctgcctgacatcatcctactggggcagccccttgcccatcttgatgttccccatctgtgaagtagggatgccacctggaagcattgttgagtggtagaagctgtgaggcatggcctgaggtgcaaagagtccttggcaagctgctggcctggagggaaatcttaggaactgagagaccccaggctttagcagctggtgtcagggcctcaactgccaaaagccacaaccctgtttttcttacagatggctgtttgtcttgtggcaggaaaaaccccgtgtccttccaccctctctttgagggggggctctgtcagacatgccgggtaagtcctcctactactgccctggaccttcctccccttgcctcctctaactcccctctccttcccaacagcacctgtgtggagactcagtgaagcccactcatcccagctgccttgcactctgcctctggggcaggatgggggacagctgtcacagaggccaatggcacgcaggtcacagccagttgtccttttaaaggacaccaagccaccagcagtgtgttctgcagctgtatcctagggcctccaccagcaagccggcagggcctgcccttctctggtctccgatttcactggtgtttctctctggctgccaggatcgcttccttgagctgttttacatgtatgatgacgatggctatcagtcttactgcactgtgtgctgcgagggccgagagctgctgctttgcagcaacacgagctgctgccggtgagcactgggccctgtggggtggatgtgggtgggcccccaaggctcctacgttcctgcagtctgcagacagctgtctgttgaatggaatcctaggcatgggaatagggagctaatttgccctggaagcagcacacagggtttatattttgtggtggctgtggttgtagcataattggagtagaactcatgtatagggaacggctcttttttttgagacagggtctccctgtgttgcccagggtgtacagtgacatgatcataggtcactgcagcctccaattcctgtgctcaagcaatcctcccacctcagcctcctgaacagcttgattataggcacatgccatcacacccagctagttattcttttttttttttgaggtggagtcttgctctgtcacccaggctggaatgcagtggcacaatcttggctcactgcaacctctgcctccagggtacaagcaattctcgtgcctcagcctcccaagtagctggaattataagtgcggagcaccacgcccagataatttttgtgtttttagtacagacagggtttcaccatgttgaccaggcttgtctcgaactcctgacctcaggtgatccacctgccccagcctctcaaatcccagcactcccaaagttctgggattacagtcatgatccaccgtgcctggcctattttttgtaataaataaaaagtgtaataaacgctgcctcggctggtctcaaatccctggggtcaagccattctcctacctcagcctcccaaagccccagagttgtaggtgtgagccaccacacccagctagaagtgctcttaataggccaagagcatgagggaaggggatgagtagggtgtcagggaaggctaattccctggtttgccagttggcctgtaatccaaagtgtccatggaatgaagtaggttgtcgggagagcatttctgatcagagagcctgtgggattaagggggttggggcatccaaggaagacgtcagggaagcccgtactgcacagggccccgcaggctatgctgttaagcagccgatcctaggtaagctttcaggagggggttggcatttccctgtggaagtggtaagggggtggcacaggagaccagctctgacaaaggcatcccttctccctgccactgggtccaggtgtttctgtgtggagtgcctggaggtgctggtgggcacaggcacagcggccgaggccaagcttcaggagccctggagctgttacatgtgtctcccgcagcgctgtcatggcgtcctgcggcgccggaaggactggaacgtgcgcctgcaggccttcttcaccagtgacacggggcttgaatatgtaagccacaggctcccgcctctaccaccacagatcccaggggcacagggtgttggaaagctctggaattctcagaaagagtaatagaagtaaagacacgttgtacctcttggagcctcaatggctgagagacctggcgaattgccagctcctctgcacggttttcagccgtgccagggttcattcactccctccttgccggcttctcagcgtatggattttcaggggcctgatgaagaaatggttgtatgtagccttctgagttagcagagctgagagggaaggaaacagtagaaatgaattttctagttcttagagggaagccctaggtcattcctgtctggggtgataccttttcatgtgtgcctctgtgcatacatatctggctcatgtccaaggataaattgaccattccttgccaaatgcaggctcgtgtggtacacacttgtctccccaatccccatcaagccttcagtgggctttttgcagtggctacggcaaggtttgaagccctctgagcagggtcagcctgcccctccctcagagcttgagtctttgccctgtgccttcaccaccatgacctccttccttacctggcaggaagcccccaagctgtaccctgccattcccgcagcccgaaggcggcccattcgagtcctgtcattgtttgatggcatcgcgacaggtgagttcggggaacacctggagacactgctatcgtgtcacaacagggtagccagggagtcagaaggcatggttaaggtgtctgacatcagtggcaagaaaggtccctggggattaccagccctgaaaaaaaccctgtctccttgtttctctccaccttctcaaccaccttgcagtcttggtcattgagttttatttatttattttttcgagatggagtctccctttgtcacccaggttagagtgcaatggcgtgatctgtgctcactgcagcccccatctccgaggttcaagtgattctctcctcagcctcccaagtagctgggattacaggtgctcaccaccacgcccagctaatttttatatttttcgtagagacggggtttctccacgttggtcaggttggtctcgaattcctgacctcaagtgatctgcccaccttggcatcccaaaccgctgggattagagacatgaaccaccgtgcctgggcagtcttggtcattttaaaaggacatacatcttagctgttacactttattttttatgtgcagttatcttgaacttgattttcattccacatgcataagtataattggagataaactagttaacaactactgctacctctggttttggttcccttcttttcctcctatatggagtttacacagccaatatgtgtggtgcgtgtacagcctttgctggattgaacgcatgtgatacagtcatgaggaactgttcattttaccatagcagggagtggaggaaatgagctgctgtgtgctcagcatcatttatgcttctgtgtctctctggcccccacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatgtgagggcagtctgtaccttgcgggcctcatctcttcctgtctttttccccagtcctccacaccctgaaacccacatgtaggccccatccctgagaccccagaaaaaaggattgaaatcctgtgggaatcttaagcattaggttagggtcagaagtggagttggtgaccaagcaagattctatttttttctggagacagtctccctctggagtgcagtggcatgatctcagctcactgtaacctctgcctcccgggtttaagcgattctcttgcctcagcctcccaaagtgctgggattacaggcacctgccaccatgctgggctaatttttatatttctagtagagttggggtttctccatgttggccaagctggtctcgaactcctgacctcaggtaatccacccccgccgtcagccttcctgggattacaggtgtgagccacctcgtccagccccacgcaagattctagaagtgggtccagctctctttccctctgtccacaccctcatcctgactctgtctctctctttcagattgaagaatggggcccatttgacttggtgattggcggaagcccatgcaacgatctctcaaatgtgaatccagccaggaaaggcctgtatggtgagcatccttctctctggcagtccctggagagcctatgtcacctgaccactggcccaggtgcagcagcctgagaaggagccacttgcttctggccaagttactggcagcatcaggggcctgttggtgctgcctacgctccatagtaaatcctcagcccacaagggaaataccctagtaaatagtgccctgctgctgcctgtgtccctgctgtcattcaggtggacatagactggtaggcatcaccctgaactgtcaggaggccattgggaacctgctggtctcagggaataaggtgggttgggctggaggtttcaaatgaaccctgcgctgtcatcttttctgagcacagagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggaggtgagggaatctggggacctgattgtcacagacagccagggcagggaaagcgctgctggcagtgatgattggtgggtgttgccaacattgggaatgactttcccgttcttggtctggctagatccaatagtgagggattcagtgggttctcttagtacatggaaaatattttttttgagacagggtcttgctctgtcacccaggctgaagtacagtggcattattacagctcactggagcctcaaacagctgggctcaggcaatcctcctacctcagcctcccaaatggctgggactacaggggcacaccaccgtgcccagccaatttttgtatttttggtagagacagggtcttggtatgttgcacaccctagtcttgaactcctgggctcaagcaatccgcccacctcccaacgtgttgggattggagatagagatgtgagccaccatcccctgccagtacaaggaaaataattgatctctaatctcagcccaactctttgaagtcagaaatgatgaaacaaaccatcatctgctgttaaggactcatgagatttgactcaattttttactctagagagttttctcatttttgatatgaaaactgctttagaccaggcacagtggctcatgtctgcagtcctagcattttgggaggctgaggttggaggatcacttgagcccacggtgtatcatattttgtaataatctggcgtatcccaggggataccgtctcagaatctgcaggtttgaccttatctctttagctaccattagcatagtatgagggcatttaccatgtcctctagccagcctcctgatggcagtaggtctttcctgttttggaggatccgtgcctcatccatagtcagggaatagccctgtcacctgcaaaggtctggttgacactgaaactctaataataggctcctaacagtaaccttctttctccccacagtgtaatccagtgatgattgatgccatcaaagtttctgctgctcacagggcccgatacttctggggcaacctacccgggatgaacaggtaacaaagggctcttagtgggtcaggtaacagccaagttaaatatgtgataacaagctctgacattcaagccttcctagaaagacctggctctgctgagaaatagttatacttggatttcagaccacctgtggtcgtgcgggttgatctctgttaagatgttcagcaagtacctgggaatctctgtaggagtcccactcttacctgttgtaagctgctgatggacctgatcctaaaagtcccacgtggctgggtgtggtggctcacgcctgtaatcccagcactttgggaggccgaggctggaggatcgcttgagcccaggagttctagactagcctgggcaacaaagtgagaccccgtctctacaaaaaaataaagaaaaatacaagtctcatgagctgtggccagactgtgtacctccttcctgccagggatctctcaagacttgagcttgttgatgctcctgcccttcacctctcctccccgttgatgtagtgacagccgtctggaaatggaagtagattgttgttaccggtgcctttcctcctgccctggagatgaagcgatcttggccaggctcatggtgaccaaccaggtggcagagctgctatgacaaacaatagcccaaagactatgtccctcagattctcatcaccaggagcatttcatattttgttatcgtatactaaaaacagtcttcttcagacactctgaaagccacaaagcagctttgctgaggattaattatttcttctatatgtggtttcaaggagaagaacttgctaattaagatgtaaaatgttatggtaatgtgacatcccagacttgcaaatgagttgagcttaaaacattctcctgtagaaggaggcatggaaacataataaccttctgccacttagtgaagtgtggacagaggtgagggtcctggggtagcttggaggatttttgttggtcaccttgcccgtgtacttggctaagcagccagtcttagggtgccatgtctgtgtctggaattaaatgggttaatgctttcaacatttgaactcccagtaggccaggcactgttacgctgttgccattttcatggttaaacacatcatgtcgatagtgacatgccgaagggggagggagagaagacaatgatttggggtttattgctggcggatggacattggaagggttgatggggaaggcttctcattctagcgaaggtcctaagtgaagggatggacccatgcagttattagagtactccaggtgggaagagggtctgggatgatgggaaacatccccagaccagctcagagcaccctaggtggggtggctgggagagaaggaccaagtaacttgggccttaatgtggtaccgctgaaatcactttggcatgggaagttacagatgagatgaattgtgctttggttcatggtagtttctgggtggattatagacaataacaggatggaggcgggaatggggagacaagtgaagggactagactgctcaaagaaggagagatgactgattatgatgttatgccccaggaggtgccatccatagagaacacagtgtgagtggtggcccctggggtttgcagcacagcaatcctgtgacttagcaaggacggatcagattcaacatatgtggagggtaggacatttgctgatgcattggatgtgtaggctatgaggtggaaagagcagtgagacctgatgcagatctgatgctgtgactaagctctgcaggcttataggatgggtgtgtcaggcatcatttaggggacagacccaagtcatctggcttgtttagagcttaatcttatagtcagcacaaggcggggctgtgcagtgtccttttcttctgggccctcagctcccctgggtccatgtcggaggtaggaatggggatagaggtagcatttgaagcctggcaggtgaggtcaaggaaatctatcagtctaggggaaatatgtgttgtgatttcctcagcccctcttgtaggcacggttcccgttctcatgtctgagttgtttggccttgacgttcctaacacaggttactatggccgtccctgcgtccagtcctcttgcaccagtttctgttctggagctgctcaactactttcagttctagcccttgcccttcttagtcatctgtttgcctctctctgcatttgcaaaataattttcaagggtgaaagttaaaagggtgcttagtctttttttttttttttttttttggaaccttaagagacagggtctgtctcccaggctggagtgcagtgttgtaatcataactcactgtagcctccaactcctaggcttaagcgatcctcctgctttgaactcccaaattgctgggattaagggtaggaaccactgcaggcggttgccattcacttttaaagcctcctgaggctgtatccccagcagtgagccaccaaaccgtgggtgtgatatgataattgtatcaggtagacccacaaaaatctattccaagctcctcactttaaaatagacaggaagcccaaaggggtagtgtgactcgctcaagctcagtcagtgagcagtgtggagctgggacctgaggtttctcctgccctaccccatgcagtgttcctgctcaatgggaacctgactttgaagtccaggcaggggagcattacctcctggatgctgggctgtcccctctagcccatccttggctttggcacacaggcttgtgctcatgccaggatcattttcatcatttatttgtagccaagttcactgccagggcacatctctgcaacatagaccctcactcccaccttgtgcctagcagaggaccctctatagctagtaagaagtaatgggttttggctgttcccaggcccgtgatagcatcaaagaatgataaactcgagctgcaggactgcttggaatacaataggatagccaaggtaagacgagctgtggccctctggaaaaatgcacttggtgacctccaagtggggacttgggagatgaccttggtgtttgattggttcctactcctccccccacgtgacttcctggtgttgggcttccctctcccacatgattgttctgtcccatcctcaaatacagagactaggagacattcgtgataagtaatcacgacgagaaaaggcaactagtctttttaattttagtactggatacataaagacaaagagtttcagctggccctctcagggagaaaggaatcattaatccttttgccaaaaaattaatttgctgtcaagtcatagaatatgaagacctccataaacctaaatctcaatgtttgcatcaagctaagatccattttctaaactccaattgagcattctctgtatctgggtggtttttacttttttacttaatcttgcttgatcaggaactctggtgtcttcttggccccccacgtgatctcgttcatggtcacttttttgtttatctcattttctctgaggctggtccttcctgttaacgtcttggcatttgtgggaagcacaaaatgttcttgtctctccaactctgcttttcgctccctgccctgccattcctctcccgcgcctgccctctcccttccatctttcccaggtacttttctctcccagccctgccactcttctgccgcacctgcgctctcccctccatctttcccaggtacttttgagccttgactccccaggtcccttcattctgtgctcactccatgatgtcattttgttctccagttaaagaaagtacagacaataaccaccaagtcgaactcgatcaaacaggggaaaaaccaacttttccctgttgtcatgaatggcaaagaagatgttttgtggtgcactgagctcgaaaggtgagcaaggctgcacttggagagggaaactgtgtagatcaaaacacaaatgggcagacatgggcaggtgcttaccttcattcttgatggcctcactgccctttggtgttactggggcgaggagtaataataccttttcatagttcgcccttatttcctgacaaaaatggcggagggggtgtggtggtggtgaggaatctgagacatgaggtcattaggccacaccatctgtctgttggctgcactgccgtgacatctgcctgtcccaacatgctgggacactacgatgtgtgagaagccagtgaaagaaaaccccacagacatgccattcttgaagacttcagtttgctcattctataaatgattccttcttagccacagtttatcctctccttccctttctttgggctaagtttgtctgttttgatgcaaataaccatctcttggatttcagttctgttctgttctgttttctttcactcctctattgtttgttcattttgcttatactattttttaaaaatcattatttgctatagtgattatggctttgaacattcctctttacatgtattctgtattctgaaggctttgatatagagtattttcattccagatatttcacttctataactcatttaatttcttctttgacttaccaacagttttctgagtataaaagtaacttctgattagtatttatgctgtagattattctgtatggacctaaacctaaaatggttggtgcagatggctgacattgtgtagacgctaagaccaagcaagacacaggcctgaggtatcacatctttggcatgtttctgaataacccacgcagccattggcctgttgggatgacttttagtattggattgtatacctgagtaacactgaggctcagcctctgtagcctctttccaggcctggtagaatcctatagaggaagcttttggtatatttgatgccatctgcctggagtcatctagcatggtccttcatccggcagctgggtttgaagagggaaggaaaactctggttgcctgagcctgtgatgactgaaaatctaggctgtttttgagtgaccttgttccttattaaggaaattgcttaacttctcccatcatagtgttttgaaaatggatacattgctggctggctgatttagtatgcatgcatttattctaggaaggtcctctgagcaccaactctatgccaagagtatggtgctaggcctgcacaaaacgggggactttcatttgtgagcaatttgtaagcaagtgttctgaattaagggctctgaatttaggtccttggggaccttactgatgggactgagggatggcgagggcagaaagagtgggacctggctggttgaggctgtcaacatcctggaggcacttctgacttgctgtcttttcactccggtacccccaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaggggtgtgctgagttctataatataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaattttttttgtaactggagccacgacgtaacaaatatggggaaaaaactgtgccttgtttcaacagtttttgctaatttttaggctgaaagatgacggatgcctagagtttaccttatgtttaattaaaatcagtatttgtcta

SEQ ID NO: 1686 - DNA, 446136 bp, Homo sapiens
aggaaggaagtggggccctgcggcgcccagccaccccctgacggcttccccacgggaggacgcgaggccccggcccagccatggccccctggcgcaaagctgacaaggagcggcacggcgtgggtaggtgcgggccccagggcgcggcagggagcgggacaggtggcgggagagccgcgagcaggaggatgctgcggggccggcggcgcggggtgggcagggcgcgctgcctgcaggtcagagggcgcagcctgcggcggggcctcggggcgggaaagccgaggctcggggagaggacggcgggaccccaccccgcaggctaagcacagccctcgccctctcgcctgctgagggaaccttagacatttccgagatagggtcaagacctgcgcttgacaactcagttcttcgcgccaaactcggcgtccccaggagtgccccagctcgccgcgtgggagacttggccttgtagagggagctccactctcccctggctcagccttggcctgcccaccatgcatacttccaccccctccaaagcgacacccatttgcctgcttcccctgtctgttcctcctgggtcagatgactcctgatttggcagggcatccagagggcagctcaagcttgggggaatggggctggacggtggggttctctactcagccccccagagcctctggggaaaaaggctcccgccaggtggtcttagggtaaccaagaagctagcttcgtcagcctcagccatctaaactcccagaagcctctgcctggagctcaggggcggaagtggtggctgggggaagggaggcctcaggtgctgctactctaagtgtcatccgtggtgcaatctccatggactcactgtggtttttaaacttaaatatcaaataaaaagtcactctggagcttcctacacaggcggataccagacaccatctcagagataaatatttcgcaggtgaggcattggaagacccaaacacccagagggatttgatgcagggggtccccaggccactgtttgggaaacactgccctggagagatcagcagttatccactcaattactgggtaccgggcactgtggggtcattttgatataaatggtccccatccagagaacaaataataattcatatctcaaggggcagttacaaagtaaggaaggatacagcttctgcccttgaggagttatgtgtaaggctagaggcttggactgggaagtcagaactgagttcaaatcagggtctgtttcctcgtctataaagtggaagtaataataatgcaggtctcatgagactcttgtgaggattgaatggggttatgcatggaaagcatttagtagtgtgctggctcaataagagttagtgattcaggtccagggtcttacctagcagcttcagaaccaagagacaccagcaccaagatgcaccctaatgccagattcaggacagtcatgccttatgagactgtagtatttcatggtttgcaagaccaaaggtcatgcaatctctgtctgacttcagaacccccatgtgaggcagtgtattattcccaacttacaggtgaagtaaccaagtttacatcacttggaagcaatggagcgggccttaaattcaattgtcttcagaccctaggccctttgcatggcaccagaaaagcatctagaaggggaacatcatgggtaaaggcagggaactggcatccctgaagtgtgtgggtcaaacaataagtagtctgttttggttttagtattgcttttagtgttaaaaaaatttcagaggtagattatggctagattgtgaagggctttgagtgccaaccttcaaagtttggatttccttctctgagcactggaggttttgagcagtgtcatctggaagaagttaaatagttaattaggataggagtggggaattggacttagaatagaaggaaaatgggtaacagttttacctgtctgctgactgcctggttaatctagcaggaggtcacttataatcaacattgcctgttaacctttactaggttaatccactctgcctgaggctcttgtcagtgaagagagctttctccttgcaggagagaggaaagggcagaaaagaaggaggtagaaagagaaactaacagtatcagttagggttaagtgtgacaaagggtgacagaaaacctccaaaattgtggcctaaccaagctgcaagtttatttctgtctctcatggaaagctcagaaatggtctgggaagaggtggtaaggtggctcattctatatctcacactgtatccttggcatgtgacttctgcctcctgagccacataggctgcttaagcttcggtgatcaggtccaccttccagccagcaaaaaggatgcagggaaaaagaaggtcatggcttttccctttaaagacattttcctgaaggcacacttgacatttcttcttacattacatcctattggcaaaaatgtaatcacatgactgactatagctgcaagggaagctaggaaatgtagtctgtaatgtaggcagccatgtacccagctaaaaattaggagttctcttcataagtaaggagaggaggaagaatattgaggatgatatattagtttgctcaggctgctgtagcaaaataccaccaactgggtggcttaaacaacagaaatgtattttctcacagttctcgaggctggaagtctaagatcaaagcaccaccagggttggcttgtctcatggcctatctccatggtttgcagatggctgtcttgctgcctcttcattgctttctgtgcaggcacacccttgctgtctcttcctcctgtcatgagaacaccggtcatattggattagcatcccaccctaaaggactcattttaacttaataattcctttatctccgaatatgcacttatctccaaataggagtaccttctgagacactgatgactgggacttcagcataagaattttggtggggacacaaattcatgacaaataatctgtggtctctggcatggtattttgggactataaagagggcttcaaggcaggagtcctgagataaagggtgagggtagaaaagagttttgtttaccctgaagctgagcctgccaggcagatttgtgtgggactctagttattcttgtaggggagggaaaagcttctttctgctactgcatcttgggttttctgtaaattagactaacaaaagactgatgaacaagagaaaacaaacaagtttattagcatgtacatcctgcttacatatggagtactcaaagggttggtttgaacttgagcttatacagcatcttagcaaaggtacaataaaggtttagagaagtagcaagtcaaaggagggttttaggcctccaagggcagcaaactgtgggaagggaaatatatggggaatctaatggaagataaagggttatttgtgcaggttcatcttggagccaactttctgtcttcttcattgccataaaacttccctgggagaggggatttatgacagtccttatttcttaggagtttcttcagataaatatccaggaaagcttcttgctgtacctgttgattcttatttgcatccagctcaaaataatcaatatgccctatggaagtggcatattttgatcagaaacctgttctgtatgcagcttctctctagctatggttttacacccatgtgtggtgttgaggaatatttgttggtttcttctgagggctgagggaaaatctgttccaggtgtctcccccagctgccagtggtttgctggcaatcctcggcattccttggcttacaaaagcgttgccttgatcgctgcctccaacttcacgtggtattctcattgtgtgcgtgtctgtctccgcatttctccttttaaaaaggacatccagtcatattagattagggcccaccctagtgacttcagttaaatgtgattacctctgtaaagactgtctccaaataagatcacattctgaggtactgggagttgagactccaacgtctctttttttggagggggagggcacaattcaaaccataacaggctctgcagaagcagagaagggatctttttcacagcttggttggggaatatggaggaatccataaccagctcgtggttcagggatgtgggtgatgctgtcgcagcccaggaccctggacagagctgatccatgcacactgacagatttggcgtgggcaatgtgtgctggtgtcatttgcacatggatttttgttgaagggaacaaaatctagtcaaaccagttcaacgaaaatgtgtgtggtgtgtatctgtgggagagcagggagaagtggtgtattttagggtcagaggaatcacatggaaatccaggaaacaggaggagccaggcctcggaaagggcttgaactgaggcaaccctggaaacctctgcctctcctctcatggcttctcagcttctctgagcatgccaactgtggtctcctttctctccccaccacctccctctgattgcattgttccttcgtaactgatactctaataccacagtggtggccccagcatgcaacccacccatctctgcacaaccttgcagttcaagcatccactgaatcttctctgtgtttatttgttcaaagtcccaacagaagagagtggtagcttgatttccctttgtaagaaagacaacccaagtcagagttcattgccagcctaataatgggcctcactctggtgagggtgctgcccctggcaggtctaattctctgtgactatgaggtggggtcacatggcttgctactcctctagcaggagccatgggtggggactgattctttgagttggaagcatgagtggaaactgcatcccaaacatacccaggagcagaacttcactacagagggaccaattatactgcttttattgccaaatgcaacagttgaaaggatagagagcatcactcactcattaacttgtccatttgttcactcattcattcttcattaacttcttaaatatttgttgggtgtgtgtgccaggcattatgctagtcactgagattactagaattaggccaatatggcccctatccttctggagcctgtagtctaatagggaagatgaaaaagaatttcatgaataaatcagtaaccatataattacaaattgtgatatgtgctgttttaatatgagtgagaatattaggaatggtcttgaattagatgatgtgagaaggcctctcaggagcaatggggaaaagaatcccaaagccaatgcttggagggatattaatacatgcatctttgctacagtggctgactgtacctttggattggtccccagaaattagtctggtgaaacaaaaatacatggattagacatctaattccttcctgccaccaattcttaggtgccggggcttcctactttcagatgcttcagcaatttgggtctgtttaggagtgcctgctgggctggctgtttgagttcatgtaaggagattgtcctaatccgtagttatatgggcacctcattaggcagtggacatcttgcccctgaccataatgtttgcatttgaatgagccttgaagacagattgtgttttctaagctctgcttcctcctgagatcagcatcctattgctgctgtcttttgagagatgaaatgtagtcaccatactgctccgctaatttctggacctttggatttgttttttttttcaatagtcaattacacatgggtgccacagtctgtgctctgcagcatatgttctgcaaatggggaatgacagtgcttatcaccacgcaactccagaggagtctgggcggagacaccacaaatgttccctttaataggcactttctcctttcttcccccttcccttaattggtgtgaattgaaaaacagtcaggctgagtttgtgagctgcttaagtcttattctgttgttagttctccttggagaaagtcattccttgtctccctgcaccccaccaggtcagcttctgctttggtttaaagtcatggtggcagaaactgaggctggagaaagtatgaccgccaatgtggacactttccagagccctctccgttcatcactctagggcagtggtctgcaaccttttcagcaccagggctggtttggtggaagacaatttttccacagactgatggggaggtggggcggggcgggagggatggtttcgggatgaagctgttccacttcagatcatgaggcattaattagattctcataaggagcatacaacccagatccctcgcgtgtgcaggtcacaatagggttcctgctcctgtgagaatcgaatgcccctgctgatctgacaggaggcagagctcaggctaatgctggattgcctgctgctcacctcctgctctgcagcccggttcctaacaggccaccaaccagtaccggtcggtggcctggggagttggggacccctgttctagggcactcagttcccctgactgcacacggccccttggatcacagcctaagctaagatgatggttggagacataggtggacagtatgacgtgcacactgtcacggcacagggtctgaatggggtaataggcatttgtttggttgaattaaatggtgcaatgccaggcctagagacaccctgactgacatggtgggctgcagcagcagggccatcccagtgtcagctgaaccttgagggtttgcctggaaagtgggtttttgctgctggcttccctggcggtggcagtcagggaaggacccttctaagtagaacgaatagccaatataaagaggaggaagcctctctgatgtgtgggaggccagtgtggctgcagtagagtaagcaagatgcaaagcagtaaggaatggattctctgagagaggtcatagggagcagtgcctcgtaggtattgtgaggtccttggcttttactctgaatgggggagggggacattgcaggatttggagtagaattgtaggacgacctgtcttaagttttaagaggattgaacatagcagttttatggtgcattaatcagggggaattaaatgtggaaggagagggaccagttaggcagcaacagtgataactcaggccaagagatggcggtggcttgcagcaggagggagcagtggagacagtgagatatgcttagattcgggatgtatgtgttgtaggtcaagcaaatggggttttcctcttggaatggatgtgggtatgagaaggagagaggagccagtggtgactccgaggtttctggtctgaatagctagaagaatgagggctgcatcgaggccttccctagtgaaaaccttgatctaagtagtcatcgacattggcataaatcatgccattgccttaccttttgtaccacggtacttttttttttttttttaattttactgacagttctgggatacaagtgcagaacatgcaggtttgttacgtaggtatacatgtgccatggtggtttgctgcacctatcttcccgtcatctaggttttaagccccatatgcattagctatttgtcctaatgctctcccttccttgcaactcccccaccccctgacaggccccagtgtgtgatgtttctctccccgtggccatatgttctcattgttcaactcccacttatgagtgagaacaggcagtgtttggttttctgttcctgtgttagtttgctgagaatgatggcttccagctttatccctgtccctgcaaaggacatgatctcatttctttttatggctgcatagtattccatggtatatatgttgacattttctttatccaatctatcattgatgggcatttgggttggttccaagtgtttgttgttgtaaatagtgctgcgataaacatacgtgtgcatatgtctttatagtagaatgatttctattcctttgggtatatacctagtaatgggattgctgggccaaatggtatttctcgttctagatccttgaggaattgttttccacaatagttgaactaatttacattcccaccaacagtgtaaaagtattcttatttctccacagcctcaccagcatctatagtttcttgactttttagtaatcgccattctgactggcatgagatggtatctcattgtgcatttctcagatgatcagtggtgttgagcgttttttcatgtttgttggccacataaatgtcttctttctagaagtgtctgtttatatcctttgtccacattttgatggggttgtttgtttcttgtaaatttgtttaagtttcttatagattctggatattagccctttgtcagatgagtagattgcaaaaattttctcccattctgtaggttgcctgttcactttgatgatagtttcttttgctgtgcagaaactcttcagtttaattagatcccatttgttaattttggtttttgctgcaattgcttttggtgtttttgtcatgaagtctttgcccatgcatatgtcctgattggtattgcctaggttttcttctagggttttaaatttttatttatttatttttttgagacagagtctcactctgtctccctggctggagtgcagcggagcaatctcggctcactgcaagctccacctcctgggttcacgccattctcctgcctcagcctcccgagtagctgggactacacaggagcccaccaccacgcccggctaattttttgtatttttagtagagacggggtttcaccgtgttagccaggaaggtctcgatctcctgacctcatgatccgcccatctcagcctcccaaagtgctgggattacaggcatgagccaccacgcccagcctcttctagggtttttatggtttgggattttacatttaagtttgtaatccatcttgagttaattttcgtgtaagatataaggaaggggtccagtttcagttttccacatatggctggccagttttcccagcaccatttattaaataggagatccttattccattgcttctttttgtcaggtttgtcgaagatcaggtggttgtagatgcgtggtgttatttctgaggtctctgttctgttccattggtctatatatctgtttgagtaccagtcccatagcatggtacatttacaaagcccttgtgtcatcatgtttagccctcacagacaccctaagaaaaataacttctgtcttcattttgcaggtgaggaaactgaggcatagatctttgaggtctctctgaaaattccctctattttatggaagttgccccttttcaccttgtcttttagttaggtaactgcatgtcatcttccccactagctggtacattgttggagggcagagctgtatggagggttaactttgagtccattcagcatcactgcaatagcaggaacgtggtaggtcagagaaactaatcattattgtagcataggtcccattgagaatcctgtgaccgctagaaacacacttcttcccattaaaatatgcacatgtgcagttctgcattgtaatgtcgccaaaactcattcatggaagccagttaaggtccctggcaaaatgtgcttattttactctgtaactatttagtaaacaaatacaataggtatagccaaagcattctgcctaaggtttgaattcttgaagccaggagcttgtcaagagtcggaaaacaattcttacagtctgttcagatcaattaagttcagtaagcctgtcctgagtgatggtccttagctgggtgtttgggcccagagatgaataaaacagttcgggaagcttacagtccagtcataacctctctttctgtatgaggcagcagagagcaccattattagtactaatgtccccattggacaggttgggggcagtgccccctttgcttcatgttactagagctgccatcatccccttcatacttccttgcagcctcatgttgaatgatctgggcacctctgtagaatgcaagctctatgatggcagggccatgtctgttgttcttcttcagcacagagcaggtgctcagcggctgctgattggatggatgaagaggtggattcataggtggatggatagttgttgattagatggatgggtgggtagatggatgatagatgggtgagtggatgcatggatgggtgggtgggtagatgagtggagggggaggaggatgggtaaagggtaagagttggaggttttaaaattttctggtggccttataggattcagatggactgagttgccccatcttgcctttatcttcccacctcatccatttccctgtcaggaggcgaggtcctgtgagagcacagcacagcaataaatagagtactcttgaactcgtctccaaacagtggactcctgcagatggtcactctaccaagctcaccagttctccctgggactccattaagatggccctgccattcatccctcacacatcaagctggtttcccccctctcttccctgctgtcacaccctctccccacctccttgggggctctcagtccagttcttccccttgccagtctctgcccctccctctccctccagtctcacttccttagtggggcctctttttccctctgagagtccacagctgctgtgacttgcagtttagcctttcacttctgaagacagctctttgtttcttgtgtgtttattttgtctcttcgactagatttcacagaagctcaggagagcaggagccaccccctttcaccccacttttctagctgcaggatcctgcagagtgccagacgctctctgcatttggggctggagggctgatttgattgatttcaccataaactctcttccaactctgtagtgtgtgtgtgcatgtgtgagtgcaagagtgtgtgagaatgtgtgtgtgaatgtgcctataggagtactagaatggagagagtgaaatccagcatgatgtttcagagcagggtttatcaaccttgtcactattgacattgtgggccaggaaaatctttgttatggggctgtcctgtgcactgtaggatgtttagcagcatctctggcctctagtcactagaggctagtagcactgacacccccgactcccctcccccaggttgggacaagaaaaatgtctccagacatcaacaaatgtctcttctagtggggcaaattcgctcccagttgagatcactgtttgagagaattcactggaatcctaactttcgtcttgtcggctgggcatgtcactggctcgctaaaaactgtgcgctacaatatgcagcccataaggttgttatcatgatccagcaagaggcctaaagcacctggcacagtgctgggaccaaatgcatctccactcgtgagaggcgatgtgagtgtggtgcatggctgagagagtgtgctccggagccagcctgtctggggtgaaatcctcacttggccccttctttgctgtgttcaccccaggatgtttacttgatcttgcactacctcagtttcctcatctgtaaaacagagacgataataatcacacccaccccaagaactgcagattcacgatgaaatgggtggctgtgcgtaaagcccttggaatagtgtctggtatgcaggaagtgtttggcagaggttagctgttcttctgctctctgctctctcctggtgggtggaggaacacctcctccttctaggttccctctggctgtaattcttctgcctcatttgctgctgactagcgcccgcccgggtttgagctctggggtggctgccagaggcttctgctgggtcatcgcagtcaccctcgtggatgcaatgtcaggatgctgcctcagtgcggaggctgtcaacacctgtccagagacttcaggcacactgcttacgcatttcgatgagcgcatttcacttgaatccaccaaagtggacctgctgctagttctatttccccctggagtggagactctccaaagtgagcttcgggcaattacattctttctccattattgcttttgttcctcttacacagccacttgtccaaactctattaacacttggtgttggctgaagcttgtgttttcaaacatgtcagcagatggcagggccccagatgaggtacgaatccatcttgaagggtcacagggcactcgatggctgcaatcaaaattggcagccaagacgtgtcttttgaagcaatcttgataaatgcaagaaagaatatagccagaagaagggacatagctgcccttcatgttcattcacatcccttccgtccaatgagcatttcttaaaagttcaataaacattgattgcacttctactgtgggccaggcgctaggaattcagtggtcaacaagataggctcagtctccatccttactgaggctggatgtaacgaggatataaacaagcccagtgtatgtgtaatagagtgtgatgcctggtgaggaagcagggactctggactccactctaggtttgaatccgctttctgccactttctgtgtggctatgagcaagttccttaacatctctttgagtttcttgtatgttacaggaagagtaataacttgaggttactatgaagattaaatgggctgatacaagtaaagtgctagggatttttttttctttctttttttttttgccggcgtcttgctctgtcacccgggctggagtgcagtggtgtaatctcggctgactgcaacctctgcctcccaggttcaagcaattctcctgcctcagtcccccgagtagctgggactacaggtgtaccccaccacacttggttaatttttgtatttttagtacagtcggggtttcaccatgttggccaggctggtctcaaactcctgacctcaagtgatccacctgcctcccctagtgttgggattacaggcgtgagccgccgcacctggcagtgctggggattttgtctgtcttatctatcactgtgactatagtactcagagcaatatctagcacccagtaggtactacatactgtgtctacagtagttaggacagtatctagcacacactagatgttcacatggatatctgttgaaaacaccatggagtatatacttggcatttaaaatgtgctctaaatatttaccattttcttaggaaacagggtgtgcagtagttagaatttagactccgagatctatctatatatcttattaggtggagaagttgtttacccaccccttcctcagtttccttatatataaatcaaagagaaacattgaacttatctcctaaaattgcacaaagcacagagacccttctttagttgtttttgtgagccactgtgctagaacaatggtgtttactttcaccttagctccctctatttgaactcctgatgaatagagtacttcaatatgtttaggtggaattggtagctaatcagtggattcgatttccagggttgctagaagttccatctgcctcaaaatagcagtccggtggcttgccaacctgggatttccaatgtgagtccttgctggagtcagtgacccaagatggctccatacttgggaacatccctttgatccttggccataaatgctttgttctgggtgggcttgtcaggataccagtttctgttttggttcctatgtatggtgctttggtacaaggagaggtcaagtctttcctagggaatgtgtcagtattccccagggcttggcgacctggcacgatggggaagctggaatgagtatttgcgggaatggccgagggcctgagggctgtgggtaggcttccctgatttgtctatcttttgtggacaggcactgggcagggtggagcaggctatgatttcttcctcttgtttttctgcctttttcatcccttgttcaaaagttgagagtggttaggcccatcttagactggtcagaagcaaactgaaggacagagataagccatcaaacgtagcagaggggaattctggcttggagcttcctgttagtcatctagaagactaaacagaattgggtattcataggcaaagccacttcctttgtcagtcatgtctgcttttcttcaaatggagccttaagaggcccttatgcaaaggcagaaatagatttataaattaagtgccaaagtcagttactttcatttttgtaatcagtgagtacttggaatgaatacggatcttcactttgaatacccagtttcaagatctgtccaggacatcttaagccaatctactggcaccttctcacctgacattgctgggcagaggatgagggaagattcccgaggaaagcagggaggagctggtcacggagtaacacacggtcctgccccacctccacatatctgatggacacccctgatttgctcgtgctccagagactaacacacattgtgcctggttttcttctgttggaagcctcagttgcttccaccatcctgtccagttctactgccaagtcctcaggcagaccacttgggctgaaagagcagggagcagagtctacccagtgaggacaccagcaaactggagtatgtccaagcaacagcagcctatgaggggaagggggttgaaatcaggccaagtgcggagggaatgaagaaacaggctgcgtttatgcaggaggagagaagcctcagcatcccccgagggccctctctagatttgcttttggacaaaggattaatttgattaagtgttggtcgacagagcagttggttgcaaagtgcaggaaaggagatttaaaggctacacaaagctctggaggagtgagccttgttcaggagataatataatgctaataaaaagaaaagtgactacatttactgagcacttactatagctggacattaagtcaagtcgtgtatgggcattaatttcagctgagcctcccaggaacccagtaaggtagggaccattatttcttgcattctacagtcagaggaactgaggcttagggagattcagccacttgctcaagcaggctgcccctggctcctacagtgcctttgtgtggattacaaaaagatatccttcctctggtgggcacagtgccagggcagggtgcaagccttggcaagcagatcgcaggttgggtgccagccttcactgctctcttggctgggtggccttgtgcagggcacagcctgggcagttgtacactgcagccctaggcttgaggccagagccaggaaaagacagaactggcctcaaaagccacatctgtctgactccagagacaactagctcttaactcctaagctttatcatctctcaggatggagacttcatctctctgaatgcacacaaaagggaggttagggatatggggcacacctgggagtagaggggacagcctgtgctccgttccactgaagcatcctaaaaaccctgcgagataggtactgttaacatccccattgtaagaaagtgaggcagagaggtgaagtcacttgcccaagatcacacagtagtgagtggcagagctggggttccttctgaaccactctggtcttttaatgtggtttaggcagacgtgttggggtgattggaccaggggaaggaggaaggagggaagagagagggaaggaagggaaggagataagtgggaagaggcagagatgaatgagagttagagactggcggtggtctctgtgatgcaaaagaatctgcacagaacccagtggcatttcacccagcttctgcataggggttagacacagagcagcattggctatttagaccctggtcacttaatggatcagcctacggtccgtatcctcaaaggtaaaaggaggtaattatgaagaggtgtacctgtagagtagaggagtaggaaagagcatgggcctgtactcccagttccagcattgtatgaccttgggcaaggcaagtaacctctctctgtctgagtttctgtatctgaaatttggaaataataagacttctcacttgcaaggagtgttgtgagaattaaaggagtaaatgcacatggagaacttagaatcatgtctgggatataagtgattgctacacattcgttcttattaggatccacactgataagccacttccagaaaagtggggcctgcctacgtttagttcctctttaggaataataacctttttacagtggtatcttcttatcttagctccccacccaacattgtggggtgggtaagagtggcacaataatgcctactttaaaagtggggaaacggattcagagggaaagtgagtctgttttgtagctgtcaccagctagagcgggtttggaggagtctggagacgtagctactgcctgttgtgtgggcagcagcagggccaagggcgtcatgaaggactggagctcacaccggggccttcctcctggtaaatctcctacacaggttccttcccttgcgtagccctctccattgtcccaatggtgctgtgctggtcggggaggagcatgggcccagctcagctggccctgcctgcaggaagcctcctgtggcccccatgcatggctccagcatgttatctcctgtgctctcaaagcacctgtacctcctgagcccagaccatccatcaggtcattgcaggtggacctgtcagcttctcccattagaatacaaggccctggctgtctaattctaccatttggttactggttatggagcattacaacatggcaggctcttcacacactgggactgtctttctttctcataataatttgccatagatccctggggtgcctgagctgggactcaaccccaggcctggctgaaggaggggctcagggtctcagaggccacagctgcctggctctcctgctatcctgctcaccagtgcatctctcctacctggtatagcacctcaccacacttcaggtgcttagtatgcagttgtttctttttaattgtagcaaaacatgcataacaaatgatgtaacattttaactgcctggtgtacagtaagaggacagtccatagtaaatagcagcctccttgtcactcaggctcaatgcagggcctgtgttgaggaaaggtcaactttggttaatagaaggtcttgggagccaggctgagtctgaaataactcttgtggcaggcaataggtttctgtgttggttttgtttagcccaggtgggctgcgtgggcatgggatggacttgaggcagggaaagcaggaaggagcagagactaatgagatctagaggtctcacctagctgtctttctttctgtttcacagccatatacaacttccaaggcagcggagccccccagctctccctgcagatcggcgatgtggtgcgaatacaggagacgtgtggaggtgagtcactggcccacgccccaagtgctggacccttggctgatggaagcctatagtacacccaggcccctcagcgctgtctctgaacctgcaactgtgtggtctatttaaaaacgttttggtaacgctagtaattagaatttactaaacagaaatgctttctcattttaggaatgtatgtttcatagcaaaagcctaactgggtggttcgatgtttgttatgctctccatttgcttcagccatggggctattcagcctgtgactcttcctagatacagttctttattagtattaatatcacgataaagggaaataagcatcattagggtttggaagggtcccataaatcacacctctaattccaggagagccgatgtgcacagttgtgttgtttgtttactgcatgaaggcacccagcccagggagcaggagctcactcccctccccaagctgggagccctgtcttgggcaatgtggtggcatctctttctttctcctacaaagatgccattgccttgtgaagccaggtgtctactgggctgcgtccacccatggtggtgtgcttgtagggagtgctttttaaaatttgcacaaagatgaatggccttggactcataagtcaggcagttggaaatcaacatgtcattgataaacttgatattgggagcatggcttgggcatgagaaccaaatgagctgctgatctgttacctgcagtcaggcaggctcccacccctcactggcccaactggcctaccacagttccctcctacctgggcctgctgatacctcctgctgcatggagggcacagagcctgggcttcctgtgtctcggcagagtggtagaggaagaagagagagtgtattgagcacataggcctgttctgcccccagtgaatccattagaggaggccctggggagggagtgacggtcagggaggaggcaggtgtgccactgtgaaggagtcctttcatggggaaaggcggtcacctgcaggagtagccatctttggtcctttccacaaaatagacactgtgctaagttctttataacacatgatcctagtcactcctcaccacaacccacaggacaggcagtgtcatttccagtgctggattagctacatgcaacctcttaggcaacagagcccctagctgggtctgcagatttgtacaaggatgcttgtgtaaacacatacacacacacagacacacacaaagacacacacaaacatacatatgtacatatatacacatatgcatacctgtgcatgtagatacaaccaaaaaacatacagaaaaccattttgtgggcaaataatttgaaatttgatatgtcaagacaactttaaaaggggtcatgggggaaatgagaactttgttcatcttccttatatttattttatgctttagtattatttttacttggggttgtagatgaggggataccgtacacttttcagtgtccagggcctgcaaagttcacactccggccctgttgaaaccttttacgcaaggagtggacaaggctggaggagaggggtggagacgctgtcctagagaattgaattgggtctgtgattccacgcacgctgccccctgctcacagcataaccctatcttttacaaatctagttctgcccagtggcagataagcaaactgtaggtgactaccaaaggcaaagaatgaaaataaaaacagcagcaactctcctcagtgcctctttcatgctactggatgctaatcctgagaaacaggcacgagacctcacatttgcagatgaggaaatggaggcagtgaaatgactcatctaaggttgcacagtgagctagtggatttttttttttttttttaagacggactcttgcttttgtctcccaagctggagtgcagtgatgcgatctcggctcactgcagcctccgcctcccagattcaactgattcttgcgcctcagcctcattcgtagctgggattaccagcatgtgccaccacgcctgtattttcaatagagacggggtttcgccatgttggccaggctggtctcaaacacctggccctaggtgattcgtgcacctcggcctcccaaagtgctgggatgacaggggtgagccaccgcacctggccccagtggctcttttctgatagccaagcccacactctttcctccacccatgcctgccaaaacaatgacaaggccttggtcattattttctgtgtcctacattgtgaaatccagatgagtatttttctcttcgttgtatgcagtttccctgaatagaaagcttgagggaataaacctcccacacaggctgccatagtcagagccttgccagtacctttccctggcctggtgccctgacctttacgaaggctactctggtggactcaagccacctttattcatctctgggacacctttatcctttctttggttctggttttccatttctaattcaattagtcttattttaatgtatctttgtaaattagtcacaataacttgctggaaaaagctggatatattcattggtaaatggctaataatttattaattatttgaaaagacagtgtttggaagtctgctagaatgattctagctatctgaggaaatatcatatctcctggtacgcaaatcattaggacttctcatgcatacactcatggccatgcagagttttcaaataggggatccaaagtcttcttggggtgccttgagtggcagaaggtaatggagctggagggggtctgagagcaggtctggtgttgtctgccttcagatggggtgtatggtctgtgattctgattgaaaaaaaaagattcctctaaaaatataaaaggtgtgaaaaccacaatgttagtcaaaaattagtcaaaactgtgtagtagaaagaatatgggtgtacccgtgaaaccttcttacagaaaactacttcaaaaccaaaatccagccaactgagaggtgaatcacaatacaagaatattggattaaaaatctgtgataaaaggaaatagtggctaatattgggtccaaatgaatcgatttataaaaattgatattaaaaacagtaggaatttcttgtagaagggacaaacataaaaaagcagtgtgatttttttcctccaaccacttccttcagtcatatttggttgacatctttcctgagatttggtggcatcagaagactttatttaatcttatatccatgtgctgctcacccacttcttccctttcacccattcaaacaagacctggggaaggagtgagtttgggatgttttctttcctattctttgtcttctctactgaaataagcctaatgattggccagtccactgtacaaatagtcatgtagttgaggaatgaaatgccagatgcccctgacatcatgatttttatggctaccataaagaatgttattgttgggaacctagacaatattttaaaaaatctaataaagttgagacttgggaggagaatggaagataatagctaactcaatgacatcactttcacaacaaagtcaatgaatattaattggaaataaaacatggaattaaaaaaaataaccacgtctatctttgaatgcttttcataacaattttcattttagagaagttttcaggaaatctttttagtgataaagaaacattgaatcaaagttcaaatgtccctcaatttcacttggtttctttttcttctgctaaatacaaataagattaaataaaatttttatttatatcccagcactttgggaggcagaggcgggtggatcatgaggtcaggagatcgagaccctcctggctaacatggtgaaaccccatctctactaaaaatacaaaaaattagccgggcgtggtggcaggtgcctgtagtcccagctactcaggaggctgaggcaggagaattgcgtgaacctgggaggcggagcttgcagtaagccaagatcgcaccactgcactccagcctgggagacagagcaagcctccgtctcaaaaaaaaaaaaaaaaaaaaaatgtatttatatagtatcttcaccatatgctcatttttatgagagtattttaaaaaccatattttatctttttatctctctgtcattctatgtatataaatataaacgaagagttgactggaatgatattaatagtgtttttctgtgtaatgggattcaggataattctttaagcttatatgtttgtacttttctgtttagtttaaattctttataatagcatatattagttttaaacaaacaaaaaaaaatacagtctttaagttgggcatgatggtgtgtacctatagtcctagctacctgggaggctgaggcaggaggatcccttgagcccaggagtttaagactaacaagactccatctctgaaaaataaggcaaaaaaagtatgaagaataaaataacaatcacttacattccaaccacctataattaatcattgccaacacctgaggatatttgcttccaatctacaagactgcattattattattattattattattattattattattattattattattattattgagatgggggtttctctttgttgcccagtctggtctccaactccagggcccaagcagtcctcctgcctcagccttccaagtacctgggattacagatgcatgccaccttgccgggctttcaatagttttaaaatcttccccaccacccccaataaagaagtgaaaagagcactggcttttgaattagaaagttattccctgcttctgctacccactagtggagtcatcttgggtatgtaagctttaggtttctcatctgttaagtgggttgttttcaccttgctcctgagcttcttatggggataaaatgagaaaaagtaaagaagctgtctaccaccagcctggctcatagaaggttctctgtgtttgttaattccatcctctcccctattatgtagtgctgtactgaaactggcagatgtatatttttacaacatggcccagaagctgaatcttttcctggaatgggtgagactagcccttccttgcctatgtactaaatttactcagctgaatgaagagggaaaacaggaccctaaactggaagcttaaacaagggtgaatttcactttttattataaggataatatattgttatgataaaaactcacatagttcaagatggtactcatgctaggccatgctaagccttagacatcaaatgctgacttcattgcccatattatatctctcatgctgcctcttttatccagaggcggcataaacattctgtgttttagatgtggaaaacacaggtaagtgtattgagcagtaggaattcatcatagaagggacaaacacaaaaaaaagcagtgttattttatttccccccagtcacttcctccagtcatatttgattgacatctttcctgatatttgatgacatcagaagacttcaatctcatatattgtgcagctcacctacttcttctgtttccccagtttgaacaagacctggggaaggagggagtttggggtgctttctttccagttctttgtcttctctactgaaataagccctctatgatcagcttgtccattgtagaaatagccaggtagctggggaatgagatgccagatgcccctgacatctttgtgtgaagctcctggaatgcactcatactgtgtttggatgtagttttggggtggaggaactgtatcatgccctcctaaggcaacaacttcctacctccaaaggctgacgtgagagaattgcttgagcccaggagttcgaggctgcagtgaggcatgatcatgccactgcactccagactcagaggcagagtgagatcttctctctaaaaataaataaataaacaaacaaataaaatcagaggaatgagggaggagatggatagagcatcctctgctttgaaaaaatagcgcattgcttttgttgttgctgttttctagaaatgcaactacatactctatgtactattctgagaccttctgttctcatttgaaaatattggagtgctttctaagtgaacacatatctattaccacattgttggtttggctgcaaaagcttggcacaaggagattttgaatgtacccctcactgaggagggcacaccaagagccataggcagtggcttccatgctaataactcctttgagggtgatcttgacctatccaaattctttgcttttaatataagtgaggacattataagcacttaacatggaatctttttaaagcaccaccttgcaaggtgatagtcttttgttcaggtctgctgtagtgacaggtcactttgaaaaggactccattttcttcagtaaggctgctccattatcagcagtgtgtatgtgaagttttcctcccttctgagtgaggatgaggctcagacgtcagtaaacttccattatgtttcatttgcggcatgtctatttgctttgttgtgatggaaatatgttgaaatgactttagtgcaaaaaaaaaatgatattataaatccataggtcctgaaaataaaatagaaaatatgcccaactttctctgcattattattattttaattgatttttttagaagaatggtatctactaactcttttggacactggacaaactctctgagtttttaatccaatttaagcctgataagacactattattattcccatgagatgtgaggcactattattctcattttatagatgaggggactgaggctcagaagaaagtattaacaggtccatgattgcacagttaagtagcagatctccaacaaattcagactttcattgcagagctcatactctttaaaaatttttttaattgtatatgtttaaggtatacaacatgatgttatgagatacataataggtagtaaggtagtaagatagttacgatagtgaaacaaatgaccatatccatcatctcacatagttacccttcttttttgtttttgttttggtggcatcagcagctaaaatctaatcatttagcagaaagctcaaatacagtacaattttattgactatagatcccttgttgtacattagatctctagacttgttcttcctacatatctgttaccctgtaacctctaacctacgtttccccatttcattcctcccatcccctaccctccctggtaacccctgtttcattctctatgtctgtatatttgactcttttttttgttccatatataagtgaaataatgcaatactttctgtgtctgtcatatttcacttagcataatgtcttccaggttcatccatgctgtgacaaatggcaagatctcctcctttttaaagggtgaataatattccattgtatatgtatattacagtttctttatctactcatccactggtgagagcacttgggttgtttccgtatcttggctattgtgaataatgctgtaacgaatatgagagtatagacatatttgcaagacagttatttcattttctttggatatatgccttgaagaggaattgctggatcatatgctagttctatttttaatttctttaggaacttccatacctttttcaacaatgactaccaatctacattctcaccaacagtgtagaagagttcccctttttccacaccctcgccaacatttgttatctcttgactttttgataatagccattttcacaggcatgaggtgatatctcattgtggtttgattttcatttttctaacaactaatgatgtcaaacacctttccatgtatctgttggccatttgcatgtcttccttggagaaatgtctattcagtttctttgcctattttgtaatcaagttatttatttttatactattgagttatatgagttctttataaaatttttgatattaaccccttatcagatgtatagtttgcaattttttccctaattcacaggtttttgtttcattttgttgttttctttggtatgcagaaagtttttagtagtcaggattcacactcttaaccagtgtattagtctgttttcacactgctgtaaagaactacctgagactgggtaatttatgaagaaaagaggtttaattgactcacagttctgcatggctggagaggcctcaggaaacttaaaatcatggtggaagatgaaggggaagcaaggcatgttttacatggcagcaggagagagagagaacaagaagggaagtgccatacgtttaaaccatcagatctcgtgagaactcacttactatcacaagaacagaatgggggaaaccgtccctatgatccagtcacttcccaccaggtccctcccctgacacatggggattacaatttgagatgagatgtgggtggggacacagagccaaatcacatcattcctcccctggcccttcccaaatctcatgtccttcttacattgcaaaatcagtcatgccttcccaacagtcccccaaagtcttaactcactccagcattaactcaaaaggccaagtccaaagtctcatctgagacaaggcaagttccttccacatatgagcctgtaaaatcaaaacaacaagtcagttacttccaagatacaatgggggtacaagcattgggtaaattctctcattctgaaaaggagaaattagccaaaacaaaggggctacaggcctcatgcaagtccaaaacccagctgggcagccattgaatcataaagctctaaaatctcctttgattccatgtctcacatctatgcaaggccacattgatgcaagggatgggtccccaaggccttgggcagctctccctctgtggcattgcagggtacagaccccacagcttctttcacaagctggtattgagtacctgcaggttttctaggcacacagtgcaagctgttggtggatctacaattctggggtctggaggatggtgaccctcttctcacagctccactaggcagtgcctcacgggggactctgtgtgggggctccaaccccacatttccctgctgcactgccctagtagaggttatccatgaagattctgcccctgcagaagacttctgccttgacatccaggcatttccatacatcctctgaaatctaagcagagattcccaaagctcaactcttgtctcctgtgcacctgcaggcctaacaccacatgaaagccaccaaatcttggggcctgaaccctctgaaacaacagtttgagctgtaccttggccccttttagccatagctggaggtggagtggctggcatacagggtgccaagtcctgaggctgcacagcaacagggccctgggcccagcccacaaaaccatatttccttcctaggcctctgggcctgtgattggaggggctgatgtgaagatctctgaaatgccctggagacattttccctactatcttggctgttaacattcagctccttgttacttatataaatttctgcagctcgtttgaatttctccacagaaaatgggtttttcttttctaccacatggtcaggctgaaaattttccaaacttttactctctgcttcccttttaaacataatttccaatttcagaccatctctttgtgaatgcatatgactatatacttttagaaacagccaggtcaaatcttgaatgctatgctgcttagaaatttattctgccagataccctaaatcatctctcttaagttcagatttttacagatctctagggcaggggaaaagtgctgccagccagtcttttgccaaagcatagctagagtgacctttgctccagttcctaagaagttcctcatttccatctgagagcacctcatcctggatttcattgtccatatcactatcagtattttggtcaaaaccattcaacaagtctctagcaagttccaaactttcccacatctttctatctttttctgagccctttaaactgttccaacctctgcccagttccaaaactgattccagattttcaggcatcttatagcagtccccgacttctctcagtaccaagtttctgtattattctgttttcacactgttataaagaactacccgagactgggtaatttatgaagaaaagaggtttaattgacttgcagttctgcatggctaaagaggccgcagaaaacttacaatcatggtggaaggtgaagggggaagcaggcacatcttacatggcagcaggagagagagacagcaaggggaaagtgccacatttttaaaccatcagatctcacgagaactcgttatcaccagaacagcatgagggaaatcacccctatgatccaatcacctccgaccaggtccctcctctgacataaggggattaaaatttggtatgagatttgggtggggacacaaagccaaatcatatcaaccagtgataggtacaagcttccatctgatctcaatcttattatatatttcaacacacaagaaagaaaaagcactcttaagcactcatcactcatataaatatcagcatatctatatatgtttatatataaatatcagcatatctatatatgtttatatataagtatcagcatatctatatatgtttatatataagtatcagcatatctatatatgtttatatataagtatcagcatatctatatatgtttatatataagtatcagcatatctatatatgtttatatataagtatcagcatatctatatatgtttatatataagtatcagcatatctatatatgtttatatataagtatcagcatatctatatatgtttatatataagtatcagcatatctatatatgtttatatataagtatcagcatatctatatatgtttatatataagtatcagcatatctatatatgtttatatataagtatcagcatatctatatatgtttatatataagtatcagcatatttatatatgtttatatataaatatggtagtgggagaacttatatatgtgtgtgtatatttatatgtatatacacatgtttatatgtatatacacatgtttatatgtatatacacacacatatgtatgtgcttgcttcagacatttgtttttaagaaataaaaatttctagtgcaattgaaatccctttttacccctcctctattcttttttcttttgtccatatgtaggtaacacttatcctgaaatcagtatgtttttttcccatccaactttttgtacctttgccagatgcatacactttttaactttgtctaaaaaaatagtgtttgtagcactcctctggggctaggtgttatttccctcactttacagatagaaacactgaggcttaagtgacatgaccaaaggccatgtggcttggaaatggcatagggaggactggatctctagaccttggattcttttttgatgttgtgggatattttaaatctcctgcctcccttgactcttagaggatttgagactctagatgtatttgatattggtatttgagatgtgaaaagggaggattatttgaataattggcactttataattttccaaaagaattgtaaaaatttttccttttctcatcttcctccagaatgcatgtctagtcagtccaggctactgtgtatcataaactgcttaaataagaggaatttattcctcatacttatggagactggaaagttgaagatctaggcaccagcagatctggtttctggtgggggccgcttcttggtttgtagatggctgtgttcttgtcatagcctctcacatggcagagagcaaagagagagggagcaaactctcctgtaagggcactaatcccattcataaaggctccattctcatgacctaattacctcccaaggaccccacctcctaatgccatcacatcaggtgtcagaattgcaacatacgaattttgggaggacacattcagtccatagcaatgcacactgtgaattttatgttaaagaaagtggttatctcatgaaaacggttagcaaaaaagcccttgttattgttgaattcaaaagagtgttgaactcaggagcgggttctgggacatggtaaatgccatgttacactgagcctgcttttgatcatggtgtccactgtccaggaatttttctcttttgtaccaaccgttgttatctgcccagtcatgttttggagcatagatagatatagctgattggtgaccatattagggaaccaacatcagtggtcagagataaatgacctggcagaagtaaaaatgccagaaaaaagtcataaggatagtccggatgcagttgatgcactaggcatgggtttggattctggtttggctgcttttctgctaaagaatgtgttggaatttcttccccacctgtttgatctcagtgtcaccatccagcaagtggagataaagccttcttgcaatgaatccctggggatttatccctggaagcatgtagcccagtgcaatatacatagttggtgcacaattaatattgattgaacttgaacctgggagccagaataagaatattgggtgtaagtgtcagcagaatcctgtcgtcaggagtgaggtgcaactctgagaattaggaaacctataagacgtacacacataaccgagttttgagggtcagagcaggcaaactccttggatccaggaagacaagttaccttaatggagtccctgtcacagagatgcagatgtggacatgagctttgtgtagggaccatctattggtccctcgattgtttttctgttttttggtggattttagtgaccttagccatcatgtgggttcaagtcactgctaccagatgaccctatctctatttgcactctaaccccatcacatgggagacaatgtggccaaccagctttaaggattggctttgaagtcacataagcttgagtttgaactctggttgtatgatcttggcccagcccatcaattgacttgaatatcagtttcctcatctataaaatgggaatgataatacttagctcacagtgtcgctctgaggattaaatgagagaatgcctgtacaacgtttagcatacagctttgcatgttgcaggtgaccagtgaaagacaggtaataataatattacaaagttgcatttctgtctagttggtgaaaaggggcaactaaaggaggttgttgtagcacagcgcagcagggtgttgcttgagtgtaaatctcagctgcatcacccactagctgtgtgaccatcagcaagctgcttaatctctgtgcctgtctattttcatttgcagagctgaagcagtaatagtacctacttaataggattgttgtaaagattaatttacaataagacaaaacaaaaaatgtcaacagagttaccagcacataggaagcacttagaaagtataagcagtattgttaattatggattatttttcaacagttattgacaaataattagaggccactgaaaatagaatgtgatgcttcatgaagtagaacatcttccatcactggaagtattcaggtggaaagtagcttagtggagatttagttttggagatttagacattgagaagttggaaatattaatattaggtaaccatcaaatcattccctcataatataggaagcataggtgatagttgcttatgttgaaaacctgacactgcaacctactagctgtgtgatccttggaaagtcacttaacttctctgtgcctcaggtaggccactcatttgtaaaacaggataataaccgttcctacttcatgcggttgttatgaatattgaagggcttaatatataaagagtgcttagaatggtatttttatttcccacctgagattctctttccaacctccctttcttccttctgtttttcctctctccttcctttctccttttctccttcctctcactttctgtcactcaaaaagaagctatcacggccccctgttgcttcagagtttcctttaggacctggccgtcaggctggctcatgactatgaagggtgactttgcatgttaagttgtttgtttttgggcttggttgtatgtctgttgggaacatatttcatcaacaatctgtcagcccggtaatgaggggtctgctagtgaggctcctgacagacgcgttttatttacaaagatgacaaatgccactccttggctgtgttggaatcatttcaaaggccagccgactcattacagtcatcaggacttgctgcactcaggcgtattttgtctgaggactgtgtgtaatttggatttctgctcattgatacattttttaatataatattcctgcaaagggtagatctcttaaaatccctgtccctttatctgtccctaaacttacttgttttgtaacgactaacttttgtaaatcgcattttagacactatttgctgctgttagaactgtcagtgttattttaggatgtttgcccaaatcaggagcatttctttgtcccgaaggcaggaattgaaagcatgcagatggtcacagggcccaggaaggcaatggacacaagggaggggctgcgttgaggctggtggactggaggcagatgctctgtctggtggaccctgctgcttttctcctcccagccagttgggagcactggccagcactactggggctcctgatttttcaaaatcaggagcacctttatatgaagtctatttttagatgttattttgagatgttggcaaccaattcaacagatttcaaagactatgagcttccagagtttgatctgtacccaaggtctaaagcaatttgcagtagttttactagtttaaaacaaaacaaaacaaaacagaaaaacactagcaacaaacttgtaataaatgagggaactgtttctttgttttctttttgcagactggtataggggatacctcataaagcacaaaatgttacaggtaaggtcacctggtttttatttgtgtcagtactggaggtcttcatatggccccgctatcccatctgagcaggtctctcccaccattgctcctcagcaaagggaatccatctctccctcctgtgccctgtgctctctgacctctgtgccttgtcactcgctgtgctcagctccctcccactttccctcattctttaaggttcatctctggtgccatctccctgcaacttttcctgatatgccactcacttatgatttctcccttcctcgagtctctgtggaattgtgcgttataaatttgaaatttattctactgccttcctttagagttgtttgcagcattcagtcatctcctcatccgtatacccaggtcaacacagaaaggacaggcctgatttctacttttgaggggttctcttgttctaacctcacatttcactattgtctccatgagagcaggcgcttgctttgcttgtctcattttctctcacagcacctagcacagtgaccagatgtccccagtatgcacattggttgcatttatgaagggatttccaagtaattgataaacttaccttgttaactgagccaaatgtatggagtaaggaaataatagaagcttcttccttcttccctgacatgctgtgtcgggagggatggtcctattctgctctctcaaagaacaatggaataaatgcaggcagaataggtctcaaatcgaactagcccaaatgcacctaggaacattgttgcttcaggaccagttatttctgaccttccagttgttcctgactgtgaagggtgaccgctttccggaatcgggcaggcaatgggagaagcagagctcctcgtctcgcttaaagtcagtgagtggtttaggttgtctttcaaacgatactgtcttatagcccacctgcaggatgagtggccataatgggttggagcatcccttgggatctagggctatggtgagatctagggctattgtgggatctagagcaactgatggagaactggagggaaagccagatctaaacaagtagatttagaatccagcccctgttctatctggctctgggtttattcctttaaagtctggggattttataagccagtagcttttggaaaaaaattataaagacgtagggtcattcatttctgtggtgatatatctttttattttattttgttttgttttgttttgtttccaacagggcatttttcctaagtcatttatccacatcaaggaagtgacagttgagaaaagaaggtatttgccattcttcaccagacttgagcctccagtggctcatggatgtctctgtcctgtttattttgaaaatctgacttggaagagctgagggttgctcagcttatcttctttgtgcctgtgtatatttgtgggtctcctttccgttactcaatgggagatctaatccaaattgattcatactgagatctgactctgagggggtattagtttggagaatcaaactttttgctggcagctaccttagaactgtattaaagtagattaatcctaaataatgagcccaccctagcgaaggaggacataacaaagcaagtcccttgtatttgcataatgtagttggtgtggctattggaggtgttttagtctaatgtcaggaaggcccctccgcagctgcagcttaatgcaaatttgttggtgttttatcttgttagcacctgggtctcaatttcacaccactttttctcccaccttaaatagaaatactgagaacatcattcctgcagaaattcctctggcacaagaagtgacaacgacactttgggaatggggaagcatctggaaacaactctatgtggtgagactcagaactctgctccctgagttggaagcttcttgcaatcttcagtttggttccagttttcattttagcattgagtcaggcaggtggaggtggctttggtgacatagcagagcgcacactattacgtgtgaggacatcaaggcccagagaggatcagggactttctcaaagccacagagctagtgacagagccataatcaatggagtctactgtgaaccttcggtgtttagtgcagaagttgtcaaacttgagcatgcataagaatcaccttaagaactgttaaaaataaagcttcctcccaaggggtttaataatctgcatttttaataaactcagatttgatttgctagtctgctgataacacattgagaaatactgttcttatactttaaccaatggctattgtcctcacatctatgaagaagttttgactttggaaaaacaaagaatatatttttgcatttgttttccctgttttgaagcaaatctaattttaaatcctcctttgatgctctaaagctcctaatgaaagcaattagctaagcaaaccattaagctgagagtgaaaatgtcaaccaaggcttactgcatgtttattatggcaccgtggacacctgctggtgtatgcacaggatttgtagacttacctttcgtggtcttaaatgttgactcccatgtggacatttcataatatgaagatgtaattggcacactcaattttacatgtttctcaaagtttttagaaaagtgtaggggaaaaatagtatccttgtggctaaagcaattttttgttcatctccactatacgctgaccttttttttttatttattttttatttttttgagatggagtctcgctctgttgcccaggctggagtgcaatggcatgatcttggctcactgcagcctctgcctcctgggttcaagtgattatcctgccttggcctcctgagtagctgggattacaggtgcccgccaccacgcccagctaattttttgtatttttagtagagatggggtttcatcatgttggtcaggctggccttgaactcctgacctcaagtgatccacccaccttggccttccaaagtgctgagattacaggcatgagccaccacgcccggcctactaccccttttaaaacatcacaatcacacgtaccattgaagcttggcattttcccttaggaaatctttgaatagcagtaagtccatttactctagtcaggagatccttcaacatctagtacttcggtatcacattcctgattcttgccatatctgcatacaacctgtgtaatatttacttaatagctgctttggatctcctttcagtaaacctgaatctatagacataaagaatgagatagcatgctgcatcattccagcagttcttgattccccgtcaccaactagatgccccacaattcagttcaacgctgactacccagggttactgccagactccatgggtttaaagcctcaatcccacaagattgccctcactttagatgccagtcgcaagtcctgggttcccaggttacctgaacttctgttggacttggctataaattcagggattctcactacccctccctgcctgggcacccccttttttcacttccagtttcataatttgttagaacaactcagagaactcaggaaagtgctatacatgtgattacggttttattataaagaatgtaattcaggatcagccttgtggaagagacacagggctaggcatagaggggcatagagcttccgtgtcctcggcacaccaccctcccagcacattgatgtgttcaccttctgggaagcccctcaaatgttattaaccaagagttttaatcagagtttcattacacaggcatgattgattaaattattggctattggtgcttgagctcaatcctcagtccccctcccctcccagaggttggggtggggcaggtggaggggagtggggctaagttccaaccctctaatcatgtgattgggggtttggttcctagttggttcctctgcaaccagcccctcatcctgaagctatctaggggcccacctagaatcacctcattagcataaactcaggtatcattgaaaggggattgttaggaataacaaaatacattcttatcactctggtcattgcaggagttttaggagcactgcttcaagaaccaaggacaaaaatcaagtgtgtatatatatatatttttttgttgttgtttttttaattataccacccacactttcccaaatggaaagacaaaagtacttgacacaattagaagaacattattcatctaaatacaatgaaaacaagataacattatttttataaaaaaaaatttagagacagggtcttgctctgtcacccccgctggagtgcagtgggaccatcatagctcactgcagtgctaaactcctggcctcaagctatcctcccgccttagcctccggaacatgcttgctattgtacctgtcaaaagctctgagtccaaaccttttctctctgtttgttaaaaaagacattaacaatatgtgagaggtgttagagacatattactatgaaactgcaactttctctttcccttacacagaaggatggaaatggagtgggagagaatcacctagggatccatgttgtttgaccttgtatctttgtaccacgaagagccatcttgcttcccataggtggtacgcgtgccacactttggagaatgctgccctagaagcagtcctttatcaccagagaaatggccctggctcccagcctcaaaaggcctgagctctgggacctccattagggcagatgttcgtagcattcctgttcaataaatatctttttagataaagtcagaaatcactcattccttaaccaagaaatgattgagatttttatttttgcttttgggaaatccctgtggtccacggggaataaatacatcaacgactaggacccccacctaatccttttgtagtgggtagggcagggagagagcctcaggccatggcccttgaccacactcacctgactttggcacagcctgccaaatagatggtcatgcccctttaacacaggtaattatgggttgtttcttgtctcctaggccagcaaaaaggagcgttttctccaggtgcagtccatgatgtacgatctgatggagtggaggtcccagcttctctcaggaaccttacccaaggatgagctgaaggaactgaagcagaaagtcacgtccaaaattgactatggcaacaagtaacctctctttcctctgcaaagaggttttcttcccccagccatcctctttcttccctctctccccagaagcttgttttcatttttagatgcaattttgtcactttctgtttgggagaaggttgtgaccaatggctgtgcttgcgtgccgttgttaccacccctgggggacctagggacatgcaggtggagagaaggcttgtacttaacatggtgttattaccaggctgagagatttaggacactcatttaacctacttccgatggactagggagcatagtcatgctggttcactttcagcttagttgtcattttatacctgcatttgcaaaactctcccttaaatcccaatgtgagacttaatgtctcttcccccatcctaaagtagccaacccacacaccatcaactaactcaaatgcacaattacaaaaatgtttcctcaaaagggaagagaagtaaaaattggttggatttgaatgctatgaagttaaggagaaaatgaaccaattatttgaggtgggacaacccactgataataacattataagtaactcttaatcagagctcattgtacaccaggcttggtgctaagtgttttgcaggcattgtctcatttaattcttataataactctatggagtatgcagtttgattatccccacttttttccgataaagaaaccgagggttttcagtagggtaggtaacttgtccagagtcgcgcagctagtaaatgacagaatctgaacttagacccaggcagtctggctccagggtccacctggagtccagggcctcctggagtggagtccagggcctcaccactctgctacttggatagcatttgagaactataaggaccttccctccctcctgatcttttgaatggcttccaaacattctgttcatttgttcattcattcctaccacaaacatgtattgaggacttatagttggctggatttcctgctaggtattggggctgtagaaataaaagtccctgtccactaaagggtcacagttccaattaggagtaagccacaagtaaactgctgatatgtactgtgagaagttcgatagctcaggaagcaagagttacttttaatgagccttagagaaggaagtcaaggaagacttcctgaaggaggcgacccctgagctgaagtttgaaggataaagagatattaagcaggctaaaaaaggagagtcaggggctcatgagagagcatggcatactcaaggaactgcaaagtgggtctgaaggctggaacacagggcctgagggggaagtaaaaagcccatttaatgggaataaaaagaagtttccccagcagccaggccaggctttcttgccctgacataagcactagggggaggattcggagaggaaagtcaatggctccaactcacagctggtctccatcccaggaacacagtccctctgctgatgccccattggcatctggcaagcgtgtccaaatctgcttataaagcacatcatcctaaagtgacaggaagggtttgccccgcagctgctactgccgttggttccatgatgtctttagctgagcacagttgcagctgagtgtgtgggaattgagggctgctttacaatgacatctacgaccttcaaatgttgttttctcaatgggggctcctgagaagaaggaccaggaatggaagaagtggtcactactcataggaagccttccctgattttccactacccgccttggcccggggtaggtgctcttgaaggccctgagtagtaattgcctcctttttggcctggcttccctcctattgtggaagatcctatagatgttgactgtctaaagcacctctctgcctgtgcctggaacaaggtctgcacatagtaggttctcagtgagtgacaactgagtgagtgggcgaatggtggtgatgggagaaaaagaagaaagagggtcctccctaaaccagcccctcctctgcagcatcctctgacctatagccctgtgcttttagttctgtcagtttcctttggggaagtgagggatgctccgtggcacagactgagacctcaagctcaggggcccccttattcacctgactgcttcagctgcaagcgagagagttgggcaacttatcactggcctgatagtttaggtgctcagagctctggtatgggatgggcagcttcctcaaatccaggaggcccagcgtctgggccaagtgtcaggatcagcctgggaacacccacctccaacttccagcagctgggagattgggtgggggtggcacaaagtggaactgaaccttggaggagtgatcagaatgagcttgtttcttctctcattcattccgttccttcattcagatatcaaactttctttgcacacctggtaggccccaagggtacagggtacagacacatacacaatacagtctctgtttttaacaacaatcaaaaagcaagcaatgagaaccagtgataacttctgaagcgctcactgtacaccaggcaccatttaaagcactttccatatattaactctgtgaagtatcaaaacaactttatgaggtaggcactattctcaccctgtttctcaggtgaggaaagtgaggctcaagagtgattaggtgtgtgagctgagaaaccaacacaggtgcctctttatcaactaagatggactctaaggttaaggaaacaacagctgcctatgggtcaggttgagcattcaggggagctggcatggcaactccctaaattcctacagctacaagaaaaacacactcttgtcaaactccctaacaataggagctatcaggcaaattatcagacccttcctaactctgatttacatccacaccactataactctaagtggacagaggactggcctgctaaacattcttttttttgataaagaactgcaaatcttaagtcagtttcagctagctgaaggctgcccgcaaactgtgtccagtagttcaccttttgatgtaaagtgccaagtttcatcttattttaataataaaccccaccccaaagtgtacatgggatgtatgttacatacatgtttacccgttgtgcatgctcttgtctccataaatatgtatgatttttcccctaaacctgctgaatatgtatgatgttggccctgtgaggcataaaacccaacatgtcctttccgtcttcaaagagagagcaccttccagacatgacagagactgtctcttcaaagtttgcaaaccgatgtaaccagtgaggttctccttttgtaatgaagtgcaggctctgctgctcgctgcttgcaaagccagtaacggggacacagggcattgtaaggaaagtgactttatttccgaagccagccatggggaaacatacaggctcacccctctggaaaccacttcaaaactctgggctgagggcaggggtttcaaaaagggaagctggatgtgggaggcatgcaggagctgtgtagggtgcaggggctgtgtgttttgccctgatgccagtcttgagttatggtccacctggagcacagactggtgccatcttgacagtggccaggctgtagatgatccatcttgaggcagtctttaagtgggggagaattctgtagctgcgctctcatgcctggtttgttttaaattagcccctggaatttcttaacaagcacagagttaagtaaatgtgcatggagtaagagagtatatgttagaagacggaagggaatggagcttcaaagtatgtttcaagggtatacttaagactaaggaaaaaaaaaggcttctatagtttttctcaaggttacatcttcagtcttgagaaaagtttttgtttttttttttcttttttgagacagagtctcgatctgtcacccaggctagagtgcagagtgcactgcaacatccgcctcccaggttcaagtgattctcctgcctcagtctcccaagtagctgggactataggcacacgtcaccatgccaggctaatttttgtatttttagtagagacggggtttcaccagtctctaccaggctggtcttgaactcctgaccttgtgatccacctgccttggcctgcaaaagtgctgggattacagtcataagccaccgagcctggccaagaaaaaagttttaaaatgcattttgaagctgagatcctcggttacactttctactatttggccatcctggtggtcttttgaacggcaggtgattttgctcaagatgcagtggaatttgaactgataatgtggctccagagttcaagtgcttgactgctgtattctactgccttccatgagctgtgtgagttaataagggaggcagagaagtaaacagccactttcagtcggaagtcatatacattaggagtgcaggaagcatgggcaagaaggttggaggacatgggggtgggagtcagggtggggatgacaaccactctgaatctaactagaccagcaggaattattaggtgaaatggagaagagaaactcggagggagagaatgtgggagatgagaggttgacatgaccacggagaggaagacatgggtggactggggctggaaccttgaggattttagcaccaactgagtctggatttgtccagacagcaatggggagccatcacagatttttaggctggcatatgcagtggtgcagtcacagctcactacagtctccttctcctggggtcaagtgatcctcccacctcagcctcccgaggagctggaactacaggtgcgtgccaccatgcccagctgattttaccttttttaaaaattttattataaataaatgcatacagtggggccttttccctctaccctcatcttggcttcattttatcacttccttgaacagaagagagcactggggttacatcctgatgagagaatgcctaaatgttctgctccccaaaattcatggtggctgcattcagaggctgtggaggacagcctctcctgcccctgggccatgagagtcctgtcaatcctaccaaagctcccaaagttccaagtgattttgatgtccaaggattgaggaatcctcaaatgacttcttcacatcccaagatagccagacctaggagaatgttttattcatgtattttagaaccgaatccactttgataaattttgaggagaaacagccagagagatcttggcattaaattatgtatcagcgatgctccatcttttccaaggtcaggagagcctctgctaagcattagctgaatgtgtttcttcccccttagcattgccgttgggcagcatggccgtgtaccattatgagtcatgttaagttgggagttaatttcctaatgaatgtggacaaatgggtgaaccttggctcgcttctgactgcatttggatgagatgagagatgcgcctctcaattcgattctctgatagagatgaagacttagtttccttcatttgtccttgctacccttccagaatctggtacttagtagtcgcaaccaagcaggagtatggttggccttctcagaatccatcagccccacctcctcctaccttctttgtatggacaactgaggctcttcatctcaatatcaagtgcaaaagcagtttcaagttcaaggtttctgcaaacacaccctaccccactccacaacccatatactgctcctaagctcctcctatctattatagtaagcataccagagaggttatgagtgtggacaaagatgtattcttagtttttactagctatatgaccttgagcaattagtcctcatatcctcagtcttttcttcatttgtaaaatggggttattgatagtacctccttcatagggttgttatgagaattaaatggattaattttatgtaaaacacttattgtatgtgagctgattgtaagtgctgtgtgagtttgctgctattagtatcactgatgccgatcaggatgacaggtgtagttgaaacaaatcaataccaaacagggaaaagcttgtggcctggaagtcaaatagctgaaagcaagctgtgggtaacagtcaacatgtctgagattgtttttccccaaccactattttcaaatttttattgagtaatatataaatacctcctctgtgtatatatttaaaaagaggctaggtacggtagtagctgggcatggtggcatgtgcctgtagtcccagctgctcaggaggctgaggtgggaggattgcttgagcccaagagttcaaggctgtgggaagctatgatcacaccactgtaccccagcctggaagacagagcaagaccctgactcattaaaaaaaaaattaaataaattgagacaaggcacatgtaacctttgacccctttactcctccagccctaggcccctacctgtccccacagataacctgtgttggtagtttggtccttttttcattcagagctttctctcatacataagcttattcttatacatgaacccagataacatatctggcctattttttgtttatttgttttattgttatttatttataaaaataaatattgtatgcacactgtatgcatctttccatgcttgatttttgcactgaaatatattattaaacatagcaaaactatataatattttaaaaggtctgctatgtggtattccattatagatagatcactgttgatttagccatttctcttttagtagaccttttttttttttttttttttttttttctgagatggagtctcgctctgtcaccgaggctggagtgcagtggtgcaatctcggctcgctgcaacttccgcctcccaggttcaagaaattctcctgtctcagcctcccgagtagctgggattacaggagctcaccaccatgcctggctaatttttgtatttttagtagagacagggtttcaccatcttggccaggctagtcttgaactcctgacctcaggtgatccacccacctcggcctcccaaagtgctgggattacaggcgtgagtcaccgtacccagctaacattttttttttttttcaatacttgctgatgtgaacaagtctgcaacacatcctagttcaagtgttgggtgtttcagtttaataccatggaaaatacacctttttaaaaaattgaatgcacactactacagtaccttctaaagggggtctactataccaatatgtgctcactagcagtgtcccaggctatcagtgtagagctcttctatgtgactatatgacccccagaaatcagctgaactttctggtaaaaagcttctcaccagtgacctaaagttctcccctgatttgtcttcacctccagtttttgctttacagaatccttgagcttgatttgattgtcagagatgaagacggaaatatcttggaccctgataataccagtgtcatcagcttgttccatgcacatgaggaagcaactgataaaatcacagagcgtatcaaagaagaaatggtgagctttactaaataggctttggccaagtgatacaatcatttagcacatcataaacttaaaataatgggctaatgaaccagactgtgtattattcaaggggcatctgtctatgacctgagatgatcagcaaccacatgtgtttaactgtggtttcgtactcaaatctgtaattcattcaacatccatctcacaggtagttaaatggcaggcaagtttcttgatctcttggagcttgtagattccagaaggggaaaagaagaaaggcgataacaaagtaaataaataagtgaaaatattaattccagatgagtgtataaaaggcaatgaaccagggttatgtgaatcaaagtgactcaggagctatgttaaaaggcactgccaggagaggcttctctcaagagtgacatttgagctgacacctgaatcatgtgagggcaccaggcctgggatgatctgggacagggtgttccaggcagagggcacagcaggtgcaaaggccctgaggtaggactgcattctgactattcaaggagtaggaaagccaaacaaggatgaggtgtggtgaacaccaggggagtttaggcaatgatttgcagaggccgggtaggtggagacagatctcaaagggcctgaggggttttggaaaagagttgtgatgttattcccacggatgggaaatcagtgagagatttcaaggaaaggttaacagtctgacttttatttaaaaaaattattttagctactctgtgttatttgaaagcaattttgtttttagatttattaagatataattttcatatagtacatttcactcattttaaattactctttaatgaatcgtaataatatattgtgttggataaacatcgtgacaatcaagataaagaacacttccatcaccctaaaagtttctttgtgctccttctccagccccaagccccgtgcaacccctaatttcctgtcactgtagatttgccttttctagagtttcatataagtggaatcgtgcagtattaattttctgtttgacttttactcagcaagatgtttttgaggtttatgttgttgtgcatattaacattttggtcctttttattactgagtcagtataccactggccagttaccaatggtatatagcattgaccaattattgggcatttgggtaagttttcagttcagagctattatactaatgcaactatgaacatttggaaacaaatccttgtgcggacatgttttaattccttttgggcaatacttagcagtgggattgctggatcatgtgataagtgtatatataactttttaaggtattgccatgctgtttctcaaaatggctgtacaattttttttgtttttttgagacagggtctctcactctatcacccaggctggagtataatggtgtgatcatggctcactgtagcttcgaccccctgggctcaggtgattgttctacctcagcctcccaagtagctgggatcacaggtgcatgccaacatgcctggctaattttttttattttctgtagagatgggttttcactatgttgccgaggctgatcttgaattcctgggctcaaatggtcagcccatctcagccttccaaagtgctgagattacaggtgtgagccaccacgccagcctaattttgcatttctaccagcaatatatgagagctttagttgctctacatcctcgtcaacacttgatatcagactttttaacttagccattctagtggttgtgtagttgtatctcattgtagttttaattttcattttttttgataagtagtaatgttgagtatctctttatgtgcttcctgtcatttccacttgtattttctcttgggaagtgtctggtcaaacattttacccattttaattgggttattttcctcataattagttgtaagagttatttgtatgttctagatacaaattctttgtcagatatgttttgcaagtttctccaaatctgtacctagctgttgcatctttcaaagagcaaaagtttatagttttgaaaaaatccatttaagcaatatttttcttttctagtttgtgctttttatgacactaactttatgaagaagtctgggtcaatggtgacatttcccaagatagaaaaatacaggccaagagagtcaaagcgaattgattcaggttacagaagcttttgatggcagagctggatggaatgcccaaactttaggcttgaacccaatatccttgactatctctctgttgctctaagtggtgctaggctaattttctccatcttctttccttcttccttctgcctttcagtcaaaagaccagccagattatgcaatgtattcccggatctcctcatcccccacccatagcctctatgtgtttgtgagaaactttgtgtgcagaattggggaagatgctgagctcttcatgtctctctacgaccccaacaagcaaacggtcataaggtaggtgtgtccagggttgccctacttctctgactatgggaagcagtgcacagagcatcttttctttccatcctcacttgtggagcaatctccacctggaaaagagactgcacctgagtgagaatgtggaaataacttctttggaggttgtaggagtcaagtggaagtgttatttaccaccagttttttcccacagtggagtttatggttgtagggttttgtaaaatagattttgattgccagaaagcagtcagaaataacaagattcagacaagtagcattggctagaataaaaatatgtacttcttttttgttttgagacagggtctcactctgttgcccaggctggagtgcatgggtgcaatcacggctcgctgtagacttgaactcctaggctcaagtggttctcccacctcagcctcctgagtagctgggactataggcatgtgccaccacacctgcttaatttttaattttttatagaggcagggtcttgctgcattgtccagtctggtgtcgaactcttggcttcgagtgatcctcccaccttggcttcccaaagtgctgggattataggggtgagccactgctacctgccaatatctactttcaaaataggagctaagaaatgaatgctccaaatcctctgtagcagcaataggctaagggtataggctctgagatctgtctgggttcacatctaggccccagcctttactctttcttaacatggggcaggttgttaatgtttcttaagcctgagtttcccatctgcataatgcgagtgctgacctcacagggtcatttgcttcaggctttaatgagaaagagtttgtgatgcacaaggcctggcacatgttgcctgtactgcaaggggcagtggttgttattattactactttaataagttgttcttgggaatggaggaagtgagggaacttctgggtgcctcagctcaaggaagggaaaatactcttgggaatctccagggaagagactttgctgctcctccggctcccactgccagactcctggcctctacttgtggcttagaccatccttcctctcaggcgaccactgcctgtctcctccattggggttttagcccaagacatggtctcatatttgagaccactgaccgtgactgcaggcatgcgccaccacgcccggctaatttttaagtttttgtagaggcacacattagaaaagagctaggacatgatctctctgcctttgtgggaaaaatggataaaatgatgtcttcctggcttgttgttatgatgattaaatgaacgaatacaccatgcctgaggaatagtggtgctttagtaaacagcggcctcctggagacatgcatgaaactggaggggctgtccatctcagaagaatgtgctggggtctgtacattgtctcatctaatcctcatggttccgtgtcactaagatgagaaaatgaggctcagggaagtcaagcaacttgcccaaagtcacaaatatttgtaaacagcagagctgggatttatatacaggcccatctaactccaaagacaagctatttcccacgtaagtctgtcaccaaggaatgagttgtgtcaaatattctaaatggttttcaccagggtttcagcaccattatggtggaaaggtaatttttattatgcaccaaagtccctaacctcaaagagtcagcccaattcacctggcttagccttggtggaccccgataatgagtgtccctggtcccttacgcccaccttgaaatggtttgggagtcagaggcaggggccccttgctgttccctgtcagttactcccaaggttcctgaaaggctcactggctgcagtttcaggagccttagaagcaaccgagaggaaacagtatggggcctatgacacacagcagatctgaaagtgctcactgcctgccacattgacaagggagtgtggtcggctggccccatctcagtgatggatggctggaccagctctgtggagggagaccatgaatcagcgaggtggcagctgtgctccctgccgtgccacctggcaggccatgctcaatggggtgtgcctgagtgacatctctgagagtgctggagacgagggccagcccagggagagtggggatgaacagagagaggaggacaaagggggcagaaaccagcaattgtgaaaagaggagaaagcaaaggaagaagagaagaggcacaatgcaggaaggagggcaggggaatctgggaacactcccaatgtcagtctcactctgaagagctgctctttccctaagcaagaaatctgggctcctgcctgctgtagccaggatcgacatacagtgaacaacaggcaggttaagacatcttcagtgtggcccagatgtggactggggagaatatagctaggatcgatgttttaatgttggactgaatcacggtcagatacccagtagatccctgaagggatcctgtttgggaaatttaatgtaaatttttacaggacaaaagagaagcagttcaggtatcaggctagcagtaaggcttatgcccaaaaattgtgtgatgaggagttggaatagtactcctcgttcctctgagtaggttgtcatttggaggaggtcttacatgtcttggtgctgtgagccttcagattctaccacctagatcttcctgggtgaggatggatgggaccagctcagccctccaaattgttttccttatttatgattgtgcttctcctggaagaaaattgctggtgcttgctgtttagacgtagcaagctgggtcactgaggggcttgctacatatgatggaaggtactggaatatatctaagcatttcactaacaacagtacagaaattaccaatgagaaagcattaaaaataaaaaaaatttgcatggagacttcctagttagtttactgcaaactccactacaatttttagatcttactgaaaaaaacacaaaagatgaaaagatccacttaacttgattgagttttaagcattggttaatctgggactgtgttcatttttgctattggccccattgcctgcttgaactctgctcagtctgctctcattaaccttttaggggtgactggagagagaggaacgaggcatcagagataaaacaagctctaaaaggaagtcaagtccctttaattttgctgaatcccgttatgccttcttaggctaacttgatttttgaatttttaaaaaatcttgttcctaatttaaaataatgggcacttatttagcaccaactatatgctcctaaatggcgtggaaaatctgatgactcaactcagcaaactatattaagcttcttctaacttaaataagtgctagacctctctatcttcctggagtgatgggactgaccagcatgacggctgctaggagatatgagatggcaaaggatcgtacgttagaaccatatagctggtcctcataaaaccctccaatgggtttccattactctcatcatcaaggcaaaaatccttgaatggcctataaagcctatgtggtctggcctctccctctaatttttctcttgtaactttccgttgaatctgtttatttttatttatttattttttgagatggagtctcccttttcacccagactggagtgcagtggcatgacctcagctcactgcaacctccacctcccgggttcaagtgattcttctgcctcagccaccctagtagctgggactacaggcatgtgccaccatgcctggctaattttttatatttttagtagaggcagggtttcaccatgttgcccaagctggtcttgaactcctgaactcaggtgatctgcccaccttggccttgcaaagtgctgggattacaggcatgagccactgtgcccagcccccttgaatctgtttcctagatgcatccagctgtttcctgcctcgtggcctttactcacgttgactttgcctgaagcatttccctttcctaccttcttttcttgaccaactttatttcatgtcatttcctcagcaaagacttccttgaccacccactaggtcaggcccatttgatacacattcatacaacatcctgaacttttcctttatacagcctgactattccttatttgaaacgcttgggaccagaattgttttggatttcagattttctcttggattttggaatatttgcattatatatatctaccagttgagcatctctaatcccaaaatctgaaatctaaaatattctgatgaacatttcctttgagcatcatgttgacacttaaaaattttcaggtttgggagcatttcatatttgggattttcagattaagggtgcttagcctgtagcacaattttatataaatagtgttacaatggcatttaaacagttatttaattgtatcttagataatggctgagaccctatatgacccatcactgtatgacattccattcaaggaaacagctctacattcaaagggtaacttaaaataattcagatctttactcagtcttgaatggggaacgggccggaaagggtaaatatattcttaatgtccaataaaatatactaaagtcctttcccctctcatctctgccattctcaataacctctatcagtatgcagatgctcctcaaaaatattagacagctgtgccagaatttgcttagcagatgggagagggatagtagtggcaaatacgcataggttaatagttctttgctcttgcctgtctaatgtctgtctcccaacacaactgtgatctctcggagggaaggaccatgtctttcttaaacacctgcatacccccagcagccagtatggtgttgggcacatagtagatgcttggtgaatgttttgactaaatggatgtcaggtcccttggcagtaacgggctgccactcttcttcccacagtgagaactacctagtgcgatggggcagccggggcttccctaaggagattgagatgctcaacaatctgaaggtggtcttcacggtgagtgtgcaccctcttctcgttaccgtgctccccaaccacaaaaatgtgaccttggaaatgaggctggtcaggagctcagggtgaagtgtggctgtcctgcagagctgtgttgtgggctccaagcagaaatccaaagctgacaaaggacattgtgtgccttgaggaagctttcggaaagatggatgttcacctctgtttttcctcatctctccctatccgtctcactcctgcacacacagagaacatatgcagaatgctacataaacaagcaccaacttctttgagcaataatgcccaggtgaactgggcacaacagcaattttgattttccggttcattcatgattaacctgagttcctttctttgttcagggctttctgaaaaatctttctaaaatatatcagaaaaaaataggacctttctagaatattgactgccttggtaaattggacattctgaatataattaagtcatagatgactaacgatctggtgggtccttaggatcatccttctaaataccaatactcactgagcaagacatgtacgtagaaatgttgaaatcgattgttatttggatgatttatttctgagagcgaagctggctttttagctctgaataggggaaacaagggaaagaaggagataagtaaaggttataatttttagtagagacccctttctcatcctgtttccataagggtgtgaagagtgtgatttttttttttttttttttgagatggagtctcactctgttgcccaggctggggtgcagtggcaccatctcggctctcaaggagaatctcaagtgattctcctgcctcagcctcctgagtagctggaattacaggtgtgagccacctcacccagcaagtgtgatcttaagacacctaaatatcttagcattgtctgtaagcttctttggggagaacactgtttatgagatttttcactacattgcctgtattagctagggaaattacagagaaggagccagggagggatttgggcattgaccaaacagatgagttggatccaggagtgaccgacatgctagattaacctaccttgctctacaataattttttggttacagcccattaattgcaatgtcttatgttatgttgtgattacattgaggaatagctgattaattttgttattttctttaaaaaatgggccagaggcatggaatgggatcataggtcctaattgcttaggcaaagttttcttggcatatatagatgtgcctccatcctgtttatctgttattagttacaaggaggagcctatttattttctggataaataggagagtcccacaggccttcctgattaaaccacaagacagatgttgcatgagagggagaagaacggggaatcaatcagtggttcattttgcagagaaccaattcatgatgtaaacatgggggaaagagcatcagtaaatttgtgtcacacagcattaatgagaatgtaatcctgccttcatggaattctgcctgggccacacctccgctcctcagaacaagtggagttgagagccttggttgacaggctcaacaggtggatgcttccctctgttaagatgatcagtcttgatctgggggtgtattagttcattcttgcatggctataaagaaatccctgaaactgggtaatttgtaaagaaaagagctttaattggctcatggttcttcaggctgtacgagaagggtgatgttggcatcttctcgacttctgggggggcctcaggaaagttgccatcatggcagaaggcaaagggaaagcaggcttgtcctatgtgaccagagcaggaacaagagacacgggggaggtgctacacacttttaaacaaccaggtcttaggagaactcgctatcatgatgatagcacctttggtgtcatttctcctggtgttaaaccataagaaagcacccccatgatccaatcacctcccatcaggccccacctccagcctggggattacattttaacatgagatttgggtggggacagtgatccagaccatatcagggggcaaggaaggtgatggtgctctcacttcttatatcgatccaagagctagccaatgagtgcctactatgcatgtgctctgtgctaagcactggccatacagcagtgagtgctttcatggtgcagtggggttaaattcagataataaaatgcatgcacaaataaacaagagcaatgtcagaaagcaatccaagcaatgcagataattaaaacagggtgatgtgatggtatgtgactggaagttactttcaactgggtgttgaggtgacgtttaaattagagatgagataagacttggcaagcatgtgtcttgctggccttatttcctccctctctggatgttagctcttcctggtctcctatgttgggggaaggcttccagatctttgagcctctctgagcctctctgagcctggcatgtgggtccagctgactgttgactttccctatgttttgttttatttatttatttatttatttatttttatttatttttttttttgagatggagtcttgctctgtcgccaggctggagtgctgtggtgcaatctcagctcactgcaacctccacctcctgggttcaagcaattcccctgcttcagcctcccaagtagctgagactacaggtacatgctaccacgccccactaattttttgtattttagtatagacggggtttcaccatgttggccaggatggtcttgatctcctgacctcgtgatccacccacctcagcctcccaaagtgctgggattacaggcgtgagccactgctcctggccctttccctctgttttgtaagggtttaccccacaaggctatgtaagaagaaagcagcatatactacgaggttccctaagatttagcccagttttggggtggttgctaacacacaggaaacaagagtgaacaataaaagaagcactaatgagttcctaaatcaggtgatgcttgttaagttccattgccctgcttccccaatactttcgagttttgtaaggccgaagcagaaatgactgggagacaccatagattggagcacaattctgtatgaggattgccagttgacacaccctccagagaatataatgtgaatatagcatttggctattttttacactttaagattctttagtgtggaggtgtgtgtgtgggggtggggtggcgggggggcgctgtccgatgagacagctctaagaggtctgacatcttcctttgagcaagtaaaaaattgttaagagaagaaggtggaatgggggcttacctgggaatcttctaggtttatgtagtatattagtttgctaggcctgccataactatcacagattggttcatgcaaacaagagaaatgtattttctcacaattctggagtctagaagtctgagattaaggtgttggcagggttggtttcttctgaggcctcttgccttggtttgcagatgactgtcttctccctgagtcttcaccgtggtcttctctctgtgtttgtctgtgccctgatatcttcttataaggacaccagtcatactgaccaaacaacctctttttaacttaattacttatttaaagaccctgtttccaaatgcagtcatgttgtgagacactgaagattaggtattcaatatatgaatttggggtgtgtgtgtgggggtgggggagcaattcagccccttcaagtctaggaagctttcaggtaccagggcctctgtcgctctgaaaggcaccaatctaagtatttcaaaaatatggagaatcctaatttgaggagagaaggtattagggatggaggtcattatgaaggaaggaggattcaagttttaaagatggaaaggatgtggatatgtagaggaggaagaggcaagcattggaggggaagtgtgggagcagggtggttaggaagaaagatccagagttggaagtgagcattgtgtgtttatggagcaataaagaaatctttgtgacaaaaataacctacttatattcagagagtcatggggaatcagtgggctaggacagctggatatattatgtctaggtcctttcatgtcaactgggaaagagtagaactaatagggtaggaaatagggagctattaatgttgttggggggaaataaatgaaataatagatgcgatgtctaaagatgaattcataagagatttcaggatggtttggaggaaggagtcaggcaggccagagacaaggctgttccaaccatctggacgtgaaataattgggatctcaaattcaaatgcctgcagaagaaggcaagggatgcagatgatggggtggggggtctttcttagcctgaaaagcagatgtccattcctgcagctggtgggatgaacagcccttgtaccagtcagtgctctctggggaaacagaacccatggaatataagtttgcgatcctaaaggcaggctggcaggctggaaactcaggcaggatttctatactacagtcttgaggcagaattcctccttgtctggcaaacctgtttttgctcttaagaccttcagctggttggatgaggcccacggacattatagaacgtcatctcctttacttagtcagctggttgtagatattaatcaggtctacaaaataccttcatagcaatatccagaccggtgtttgaccaaacagctaggcaccacaacctagccaggttggcatacaaaatttaaccgtcatggtccccaggcaggaaggtgtggaccacactggggccttgccctgttcccagagactctgcacagccccactcccttcctcctataccagcatagtgagaggcaggggatggcagctgtgccttggtcctggatctgatgtgagccgacagcttattcccagtgcatatgcccatatgagaattaactcgaaggagaataaactgttcccttttgagacctggcccagggtactctactctgatgccaacagcatgtcttgttgtttcttccttagctgatccttactggcagggggcctcaagatcactgaagcttttagattcgagcatgaagtcaggagtttcctcctgcatgcctttctgatggcaagggagctgtactgtagtagctatgtttgtggtctttggtgtcagggactgggctcaaagcccagagtctcatgggctatggtcatgaccttggggaagcctcttatcttctttgtgtctcagtttccccatctgtcaaatggggatgcaataattgtatgtacttcagagatgtgagagattgaatatggtgatgcaggaatcacttagcacagtggatgagagtgcgtttcaccagttttggcttttctagactcagttgagctgggtctggtggctcatgtctgtaatcccagcactttcggaggctgatgtgggaggattgcttgagcccaggagtttgaaatcagcctggacaacatagtgagaccccatctcttaaaaaaaaaattaggtaggcatggtggctcatgcctgtagtcccagctactcaagaggctgaggtgggaggattatttgagcctgggagactgaggctgcagtgagctgtgatcatgctactgccctctagcctgtgtgacagagtgaagccctgtctcaaaataaataaaataaataaataaacaaacagatagttgactgcagtttcctgaccccttgaagtcaggtgcggccatatgcctttctttggcaaatgacatgcaagcaaaaagtgatgtgcatctctcttgggtagatgatttaaaagccagaagtgatttgccacattcctttcccctgtggcagagacagtgagcgcacccgtgctgagacagagctgccagccaagggcccagagtaagtaagtaatcagagcccccacccctctgcattggccctgtagactgcaccagaagtaaacttctgctgtgttgtaagcactgagatattggggttgttagcactacctcaacccaactgatggccacactttagatgtgcaggaaatggtagctgttatgatttttttctcttccttttgtcttctctctcagaggttctgagcaatgatgtgaccgatggtgtcatccgagtcatctgtagcaaatgctacttttggatctatcacctcggcatatggggaatcctgtctgtacagctgatattccacctctacccttctcttgccctatcattttgagagggaagaattgggattaaacactagagttttatcactcattttcctttgcaaaccttaccttgcttatctgtgaaatggatgtgagagccttgtttctatcttttccaggacttattgtatgattggtccatgtatagcaagtattatatacatccctcagaaattactattactgggttttcttgtctaccttttttcccccattcagcacatgatggtcaattttttgtttctttccccccaggatcttggaaacaaagacctcaacagggataaaatttacttgatttgtcaaatagtccgggtcggcaagatggatcttaaggatactggtgcaaagaagtgcacgcagggactgaggaggccctttggggtggcaggtaaggggcacactctgcatcattgatttttatgggagcgcacattttatgtggctgaattgtaatgatgatttgtttcccaaccgcctcctgctgcccccacccctgcaaaatttatgccagacagcccttaataactacatttctggtgactaaatcaaaataattggtgactaagtccagatttatgatgaacacagtgaatcatgggctcctcttgtctggagtagagcatcgggagaccggggccgtctgagcagttgacacctttgctccccagctctgtgaaaaaggaaaaacaatacaggcaggatctaattatgaggagcaaatcatttaaaaagtacatctaggacaggaaatgcagttacacagaatgagtcacctaccacacatctaaattccagatggaaacggacatttggagaattggcgtgacctgaggcagagccctgcatgaggctgctgtacagcaacatcagctctgcattcctcttaagctttagctctcctggggtttctaaggcttcgtcattcttgccccacttttatggttttagttatgtttgactaccacttgtactgttatttaccaaatatagtttcttttaatcaacctgctttacataatgtatgtttttcatcaaaggcgatttaaattcctgtgaaaatggcaatttgatatgccagttttctttttattaaaatataaaattttaagagtataccgtgcataacccctatgtaccatagctaacctcagtgtttcaggtttctcacttcaagatgctctgatctgtaatcgcagacctgcttactctccaactagtcccctggcactgcttgcaaagcggtggagtggaggatgttttactgagctcactgttttttttttttttttaacctggcactgcggctagctagccagccagtgatattgggcaagcattttccccagagccttagttttattatgtgcaaaatgaaggactcatacctggttaattcatgaaatcctctactgctctaaaatgctctgattctacttgtgggggcatttctgacatcatggtgtttctgttaaggcagtaaggatccttcaaccttactgcaaagtgtgtctttgtcctcagctgtagcctgccctctcttttggtgtcagatgacagaaatctgatctaaactggtagaagaaggaaaagaaaaggtactttattggtgtaactgaagagcttatgaatagatcgcttcaggcatagctggatccaggaactcaaatcagtttgtctctttcttgctcccatgtcctcatgctggcttactatgaagaatttgtctctttcttgctcagcccctatgtcttcatgctggcttactaagaagatggctgtccaactagttggcaaattatcagccagctgttccaagcttgcatcctaccaacttagcaaccagtggaaagaatgtacctctttcccattagtttcagcagaagccccaggagctttaatataggtcacgtcctcatctccatagtctttactctgggcagggagagatgattatctgatctaccaggtcctatgaataactttggagccaaagggaaattgccctgccctaatcacagccctgaggatggatgaggagagtcagttagagagaatggatgctcggtttctcctcctgtctgctctctgactcccctctctatctagatgcagtcagtggttgattattacccaagcaattttaatggcccctgcccagtgcctggagtgtttgacgtattttctgtaactagggtatgagcttgattggagtagcttttctcagccctctcctacactcccacttctataatccccattctagtgtaggagttctttaccttggttttgggacctttagtggctgatttaaggaaaggtttcagaggatccaggatacctctggaatcacaggatttgaggattcttcagttatgtatctgtacatatgagtatgcttatgaaaagagggtggatatttcatgagattctcagatcctacagagacccaatcactgctgtctggttttgtaggcatggtagacattcaatacatgcatgtcaaatccaaacctaattgctgaattccacagccacggctctgaccctttccttttggcctctgctaagccatggtgctcttggatgcctccctggccctctgacctcccagtctgctttgcctggaggtatttgccctggtgctgcacgcgaggaacctctgctgtctgagtgttgtgcagcactggcttgcttgccattttaggccttcctgacccccaggcatcccaggctctacctcctgtcccataagctcatcccactgtcatcccttatgggaacaggaagaagttaaaccattaattcattctgtcttctttctagttatggatataacagacatcatcaaggggaaagcagagagtgatgaagaaaagcagcacttcattccttttcacccgtaagacatttcccatttctttccattctcttcaaccacaccctttgtcatcaagggctgctggagctcagagggtaccagttccctgagttagtgataggcaggtggagcctcccaagggaagctcagggtgagaatcactggctcagtgcccaggcactcaaaaccaaacagctcttcagccattcattcatcagatgttatttatgccacagacatttattggtggcctggcagaggctggcactgtgctaggtgtggaggatgaagtagtgaacaagatgggccctgtcttcatggagctcatagtatagatggggaattaaacagataatcaacaaaagattaatgcattaattacaagtgcagcagaaaccacgaagctgtgaagcagcagcatttcaggagcgtgtggcagggaatcctaacctggttctcatggatagacgtatccatgacttaggaggagggcaataagggaggtcaatgtcctctcctctcctgttccaaaaggagtcttccagaaagcagggctccagtttgagagcatcatcagtacttaatagccctaaggatggtccaggtaatgaggctagtgactttgctgaaggcgtgtgataacgacttagcaggagcaactcttgctaagcagatatgcatgttgaaagctttggaatcctacctttataagcatcttcctggagaataagaaatggcctctacctgtagcattgatattcccaaatttcagagccacattgctttgtgataaaaagtgaggtacctcttgatggcatgtatataccctgggctgacatatgcaaactcacttttcacctgaggcgtgtggaggggctggggagattcatgggaccccttgaaacgcaaggaggacacgatgtggacatttcatgctctcttttcctttccagggttacagctgagaatgacttcctacacagcctgctgggcaaagtcatagcctccaagggggacagtggagggcaaggtaaagtgccaatatgccagtgggctgagcctgctccagcttgggagcccctaactcttcagcaaatgaatcaaaatcctgaaccctgggatacttagctttccttccagacagaccactgggaagaatgggaacatatgatctacagggataagtcacattttctgaagaaaattggaggcatgtcctggtgcccaaaagcagagaggaattgatacatcctgaatatctccggtgttccgggggcactttaataagttaccttgtttgatttctttcttaatccaggcctgagagataggtgttgtcatcctcactttgggcttagagaagtgggataatttgccagaggctgacaccgctagaaatcattagcgggattcagacccagagatcgcctgttccagaggccctgtgggctgggtggctgcatctgtggctgtatgactctgttcccagtgatctccagaaagacagaggggagaggtggcgggagggccgactgaggggtcacttgcaaaagtgggctcttcacggtgagctgttcctttgcaggcctctgggtgaccatgaagatgctggtgggtgacatcattcagattcgcaaggactatccacacctggtggacaggaccaccgtggtggccaggaagctgggattcccagagatcatcatgccaggtgagacacagctgctctgaccttcccctggggacataggggccaattcagcttgtctaattcattttccttctaaagagtcaactccttccttttttactgcctctctccatttctgtccctgaaggtaacaactaaaaatgatgtctgtatatccaaaaacttctatgcattaacaaaatagacacaagcatgtaaatataaacacataccccttctccccacaaatggggtcatattttatattcctttacttaatatactttatatagtattctacaacttgtttttatcacttaataatttattgtggccatcatttatattttatacatgcagaacagttgcactctttctgggagaatattgtcattctcttatatttttaagctttttttttttatattaccaaaggaatttgtgttcattgtaaaatattcaaatggcctgaaaaggtataaagtgaaatgttaaaagttcctttatatctttgtctccagaagtagccactacatttccaaatgtgtgtataattttaaaaaatgagtttatataatattaaacaaaaattataggagggcattgttttggactaagttcctgcaccagcccccaacaaaccagactgaaaatcaaaatggagtcagctatgctaaagggtcatgtcatcaaacctaaactaaactgttatctgatcttgcaagaaattcggagaggggagagagggcggcgggcgggggcagggagagagagagagagagaaagaaaggaaggaacgaaagaaaagacaagaaaaagaaggagagaaagaaagaaagaaagaaagagaaacagcctattttccagacaggccattttcaattttcaatgggcatgataatgaagttcctgaagtaacctgatgttaacaatcagtcacttttctatttttctgtttccctgtttcagccttatgagggctataactttgaaataaccaattcactctgtcttgcttctacttccttcaggccttctctgtctataaagccaacctcttctgctcagctctttggaatactgattctattttatggaatgaagcattgcccgattctagaattgcaatagagccaagtgaggtcttcaaactaaatttgttgtaattttgtcttttgacaatggtaatactcttttgaaacttctctttgtgtcttaaacctgtgtcttggacttccgttcacgatggctctcactgactggctgtttctttccacatttgtctggcggttgtctcctagggcctgtgctgtcatttatttgtccatgctttacctgagacttcagttacttgtgtaaccccttgtaggattttctattcctttttttttttctttttgtttttttgagatggggtttagctctgttacttaggctggagtgcagagtacagtggtttgacctcagctcactgcagcctctgcctcccaggctcaagcaatcctcctacctcagcctcctgagcagttgggaccacaggcatgtgccaccacactcggctaatttttttgtattttttgatacagacagggttttgccatgtttcccaggctggttttgaactcctgagctcaggcgatctgcccgctttggcctcccaaagtgctgggattacaggcatgagctacctgtgtctggcagattttctatttttcttacctcccttcctgaagatcctctgcagctccctcctaaccctgtgtccctaggacacatggaaagttgctctattctgctcctacacagtgaaatatcggcagatgtatatgtttggttgttttcatgggacaggatcaattcaattggagctttcctttgccttcccagaaggtgtcactagaggatgaaaattaaatgacttttaatgtcgagaaaaacatggccaattttgagtgtccctacttccctttttgcaactgatttcctagcatcccttcatccccgtgttacctacttctccagcctccctgatgagggaaaaatgctttctctaagcaattctgattttaattaataccaatccaggtgggagagcttcttctcaccctccatcccctctagttagtcagcgtctctcctgctgtaatccacactaactcttgtctctctctccctctgcctcaggggatgtcaggaacgacatctacattactctcttacaaggtgactttgacaagtacaacaagaccacacagaggaatgtggaagtcatcatgtgtgtgtgcgcggaggatggcaaaacgctgcctgtaagggactcactgctgctctgggtgacagggtccgccttgggggcctctgcttgtaaagacgtacttttcctctccctgattctgttgtctaaatgccaggtgcctttgggatggtgttgaataatgtgttcaacaccttttgagcttggttagtgcagtgttccataataagaccttgtgatatttccttacaccaaagcagtttttcaatgtctgttcctttcctttcacaacttcttcttgtatgtatgtatgtatgtatgtatgtatttatttatttatttacttttgcttggtctcagcttataggttagctttctgcagttaaaatgttctcactgaaacctgagctggtttattcaggcaaagtccatggtaagaaagaggatcaatacagtgccttgggctggtgtggaggctcaggatgtgcttaaagcaggcattctcaacacttaatctaactccccagcgctcagccagaaatgctggtggaaagccttattcgtaaattggtctccagagagctagcagggtgtattcaggaatgcaaagcgcattgctatatttatacagcatatgtcctgtccaatatttgtcatgtgtgtttatatttatttgcttgtattttctttaaggttgtcagtgctgtgtccagtgtgtaggagggttttgtttctcagttcctcctgacagagtagttagctgaaaagaaaatcagctctcaggagaaattttagcatgggcgaatattcctcttaggccactgtgagtgatcaaatagccaagcagggcgggtgtgttcatcagagaggggatgtgaagatggaagaggcatcatttttgtccttggggcctggagatcagactgatactttgtacccaagaataactaacattcacaggggaattaccatgtgtcaggctgtgtgatagtatgacacatttcctttattatgccccattttacagatagggaaacaaaacccgtgtcacttacagtaactcgcccaaagccataatgttagcatatgtcagagatggggtttgactggttccaggccctctgagacacttcactacaatgcccgtacatgtagcaaaattctccaatttatttctcattttaaaaaatgaggctaataaccactgctggcaaatttgggaagattcataatcgttttttaaatgtaaagaaatcctcacaattgcctttttgttcataaagactggtcatgttaattagtatctatttgaacaaaatctaagcattgaacgcatcctccttttgttgcagtctgaaactttttccaaaaaataaaataagtgagaaatacttgactcaaaggaacataaaggagcggagggtttttatctgaaagggaaattgcaattcccaaatgtagagaccattgctttgaagttacttttatccaacttccctggtagagaactttttaacctcagcttcatttttgaaacattgatacgcttaccttccatgttgccaaaggacaaattaaaagacacagttaacaggcaagcagccatcttatctcctgtctgagccactctttcttccacttttgtcaccctttcaagtcactaccgagcaggctgagcagatgcacttatccaagatgagtaggtaagcaggtattctgggggctgacatggaaagggaactgtggggcatggtgatgatttgtggtttcctctattagggaaattctgggggagttcagttgactgactattgaaaattgcttaggaagcctgtgggaggcttttctttctctatttgtagaaataaatattactgcctaattaagtgtcagtcagtacattcaaacacttctgtttgatattggtgggctcctgtggaaatggtcccctttagaaatattgatttctcctcctgctctaggtgcatgcacactgtctttggcagagcaggaccagagggcagaggaggttaggcctgctcatggctcaccttggggtgtcaagggccttgctcaggaggggtcatagcagagaagctaatggggtgggctctggggtcaggcagacagggttcaaattccagcctcccctcatattagctgtgtgatcttaggcaagtttattcatgtgtaaaaagaaataataacctcttctcgtggggttgcaggttaaacaaaagagtaggtattaaaacaactaaaagagtatgattggattgtttataacacaaaggataaatgcttgaggacatggatccccatcttccatgatgtgatttttatgcattgtatgcctctatcaaaacatctcatttactccatatatatgtgtgtgtgtgtgtgtgtgtgtgtgtgtgtgtgtgtgtgtgtgtgtatgtgtatgcacacactatgtgcccacaaaaattaaaaattttaaaattaaaaaattttaaaaataaacatgctgctgggcacagcggctcacacctgtaatcccagcactttgggaggccaaggggggcagatcacttgaggtcaggagtttgagaccagcctggccaagaaggtgaaaccttgtctttactgaaaatacaaaaattagctgagtgtggtggcaagcacctgtaatcccagctactcaggaggctgaggcacgagaattgcttgaaccctggaggcagaggttgcagtgagctgagatcgcaccccagccactccagcctggccgacaaagtgagaccctttctcaacaaacagacaaaacacgccataggtataaggcacctggtattgcagtaagtacccagcaacaggaaggagggtcacattcagagaagaggaccaagtgcagggtgaagccctctgagggacctgagggagtcaaacaggcaatccagccagaagcaaattctggtgaaagagaaaggcttagatgctgggccaagaaacctctgtttttctgagaccacccaacttgaggcggtggaggcaggggataggggaagtatgggatagtggttaagaccatgacccctggggccagacagccaggtgcaaagcccagctctgcctgaattagtaagaggatgttgaggcagttacataacctctctaagcctgagagtctctgtctgaaaataggaccagcaatggcactttgctcttgtgaatatcagatgaggtaatctacataataggtgtgcattaaatttagctattattattagaagggtatactgagctcccagcctgattcctaccttaggcatgctaatcgacatcccatgatgtggtcttgtgagaggagaacactgtctttcctaaagtgtgttcacatccctggtgtcatctctttctcacctgattcctaccaagtaaacaggacatgtgttaggagcctggtttttcttcctgcagagatgtttcttctaaggccaagccaacatgaaagcctccaggcttcctgatccatactcagattttcttcaactgacctgaagtctcccacacctatgaggggctctcactgttaattgggggccatggggataggcaatgtagaaaattatggaacagtgttatttgagatatataccagtgtatattttccctagaactgggctcagtccctggtcacaatgctctctcagtgcacttcccaacactgttatttctctgaagtgctgaggcctatggcactatctttggcttttctctgactggtactgagacttttttctccagccttaggaaatcaaaaattttcatcatcagtacagttttgtgagatccagttgcctgccatgcggcagttttactttcaccagagatatatgtgtagtttctgatttggtaagctacatgggatttactgtaactacagaaactctaagcccataaatgtcaacagatataaatctttgtaggctggaaggcatctaggttcttatagaaggaacactggatgagtatttagagggtctgtgatgttgtcctggctttgccactttttgggcaagtggtttaatctctcagggactcaggtcacccagctgtgaaatggggatgctgacagtaagcatcagaggtggctatgaggactgaattaagcgaggtggtgtgtgtgcagggcttagtgtgatgctggacacaaagcccactctaaatggttagaaagactttggaagcatgtttttagctcagtgcctcgggaagttctggaaggcttcatcccatggaaaaacaaggagagctgtgtgtcttcactcagttctggttcattggttacacttgtttttcttttaaagatacattctgaaaggactgctgtgtattctgttttcaaatggatcgatttggctgcaagtactgtcagtcaatattgaaactgagctcattccttttccatacctcggaagcacaaggggagatttccagtgtgaagggcgagtcttcctttccccaggttagcatggttggccagggctcacggagtgcctgtatgtggccagctttggtgattcagcctgctgaaggtcaaggacccacgggagaatctgattgaatctcatgagaggcatgactcgctcaccatcaacatgccgagaggcacacagtttgcaatttcaggggctggggctccaaaaccaaatcttatgaatctggcaatttgaggattgaaaattgtttggcctaatataaaaaccacacttcgggccccttctgggtaatcctagcttggatcttgtttgggggccaaacggctggaatgaccatagaagtaggcattgttgtatgtgaccaggaggtcattccttgtgagtcagctcctttctgaacctctgagggtgatttttatggcaaggaataaatgtcccacttggacatgtgtgctctgtgctcactctctgctcagaaagcccctcccacatttctgctgtgtgccaacttggaaactttcttcaagattctcaactgtcattgcctccaacaaatcttccctgattcctcacctgtccttgtgtccttcctctgtgcccaacagtagtgtgtacacatgtctgtcatcacgttgccttgctgtcatgacgtgttccctaatgtttcctgcacaaaactgtgagctcacgtcaggttcaatgtctgacccattcctataccccagtgcacagcatggagtaccaagaagatgtttccattattgtgacctgaactgagcctcctccccggaaccccctcaccccagacttgttctttaaggcaggtgctcatgtgtctctctgaagcctgtgctctctccttttgtccagcactgcccaccgccctgacgtgttagctgtagaaattcatcgcaaagagttgctgcttggctgatctgagcctgttagtaaactttctgcacattcacatttaggaaacaaataggattaataagactggcagtgtgcagtaactccaaggctggttgtcacttacagtaaggcagccacatcaatgccctggtgcactccagtggtttccagaatggaagtaatggaatttctgtagttaagtgcctgtcagtcctgtggctggggcactcctgtgtaaatctgtaatagagaaggagccattatgggcacctggcatgagggctagggaaggcagggttggcccaggccctaaggctggtcgtggcctagggaccaaacctgcacaagcacagaaaatgacaattctgtagtcttttccctcactttgtttttcttgggtcagaatgcaatttgcgtgggagcaggggacaagcccatgaatgagtatcgctccgttgtgtactatcaagtcaaacagccacgctggatggaaacagtcaaggtaataattaataatagcagcaaacacatgtctagttcttaccatgaaccaggcactgttttaagtgctttatttaaataatttatgtattgcttacaacagccgtgtgaggtttgtactaatatttccttcattttatagttgaggaaactggcactgaacagggaagtagcctgaccacgaccacgctgctaggaaatatcagagctgggattcaaacctgagcagtctggctctgggtctgtgctcatccccgcaagctgagggagcagaatactgactggaacaattagcattcttcttttttttttttttgagacagagtctcactctgttgcccaggctggagtgtagttttaccatctctgctcactgcaaccactgtctcccaggttctagtgattctcctgtctcagccccctgagtagttgggattacaagcgtgtgccaccacaccaggctaatttttgtgtttttagtagaaatggggtttcaccttgtaggccaggctggtctcaaactcctgatctcaagtgatctgcccaccttggcctcccaaagtactgggattatgggcatgagccaccacacccagccttcttccttttaatgagagcagttgagcaaggcagttctgtgcatagaccctaggcccagagagtctgggttcgtattccagccctaatgctcaccaatggtgtgaccttgggcaagtcattcacctgctctgtgccctggtttcctcacctgtaaaatgggagcaataggttgactgtggaagtaaaaggacttaatacacataatactgtcagacaagtccttggaagagagtacttattcaattaatacaactcttgattatacttggcagttatctcagtctgcaaaattgaactagattttgcattccttcaagatgcccttcaaacacttgacccttgcctgttttttaaccacccctctacaggcagtctaattggtagtggcaggcagctttgtgcctctctgtgtagttgtggggagaaggcagagggaaggtatagttgttccagatatctgttgcagtctccctccaggtccttctcatatggcatctccccgcaaaatgttttgtggaatactaagtggtgttttattaaaataacgttttaggccaggtgcagtggctcatgcctgtaatcccagcactatgagaggctgaggcaggtggatgacctgaggtcacgagctcgagaccagcctgggcaacatggtgaaactctgtctctactaaaaataaatacatacatacatacatacataaatgagtcgtgcatggtgtcatgtgcctatagttccagctactcaggaggctgaggcatgacaatcacttgaacctgggaggcggaggttgcagtgagctgagattgcaccactgcactccagcctaggtgacagtgcgagactccttctcagaaaaaaaaaaattcatacgttaaatgtattaaaataacatttcctggtcaaatgtgagaaacttgagaacaaatatagaagttaaaggcttccttatgtcaagttcttagagcccttgagatgtaaatgtgctctgcagacctgcaaaaggaaataagaatgcagagcacgtcccaaaactcgttgactaccgagcattttcctttttcctagtgtcatatcctggggctaggattctgttgaacatattttagaaattctttgttttagccaaagcaggtgggaggcttgatggatcaatgtgattgtgaacaacatatgagaatatattatgtttctcttcatgaaatatctaactcaattctgaggccagtcatgaacatactggagggacatagagtgacagaaaaacttctttagctctagtttatagcagaagtcaccatctgtaagagcttagggtccttggaggcacctctctgaatctgaaatgaccccctagcatgtgtctggtggtattgtcagccagtggaaatggaggccaggtgggtgagcaccctggttcccttgatcacccttccttggtgcaggatgtaaccaaagtggaattgtcaaatagtcctcttgtgggtggtgcccagttcatcaagctgcaccattctactcagcaatgaggagtgacagagcttgcaagccaatgtgagcctatcacaggctgtataatgcctgaaagatgcccttttggaataattccttgacagaagtgacattaactacaaatattacattaccagatcgtcacactaagcagaaaggaataacctgcattggaataaggatttggaattaattcagtgaacactgcagcttgatcatagcttcagatatctctgccttatcattagcagcattctttattccccccgggctctgactccaaacacaagatgcacacttgacttccttttcagtgagagctattcaaaccccagcggttctccacttattacacatattattactttgctcagtgtgtctccccatacccaatgccttcgaattgatgacccggtcaactctgtggtcagaaagttaatgtaccaggtcaggtttcccttctctgttctctcttgcacctcagttgtatctccttgctagcccttgtcacagggctgttacacattgccccatgtgtaacacggaacaatgagctctttgagtgtgaggactctgccttgtatcagcatggccagcaccccacatgattgtagcttctagtgaacattcaacactcagggaaagaatgaattggctgcagttacccatgagaccctcagttcctttgctctgcctgaaacatagacaggatggtggacctcctcaggctcaagcctcattttctgcaacagaaagtgcccccaagtatacatttgttttggcgtttaataggcatctgtacagtacaaatgtattcctttttaaaatcagtgtccttctctcaggtagctaaccttctccgcattggcctgaatctcagattgcagaggagctgtgagactttgggaggtgggcagcacagagccaggctgaaagcatcacaatcagtggtaccagtgggtcattcactggacagggatgcctgggtgaccagtgggttgttgtcttagctcagtgtccttggaatcaaaaacatctggacatgtgtctgatcaagggtgagatgagccctaggatttttccaaatattattggattaaagcatttttattaatttgcataaatgagattcctcaagcaaaccccctaacaaccattgttaatttgctaagccctgctgcaattgccagaactcctggagtgtgtaaggaaaatgtgcattgtgcagtttgcagtgcatcaaatcctgtgctaaagttatgtgacttttatatcaatttggggagactcatttttcctcactataatttacagacctcttttcattggctgggaatgcaatttgccaaatggattacatttggtactttattttctcttcatagctagttcttctgtaatttatttacagttcatcagcctcaatggatgggttgtaaatcagcaggcagctctctcagttaaatggtcaggctgctgtggaagtgtgtaggggggtgcagtggggagggccctttaactcattgtgttctgagctctgtttctgtctgctgaggtggctgtccctattgaagacatgcagaggatccatctgcgattcatgtttcgacatcggtcatctctggaatgtgagtaccatactgaatggcatctctgcacctccccctaaggggagaagaatggaagagctgggtggcccatgtatcattttctttcctgaccccacaatgctatttccagctaaagataaaggagaaaagaactttgccatgtcctatgtgaagctgatgaaagaagatgggactactctacacgatggattccatgacttagttgtcctcaaggtaccatgagttggaaggagctctgcactgaggggagtgcaggaagaaagggggtgatggcaaaattgcttagtggtcaacagcagggaccccagaatcacacacaccagagtttaccaactttgtggcctcttataaactcttgacttctctgggcctctgtttcctcatctttgtgccctcagtgaatatttgtgaaaattatgagacagtggatgtaaacatagcaatgatgagtacatggaagaactcaatacatggaaaaggttattgttatttacagaaaggttattgttaatgactgttatatactcttgactctgtagggacctctgtggcatgtgtagaggatgtacaataaacatttgagagatgctgcattgtagctaatgggaaaatattaaaacctgcagtcctgatcctgctgctgactaagcctggactcatctcacatattttcctgagtctcagtttcttttttcttaagcagttgtggcaatatttatgacaacccactaggatgacccatgaaaaatggccatctaaactataaagggagtgcagatgtccactatttttatttttacattatgagacttggactgtttttgagacatggaggagcatttgtctggtttttacctgctgcttttccacatgtcctcttatgacaacagaatgcatctactagcacctggctggaggcaagtgtatggctgtgaggtggagcaaggttgagtagccagcacatggatcacacccttgcccttggctttcttagccttgtaggctgaaattgcccttttgcctgtgggatgcatggcaaacacagcctcgtcaaggcttcatctcatagtactcttgtactcttctctgagtctctctgacttttccagaaaaccccctttcttctgtacagcctctgttttctcatttatcacacatagaattcttggcttgaaagcccttcttccctgacagaatgtgaactccttggggtcagaggcctagttgcagtcaattttcttttacttacccccattaggtcccagtttccttgactgaggataataacagtgtctgcttcatatgtttgttatgaggcttaaatgaaatgaaccaagacatataaaacacttggtttcactcctggtgcggagtaagataaatgttatcttctgtaatgcctacctctagtcattcattttaacatgccactcatttatgtgtgtatcactctgctatgtattctatatgcattattccatattatctgctcaggtattctaggaagtagggatgatgattgtcttcagtttactaatgaaaaaaaaaatgagacacaaagaggcaaaatagtgtattcaagatagcatagacctgtgaatggcaaaacagggtccagatcccagcacactcttacttagtgcctttgccattaaattcctctttaagctagagtccttattttgctggtgagcagatattatggtctcaaaaaaaggatgaattaaaatgtactgtctgggaattttcaattccgtttttattttgccattaatgaggttcacagagctttcacctggtggatcaaccccctttctattaatgtgtctttgaattcttacctgtattgtggaaaaacagtcctgcctcaccagccaatgtctattgcttctctgatgattttcttcactctttatgactctccccacttcacagtgtctaatttgtctgctgcaggctctgtgtggcattgggcatggagccttggcttggggcagtaaccaagtgttgtttccagggggacagcaagaagatggaggatgccagcgcatacctgacccttccttcttatcgacaccatgtggaaaacaagggggccacgctgagcaggagctccagcagtgttggggggctttctgtcagctcccgggatgtgttctccatttccaccctggtgtgctccacaaagctcactcagaatggtaatcgggtcatcaagagttgtgtctgtggggagtgtgtgtgtccgtgtgtgtgtacatgtgtgtatgtgcttgcagacccaaggaggtcctgatatggacagttaggccagtaatgatacttctgaatgtctggactctattttagtgggcttgctgggtttgctgaagtggcgtatgaagcctcaactgctacaggagaatttagaaaagttgaagattgtggatggagaggaagtggtgaaggtcagtggggcttcattttgattgtattcttacactagtgacagaactctccatgtgggtggcttcaggggaaaaacaaggtattgaaggacatggggaaacttttcttccaacagtaggatacactctcccgagttgccttgaggaatctttattgggaaatccaggggagtgacttggttcaatggcactgaatgttgggtgccagaaaacaatggttatgctcaatctctggaaatagatgagcctgggtgtaaatcccagctctcccacatgccaactttatgtgataatataaaagtgacatagttctcagggctgttatgagcattcaaggtgataatatttaaaacttactcaacagtctcttacacatagtacacaacaattaaaccaaagcatataaaacaaagttcaataaatggtaattattatttttgttgtcatatgttgatatatatgtatatgcatatatatgtatgtatgtgtgtgagcatatatatgtgtgcatatgtatatatacatatatatatagtagtatgatctgttagtactacccacagatcattgttagaaataaaaagtattcttggtttctgctgcttggagagcattatgtattaaagacgggaaagggaaagacatcagggcttacattttaagtgaaataagcagaaaacaatgcaaatgtcagatgtattattgcatccacatggtagtggagaatagaaagcgtctgaagtgcaaatctaattaaagcaacccttctctccagccttatgaattgggacaagtgtttcccaatggtcctggagatcttgtttccttgatacagctagaaattctgagattaaacatctttatatggtagctctgtgttttgagggattataggaaatattgacccatcccttaggagggaggaaaatcaagttttatttaattgcctctacctggagaagcagtggcagaatttccagatgccgtaaatgtataccactgacccatctacctcgttcagcaatggcagagtaactccccaagacaccactttaataaagtctatagccttttggtagcttggagaagtcatggaagagatgaggcttttgttgtcttcctcttgcattcttttttctttttttttttttaaaaaagtttgttatttaaatatgatatacatatgatgaaatagatacagagcagttatcttaagagtatagcataatggatttttacacacgtaaacaccatgtgtactcaccacccagaagaggatacagaccacttttagcattatagtagattccctcataccccttctcagccagtagtcccccggggtaatcactgtcctgacaaccatcattgtagatgggtttttgcctactctcaaatttcataagaatggaatagtgaagagtgtactttctgtgcctgatgtattttactgcatataatgcttgtgagaatcatcctcatttctgcctgtggaagtagtttgcactttagtccagctgtgtagtattctctagtgtgaacatgccaccatctgtgcatccattctgctgttgatgggcagttgggttcctccaacttctggctctcgtgagtaaaactactctagacgttttgagcatgacatgtggtggatgtgtgctctcattctcttatagatagttaggagtgggattgctggttcacctgtactttgtcttgtttctgaagtagtgcaacctttgttatttcttccagtttctccaggatactctggatgccctcttcaacatcatgatggagcattctcaaagtgatgaatatgacatcctcgtctttgatgccttggtaagagagaggggaaaagtgtctagtgacaacaggcattaatgtatgtcttactgtgaaaatactgagaactcatggccctcatggccctcatggcctttttcatgaattctttggaggtgttgtaatgtttggcaacaagaccaataatgagctgctatttccttttgcttcttgccagttcatttgaaagcatgaggcattgtgggtgaaaggggaattttaaatgctgatgtcagattgacactggctgaaggtacatgaggctggatattgtgaatgattgcttctgctttctatgaatgttgggagctagtccctggctaggttgtaaagcaccaaaaatgtttcttagctttcctttcaccttcttctccccatttcctccaactcactaatcattacatttctcctacccacccagaacttttcatgatgctgtaccatccagatcttccttcttttagtcctcccctatggtctttttgtcctctccctatctcgactcagattttctcagtgttatgtcaaaataaacacaagaaacatctgcattagggaatcagtgcccaacaaagtttttaagtgttaaccccttgtgtcatggatatttgcatttttaaagaggttactgagagacaactgtggcttaatcaagtgcttccccagagagtaccctagaatgctagctctcagaaaagatgtttcatgacaaatatatactttgattaattaatttagggaagtgttgaatgttgcatgacccttttagagattcacaatgtacataagtatattaaagattctaaaaagttttgcaataagaaagtctaataatgataacctgacatttctcaaaacctatttgaccatgaaatccttttcatcttataacaccccacagcacacttcatgaaacattttctttgggaagatgctaccttaataaagagaactcattatgtattagtgagctaattcctgggcaaaggattttaatgggggttgaattatgccaggtaaagatggcttcctgccctgggtttgccctgaaaatactgctgccttgcatcttcctcagatttacataataggactcattgcagaccggaaatttcagcatttcaacaccgttctggaggcttacatccaacagcatttcagtgcgaccttggcttacaagtaagtaattgtgcacatgggaacttcttctctaccaccctcttgccctgccaggatgcctagggcacaggaacttgagtaattttcttttgtgactcatctgtgtgagctctccattctctaacaaaatctaacctatgcttgggttatttggatatcattaaaaatgtggaatacccataggtttggatgaatgccttatggttgcagtggtacctggaagtgctcattcatccattcagctagcgtgctctcatttcttgagtggacaccaggacttaaaggctacagagaagaccaggtgtggtggctcacgcctgtaatcccaggactttgggaggctgagataggtggatcacctgaggtcaggagttggagaccagcctggccaacatggtgaaaccctgtctctactaaaaatacaaaaattagctgagcatggtggtgggagcctgtaatcccagctactcgggaggctgaggcaggagaatcacttgaaccctggaggtggagattgcattgtgcagagatcacaccactgcactccagcctgggtgacagtaagactcatctcaaaaacaaaacaaaacaaaacaaaacaaaaacagcgggggagctacacagaagaaagtgcacatgccaagtagctcagtctggtttgggtgtagggagagggtgagagataggagatgatgccacagggagtttggtggggaccagtttgtgaaggggccttgaaagtcaggccaagtaatttgaagtctgccctatggtaaagaagaaacatagaaagttcctaagcaaacttagagttctgtgatattacaagagcatgttctatagaaagaaaaagttgaaaaaaaagacattattgccaccattattccccattattcccacttgtagcctgattgtgactagttctcctagtcaaaagatttttttttcctccctatctttttctttgctggctttttatgagcaggaaatacttattaattccctgtaataaatataatttttatgcagagttatctttatgcttacaaatgagtaagtgagcttggctctactaccacctttaacctttgattgaatgccttataatttactgagcaaactaattaccatgatgaaagagatgtattttgaaaatattatcccttattcaggaaattgatgacagtgctgaagacttacttggatacctccagcagaggggagcaatgtgagccaatcctaagaacgctgaaggctttggaatatgtgttcaagttcattgttcggtcgaggacattattttcacagtgagtacttgttatgtaagagtgattgattagctctgcaattcctctgggatacaacagtatttttactgtaggagaaactcgtttaaaaaattataaccagctgtcgatcaaaaacagctcaagaatccaacctagagagtaatgaatatgtaataattgtaccctctaagttcatttgggaaaaaaaagaaatcttaacaggttgcagagttatgtttaaccagtaaatgtgatttgaggctcttctgtgtttcatctaacattcttcatttgatttgaaatatggtgaacattttccagcaatctatatccaatgttagagggcctgggagcaggaagggcagaactcagggagtctgacatttacttggctcttgtaggttgtacatggccaataagctggtatttgcagttgacctgtctgtccttgagatcctagtagccaaaaagtgagctgatgtattagagtaccttagaagattttgatggtcagtatcacagaggccagctgcctttttgaagggctttggagaggaaggtattcaaatgcaatttatagaagaacaattcatgttcatcttggccatagggcaaagttaggtagaggattgtttgtgtgtaatcaggttggttgtgtgtgatggaaaataagaaaaacattcaaggaaagtattgtctggattcttagtgcaaacaaagaacacgcaactgaaactgacttagggagaaatgagactttatttcacatcattgaaaaaccaagggtgtagtcggcctcaggcatggctgagtccagatgctcagcgttattgggatagtctctgtctgtctagatctggactctgctttctttttgttgattgtcttataaggcaagttttccgacgcagaggctgctagaatcctcaagtttacattctaccagtggaagcaactctatgttccttgttgtcctagcaaaaccctatgccaagaactgttttgggtcttgtatagttgtggtcatgtgtgcattactggagtcatagccaggtcagccacttatggtgtggacttgttattttagagatgagttctcaaaagaaacttgaattagcctgggcaacaaagcaagactctgactcttaaaaaaaaaaaaaagaccatcattgtgattgtgatcatgacaatggatgggctgctaaagctttatatttgacagtgcatctgaaacaggcaatcatttgggattctcttaacacattctttgagatttcaggttatgaatagaaagatgtgagtgtcttgaaccatgcgacagaacaaatgcacttaggtcattctgaaagtgaagtgtctgtttcagattcctctggcttgtcatttagtcaagtctgagtcgggtattctaggtttgagagatacttctcagtgatttgggaaaaccaatgagactccagtgaatctaagagtgattttcttggaggagttcaagaattcagacattgcagttacagcttaaaagtcaaggatatcttatcccatcttccaagtgagaatgttttatgtataagtagaatatgtcttttctacttctcagaccttttcagttcttccttttggtgtatttattttattgcttctcctctctcctatatttctttccttttccatcccttcctccctccctttcttccttccttccttccattttttccttccattttcaaggattgagcttctttacaaagcctcttgcagtgcctgaagctcagacaaccagctgcgctaatcctcaagggttctgagcttgtggaattatacagagtttggagcaggctgagcttccctgttccatgagatggacactgagcggctccccttcctactggaaggcacatggagatgagactgcagagcttctgttaagataactctcttatttatttattaattttgagacagagtcttgctctgtcactagagcaatggcgcaatcacggctagagggcaatggcacaatcatggctcactgcgatctccgcctcccaccttcaactgattctcctgcctcagcctcccaagtagttgggattacaggcacgcatcaccacacccagctaattttttagtagagacggggtttcaccatgttggccaggatggtcttgatctcctgatctcgtgatctgcccacctcggcctcccaaagtgctgggattacaggcgtgagccactgcgcccagccagtataactctctcatgtcttacgtctgttagtttttgtgttttccatctactgggacaaaatacatttgtgcatttgttttgctcttctctgcctcaaggcatataatcttgcagaacccctaactctttaactggtgtaaattcagtgctgctgtgacgtaaatgctaagtgacttttggcttattcaggagcagggtgatctgttattccttgctgtatccctagaatagcagcacatcactgacatttggtcaggagaggtctctaaagcaacccaagcctaatcttgaatccttcctcatgaacagaaatgtaggctgacctgcaaagacggtctaggacctcatgctaggagaaggtaggttttgtgtcttgttctttttagaatctttagcaatgatctgctctccagtggagtctctagggcattgggaagctattggggtatttctccatacgagggggcatcttctgtgggaaactagaaaacagaagtttcaatgctttgagatgtctaacccagctgttgggaaatcagaattgaattattggtttggggctaattgtatctggtattgtgtgtctgtttcctgtgaatcctttattctctttccctgcttgcataactgcagcggatctagctcccattatttgttcccttgccattattttttgcacatcctgcccaggaacacttgcaagggctaaggattttcctgtgtcagtatgcaacgtatagttgggtaaggaaagaagagtcgttgtggagaaggggtggaatttttattttactatattgttcagaaggattcatttttatctatagccaaagaaagaagagagtgagttccttgtccctcgcttcttgtgtcactagctcctgagtcaaagtctggatcaagtgtctctgattaggcacatgccagtgctgtagctgcaaaggaagctggcagagcaggttctagcttctgccacagggaggcagtcttatgagtaattcctaaattataggaagtgtgtctgaaagatgctggtggccataaatatgtccaatatccactaggcttttgtagaatgactgagctcctgggaggtattgagcattgtaaggaacattcagaaagagttgaagtgataatcttctacgattcagcttctttacaaagccccttgcagtgcctttaatcctgaagctcagacaaccagctgtgcagatgcccaaggtttctgagcttgtggaattacacaaagtttggagcagaccatgcttccctgttccatgtgatggacactaagcagctccctgtcctactggcaggcacagagaatcagactgcagagttaggataactctctaaaagggagaggaaccagaacactgtgctgcaacaggagttgctcccacttgtctctgctcctcacagatcctcatgctgccccaggctagagtgcaaggggcagcatggagtaagagttatgaggagatgttcatgcaggacagacaatgggtatagtggtatctctgcctctataagtacctgggttagtgattgaatcagcctctctgagcctcagcatcctcatctataaatggggataaaccagttcattgtgtttcaatgatgaaatgagattatgggtacaaagtgctccatgcaatatctggtacttatttcataaatttaataaatgttagctggtatcatgttttcacttaggagaaacagcaagggtgcttttttcaaaaactcagatttaaattattaagaagaaattccagggtcttgattcaagcttaaaatttgacttactactcatactatcctaaacatttcttacagtttatttctctggaggcagggataacttttaccaggtgtctgtgctttttgaggaccacaatgtggtactctcctggccccaggaattcacgctggtctactgctagccctcactgggtggtcctgattctgtgtgttgctcttatttcctctgtgagtgtgatcaggcccctctggccagagcagctgtggtgcccgggtctctggcccctgcttgctatgcctgcttttctttgcatcctgccttctgctcttattacagacctgcttatttgggtcttgcttccttccccatctccatttaaccctgatctcctgcttccacaaactcctccttcaccagccccagctccagctcatttgcttatgagaaactgccagctcagaggtgaaaggcacagtctccaaagccaagtctgcttgggtgtgaattctgagttggaatcttgccattacatttactagcatttacaaccttggacaaattatttaatctgcctaaagctcaatttcctcatatgtaacacggtcataatagtacctaccatacagggttggtgtacagactaagtgagcccaatggatgtaaggtacttacttagcacagtgctggtcacatagccagtatacatggttattcacttatcatcttcagcagtcttcacaaaaattctacggaggaccccattttctgactttatctcctgctactcctcactcactttgtgccaaccacactggacttgctgtggctcaagctccttccttccttgaagacctttgcacccttccccagatccatttgttaactccctcaccatttttatatctttgctcaaacctctctttcactaccctatttaaaattgcaacccctgtcccgagcactgctgatttctctcttccttttgatgtctttttctccccatagaactaaacatggcatactatatagtaatcatgcttttgttgactgtcccttccttgctggaatgtcagatccatcagtacaggaacctttgactgttttgtactctgtggtacactaaagcaactagaatgtagtaagcactcattaagtatgaaattggacaccatttctagccccctttcacaaagaaggagactgaggcttagagtcaagctcaatgatcacacagctaagaaatatagcagagtgaggctttgcactctgcctcatctgatgaagcaaatgtgagaacctgatcatttttctgggccatgcaaatgtgaagtctggctggccatgttgaggggctgtcctgagggagggcgactctgactggaggggctgacgtactgagtgacattaggggctgctgagaggcacatggctccttgggtttcagtgctaggaagcatggtaacatccctaagtgcagtaggaattctgcaaacaacaacaacaagatgagctggagcaggagtggtcaggaaaggcatccttgctgttatagtgaagctattcaggcaaatgtgactttgtcttcatccccagggaatgaataaagaaaagttgacacagggcaggccaggtgagctcacactccttgggaacaagtcactggttggggagagaaaaattgcactctgtgtcctgatgggagcttcagcacctggaagcttcatcctgctccctacccccgagagccgagaaagcctgccctggtgtgcacagttccactggcctgcactggagctgccaccacattaacaagggcatctcaggagcatggttcgcagctcagcgacgcctccagtctagcttacctcacccagggccagacgtgattgccctttctctaattgccttcagcatcaatgaccagaccccagacaccggctttctggtactttcttttgtcttttttttttttttcttatttgcctatttatttattccgtgccaccctaccaatcaacctccaccttatcccctcccaccagctcagtttcttcctatgtaaatattgcatagtagtttaccctctaggtcatgaatatgttaggcagcaagattgtctgaataaagctcagggcaagtcagtgtagcttgcagtcggagggagcacataagcctctgccttttgaaacaaatatgaatttaactcagaggtgcttgccagtgtgatttgtttttattgttcatgtatgaataaatattaaaatgtaatcatctgtttatgccgagcatgagctgaaatgcctgtgacattgagattcctgtttcttctgcgtgtaatttgtttgcatattaatgccatttatttctgtgtaagcctctgtttttggttttgaatataatttcactttttgaagacagtaatggcttagtaaactgaacaattgcagttaatggaactattttatgatagcattaacttggcgtcagatcaggatgaaagagaaaactgtcaccgaaaggatatcatcaaacagtgacttctctttattatttattttatgaattgctgcagtactcagggaaagctaaacagcctttctcatgaacatatgtgaaagtggtttgtcaactgttaagtaagttgcctgattataacatgaaattgtgcatatgcatgagctgttttttctttttatttatttatttatttattatttttcttttttaaaattatatcttaagttctagggtacatgtgcacaaagtgcacatttgttacataggtatacatgtgccatgttggtttgctgcacccatcagctcatcatttacattaggtatttctcctaatgctattcctcccccagcccccaacccccgacaggccccggtgtgtgatgttccccaccatgtgtccatgtgttctcattgttcacctctcacctatgagtgagaacatgcggtgtttggttttctctccttgcgatagtttgcttagaatgatggtttccagcttcattcatgtccctgcaaaggacatgaactcatccttttttatggctgcatagtattccatggtgtatatgtgccacatttttaaatccagtctatcattgatggacatttgggttggttccaagtctttgctattgtgaatagtgctgcaataaaaaatacatgtgcatgtgtctttatagcagcatgatttataatcctttgggtacatacccagtaatgggatccctgggtcaaatggtgtttctggttctagatccttgaggaatcgccacactgtcttccacaatgattgaactaatttacactcccaccaagagtgtaaaagtgttcctatttctccacatcctctccagcatctgttgtttcctgactttttaatgatcgccattctaactggtgtgagatggtatctcattgtggttttgatttgcatttccctaatgaccagtgataatgagcatttttttcatgtttgttggctgcataaatgtcttcttttgagaagtgtctgtttatatactttgcccactttttgatggggttgtttgattttttcttgtaaatttgtttaagttctttgtagattctgcatattagccctttgtcagataggaagattgtaaaaattttctcccgttctgtaggttgcctgttcactctgatggtagtttcttttgctgtgcagaagctctttagtttaattagatcccatttgtctattttggctttttttgccattgcttttggtgttttagtcatgaagtcttatgcatgaacttttaaatagttctctgttccctttgcctatggaaatattagtaaatatttattgggcacctattatgtgctaggcactttgttaagtcatggggaccctgaaattagtaagtcagccttcctcaagtattggcaatgtagtggacaagataaacatgcatcccagcaatcaaatcacagttgcctgggataagcaatgatcagtgatgcaatatcacagtggaggcctggaaattgttcttgtgggagcagacagatttgaatgacaaaccttaccttgggaggatcagtaattcttctcagaggaggtgatgtttcaaactagacattgaaatgtatttaagaagccaggctagccaggtgcggtggctactggagaggctgaggtgaaagaattgcttgaactggggggtggaggttgcagtgagctgagatcgtgccactgcactccagtctgagtgatagagtgcgaccctgtctcaaaaaaaaaaaaaagaaaaaagaaagaaagaaaagaaaaggagccagtccatgggacgaaagagactctctaattctaaatacaatctgtgaaatagaacttccaatgactcctgcttctcttcagtatcatttatgaagcctctcctctgtgcttggccctgcattgctttttactccacctcacttaatacaacaacgctgcaaagcataggtattatgatgttcattatataaaagagaaaatgaggctcagaaaggtacagaaagtgactccaggtcacactctagatgtcggcggggagggatctgacactcaagctgaggttcttgctgttgtgctgtacccacacacgaatgtcatgtttgtggagaagagtagctagtgaatgaagccgtggtggtggaggggggcctgatgcatctggagaggtggcttgaagctgaattgtgaaacaccttgaatgtcagacccagcagcttgacgtcatcctgtatccagggggattttgatgtagatcctaccttttactcttagagagcacacagtgagtgccccagtaggtgtacacactaagctattgggatcagataaaactattaaaattattttatctcacatgaagacattaaacttataaacacttaatttagactagcagatggatatcatttataaataaataagcatctattgagttttgtgcttaaaatgaaaaaaaaaatttttttctccaaggagcagtttggaaacttctgcttttggcggtggggagccactgaagttctaaagcaggggattaacatgattagattcatcttttggatagagtactggggaagaaaggttagttcgtggaagatgagatagaaagcaagagatggagacgggtgatcaatggtgaagctatcacaataatccaggcaagagctcttgaactaaggtagtgacggtggtactggggaagaggagaggaagaagataaaggtttacagatgaggagatggccagaactaattgaatgtaggaatggaattcaaggagagggccaagccagatgatctgactctggactttctggtccatttgacctggcattgcaaaccagcatgagaaatacaggggagtagtgggtttttatagtgtattgggtttgggacataaaatgtttgaggtgtttattggcagaaccggatgaaaatgtatagcaggcagttagatacagattaggagttcaggagaatggagacacagttttggttgaaattgatccaaagagatatttgaagctatagcacaaggtgagtaatactataaaactcagaatgaaacccagggagtcagcccattgaagggatgggtgaaaaaagggtcccactgaaagctggattagggacataggataacaggcagaaaggattgtcattccaggaaccaggaaggacagtgtttcaaggagggagtgtcggcagtgtcaggtgctacagggagatcatgggactggaaactgattagaggcatgatattttgcaatagaaggtcattgttaagttagccaaccctttcccagagcttagcatctttcctaatatctggtccaaaggccatcagagcaaggggtcaaagtttgaagtgcatttgatttcctcttatctgtttgtgaattacctacatttggattgcctttttccagggtgtaatcctagactgacttcccccatccatccttcagaatctggggaaaatttcatacttcactcatagcaaagcgtaagacactggtcttgtctgcttccacctccctttaaatggtgtggaatgaggctatcctgtgctgtagacaattaagggtaaggctgtggaggacacagatattcattcttttaggttgaaatggtaaactatttcctctgattgttaactcattattggaaatctgggagctagattgctggttgaacccttgcctgagagcaaagatggctatttctgtcaaatgctgaggctgacagttgctcagagaatgacttgggtgggagagcaatttactgaataaacgtgtagatttagaaactgcatttgcaaatcccctgtaacgaaatatgaacataccggataagaagggtctagtttgccagaagggtgaaatttgccatgctaacgcaattgtcagggatgctaagtgcaattggtatgactagacgtactttgtgatcttcgtcaaatgtacttgaggcaggcatcaccccgaaggagaatttgtttccttagtagaaaataatatattgctcactcattgggcttgttatttattgtgtctttggggtggaaggaagattgaaaaggacttcatcatgtggcacatatggtcactgtccttcaagtctctaaactggcccctctacctggcagatctactctcccacatacaggagagacatatagcctgctacagagacacattgatttcattcattcatttgtgtattcaatagtcacttttgagtcttactatttggccaagttctatgctaggagactctagtgaaaaagacagatggagtgtcttcttcatgctgcccttatattatactgggggagatggaaaaacatagagaaatgaataaaccaagttgtttcaaatggtaataaatgtcagtgaaggaataagcaagtgtgtggctgagacaggggtagtgagggtggggggtagcagagtgcagggtatagcacagtggtgaggctctggagccacactgcctgggtttgaatcccagtaactgtgaccttgggcaaagtcacttcacctctgggtcttagtttcctggtctaaagtggggattacctcagaatgttattgtgagggttctgaaaatgtgatatttatttatttatatttatattttggaggtggagtctcactctgttgcccaggctggagtgcaatggcacaatctcgactcactgcagcctctgcctcctgggttcaagtgattctcctgcctcagcctcccgagtagctgggactacaggcatgcaccaccacacccagctaatttttgtatttttagtagagatggggttttgccatgttgaccaggctggtcttgaactcctgacctcagcttatctgcctgcctcagcctcccaaagtgctgggattacaggcatgagccactgctcctggccctgtaaactgagatgtgatagatgcaaatgaatcagccatgcgatggctggatgggagaaggaggtgcagggaggaaagctatgagcaagtgctctcacagggtgaagcttttcagaaagttagagaagactggtgctgggggatgtaaggtgagcataggggagaacaggagaaagatgaatttggacagcgagtcagaggctaccatgcagggattattctaggcacattgcaaactgctcagaggggatttaactaaaaacgcttgtatggcaggtagcacgtataatacttgggtgacaagaagggtttgtgtcatggaccacacgtgtgtcgtaacctctacaagtctctttagttacctcacttaagatatataggacataaactgtccattctttaatcatgctagatggaggatggacatcctgtgtttcctcaaatcagtgaacaatccctagagttctagcaatcgctcaactcccttaagcatttttgttctacagtcaccacacttactatttttaagagccatttatgtttcagccaccatgaatttttggttacagttttgaacaagtttattttttaattttaggtatatgattatagctaccactctctctctctctcttttttttagagacaaggtcttgctctgttgcacaggctgaagtacagtggcatgatcacagctcactgtagccttgaactcctgggctcaagtgatcctcctgttttggcctcccaagtagctaggactaatgcccagctaatttttaaatttttttgtggagatgcagtctcactgtgttgctgaggctggtcttgaacttctggcctcaagtgatcctcccacctcagtctcccaaaatgctgagagtacaggtgtgagccaccacacccagccttgccacttctcaatgctgtgttaatgtatcggtctaaagaccctgatatggtttggctgtgtccacacccaaatctcatcttgaattgtaactcccacaattcccatgtgtcctgggaggagccctatgggaggtgattgaattacaggggtgggtcttttctgtgctgttctcatgatagtgaatgagtctcatgagatctgatggttttaaaaactgtagttttcctgcacaagctccctctttgcctgctgccatccgtgtaaaacgtgagttgcttctccttgcctttccccgtgattgtgaggcttccccagacacatggaatgtaagtccattaaacctctttcttttgtaaatggcctagtctcggctatgtctttatcagcaacacgaaaacggactaatacagacccttattcctcaaagtaacagatgctataaaagccatttgatgtgattattagcagtcattgtgcccaggtacattcttgtacacaagtgtattttcctcagaataaggttcttccaaagtataatttgctgggctaaagggtattaattatttttttcctgagttcctatcagatggacattctttggggaagggcaaacttgcatgtcttgagtgccataggagtgataaaatgaagagcttgcctatatttggggcctggtgtggtggctcatgcctgtaatcttgcactttgggaggctgaggtgggaggatcacctgagctcaggagtttgagactagcctgggcaacatggtgaaaccccatctctactaaaactacaaaaattagtctggcatggtggcacagcctgaagtcccagctactcgggaagctgaggcaggagaatcacttcaacccgggaggcagaagttgcagtgagccgagattgcaccactgcactccagcctgggtgacagagtgagaccccatcttaaaacaaaacaaaaaacaataaccatattttgtgaataagccacaggtgataatactatcatgctaataattaagaataccctaaatagcatgagccacagcattttattctgctgacctctgtctcttcctggaatcacttttcttcccttggctcactaacacagaactctttttgtattcctcataccgttattttctctctggaggtcctaaatgctttttggtgtcctcctttcactcgcttcccactccctagctgaatgcatccacgcccgttgcttcagttatcatttctatgcaggtaacacagaaatccagcctcacctcttcaccaagttccagatccatatatccaatcacttgatatcttcttttctagtatatcaaaggcaactcaaagttagcacatcgggaatcaaattcatgatgtgctctatctcactgacccacaaaccagtatgcagcgtgagacagaaaagagggactcattcttgacacctcattctgttactccacatatggtccacagtcaagtctcaaacctttctccctgaaacgtatctcaatttatctatatctttccatctttactgctaacctcctactccatgttctcaccctctcacatgtggaatactgtatttgctttctccagtggtcttgctatatccattcttgccttcctacagtctattctctataaaggtttttggatttcctaaatagacaattatagcatctataaatatagaacattttgtacctccctttctaatcttaattctttttctccctgtcttactgtacgggctaggagtctaggtcagtgttgaatagaaatggtaatacatattgtgctttggatatttattgtagatgcttttcatcagtttaaggaagtcaataattatgtctgttatgaagagataagaggtttaattgtgatgactgatgttttgaattcatttctaccattttagctgtgcatcctccacaccaccccctgatttttctgtcctttttctccctttctttttttgggattgttttcaatttcctcattcccttttttcccctttattagtttgaaagttacattctgtgtttaattatattagtggctacctgcatattttatcatacatatttaacttagtaaagtctaaagttacatttttaacatttccctgagtaataagatttcagaaggctctgtcacctccttcttaaatatcatgctagaattatgcagcattttagttttactttctaaaaataactccacatactagatattattattgttttaaacagttagtatttatgtttttaccaataaaagttcaacactattctactgtatacttaaaaatgattaagatggtaaattttatgttatatgtttttaaccacaattaaaaaaaagctcatcactctttctcttatcttagacatttcatatttgcttactttctttctgaagttaatcttgtagacttaactttaagaaattctgttggtaaaatccctgaaattaaattatctgattttattctgaaactcgaaaggaagtttttctagatatagacttatagctcattttttgtttactgtcatctactgttaatgttaactgttagtcttactattgtttctttataggcattctggttttatctctctggtggcttgtaagatcatctctttctctttgatgttctgcagtttcaccatgatgtacttaggaatgattttgttgatgttgctaaaagttagttttcctggatttgaagttttgaatatttaataccaattccaaaaaaactattattcttgcttttttaaatattcacatttctccatatattttattatctctctgaaatatcaatcagcatatgttagacctcattatattctctagttctcataaattctctttcatattttctatcttttttgttttctcggttcattctgcctaatttctttaaacccattttccagcttaccaagttctctctttagctttgtctaatatgttctttaactgactgaggtttttctttcaattacaatattattttcaaaaactccattttgttctttttcaaatctaattttttgtttttataatattttgtttcttgatcatattttcaagcatctttttaatgttttgaagcatagtgagtgtgctgggtttgtacactttgttgcataattccagtagtgggaatctttgtgggttctcattctgtctctctgttttgggtgaccctgcttctttatgcattttgttgtttttattatttcctaaagctaattgtccttggaacttcatcagttggtatatattttaattaaagttttttattttcctccaaagaaaatcagagtttccttctttcattcacctggggcaataccaaccagatacctcattagttaaaatttctgtttatggatacaagcaaggaacatgaattggaaaacaaaaacaaaacacaggtcaggactgacttgtggttaagaattctcactggagatatgtttgcgtttttcttctacatacagcatcgaagaccagggcatttccttcctgtttccttttgtgcaataggtttatttcttttcctctattttgaagaagatgcaacaaactgggaaaccagctttatatgagggtctccaatatgcaggccctaggattgatctcatttcttctattccccaggcagccatcaaaatagaactttaaggacacgagggcttgcagacgcctttggggcaaagctggctgcattgctctgacgtacccagagacctgctttgctttgtgtttgtcctcggtgtattccttactttcttgacagtttagtgacttatatttaaaatccagctttgatagttgttttcactgacaggttttccaggatattttgttcaccatactgtcagaaatggaagtctttaaacttcaccctacagtcagagtgatctttccacagttcaaatcagatcacagtactcaccttcttaaaatcctcttatttctttttattcttcttaggatgaagacaaaacctaatgtggcctgcaagggtctcctggtctggccctgtagcccctctggtcccctttgacctgacttccctaggtgaaaggagaagtctttctccactctggaattggtggctttcattcagctcctctgattctctcagctcccttctgctgtggggcctgtgcacttgctgttccttcaacctgaactgctcttccctctccttcttacctaattttctcttatttatctttcctgtgtcctctcaagcatcactttctcagggaatctatccctgtattttctggctaggtcaaagctccctattttaccttttcattgcccacgtattttgtgtttgaagtacatatcacagtttctgttttacatgtatagacgtcagtttttatttatttgtataaattccttaattgcacagtgactggtgcatagtagatgctcagcaccgtcattggcacaataacaaaaacacatttttgttagttgaataacttatcttatggagaccctaagcacacctactttagccaagtaaaagctgccggtattagtctgttctcaattgctataaagaactacctgagcctgggtaatttatgaagaaaagagtaagtttaatggactcaacacttccacaggctgtacaggaagcatggctgggaggcttcaggaaacttacaaacatggcagaaggtgaaggggaagcaagcatgccttagcatggcagagcaggggggagagggagagagagagagagagagagggagagagagagtgagagagaaccaagtgggaagtactacacacttttaaacaaccagatcttatgagaactcactcactgtcatgagaacagcaagaagggaatctgcccccatgatccaatcatctctcgccaggtccctcccccaacattgtaaattacaatttgacaggagatttgggcggggatgtggaaccaaaccatatcacagcccttctcctagaattgagagtccatgatttttgagtttttatttctttcacccctcgtggcttgcttcctggggtaaagtgatgggtcttttcactggtttcaggccaggtatgcacagctgggtcagcagggtctggtagctgaaatgcagccctggattttaaagctcacctgtttgggtcaggggccttcttcttttatcaacttttcctcctctgatatgttttaatgtaatattctagtgcctctccattgcagtaagtgttagaatgtgacctctcctaaaccctagaagtccacacagggtgtgttaaatgccctgcactggtttgcaccccagcctttgtctgctgtgtgcattgcatgcccagattttctacctgggcttttgtcatggtgttcccactttggaaggcatctgtgggtttctcagcctggaatataaagatggtgaacaatttttcagtatatgggtatttcttaacttttaacaaattgctcttaaagcctgtagcttccaaaacacctttaactcaggatttattcatccttacattcagcaacaatgcatcacatacctgtcccatgcatactgggccataaaacttagtttctttttttaagcacatgagtagataatgaaagtttctatctcaaaataagttcaaatacgtgtctagtggtagaactttggtttgcattagtaatcacatgtttatccaacacatatcgagtaggccactatgctaggtactagaaatataacaatgaactggacagactagtggaattagacaaaggtatgaaagtttttagtgtagttgagaagagacatgaagcagataatcatgtgggtgcatgtaaaatcaaggggaaatgcatgtgaggtgccctgggatcatgctatgaagagatcagctttcatcacagggtcaggaatacttctctgaggaagtaccatctaagctgtgacctgaatgatgagtaggagttggcaggtgaagaggaggagggtgtagtaggtgaaaataaagccagagggagctccctgagataggagggagtttgacccaaaggaactgtggaaagtctagggtggctggaattcagtgaccaagggatagaatgactggacattgcctaaaagggtaggaaggggtggctcttgaagaaccttgagtgtcaggccatgacctctagaaattatcttagggaaatggggagctgtgatattatgaagtgtatacttggtctttgatcctttttcctggcatacatgtcctagaatccttagaatctccaaaaagtgatgtctttttgcatgctaatgagttgactgaagcctggaaacccttaggtagtttcaggatgaggggtggccatctgaaagagcaaggcagaattagagggttgagactttcagcctcccccatagggaggggagagggttgaagttaacttgatcaccaatggccaatgctacataacaaagcctatataaaatcacaaaaggactgggttctgagagaacccagcaattccagacagctgaacacgtggcacttcctggaaggtggcattcctggaccgggcatggaagctccgcataccttcctccccattcctgtatcttttgtaataaataccctttatatcaaataggtaaatgtgtttccctgagttctgtgagcagctctagcaagttaatcaaacccgaggagggagttttgggaactcaaattaatagccagttggtcagaggcacaggtaaaacaacctgggcttatgattggcattggaaatggggggcagtcctggggactgagccctcacccaataggatctgactctctccaggtagataatgttgggtttggactgaattagaggacaccagctgtgtccactgcagaattcattgcttgcttggtggtggggatagactctcgcacatttgttacagatgtcttctgtgttcatggttgcggcatgggagcagagggaaagtagcgtgtgttttttccacttaggaatttttaaaggattttcaacaggaaaatgctatgatcgcatctgtgtttttagaaaggtccctctgaccattatgtagaaactggattgaaagaaaataagagagagggaagggacactggttcagagacccccacaggtgaaaggaaatggaggcttggtcctccatggtactgatgaagatggagaggggtaaatggcttttggggtggaattaatgggtcttgatgactcaataactttcaagcaattcaagatagtcccttcttagcccaaggctttgacttgggcaccagtggggcctttaggctgtgcttggaaactagagggtgtttttttattgtccaaaaacaggcttggttttggacaatacatgttctgaaatagatagtaatgttcattttcaactcaggtgcttaaaaaagaagctaagtcttatgggccagtatgtatggaacatgtatgtaacgtgttattgctgaacgtaaggaagaactctttgacaatagaagccagataagaatcctggagaattacctcaatggtaaatagtttacctaaagatgaggacacaagggcccagacaggagtgatctaaagtctgaatgtctgtaaatgctagtctggtttagaattcactcagtcctgtgaccgataccattgctccttctgttaccctgtcctctgcgggcagcctggtgggcccttggtcatcctactgctcaaagaggtctccaggcactcaaacctcagtgtgtttgatctccacattccttgggtgttcccaaatttcaaaacaaagagttttattgcacatgcatttttaaaactggcaccattagcaaggaaaatgttaaaagaagaaatcacttaactacacacaccaaatgtcagggctctcagtggaagagcctggggttaattatccttttcaggaagccatggaatcaaaggatgaagttcaatgctcttggcatgaccatagtttagagtaataataacttggcatttcttgggccgttgtgtctctagctgcagtttatgccagaaactgggaggcaggtgaaaaatcagcatcttgattctgtaattgtagagggaaaatggcctctagttgtatgtgaccttcagttagattctccagccccagccttattcccacatgagaatgagaaatttcaggaaaggctttggagaaatggactgttgtaggaaggagctataaggcaagaaatacaccaaagaaagagtagatctctctttttaaagttaaatgaaaatttcacttgtgtttaaaaatcagaatataaaataagtgtatataatgggcatgttatacctaatccccttttccaagaggtagctaaattatcaatttaatgtacagatttgcagattttattagctttgcacgtgtgtctgcgtaatcatctggcaagccatttttttctgttatatattttcaattatatagaaacctcctagattgtaaacaaacaaataaaaacactgagggaacaaatgataaaagaagtggtcaaaatccaacttcttcttggcacccagacttttataccaactgggccatagagaaagagctggaaggagtgtgctgaatattagctgctttttcaagtagatgatgtaatctatatatttctctgtatgtcttggaagcagggaagaaagaaagagagatagagagtgtgcatgcgtgtgcttctttctatccttaggaatattgttttggaaacattcaatttctaattatattggggggaaaaaccctaaataccatttttcatgctaatggagaaatttacttaagtgcagaattatgcaacttagttttctcgccaaattacataaagtgtgcagctcctctgaatagaatgaaggatggcatgggcacacatcacacactgttcataacttaaagttcttttcaggctttttcctgcatcttattacctacttactattaatttattacacagggttgccatattttaaaagtaaagtgaatgtttcagatggattgtttttctttcatttctcccatattgttaacttcttttttttttatttagaactgtttatacttccatcagaggcagtttttcttcagtgattgcattaatttttatgtgttcattctagacatttttcaaacagaatctccacatgttgagtttgtcttcttttctctcatccacaaatcattctttcctggtgttatttacaggaagatgttagtgaatctcctttgctatttgccctaaggagtgatcccaccccaaatgtcaggctctggaaaagtaacagctcaatagaaataatctcgtcattgacaaaagtacttggcaccaggagctgatctgcaccccgcctgttggctgctgggggtattcaatgaagtaaagcctgcacaggcacctctgtggcctctagggctgcttgacagttgacactagcaacactgtagtcatcctaaccgttccttacatattctgtttctcatgaggctttgctctttctcttctgacagaataaatatttccacttcaactttgttaccctttagaggagaatttctctgaccactgtgtatgtgttttgtttttgtttttgtttttggagacagggtctcattgtgtcacctaggctggagtgcagtggcttgattatggctcactgcaaccttgacttcctgggctcgggcgatcctccagcctcagcctcccaaatagctttaaccacaggcatgcaccaccacacctagctaatttttgtatttttttgtggagacattttcccaggttggtcttgaactcctaggctcaagtgatcctcccatttcggcctcccaaagtgttgggattataggtgtgagccactgcacccagccatctgaccattgctgagtaagacagctaactctcagattctgtgtctttgcaatttcttatttatttcaggtccatacaccttgatggtggggaagaggtggggatggtggcagtgaccttacagggaagggatgaattaggaagggaaccgtctctttcacgaatcctttgcatgcctatttcattgacttaaatgtgcctgcctagtgcattgaagggtctcattctatgaacaggattgggaagtgcaaggatgatcttcagacagactcagccactggtttagctgtaattattcttggtcccaggttgtggggtgggagggagagagggagagaatacacatcactccttgactcttgtcttaaagtattatgattttcccagagtaatcactcttttgaaaccaggaaagattcaatggttctttttgtaaagtcactaatttacacttatctgaatagggcaaattattggctcaggggaaggaacaccagccaagtcaccttggttttagagcttgaatagaaaaagcgtagagccagccttctagcttccctccaacagtcccatagcgtcatcccctggataacggatgcctccctacccactgacttgctcttgttcctggggtcataaattatttagctgccacttatctcccaggatcttttactattttttttttttttttttttttttgagacggagtctcgctctgtctcccaggctggagtgcagtggtgcgatctcagcttaccgcaagctctgcctcccgggttcacgccatcctcctgcctcagcctcccaagtagctgagactacaggcgcccaccaccctgcccagctaattttttaaatattttttttatagtagagatggagtttcaccgtgttagccaggatggtctcaatctcctgacctcgtgatctgcccatctcggcctcccaaagtgctgggattacaggtgtgagccactgcgcccagcccttttactcatttttatctgcagtgtggtgcctggcatgtagtaagtgctcagtaaatggtagttgtctttatgaaaatgctgatttctttcttcttacagttcaggaagcaaaaatgggtgtatccggaagaaaaactgtatatgatgtaatagtagctgacatctgttgttgactatgtactagactctgctaatggctttatgtgcattgtttgattttcgagcaaccttatggggctaatacaattttactaatgagaaatctgagtctcagagagattaggtaccttagccaaggtcacccaactaataagcgacagagcaaggctaggaacccaggcagtgctgcctaaacttctctattgcttcgaagagtcagagaaggaatcggagggatggatgcctataaatgtggaagtgactgaggtacagaaaataaaagagggtcagggtgttaggaggctctccctccacccctgattctcaagggaatcttcccacttgctttctgcatcctgaggttgctttggttagattctgctcccctgggatgctagcctgaggttggcatctcagttttgggctgaggctttatgtacctgcgtgaaagaggtggtacagagcattgtacacaacatatggggctccatttgcatttagtgagtgctcagctgtgcacagtgtctccttaatgaatcacatgcaagccgagcatcgctatatttatccaagccctgggagccggagtgctggctgtggtcgacttgcatgccccagaacagtgccttgcaggttgttccagttttccttgtggtcagggccttagggcccttcaataatttgttccctggcaaaatctgctggtttctgaagtatctttccaggcgttctaggccagaaaaaatgtttacatcctgaagctgtaacagagatcaagcgctaaaaaagaacctggaagctacatctgctgtgcccttgacttcaaggccacatctgaagaatcgcagacagatgaggcatttttattttcttttcaagcttttcaagggggggtcccacaatgcttaatgcttaatcaccctgctgtcatcaggttatttcttccttgtaatctaaaacccttatgaatttttttccttagtcactccttaattgaaatatttctttttatagctgggcattggtggcttgtgcctgtcatcccagctactcaggaggctgaggctggaggatcacttgagtctgggagtttgaggccagcttgggcaacatattgagaccctgtatcttacaaaatattcctcttatgctcagatcagagagtttgcccaaataatcacttctgtgcttaggaatcaagaacaagaatttataatgtttacttaacgctgattaaatgccagctacaatattaagcacttaaaaataattatctcatgtttttcacctcaaaataaccatttgaatgagcattaggactcctttttatcaggaataaaagtaaaatttcagaaaagtaattaactgaggccacacagcaagtatatggaggagtctggcttgatagcaaagcgctttatatgaaatagatttttctttcctttcttcttcccagctgtagtcatgtcctgtgactcttcttcccattcccagccattcttcagctaaaaagaaagtaaatattttaaaatatgtatatatattttagatatatatatttatattttaagacatatagataatatataatttatgatttatatttaaatttgtataaacttatatttaaattataaatttaagatttatattattatatatatatatgtacttttcccccattttcctcctagaattgtttttttatcctttataagacttaggcaggtgcaggatatattttcatccctggactcaagtgtggtgtcaagacccttaacttgtgacatgaatagcaaggagcagattggattcccactggagtggaggcccctaatcatggcttcctgggatttgtgttatctgccttcccctgttagatgctgagaacatagaagaagaataccaggttctggttcaagctatatcattggcacagtctgtgacctagagcagatcactgctctctttctcgtgaaaatcaaatttagtttcctacaaaatttaaagttgagcagagccttggtttagtcttacagactaaaaatcttttttccttccagttcagtcacataatatttataagatggtgaagccaagtcacttgccctctctggccctgagtctcttcatctgtacaataagagcaagaactaaatgctcaccggacttcccagcagctcttggtttcaaactcaggggagctgcaggaagaagctggctctactctgccaagttctgactagtgagggtttgcaacaaaaccagccagggctagtctaggcaaaaaggagagtttattttaaagatatttgtgcagctcataaaatcaaaaaaaaaaaagttaaataatgagacacagagaagttgggaaccaggacagcctcagggatctcttcagcaggagctcatgacccttccccctggagtgctgccattaagatcactccaaaaaagcctgtttttatgtttctttcttaaaaatgacaaattccagaaggagaactgccagggggccattcagttatggagggtaggattggacaggccaaccagcaggaaagtgttgctggagcccagccttgttggaggagcaggtggttcccaggaggacctgggcagaactccccaccacacacacaggtacaccctacagaaagagcccatgtgtctgtaaatgattgggaagccaggtcgggatgttaaatgtgggtgggagacacagtgggcaggttcaatactctagaccagtagcagccatggtgatggaattcattcagcgttttcaggcagctgtgcctcatggaagagtaacagacttcaaggcaaaaggcatgatgagtggacagtccattagggattgctggtggctgtgggcacaaagaaagacaaacagtgtgatctcatggggaggctgaccaccaccatgctggattaggatcctctcttttcagccaggtcaaggacagggtactctggtcccatcttttctactttgatgacatttgggcaagtttcaacctcttgagagtttttctgtttccttatctgtgaagtggggatgagagcaatgataatcatgctactcttccaactgacaacagtacggcaggcgctaacatctgctggggccaggcacccatgctgagaacttcccatgtgggttgatcctcgcaatcctctgacacagtactgttatggtttacactttgcccaaggcttgtgggaattaagggggcagtaaagtgtagagcaaagcagtgtgcaaagagactgagaggctgggctcaggagctgatggccagttttgaattctggctctgacactcactggcctggtgttttctggcatgttgcgtgagcttcattaatttgtaaagtgggtgtgatactagtgcctgcctcatgctgtggttgtgaggagtgagtgatttcacaggcatccaggaaggtgcctggagcagagcagtgctctgtaatgtttgctgttgtttgtaataaagtgcctgccgggcagtggggatttgaacccaaagcagattgactctagaatatatatgctgtggcagttatctctggtggcagaacaagaaggctcaggagtgagctgtgtaaaagccggggtgggggtgagttagcagagggagctatggaactagggagaggaagagaatgaggagccctaggcacgtagccacttcaacactccttgtctctgtgaccttgagctggacccagaaggtcagcagcaattgctgagtccccataaccaacgggaacattcagcactgacttcacttatgcttctgacttcaggagggctttagagagggggttagttagaaaaagaaggaaagaaagagagacagagagtgactaagacagaaagagagtgatgaagtcagggggagggtggggagagaactagatataaagacatagaaacccaaggagagaaagagagtgattgacactcaagaagataaacagaagaggcacacacttaaagccacagaaatgaagtagaaagacgggaaagaagggtgaggggaaggatggggattttgcagagacagtgctgagggggctgtgactggctggcctgctctgtggttgaggagcaaacaaacctgttaagtgtgtcagtgctttatctaggaaagcacctttgccaaggcccgggcacactgaggagctttttgagcgtgtagggctgtgacaggagagactctctttatctgaattggagacaggagcactcttctgtgcatttcacactggatgccacagattaggctgcggatatttcacggttggtgataaacatttgtttggagaagccttgagcagagcaacactcctaaggctgggggaaggggttgataacaggcaggtacctggagactggttttacatgagggactggttctatgcaattttacacttgtatattattataggcattgaaagtccctagaaggatacccattaaaactttgacaatagctaacctccctggttggattaatgaggagtctcaccttctaagttatgtatttcagttaggtttacatgttttacagtgtagggattttataatcagagaaacaaaggcttaaggtaataagttaactcctgaaatgaaggaagggaaagcaatggcccctgacataaaacaggttgttggggctcatccgacaaacagacaatgggtggcggaaatggcagtgcatttgaaaatatttctccttgatatttccaagttactttgaaaatctgatgatcacaatctttcctctgattcttgcagaagggtgaaattattaatgtctcctcagctcagacaaatttccttcctttggggtttccttggggtttaaaaaaatacggcagaaggtgtatgccctgttagttggtgggtttctgttgggtatggtggatatgaggcttttcccttgagagaatgatgcacgcagcatctgcagaatcctctcctccttgaagtccccacctcccactcctttttgttttaaattttaaatgaagtttgtgcctagtacacacttttaaaagtattgtctgttagcttgagaaatgacccagatgtatcttgtttcaggctttatgaaggcaaagaacagatggagtttgaagaatccatgagacggctctttgaatccatcaacaatctgatgaaaagtcaatacaaaactaccatccttttgcaggttggtttatgctacaataaaatctatcttctccttggccatccagtaaataacagcatgctaagataatatcttcttttacttaaatatgcaaacttgtatccagtgaaggcctgggctggccactaggttaaagaccaagggctcctcaggacaagagaaaacgtatttattgtttgttacccatgaagctagcagtgccttcttttaaaatagctctgaaatttttgttacctagaaggaaattagtcaaaccggatccacttccaatggagagaacagttcatggtagcagtctcttaaactgagtttaattctcgacaacataaagtcagggacccttttgggattaaagagggctcctcaataaacaagaggtgctttggagagaatgagtcctctcatgtgtggtccacgatgctaatctgtgaagactgcaaatctttgagaaactgtgaggcctatccctgtgtttgggaaggagttgagcagctaagagtctgaatgaagaggctgtttcagggagacttcagaactttcacagaatgcacttgcaggcactgggggtgcgggtgggggaagctgggagtgcctgatgtgctgtgaataaacgaagcccaaacacatttatctaaatcaatgagttaatgcagattgctgctgctttttttttttaaatcaatattattcttttagatgctaatttaaagatccattatgcctgagatgcccaggcactggttagaattaatgacgtactagtgtttagctagaatgaaggtgaggaagcagaggtggaagtcagcctggggaatgtttgcttctcatgctatgggtccagactgtgcacgttagaattgtgtggggatctttaataaattctgatgcctggttacaaccacccgactttctaatttaattggtatggagtgtgacccaggccaggggatttaaaaaattccccaggtgattttactgtgaagcaaagtttgagaaccactctgctgatggcttcctttaatttaacaaacagtggaaacctgtgtgttggggaaggcaactatcttattcatatgtgtcttcaacactcagaataatcctgataattctaaaatttattctcctcagaatgtgtatctgtatttcttgatctaactgaataactgaaggtcctaacactatttggtcttatgtaacaaggttaggaacataaataccctcctctagaatccactagtaaaatacccaaaaagcttctgttttatgatgagatagaggaggaagaggtataaatgattaaaaatgatttaaaccaaactatgtaacaggctttatatttcatgcttcacatatattactttatttcaccctctcaaaaatcctctaaattacacattaggcctgccatgttataaaaggataaactgaggctcagaaagctgaaacgatgtgcctaaggctacatgcccacatctctctggtcaaaagccaaagctccttctcctgcagcaaatctcaaagtctatagaagagtccttgtgtgggatttgctgacatcacatgggcttcacccctctgccctcatcactaagttctcttcacatggtactgctttccatatttgaacataactttaaattcttctttgataacttttcaacagccatacacataggtggaaagcatcattggttttatgaaaatccctgaggctaaatttggcccttagagcaaattgaaaaagagatgaagcccctttctatgtctctgaggtggaaatctatgggaagaaaccagcataatctggcccaaatcacaaggaaaacaaggcatttctaacacagctacccggacaagaagaacctgggtaaaaagacttatgccaaaaccataataatcatatgagttctctaatcctaatattaggattattctgagtgttgaaaacacaatgattagtgtgtcttcaactaataatcatttattagttgatgcttaatagatatctgttgaattaattaatgtataacactagggatacgtcttaaggtttctattttattgatgagggaattgaagctcagacagttgaaacagcttcctccaggcaccattgctgagaagtgggatggctcagattcatatctgttcctgcctggctctaaagaccatactcactaccacggcattagcctgttctttatactgtttctttagtccctgctggggatggatgtcttcctatggattagttgggactgcagtcttctagtttttatttttcccttaccccctcctggttaaaaagcaaacaaacaaaaaatgtattcctcatattcctaaccccttcatcattctctgactaaggggataacaggagcaggggacagcatgaggagatgcggcaggagccccagccagccactgcatctgtatcacactggaagcaactgagcttctagtgagtagccacacagtgttgggatatctggagagagccaaggatgaccaattgccatgagagaggctatagggttgaatcaggtgtgaaatcagctccaaggaagctgaagtgtgaaagagcagaaatgatgagccaatagataaagccagtttctcatcccagaggagaaaggcgctgatgccccaaagaagttgaggtgccatggagagaagaatggaagagggaataggtaattttggagctactctttctaatttcagcacctgtttccctacgatgggctacacatatatttggggaaggaacaaagggagagagacagtaagaaggcagggaaagaaagaaggagaaaaaaaggaagcaaagaggaacaagtgagcatttgccgctctcaagacacctggtcaataggaatgcccttctttatcagctgcatgaccttacattggtcacttaacttctcaatgcctcagtttcctcatctataagatttcattgtgtgggtgaggatcaaataaacattgtctgcaaaagaacaaattataaaatgctatgcaaatgcagtgaactaatatgattattatggttttggcataagtctttttacccaggtggttcttgtctgggtagctgtgttagaaataccttgctttccttataatttgggccaggtttgttggtttgttctcatagatttccactccagagacatagaaaggggcttcatctctttttcaatttgctctaagggtcaaatttagcctcagggattttcataaaaccaatgatgctttccacctatttacatagctattgaaaagttatcgaagaagaatttaaagttacattctaatatggagagcagtaccatatgaagagaacttaatgatgagggcagaggtgtcaagcccatgtgatgtcagcaaatcccacacaaggactcttctatagactttgagatttgctgcaggagagggagctttggcttttgaccagagagatgtggacatgtagccttaggcacatcgtttcagctttctcggcctcagtttatcctctgtaacatggaaggccaaatgtgtaatttaggggattattgagggggtgaaataaagtaatatatgtgaaacctgaagtataaagcctgttacatagtttggtttaaatcattttttaatcatttatacctcttcctcctttacttcatcataaaacagaagctttttgggtattttactagtgaggattcagaaggcgggcatttgtgttcctaattttgttacacaagactaaatagtgttaggatgttcagttattcagttagatcaagaaatataaatatacattcttaagagaataaacccacaagaagtgactgtatgaaaacatgcatgggaaagtttcagctagtgaaatagtacgaggtgaccggagtcttgattctgagcctgcatggggtgtgagctattagtaacatcagccataagtgctggctgggtgcagaggatatgaatgcccgtggttgatgttcctggttcaaacttttcacatccagctgggtagcggcttatgttggaaaccctcttttgtgaccaatttaattgtgagtagagcagatctggttcaaatctcagctgtgtccactgttaactctgaaacctaagcaagttattgcccatctctaatgctcacccagcttttgtgagttgctttctgtggtttttcttattgttctgagtcggcgtggcagcagctcaccaagaccacggagaattgaaagccagtagttcagaggaaaggagcaataaaaacactttctgctgatcaggtacctaccatgttccagacatggaactgggatcttcatatacagtgttttaaatcccaccagagatcttcaaggaaccactatcctcagtgttcataggaggctcataaagttaaatagttcatcccaaattacatgtattcatagtgctggagctaggatttgaatccatccaggtcatctgcctccaaagcactattctctatgccacaggtaaggtttaggccagggattcccatgtgttttcaacaatggaccacatgctcagaagtccttgtgtgtgccagccctgtgagcgtggttgataaaactgatggcagattcagagggtcaacaccacacacatgtaaattagatagagctcaaaagttagtaaaagacatatggcgatgttgtgcaggccaatttgccccactctccttacgatccatggtatttcataatgctccaatttgatggcacaagtggaattaaatgaacagcttgtattgaatgacatgctctcttggccactgtgaatgccacttatgctaatgaagcccctggagtgtccaggagggcaggggactctgccatttatatccccaatgtctggaacaatggctgccacacagaaagtgctcaaatatctactgtctgaatgaatgaatgaatgaatatggctgggtgcaatggtgcatgcctgtaatcccagcactttaggaggctgaggtgagaggatctctcaagcctaggagttcaagaccaggctggggaacatagtgagaccctgtctcgacaaaaaattaaaaaaaaaaaaattagctaggcatgggggcctgcccatgcctagtggtgtatgcttgtggtcacagctactcaggaagctgaggcaggaagatcacttgagcctaggggatcaaggctgcagtgagctgtgataatgccactgcatttcagcttgggtgacaaagcaagaccctgtctcttaaaataaataaataaatactgccgggcgccgtgactcacgcctgtaatcccagcactttgggagaccgaggagggtggatcacaaggtctggagtttgagatcagcctggccaacatggtgaaatctcgcctctactaaaaatacaaaaattagctgggcgtggtggcgggtgcctgtaatcccaggtattcgggaggctgaggtaggagaattgcttgaacctgggaggtggaggttgcagtgagccgagattgcgccattgcactccagcctggcgacagagcaagactctatctaaaaataaaataattacttctatcattttgtttagtttgatgtttcagtgtttattaagtgtcaagtgttgagctaaaagctttacatatattgttagctcaattgatctttgtaacaacaaccttataagacaaatagtctttttaagttccatgacatacctgcacagaatgtgcaggtttgttacatagatatacatgtgccatggtggtttgctgcacctatcaacctgtcatctaggttttaagccctgcgtgcatcagctatttgtcccgatgttctccctgccctcacccccccccaccccctgacagctcccctgtgtgttgttccccaccctgtgttcttattcttgctctcccacttatgagcgagaacatttggtataaagcggagataaagactatatgcaaagacaaatgggctttatctctgctttccaaatgaggaaaatgaggcttaaagaggttaagtaacttaccttggctgaaaattagtatatcttggatttaaattttggctgtgtaagtccagagtttgagttcttaatcaccaccaaacaatagcgcaatttcattaagactaaagtcttctggcaaaaccccaggtggataagactcaggggaccccataaagttgagttacagaaaggatggaaacacacatattctggaacctgttggttcctttcccttcactttgcctgagagattagtgatgagactgaatgtcctgagagagctgcatttattttcctcggggacaactcagcatctcaaaggaaactgccttcttatggtcatgctatggggaattcctgtgacatcgtttttccagtttctatggaccttgatcatccactgcttggctaaaataaaaggattaaaaattgaggggaatagtacttgttttgaatgcctgtggctcttgaatgaggaagctatctggtagcattcttgcataactgtgtatcatttcaagacatgttcattttggccagaagtctgagtgtactggcaccaacactggtcactctgtttgaaagagagagaaagggaggagagagagagagaaagagtgaaagagagaacaggaaagcctgaaagcactcagcagacaagtccctctgagtttggaggcatcctagtctggttttgatttttgttgttatgtttaaacacttgccgttttctaattctggtgaagtccatctagatagcaatgatctcaagtgtcctcccttgatttacctctgggacagtaaaaccactcttggttgctttgggtttgattctcttcttgagggatgtacctggcctttggcagaggggttcagagtggacccttaatctaggaaattcactcagtgccacatgatcacctaattagcaagatagcattttcctgttggccattcttgcaaccccctatagatgtggtaatgaggatccttaacttaaggaatgtcagaagaactgcactttattttcaaaaactattcttacaaagggtgggggaagctctttttccacttcctcctccaaattagccttctcgcccctgctgaatcctccccacttgccgagatagaatgcctttcctacagcatgacaggcagtagtggacgtactggataacagccagcaggacagagctgggtacacatccttgctttgcttctcattagctacatggcttctggcaagttatttaacttcttctccatgccatagttttcacattggtaaaatgggattaacattttccactcatagagtagttgaaagaattaaatgagatcatgcatgtaaagtatttggcatgtaaacagtttccaataatggttcctattttttattatttatttatttatttatttatttatttatttttgagacaatgtttctgtctgtcaccctggctggagtgcagtggcaaaagacagaacactgtagcctctagctcctgtgttgaagcaatcctcttgcctcagcctcctgagtagctgggatcacaggcctgtgccaccatgcctgggtattttttttacatatatatattttgtagagattaagtcttgccatgttgcttaggctggtcttgaaaccctgggctcaagtgatcaatcccttggcctcctgaagtgctgggattataggcatgggcaaccatgcccagccatgattcccacttaaaaaccctataattcataatcgtattatatgagtatgtgtgtatatgcatcacatgtatgtttatgtgtataggtatatatatgtatgtgtgttttaagtattatacacaatataggaatatagactatggaatgaaagtaataatgatacaatattattttatgaagaatggtagtaataatgagagtaaaaataatagaacggctgggcacggtggctccagcctgtaatcccagcactttgggaggctgaggcgggtggatcacctgaggtcaggggtttgaacccagactggccaacatagtgaaatcctgtctctactataaatataaaaaactagccgggcgtggtggcgggtgcctataatcccagctactcctgaggttgaggcaggacaattgcttgaacctgggaggtggaggttacagtgagcagagattgtgccactgcactgcatcctgggcgacagagtgagactccgtctcaaaataaataaataaattaaaaacaataataataatagaagagtgaaactcagttcccaggatagaaacatgtaacatatggagtctcccataggtcttatggttgaggtgctctgccttctgggagcgtttggtgctggcacctcctgaacttgcctgttgtcacctgccccagtgtgtcagggcaagaccatagacagaagtcctctgacaaatgctgaccgtgacaacagtcttggcaaacttcagtaggcagagatgggctgtccccattgggaaaaagaaccacaggcctgccacttctctgtgaggccgcctggactagatgcaaatttaatactcccctgtcatgttgctaaaaccctctgagactcaggtgacagctacttgcttcatttgactgtatggcctacctggagtgggaggctgggaagatgggcttcttctgagcagcccctcccgcagcctgtgcagctgcctgctaatagctaaagcatgtaagtgtgcgggctgtggagactcctgataactgcggttccatcgtgtccctccaaagtcctggaatgacatgcagctcttgaaagccagcaactcgcagcagacactgaagtcctgcctttccccacaggggtttgtttctgtgcatgtttctcactttggccttaattatgatgagtacgcgttataatctgtccaggtgtggggtatgatggccagtgcttgagtaatgagatgggaagaaactcagcacacaccatcatgaagaggctgaggctcaaggagtgaacaaatgagcctaggctcatgcggtgctgggtggagagctcagggccctgagggctgtatgttctttggcctaagagtggatgaagaaacagtttgctagaagtgcttgcaccaggccaggcatggtggctcatgcctgtgagcccagcactttgggaggtcaaggcgggtagatcacttgaggtcaggagttcaagaccagcctgaccaacgtggtgaaaccccatctcaactaaaaatacaaaattagctggacgtggtggcacacgcctgtaatcccagctactcaggaggctgaggcaggagaatcgcttgaacctgggaggtggagtttgcagtgagctgagatcaccccattgcactctagcctgggcaacaagagtgaaactctgtctcaaaaaaaaaaaaaaaatgaaatgcttggactagcctcttttcagggcacatgcctcagtatatggtatccctttagacttcagaggttgtaaattagtagcctctgggagaaatgcagcctgcatttgtgtttgatttgtctagcaaatcaaagcgttaaatcaaagtgttaaaacaattgataggaataactgagtctttagggagagaatggaatccacacacctcatcacttcccactgccctgtcctcattccatatcacttctttctgttgcttgtctagccctgcagtcatctgattttgctacatctgcttgatgtttcctgataaagatggtccttgaccaactaggttggaatgtactggatactgtgactgcctggaggaatgtcataatgcttcttagcatattaaaattatgaaaagttctatagttaaaaaaaaactcactggtttatctttgcttaagccaatgctttccaaaattctttgattgcgaacccttttcccctacagaatacctagcaccatcctatgggacaagaggctccaatagaacatagtttcagagacaatggctttggaatgttgttttatcttataatctacatttaaaagaataaagaataaatctctagatacaaaatccaataaccataaagtaaaagtctgacaaatatgacagcctgcaaattaaaatctttctatgcaatggaacaacaggataagtgggagaaaattcttgtaaaatatgttactgtaaaagggttactattaatgatgcatgaaaaattttaaaaaccaataagaaaaaaatacccaaaataagaatagaaaaaggatatgaacatgcaatttagtaaatatagatgttcaataaatatggaaaagatgctcaaccatactagccaccaaaaagttgcaaattacacatcagatcaacaaaaatctacaagattgtatgtccaatggtagcaaggttatggggaaatggtcaattaaaggaaattggttactgtatcttccaaggtaattgacaatctctcctaaaatgtatatgtctatatgttttcatgcactaattcttctttgaacaatctatcctacaaggatctttacagatatacaaacagtattttttttaccacgtatttataataaaaattgacaatagcatggagcctatgatcaggggtgggctgaagaaggtataatgtacccatttgagcagtgctgggcagtggttagaaatgaaaagaatccactctatgagaaggcaggatgccactggtgtgcagttaactacaaaaagcaagttgcagacatgtatatttacatacacacacatgcacatgtaggttcatgcatagaaagcagtctggaaggaaattcatcacaatgttaactaacagtggtcctcccctctctggggaggagagattgggacccagaggaggatgcgatataggactttggaaacaattttcaccctcatgccttatctggtatgaatgtttttacatcaaacatagagtattgactttttaaaatttaaaaattataaacaagattaaaaaagggatgaaggcatagagagagagagggttgctatttgagtaaggtgaccatgtagcttaagggttacgagaaatggctctaagtgcagcctgcctgaatttgaatcctggctctccacttgctaacttttcaaccccaggctagttatttaattgtgatgcaccagagattccttatttatgcaaataatgtttcccttgcagggttgtaactaataagctaatctattagcagtctttggtacagcttctgccctgttgtaaattcttagagaataatcataatcattatttatgttaagaatctcagttgtatatggctaggaggaagattttctttaggaaagtaattttcacgattttttacttgagtctgattgttaaagggtgatacatgttagtaacagaacacctaaaatatacagaaaaataaataaaaaatgcatacttccattagacccttacacattattttccattcatgtgacttacagttctttctactgaaactgtagtctgccctgctgcttagcaagtggtgttgctatgcagggggtgagtgtggctcctatctctggatgcatcagttactttaagagaggaagcaatccactacaatgctcagctttcccaacccagctagtggaccaaaacatacccactattattcacaaagtggccagggagaggaaatatgaataacttgtcaccagcaaagcaattcaagtacaccatcttccattaataatatgtcaccatttattgagcactaaaataggcctggtgctctgttggatgcctcacatatattatttttaatcttcgcaatccttcagaatacatataactttgtctatttcacagataagtaaatgtctgagaggttaagtgttttgtccaaagcctcatggctaataaggtgtggaaacagaatttgcagatctatagaactacaaggtctgtggtcattctagtctatgttattgcctccttgaagacaggagttgtgacttcacttttgtatacaaagaagtccgtgcttatgttttgatgtccatacagaggcttccatcaatattgtaatgtccaggatgcagaatcattctcctctgatctgtgtcatgctgcaaagtaccctctttgccagcacagacttgttgatgtgaggatcacttatatgtattttacattccacctaggtggcggctttgaaatacatcccatctgtcctgcatgatgtagaaatggtctttgatgcgaagttactcaggtgagagctcatgttgtactttcttgggctctgctggcaagctagggattcagagtgggaggagggctcttatggggagctccagatgggcactcagcttggggatggggaagacctgtggcaggggatgttttcagggtttccggtgtggtatttttaccttttggttttcttgtgccagactttggtgaaaaccaactgtataataagcatccctctttgatgatatgaaaattaatcatataggttaaaaaaaattgatgtttgagatgaatgtttccatttcacctgggcctgaaggttattttgggttccactctttgccttgtagaccccacagttgcaaatggagaacagcctaagcatacctaaagagataatggagacagctcccttttgccttctacttcttaactacgttcagctcatagatgaacacgttattttaatgtgattatgctgttggaataggggcatttcaatcagatataccttcttctttttaaaaaatgtattgtagtttacagataacagacttaaaagactttttatatttaaatacttatagatttagaagagagttgcaaagattacatacagagagttatcatatgcccttcacccagcttcccctaatgttaacatttaaataactatggcacatttataaaaactgagaaattaacatggatacagttattttaactgcactctggactttattcagatgttaccagttttttcatggatgtcctttttctgttcatatggaagatttttgctagctccttctcatccttcagaccctcaggctaaatgttatcttggaaaagctactgctggatattgtaaataaattaaatttctcccccagcccctgtgccattattctctgacacagctccctatttatttcctccactgcatacatcgctgtgtattgatttgtttgcttctgtgtcatttgatgacctctattagaatgtaagttccatgccaaatgggacccagtctgttcccattatatccccatttctctgcgctttgcctgtctcatattaagtagatgtttaataagtccttgaaagaataaatgaatacaataagtttattttggaaagccgacaaggactataattttgtttcagggtattttgattctcaccctatttgggaagagctatctcccttttgatgtcccaaactggttctaatccacaatttttcatagttttaaaaaaaattagagattttgattttaagacttatcataaagcattaccaagcataaaacatttgtaagtaaaatggtatggtaatgaagtcagaaccttgttttgaactcttgtttctttaacttcctagctgcataaccttagaaaagttagcctttctaaacctgagctttctaacttataaaattgggataagtattgtatatagcttgtagagttatgaagtctacatggcataatgaatgcaaaatgcaaagtgtgtgcttggtacacggtaactgctcagggctatgggtattttcagatttttacgtctcttttaatgctactaatattctataccaagaacaacttgtacatttttactgaaggcttaccttgcacctcatgctctgccaggacttgggggtttcccagagctagaggtccagggatggactgtaagtgctatgagctgggagacatgggtctgccttgctctaccagctcctatttttcctgccctcagccaactcctgtatgagttctacacctgcatccctcctgtgaaactccagaagcagaaagtacagtctatgaatgagatagtccagagcaacctctttaaaaagcaaggtgagtacacagcacccttgctggggtggggtaaggggccaataaaccccacatcattttggggaagcttggcaggagagggcaacctgtccagtgactataacatctcttttctcacaactcccttggtctgcataaatgcaaaaagtagaaagtagctgacaacttagatatcagaatctaaattgattttaggaaagctgaggttgcattgtttatttctcttgagaaagtttaatgaggtttttttttccccctgtatggtttattattgctgtctttaactcaaagggaaatggataaagttccttttagtagaaagagcctttcacggggaagttctcaaaattttgagtgtgtaagaataaactggagagcttattaaaatgctaattcctgagacctagctcgaagagtctaattgagtaggaattaacattttttaaagtttttagaaaaatgtaaattattttggaaaaggtaacgcatttacatggatgaaaatgaaaaggtatgaaagggtaccatgtggaaatggtccctccagaccctgtgcatggctaatcccagtcccttctctgtggcaaaaggcatatccagtttcttgtgtttgcttctaggcacactctgtggatgtggaatcaattacgtatatgctatatactctttattattatcatgcaaatggtagcatgctatgtaactgttctgcactttgcctttcttcacttaatggtatatatttttgggagatcatggaatgacagtggatttgcacagaagttatgttcagagcttctgcttaccctaaactggtcaccactgggccccactggcagaagacttagagttccctattttcaaggtcagtcaactggatgtcgatagctccatcagatttgatcaggcaggattcagaagctcatattcatcctctacctcatctctaggaatgctctgcatgcctagattttcaaaatggatcatgccttttgctccatgtaaaagaatgacctgttcagaaactgcattccttcactcctttctgtaagggtgaagaaatgacttttcagggtcagtacttttttctgtatcctaagacccagcctctccaattttcaatttctctatccacactggtgtcaataataaaatgcgaagcaaactgtgcaagaaacaaagggtcttagaattcagaggatcagccatcacccaactggaatttattcagggagtgaagcctgaatatttatgcaaattgcctggtaatcacagaaatattcaggaaccacttcactgtaaagatgtttttttccaatgcctggttaacatggtgcatccaaaattgctgtctgtatcctctccccagagttaagggtaggaggaggatgtggggatgaaaatgttcttgtgattttaatatttatgtgtgtggtttcctgaccctttagacagatatgtgacaacagattaatccaataaatatgtagtttgtttgagccaggtggtttttgtgaggttatggagactaattctggtaagtcttgttgcacttcttgtgtcactgtgcctttttaaagtgagacttccatggttttaaagttctgatttccacctccaaataaatttccctcaccccaaaagcattgaaatatgtctgccccttcctgccctggaagcccctctcaggatttcaggtggtgccactgcagaggcaaattgagtcccatcctagagacatgacaaggacgactctagctacgcatatggtgtggcacaggcagcagggagtgggctgcttggctcttcttcattgttcagagctgctgtcattgtcaggggcccggcttggcatcaaggccagatggagtgctagcacgggcctgggctgggcatgtggtgtcaattccagcctcttggaagtcggagtaattccttgactgcagccacatctccagggctgggaggaggcctctgagggttagcatcatggcagggcaggctggacagctgctgcttctcagtcctgctgtgtgtctgggtttcagattcagtagaaaccctctgattaatattaactgacagaaggccagccctggcgttgtacacagttaaaaaagaaagcaaaattcttacctttaaatacatacagagactagaggtagacaaagtatcctttggggacccctttcaaagaggaggcaaagtgtaattagtgtagccacgctcggctcacatgtgaaagtcgtatgaccttattcacagctgaaaggtaactcctctcccaccatctatttgctaagtgagccctgttaccaaaatagtcccaaagggaaacttcagctcatcccctttcttaaatcctcaagttcccaatgaataaaacctgaattcattatgcttactaggtgtccatcgacctcgggtgagcatctctctttatacccttaaataaggtgagtgtgattcctctggccaagtttgagcagtaatgaaattcctcctgttattctccctgtgaagtgtcctgtgcctcggggacgtgatttgctttgagcctgcactcatttaactgccagatgtgcaaattgcctggagtattttcagtgacagttgcttgtactcacagccttgaacatttgtattgacattaagcggagggaccagaaggcttttaagcactttctgggattttggcagactaccctattggcctgtcatcagaaggatcctatggagaaggtggagaagggtttactggttaaggacggtggttcttgggtcacactagacccgagtttacttcctggttcagctttttacatgactgtgtgactatgggtaattttctaaacctctctgattctcagtaagctcatctggaaagtgggaataagaacaataacgtctgtcttagagggtgatagtgtgggctaatgagatggatgatgcatttaaagtacttgacacagcactgggctcagcataatgtttcatactaaacagcaattgttattattggtgttgtggttgtttttcctgctgatcccaatttccgtgctgacctttaaattccttgcaataagggcatcccttaacgtttgatagttgcacacaaccctcaactacatggttttcctcagggtccgagagacacaggacctaatgaataaaagggccttggttggtacatgctctccattctgactttgaacgtgtttgttgttgttgttgttgttgttgttgttttcaatttttattgccctagaatgtttttgtaaaggggccatgttacatatgcctggaagaagtagaggtcaaggtgaaatatttgtgatttctcacttcattgtttgtgttactacaggctccaacatagttacatagttttggacacttgacagctatcctctctgatgatttacccctcagggctcttttagcgcacacacacacacacacacacacacacacacaccccacacacagttttttccttgttttctttatggaggcaattagcctcaactttgatttgacctgtgatattgagtaaattacttaatccttgtaagtcttaatttctgcatctgtaaaatgggaatagtcacagaatgggtccccttgggttgcttgttcatcagtggcacatgtggctagttagcctaggaattgcaggagtaaggagtcatcaccagccaggttcccacatggaatgtcttgctccctgtggatgacttcaggcttcagtgagaggagaactgagaaacttacaaacactaatttgctgtcttctccaacacaagctcagacctgcctggtggtgatgacaggagaaaggacgcacagatatgcccggagaaagctccaagaggagtctagaagaaaagcaaaccctctgtgcctttgaaacagatttgtccctacaagaacctcatctccaagaaatgtgtctttttagtctgatgctaatcagaggcaccatctggttcagtgtaaactgctttaggatccacattgctagagatttctcttcaaatttccaaaacaaacacagagagagattgacagaaagagagagggaagaaggggggagagagggagagagagagacagacacctgacagagatttggaagctctttcaatgtttattttcagctggtgggtttttttcactgggaactttattgagaagctgttttttgagcaaagcatccagtttcccttttattaaagcttagcttccttcttccctctcatctgttgcccacagtatctggagatgctgggtcccccattcacagtgtacaaggggctggacaacggttggggaaaagagggatggaaataattgtgcctatatcttttctaatcaacatatcattgcagcattgggctaggaataaacaaccctctgactctagcagttactaccttttttttcttttcaacttttatttcaggttcatgaggaacatgtgcaggtttgttacatgaattgatttcatgtcaggggtttcatgtgcagataattttgtcacccaggtaatacgcatagacctgataggcagttttttgatccttaccctcctcccaccctctaccctcaagcaggccccagtgtctattgttccgctctttgcatccatgtgaactcaatgtttagctctcacttataagtgagaacatgcggcatttggttttctgctcctgtgttaatttgcttagaataatggcctctggcttcatcagtgctctgcaaaagtatgtgattttaatcttttttatggctgcgtagtatttcatcatgtatatgtaccacattttctttatccagtccaccatcagcgcgtgtttaggttgattccacgtctttgctattgtgaataaagctgtgatgaacatacacaggcatatgtttatgaatgttaatgtctttgtggtagaacgatttatcctcctttgcatacatacccagtaatgggattcctgggtcgaggggtagttctgttttaagtactttgagaaatctccaaactgctttccatgatggctgaactaatttacattccctccagcagtgtatatgcatccccttttcaccaaaacctcaccagaatctgttaatttttgactttttatttatttattttttttgagactgagttttgctcttgtcacccaggctggagtgcaatggtgcggtctcagctcactgaaacccccacctcctgggttcaagagattctcctgcctcagcctcccaagtagctgggaggtgcaccactgtgcctggcttttgtattttagtagagacggggtttcaccatgctggccaggctggtctcaaactcctgtcctctggcgatctgcctgcctcagcctcccaaagtgctgggattatgggcatgggccactgcgcttggccaatttttgactttttcataatagccattttgagtggcgagagatggtatctcactgtggttttgatttgcatatctctaatgactagtgatgctgagcattttttcatatgcttgttggctgcatgtatgtcttcttttaagaagtgtctgttcatgtcctttgtccgctttttaatggggttgttgtttttgcttgttaatttgtttaagttcattagattctggatattagacctttgtgagatgcatcatttgcaaatactttcccctattctgtaggtcgtccatttactctgttgatagttgcttttgctgtttagtttaattaggtcccacttgtcaatttttgattttattctagtggttattactttggtgatcttctttaacatctctgagcctcgggttccatgtcagaaaaatttgaaaaatgtgaataggagtgtcatagaataagagacctttgagtcaggatatccttattttggatcctggcttgattgcatgctagctgtgttcctttgaacaagtaacctctctgagctgtagcttctttagctacagaaatgtgataacttatgaaaagcaactagcagagtgccagagacccagctgctgcttattaaaatgcatctattttgtctgttgtataacagtactaaccataacaatagtaacgacatcaacagcaacttaaagggagagacttaatatttatcaaatgccagctctgtatcaggtattacatacagcataaatatatattaagtttttacaaaaacctaatggcctagaaagttaagtaattttcattccagtgagatcaaatattacacaacgtattagggtattaatattttggactatgtgatgctagggttacaaattaatctccaaatctcagtggtttgataatggaaaggtttatttctctcctgtgcaaagtctgatgaaggtcatatgccttttgtccctcctgaagttgtgccagctggtgcatgtggcctccctgtagcaggaaagataagaagggagggaaggagcacagtggctcttaatgaccttggcctggaagtgacacctgccagttccacccacggtccgttggccagaacacatcacatgtgctctgccagttccacccacagtccattggccagaacacatcacatgtgctaacaccagagaatctgggatgtaaacgaagcacacgcacatgcaatatttgatgagcgctgtctctacggctcacaggtagtaagtgctggagctgattctgagtgcaagtcatttgaataacagaacccacctttttctcactatgctttattcttatgaggactaaaaaggagaaaatagtggtgtattgacttggtaattcttccttctccatgtgagaacaagtgcctcaccattcctcctgaaggatttgtttatttccattccctgctcccaactcctgttccaaatgccaggctatacatgaactctgacaggtgtgcacagggacccttgcctgggagggggatgaggctcttgctgccagcagttgctgtgtcacctgtggcttctcagggcacagcttccctgcagcaagccggggtgttagcaggctgcccaagacttggaatgttgacatgaggctctgcttctgagactgttcagaaggaaaaggcagttaggagaacaaagcctctccctctcaggatgtgctctagcctcatagtggggctgtcatctctctttgtaccttacatgcccttgcaaaattcagttcattgcatatagtgcctggaataccttctactgcctcccattccctacctcaacccctagccatgctcaacaggcaactcctactcatccctttaagaaccaaagtagacctcaagcctgcagtaagtcctccctgatgtctcaggcatttcagctcaattccattcaacatttagtccctggggaagcaatgtggatacaattgtgacgagtttgcaaacttctgcaccgtgatctctgtgcaaagaaaatgaagctgcttctttttgtttttaatctaatttaatcttctttttgagtctctactttgtgctgtggcaacttaaaaatttcaatacatggtatcttatggctctagatttaaccagtttttctgactcaaaacagtccccaccctcctaggaactcaaataggaaggggaagaaaggcacaggttttgacgtttccctcagtttatctaaaatgactccctttgggactttagccccagaggggatgttggtacacacaaattttgtggctttgggtctcaatgccaggtgaaggagcagctgacccttcctctccatcttatcgccttcctttctgaggagtctgtcctcatctctgtccctgggatggtagaaagagaatggctgccagggtacctgatgaatggggaaagatgtgaaagtagagggttgaatacattgcagatattaccctgattcccaaagggggcaaaacaacgcatctaacctcaaagcttagatgtccctgaggagtttgctaaaattgcagaatcctggaccctactccaaagattctgactctgaatatctggggaggaggccagggatgtgcatggtatcagcccgccaaggggctttggatgcaggtggcccttgacctctctcaaatgggagacacagctccaggagcctgaggagggaaaggaaagcagtgtgggcaaggacatggctcccccattgcagagtacaaatttccatcatgacacttgacatatcattctagcattctctgtttatgggactgtctatactgatggaatgaactccttaaggataagggaagttgtaagttttgttttatttacgttcctggtctatacacacgtttatgtgcctggtcttactgataccagctctcagaggctggtctgtggacctcggtagtaaaagcattattcaatggccagtgtccctttaagaaaaggaaaagaacagacctcaattgtacagagctggagcagtcctggccattaattcaaaatacatcttattattgatccacacaagacatgcttttatttatttaaatgttctattcattatttttaataacaaatgaagcatccatgcattcaccacacaaaacagaagctaggaagttaacaatcacttacgtgtaaccacatgactgcctttccccacctaaggtaaccacattcttgagtctttttttttttttttttttttttgagacagggtcttgctttgtcacctaggctgaagcacagtggcacagtcatagcttattgtaaccctgagctcctggactcaagcaatcctcctgcttcagcttctgagtagttaggactacagggacataccaccatgtctggtgaagttttttaaaaaaaactttgtagagatagggtctccctatattccccaggctggtctcagacccctgggcttaagtgatccttctgccttggcctctcaaagcactgagattacaagcatgagccattgcacccagcctcttgaatcttttgttaatcattccactgctttccttttcatgcagttgtattgcatttatatatattcccagtattttagttatttgaactttacgaaaagtgtattgaactgttgataatttgaaggaatttattttttttacttaatattaaactaggaatcatccatattactgattgctggagttcattgttttgatgacggtaggaaattccattgtgtgaataagccataatttgttcattcatgctttcaatttcaggcattgggttgtgtcagtgtttcttctattgaaagcactgctgctaagaacattcttgtacatgtctcttgttgtaaatgttcaagagtctcctttggggatagaactactagtagatttgcttggccataagggatcagaatctttaggagatagtgaacactcttttccaaaggtggttgtaccaatttacactcccaccagcaatgccgaagtggacctgtgtagccacagtctctttaatgctggatattgccctacttcttaacctttgccactaaaatgggcttagactacatcatcactgtcttcagttgcatttccttgatcaccagtaatgctgaaaatcctttgttctgttttctttgccactcgtgttttgtttctttgctatgtcttttcatgtcttttgactgtttttcttttttctttttgagacggagtctcgctctgtcgcccaggctggtggagtgcagtggcgtgatctcggctcactgcaacctctgcctcccaggttcaagcgattctcctgcctcagtttcctgagtagctgggattacaggtgtgtgccaccacgcctggctaatttttgtatttttagtagagacaggtttcaccgtgttggtcaggctggtcttgaactcctgaccttgtgatccctctgcctcggcctcccaaagtgctgagattacaggtgtgagccaccgcacccggccttttgtctttctgtcagattggttgtatttttcttattgatctataggatatttaatatattctttctacttatcttttgctgattttatgtattgtgaatatcttctcccagtttataccttgtctttttatttaagatgcattttcatgagcaaaagttcttaattttaacacaatcaaatcaatgtttttttagtcaaatttttgtgtgtgccttaagaaatctttctcagtcctgaagtctaaaagatgttcattatttttactaagaattctataattttagttttgatacataaatcctttatctacagagtttatgttttatatatagtgtgagtaggaatctgatttttgtctttcatttttgtttttttcccatttgaccacacctctttcccagcttcatctgctggacagtttctcctttctccatgccagtgtcattttgcattttcaggacattgctctttcctacaggctgtgggctgagttgctatagcctagattcaatctccggtgctgaggacagggttgctgtagactggattcagtctctggtccacaacatgcaggttctctgtgctatcgctcactgagagctgaaggattaggaaaaaggagtagcctctcctcctccagtcaagcccctgaattagtcttcagtgtgatgttagcatcctgggaattatgtgccaaggcatagcacttaccttctctcggcttgcactttctcaattatgaaagaaataattttccttatggtaagaaattgcttgggctcataaagctaccttcctgtagtttctttttgtatttgataataacagcactgaactgggagtgaggagacctgaatcatagtaaaaacaacatcagcagttgcaacagcaactgacgtttattgactgcttattatgcactggcactgtgctaaacagttaggtatattatctcatttagtgcacagttgtgagatcttgggcatgtcccttaacctctgtagaacaactgtaaatgatgacactgaacaagattttgtagtgttccaccaacaatgaaaatctatgttttaaaaaagtcatcctctgcttcacagtgataataattctgaatctttttcacataataccatttagtgccttaaaaaccctcctcttcccattgaaaaatattctcccaatactgtgttgagaagtattgagaagcattcccccagtacgtctcagcatcctgcctcagctgggggcaagggatgaggccattttatagaaccttaagtgaatggagggcaattacatgatgcattcgaggttacacagctggtcatttaacagtgcctcatgtgctggagcgtttcatttcttcaagaaagtaccatcgattttgaggacaagttttttctcatcagagcatttagaggcatcaaagttcttcaagtgaggagcccactttgcccgtttcaactgcagtgtcacaaagccatagccagcaccaaaacgtcccttccacactctggagatctgagaaggggttctccctcaaatcctctcttcctgttctgatgtgacagattgcagacttcattctcagagagaaaccttcagatccagaatcagagaagacagtgatttaatgtgctgcagaacaagtccaagagagatttatgaaagtgtctgttgggggtgagggtgcactgaagttaaaaaaaattggcatacaatcaaggaaaaaaatctgtcttaaacttccaaaaatacttagaatagcagctttcaatggccttatgaactacaatttaattaggggagaaaaaaattcccgatcacttctttaatagcaatgtaaataaactcaataaactcttcgtgtgtgtgtgtgtgtgtgtaatttacctcattaaaaatagagaacaacaaaatcactctgttctcatatctttcaaactatattccatgggattcttatctagttttggaatgattctttgcattaatggaagcatacataatgagggcatttatataaatctttataaggttatgcatttactccaaaattttgttttcactgtgaaattgcaatcatgaatgattcccattatgctgaggtggggttttagaatgtttgtatggtttggctgtgtccccacccaaatctcatcttgaattggagctcccataattcccacgtgttgtgggtgtgacctggtgggagataattgaatcatgggggcagtttcccttatactgttctcatggtagtgaataagtctcacgagatctgatggttttataaggggaaaccccgttcgcttgcttctcattccctcttgcctgctgccatgtaagacgtgccttttgccccctgccattattgtgagacctccctagccacatagaactgagtccattaaacctctttttctttataaattacccagtcttgggtatgtctttatcagcagcgtgaaaatgggctaatacaagcatcctgagacttttatgttgatctgttgaaatttgattttgctaggttatttttccccaacatcttagaatagaaggaaatttcctgaagacgacaatacagttgaattgaaaatttgctgcagattcatttcagttcaagtaatatttattaaaaatctaaaactgtggcagcactgtactgtggggactattaacaaaatacagtaataagtaatgtatggccaccacttatttaaccatgattttgtgccaggccccaaataattaactagtttaattatcatgacatccatgtaaagtgtaggtatcactattcctatttaacaggtgaggaaactgataaggaggtttaaaaacttgccagttaaggaggttttaaaacttgccaatagttacacaccaagtaacagcagagacaccattccaactggggtctgtctgattccccagcacacactgaactgccatgctggatgacttctggaacagaagagtttctgtccccaggagcttacgattggagaagaaaagatttacccaaagatctctttaaatttgagctcacacatgctgggcaggtaatacaaatgagtgaaggggcagggtcatagttattatgagatttgctaagataatcattcctttccgagtagatagtcctaatgtcaccttcacttgtatttttacaactcagattttctacttgcctattaaacatgtgggaaccttctttacttcacagagaaatctgatttctttaattttcctccctaaaacacagtgccatctggttagtcatccatatccccatgactgttttttgttgttgttgttgttgttgttgttttcttttgagacagagtctcattctgtcacccaggctggagtgtggtggcacaatcttggctcaccgcagcctccgcttcccaggttcaagcgattctcttgcctcagcccccggagtagctgggataacaggcatgagccaccatgcctggctaattttttgtatttctagtggagacagtgtttcaccctgttgaccaagctggtctcgaacttctgacctcaggtgatctgcccacctcggcctcccaaagtgttgggattacaggcatgagccaccacacccagccatatgcctatgtgtgacagagacaagtgtatggtgaaatgtttctttgctactaaggaagcaagagtgacagaaatcaatggccagtcagctctgggaggagagactatagggattggtgaggactggggcagagtctgtgccatgggtaaacaggacagcagtgaggcagggccatgtcaatatgcagacacagtgctgcttgatagtctgtctctctttcttttttcttttttttgagataagtctcccaagtggagacctgctgatttattttcaaatgatatagaaaacagacaaaacctacagatggacccagaatagcagtctctggtgcaaatataatgtttatagagttttaataaatttataaggttttcattaatttattataaataaattttataataaagttttatacaattataaatatgataacttataagttattatgtttataaataaccctataagaatgactattgccagaattcagtggaaacagggctgttggaacattggggacagttttatggagaaggcaggatgtcagccgaacatgaaaggccagtgtatgtgacacaggccctctctggatgacagcctgtgggagatcttggagtgtctgagctgagagatgcctgcttctcaacctcagcagcccttgggattcctccttgcctgatatgcttccttgctaaggggggccttggaccacaccgagacctctgctaggcatgcttctgaagatgttggcccagagatgggaaaaatggcatttattctttatgtaagttaggattatcaaaatattgtgagttgattgtaagacatttggaaatgtataaaatgtccatgatctcacgatttagaggaaaccattgtttattcttcctctcttttgtatcatatatatgatatgatatgaatcatattatatttatataaatatatatatttatataaatatatatatataggtctcactctgttgcccagtctagagtgcagtggcatgatcatagctcactgcaaccttgacctcctgggctcaagcaatcttcccacctcagcctcctaagtagctaggaatgcaggcacacatcaccatggctagctaatttcaaaatattttttgtagggacagggtctcactacattgcccaggctggtcttgaattcctagcctcaagtgattcttccacttcagcctcccaaagtgctgggataacaagtgtgagccaccacacttggcctgtatcatatattttatataattgggatcttgttttgcatgctgtgtaatctgatttctgaaaattattaggaacattttcccattctatttttaagggcttcacaggactctttgaaggacactggctatagtcaattttatggcttggctctgcgcccctgaccaaatctgaccttgaattataataacccccacgtgtcaagggtggaaccaggtgaagataactgaatcatggcagcagttttccccatgctgttctcatgagatctgatagttttataagaggcttccccctttgctcgccacgcattctcacttcgtcctgctgccctgtgaaaaaggtgcttgcttctcctttgccttccgccatgattgtaagttttctgaggcctccctagcaatgcggaactgtgagtcagttaaatctctttcctttataaattacccagtctcaggtatttctttatagcagcataagaatggactaatacaaccaattgtaatattttcttctttaaggacatttaggttcatttcattgtatgctagaaaaacttcctggaattcatacccttaatagacaaatcattgtcctctttgcttattatttgtttaccattggatgtgagtctcacccaaacttaccagtgtttgtccaggttttgactctcccttttccctacttttcaaacacaaaggtgcatgcacacacacacagaggattttgcttcctccctgtgtgatagactcagcatggagcagactgtgttgtccttgagttaaggagttggagtaacatgatccaattcgggagggacatgttttcacaactccgccgttatccttgatggcagggggtgtgtctgtgtgtggacgttccctgcaataccaagcacttaaatgcgaccacactgagagccctcattagtcctaggcagccaaagtagatttgctgagcatgccaccatccaggctggagagactgcccacatggaaccagacgccacagtggagaggggagccaattatccaaaggcaaatgagactctaattacagctttagctaaagagtgggaaattatttgaggagagacttcccatttctggtgtaggcacaacacaggacagttgttcagaataaggggctggatcaattcctgattttgctaccttacccgggatacttcacctctgtaagcatctgattcttcacctgtgaaaggaaaacaatatagacggttgacctcactggtttcccgtgagcattgaatgtgatgttgccggtgagaggcatagagaggcctggtccttagtaaggactcataagccaagtttcatcattaataactattactagtgctactattatttgcagtcatctggtagcatcatagaaggtacaactggaagtcaggagagctggagtctcagctctgcagtttcctgtgcattccaacttagagaatgaattcatccctccgtcttcattttcctcatttctcaaatgagaagcttgaatgaggggatacgtgagcacacattccctcctgaggtttgtggtcctaagctaactgtaacctagggttcagggtttgagttactctgtgcagcagcactcagcaccttccactgccacaagtgctcctggatggtgggaacctggctcctcagttactatttctggagttcttactaacacacagaggtgcattgtgctgagaaccatatatcattaccttcatgaatcctcccatcaacactgtcttacaagggctgttatgatcacctctttgcaggtgctaaagctgagatttatataggaagctgggatttaaacataggctcctaacacccatactaaatggtctctgtgtccacagtgttcagtagtgagtagtaatatttttgttcttataaatattggttgggctgcactcgaggatttggaagaactgggatggagaggacactcagcagtgtgctcttattgcactcttctctcttttactcagtcctttcaaaattgtaggcacaaaagtcaggaaggcaacacctgtaagactttgggggcagctcctgctaccttagccctgtctaactttctctctctgtaaaatgagactgataaacagttgctctgccctacttgcctggtagagtcattttgagctacacgaaggattgtatatgcgtgtgtgcattaaagaatttgcacattgggcatatcgagtgtttgagctgaaaggaatgttagcaaccagctgcccagagatagtcaaattcagcaattgagagaaaccctgaaggggcttcaccttgggtgtataacaagcaggcccacttctccctgcttcttagaatagctcactgtatctatgtctctgtcagtctactgatctaccaatctatctatctatatatccaagaaaattttcagcaaaaaaattctaagtctaaagaagtatgtggtattcgtttttctgtgcctggcttatttcagttagcatcacgtgaaaaattgatctggctctgatgagggatgttgatagtggggaaggccacgtgtgggtggggacaggggatatatgggaactgtgtacttttgactcaattttgctgtgaacctaaagctgctctttaaacaaaactactccaaaaataaaaaacaaatacagtacaaacattgacctgaattaccaccacccctgatccattttacagaggaggaaaaaaggccctgaaagaggaagtggctcttctaaggctactgagtagaagagttaagatagaacccctggttcagctttttctgcccacataccaatttacttaccaattgttagcactgaaagtgtggccctgtccctccctggcttaaagggtacacttcagtgacttagggagggggtggtggggcttcagtttcactgcctgtgctcatggtggtgcctgtggttggggggaggggacatctctgccattgctggctccctggcatcactgtgcctgcgattgtgagctgttggtggtggtgtccaatggctcacactggctcattgctgggacagtgggataatttcctagggccagctctagaggaactcacaagatgattaggtggtggctgaggttcagatgggttcaggctttctgccccaccagcttctagctatgcaggtccagccatctccctgtccgtctctgtctgtctctcatttgttctgtccccaccccacccccgcatcatcccatgcagccccttttctaaaatcttctgcttcaccccatccctagaggaactccccctttccccttgctctcttcttaagcctgaacaactcgcatcagcttagacaccagccagttcctagggaggcagttctccactcagtcccctcaggttccaggtgtggaggaggtgtggtgactgactgtggccccgtagagagtgtaggctgcaggaattcatcccgttgcatttgccctcccagagagagctctaaccagttttctttctgggtcaccgaagcagtaaggcacaccttgccaaggtgagcattatttttttctcagacccagcgtcttctaatctactttgggggtcatgtatttccccttccaccatggctttggccttgatccttttggatctagcaaccctggcattgctgtgctaagaagcatgtggctcttgcccatccagcgtgagcccagtttgccctggtgattgccaccttcccctagctgtaaactctgctctatgactgaggagggacggagtcagctctggttagatttgtaagttttaaggctcccccaacccaataaatgtgtgtgtgtgtgtgtgtgtgtgtgtgtgtgtgtgtgtgtgtgttgaatcgttctaacacaccttccaaaatgcatgggaaagttgtcaacttcttttctcatggtgtgttaaaagaatttggcatccaataaagtacctctgggccttgtgtgctggcagcttctgggcaggttgacggtttcctccctgttcgtatttgtttcatcataagccaaacaaaagcactgagaatccatgtattcgggatctcaggggcctctcctccttctcgtgcttctctaagattttccttgtgcttacgtaacaccagcttcctgacttcaggtaaagagtgtgtgttttctctctgtattcccagtaactggcactgggataggtgtttgaaggtgaaaggaccagttgccttcattgaaagatggtaatatcgtctattgaagaaaacactacacagtacgtcttcacttattgtcatccataggttcttgggaaccgtaactttaagtgaaatgatgtataacaaaaccaattttgccataggctaattgatataaacaagagttaagttcctaacttaaaatatcaccataaaatatcgccatacttctaaataaagaccaaaacacttctaatattatacattaaaataaatgtgagctatacatacatttaagaataataaaaacaagtaagatcatgacttacccacttattccagttcagggtcctggtggctagagcccatgctggcatctcagggtgccgggcggaaaccagccttggacaggatgccattccgtcacgaggtgcactcacacacctatgctcactcacacagtggccatgtggacatgctaaatgaacctgatgcacatgtctttggaatgtgggaggaaattggagtacctggagaaaatccacatagaaatggggagaacgtgcaaactccacagacagtggccccagctgggaattgattttttttctcatcaaggttataacaaaacaacattgaatgaaacgatgttattcaagacctgctgtgctaagagctggaaaatttaaactctagtccaggaaagctactaacaagcagtgtgaccttggacaaaccacttaacctctctgggcttcatttcacattgtataatcagaatgttggatctctgagatcctgttcatctctgacagtcagccagtctctgttgccaggacagcatagaacaagagacagcagcttcaagtactatttaaactgcctgaaaggcattctgttatcctggggttttgtgggcactagtgtcagcctgacatgaaagacacagaaggactcactgtgtttggatgtacccagattagggtattgtccacacaggccgtggtgtgtgaatccagtgtgtcattgagaggcttgttagaactagttctgtgtttcttggcatgggacctggaactctaccactttctgcccttctccacgccccctctcccgcccccacagagaggggcagcagtcaggacattgcccccttttgcaggtggatgtttctctccatgcaagtgtttgtgtgggtctcaaaaatttgcttttcatcaggctcatccctgccgatgtcccagatttgccagaacccccgtctgcagcaggatgctttgttttgtttgttggtttatggggattctgggctctgtctctgggtgcagtggcaggttttaaaatcaattacaatccaggtaacaggaggttcaccacagcactctgctgtctgttcaaggcctgtgctgagaaattaagtaggtcccagttacctctcagaaaatttgtggtatttcaggggactacagcgagttgcaaatcttgataggtagtgggacctgtcagcaaacagcagactggcttatgttgtggttcagcaggaaaaggagagaataattccctgagcataagatgtgttgctccctcttctagtttatcaggagatagccacatacatcaagagacagaccctgggtttggggtacaagcaggagagctggttatttcttgctctgtttccaagaagacgggaaactgtggttgtagtctccttattcgtgatcaggttccttgcagctgtttcatctccaggcctaaagctgaccagttactcctttctctgtctcctgccaacctagggggagaacactaggcagcttcctccttagttttttttttttttttttaatttcttgattcatcctgggaaatgggtacatccacagaatgcctgctgtgtgattgcaggtctccaggtccttctttctacgccttagggtcagaaatagggggaacacagagagcaggactacctaactgttttggagaaattcaacagccatgtaggtcttcggttctcaactgcattcgaggtttgctttacccatccttgcctagaggggatttcatccactctgctggctcaatgccatcctgctgcctacagctgcaaaacttaatttttagtctacgtcttcaccttcatcccaagacctgtatcgttaactggctctctgacatatcaaattccacatgtgatagttggagccacatttttgatgaagagaggcaatgtttagaacaggttttccaattcaaaaaatgtttattgattctctggcataaacaaaacattttgtagccatttagaaaatacaaagatgatgaaaatatggtgatgtcctcaaggagcttgcctttatttgcaaaatgaggcattctttattataatgcagaatgaatattttatagtagagataataagcaaagcgccatgagacttcagaggagagagccagaggatgttaaagtcattcttgtagtttaaaacctccaaaagattatttaaaatgaacaagaaacaccaaagaacttcagaaattggaaatattcaacttttattatattagatttggtaacctctgattttttcatgatcttgactttggccccaaatgtacaaagagtgtttgttggatgatctccttaccaaagtctagagttccagagagccatttcagggttttccatttggtttcatagttgaattgtattcatcggtgactttggaaaagtcatgtcagttttttggttcttggcttcttgatctgtaaaatctggattatagtggggttaaatgtgaatattaaataacaatgctcaacacagtccctgaatggcaataaatgctagataaatgatagtttgaaattagtatgattattatttccattttaattattcattaataattattatacccatttttattatcagtttgaagttagagacactgtagagcattaaaaataaaaagttgcttaaattgactttttagaatatcaagatagaaaaaaagctatgggagaaagggtgttcatatatactataataattacgatactagttacttttaataatttttataaaaacttacaaagtaggttgttatcactattttacagatggataaacctgcttaaatgtgccagttctttccaataagcaagcttgcagatacttaactaatttttaactattgatgtatttgttttttcccctcacaatctactgtctcctaggaaggcggagataaacctgatagtttgaaattagcaccctcttttactcaaccagcataaaggactgtttgacccaggcaagtgatgaggtgatttgtaaggccaatttaaatcagtgtcttgcccactggctttcaaagtccagggatgtgcaggtatatattttgggcagtcaggttctgttgtgcgtggattgtggtcaatttcattgatttttttttttttctcaacacaacagtttcaaaatgctcttttgctccccaaatagctgatcttttcaaaccttttgctattttttcctggtaagactttcaggtaacagtgtaaatgcaatcaacaaccacacatttcagacgatgatgatgatatttttgaacatgtttaatgatttcacaaaacacagacgggaaaagttgagtggctccttggagaaactgcctaatccaacctcttcattttcagcccaggaaagtgtggttctgaggggacatgacctgcccaaggtcacaccacaagttggtggcagaattgggattaaaagttaggaatccagattttagtttctttctttcatttgcagagtaagcaaaactattttccttggcatgaaagataatttcaggtgtgtacaaatagagtactgtatccagaagggaagttcattcattcaattccttttcaatctttctgattatgtcaacgattgtgtatctttgctgttttgtttttatctttctctaataatctcctttgataacaaagatggagcagacatcaggctcaagcttctcttagtatttaatataagtgtttatttttattgtattgattgttatgatatcttccatttatggcaaaggatactggttttctggttgaggtagcaaagttttctttcaaaataaacttaagcagattcaaatgaatttactttatgaaaaatattaagtaaacaatagtgcaggtggaaattatgatgaatacatagcaggtttcccactgaaaaacataatgataaactaaagcttggaaaatacttgactggattttgccctttagaaagctctaagctctatgaagatagatatggctaaatcccagtttccttcttattcatgtcatgtcctttttatggagcagtcagaaaaacaatcattagatctaaaagaagatcataaaaactacccgtataagagatgaactcgtatgttgataacctcattatgggtagcttccctacaagccaaaaagttggatcagcagccaatctaatttcagtatggaggtagttttgtttatattttacgttataaacagtatgtgaatgcatttgaaaacagaaactagtttcatttttcaggaactgatgctgtattttaagatattttataccttattcttgcctttttatccttcctaagaagttctctactttctgatcatcttgctcttccatcagagagtgtgaatgaagaaaaagatggcaaaatgcaatttatcaaatattttcccactattaacacattttagagattagcatatatagaacaaatggaataggaatattaaagttattcattaaaatggagagtagaactctccacatatttctttcatctataatttaccaatatcaaatgaatacctggaaagaaagatgtactagattgcagtatttgagtgtttttcccattatctttaatagcaattcttccagtattgcttaatttgtttccctgctccctaaagcagaagtttcttcttagctatgatttagttatccagggatcctggagctctgaagacccattatggtttggctaagatgagcttgcctttcctaaatgccacacacaactcattcatgccccctcttcctgtgggcttcttctgctggccattagtgtttttttgtggaatgctccttcattggaaaatttattctcatttagaggaatctggtgacaaaaaaaagaaggcggagtcaacttctggtgacttatgggcagttagagtcaaacgtttgaaaaatgggcttctgaatcagcagagattttacaaagtgactggtggaactgcatacaaatgggtagagtacagagatgccaagaaataatgctacttctattaccactaataaaaagactgcatttcccagttcagggctagaaaggttaatgatgatacattcttttttagtatcaaagattaacatgataacttgcatattaaagttaattcagacctactgctaatggaaggggcatacaaaattaatttctacagcacctcataaattatgatcactcactcttctttggctggtgttctttgtcttggcaggggctgcatgtgtacttaaagtgggcacacttcagttagtaggggggcatctttggcccctgaggaatttgggaagcttggggtgtgtgccttgtagctcttaatcactgcctgtctgccggtgttttcctgctggaatgtgtgtactccattaccagccagcttgttgactggcgtggatcttggttttaatatttaatgagatgatgaaaccgagctgaaatgagaagaatgtggaaggtgggagaaagaatgggaaagataagaaaagagctgccctctcttgatggcaggagattctccaagaagagttcagcacagcatcttcaggcaactatttgctgtcctgttgagtaccaaggcccagctgacatagaaacatagccagcccaatctttaagagcaccggctctggagtccaagtacttgactacaagttccagtataatcccttgggtaatttacttgactttttcaagacttactgtctgttttaaacaggaaaaataatatggactctatgtatacatgtacacacacacgtatttatattttatataaaattaaatacaactttagtataatttacatatagaaaaatgcacacatcttaagtatatagtaaatctattagccacgacccttatcaagatacagtatattttcattacccagaaagttacatataaatattttaaaaactaaataacagtagcttatacttttataatgctttccatgggccaggtatgctgatctaagtgctttatgttatcttgtttcattctcaccaagagaggtgctgttattatttccactttacagatacagaaacaaagatacagagaggttaagtgatttctccaagatcacacagacaataaccgatattccacttccgcactctgctcaccgttgtctatatagcacttaccatgtggtctattactgactaagtacattagaggaatgagaatggagcctccttgatggccgacatttccttccattcctcttcttcatagtccagtttatcattccaccttgtcttgggctgacgggctgtgcatggtactctagcagagtctttgagggaaaagatggttccatccctaccttcaacactcagatgcatgataggtgctctagaagaagtcattgactgttactcccagaaaatcctgtcccccagctcccacccaactgtcactacttgaaattttgacaaacttacaggtgggctcactgggccccctgccagtttgggctgcttagccacctttgggctcagtcttaaccttgtccttttgatagtctaaaaatttcaagtgaaaatccctcctgtttctgggcctgttgtggctcccttgtcccagcttcccatactcatttctcctcagtcagtcctcattcttgcccagttgctatgcttttcctcctccacttttgctttttttttttttttgcctcctcttctgtgtctgtcttctctttctttgcctcctctttcttctttttctccgtctttttttcctcttttacctcttcttttttctttttctcttcattcttcctctcttttttctgctccttttcattttatcatggtcttcatgagcaccaccaaataaaattaagaagccactctctgctaaatgcattgtaattgcccatgggaaattattttttttgtagggggcagccgcatccactgtatctctcatatggttaaactgatgcttacccatttgtactagattattttcagacatatttagccaatcattcctttgacatctcgttttgagtgtcttatagatactcaaactcattatttccaaaactttactcattcttttcaagaaaaccttctgctcttccatgatttttctgcctttgaacctttctcatatatgccttgaatctggtcacatctctctctttatcacttgcatgctggtcctgtacacccgtgtgtcatatggaatgcttggcatttggcagacgcttgacacatactttttcacatgaatagagaaacggaagtgccatggagggacaagcacacgctcatgaaacctcctccctttattttttttatgtttcacaagagcactaaacacagtcaagtgacttgaaaccattagcttctctccagttcttttcagagctaagatttcacaatttgagtcaaaagcagcaaatgactactaaactcagtgtagaacattaacattaaaacacaatatgaaaaatttctttaagaatttcgtgccagaaaaagctatggttcctgcaaggaatttgtcctcttctatcctaatgatcaacaaactctagaacttggagggctgcccttatggccccagtaagggcagttggagctcatgttgtcttttccattgggatgtcatctttcttctttcattctttttggactaaggtaatgtataaagaaatacttataactaataataaacacatgaacaaataatgtgcaaaattacttgcaatttcataggagtacaattgtagattcatgttgggggcactgagcataatttgaaatatggtatgtttctttttttaacttttatttgaagttcaggggtccatgtgcgggtttgttatatgggtaaacttgtgtcatggggatttgttatgcagattattttgtcacccaggtattaagcctaatacccattagctatttttcctgatcctctccctccttctactctccaccctccgatagaccccagtgagggttgttcccctctgagtgtccatgtgttctcatcatttagctcccacttataagtgagaacatgtagtatctggttttctgttcctgcattagtttgctaaggataatggcctccagctccatccatgtccctgtctccactcatacctttggacatgatcttgttcttttttatggccacatagtattccatggtgtatatgtaccacattttgtttatccagtcttttattaataggcatttaggttaattccatgtctttgcaattgtgaatagtgctgcaatgaatgtacgtgtgcatgtgtctttataatagaacgaattatatttatttgggtcaatacccagtaatgggattgctggatcaaatggtagttctgtgaaatgtaatatgtttcattgtacatatgttttcttactgctcccatcaattgactgcttctttcctttagtacacatggactgttcaaaggtaaggagcatatgttgtcatctgtttgcacagagagctcattacatgtctttaactgatatttattatctttatttcctcccatctcatactttccccagttcctcttttattgctgtagagtccaagcaaaatctctttgatcctcttatttaaatattgggcctaagtttatgatacatttcttaaatcactctttgctttgggccttttagggaagggctccccttggctctttttcacaagtgaagaaataaagcaggcaagagcccctgcctcaagtctgtctcatctctctatcttcttagctgagtgcttttagaaaagaaaaccaggccagcggataaattcttcccatttccatttttatttatagggagaaaaatggctgtggttttttcctttcctctttgaagtttgcttccagttcttcagtttatttgaaatatagtatacttcttggttttccttttgtaataaacaacactaggttttaaatctgtggagctgtaaatgagaggagcttcagcctcctcttcttcagagctgatatggggaaggtaagggaagaggagaatcagatgatgattggaaacaattacacaaccattccattttgctaatgcttgaatccaggataattttctcatttaattctctgaaatgaagggcccctctgttagccttaaaatgtaaacaagaggcttttaatgcatgattttcccagaaatggaatgctagctgctcatattgattcaaaacattgctgttggcttttgttctttttggtatttgtaagttttgtgatgggggcaatataggattgttcatgtgtggcttgaggattgtcagtacgtggtattattattctaagttgcaaacagaaattaaaaaggacattcagagaacgcttgcctgagccctccattagtctgtccacatacaaaagggaaaatggaaatctgaggcatatatcccaattatttcaatttatacccacctcttggaactcaattctctgagtttggtattcagaccaaagtgtagtttgtttgaatgatgcagataatagctttaagtccactttattccagcctgtctggaccaggcatttgtaaaatttataagttagcaacagtggaaggaaactgaagctttaacatgctctcctttggactgaaaaacttctgcatagcattggatcccaatgcctcattgcacttaataactgcaactgaatttgtatcatgttttactttgatcttcttatgaaagagtcattctcatctccatttttggagggagagaagtgaaatggctcatccaaggttacacacagcctggtggtagtaaggctgggattcaaacccaggtctcccaacctttaacccaaagctctacttactatgccatgccttcctctatgattaggtaaaacggctcaggggaggtggtgaaggtaaagaaacacacatgcagttctccttctacacctcccatcccacccccagctgctaccacctagtttcctcaaggataacactgaataatgagtattgatcaatccaacactaaacagggttctgattctgtgagttgccctaaatacgggccccttatttgccttcagcaaacactcactcattcatctaacacttactaagatcctactggataacaggcattgtgctaggaactgtaggagacatgacttgattgagattggatatctcaccccaggctctcactgtctgatgaggaaaaggtagcgaatggcttgaagtcatgattgctgtttgctagccaactgcaatgcgatggggaagcccaaccgactatagttgaataaaaaaatgaaagaagtgaatgattggactaaagactcaaccactgagttgactaatgctcattattgtttaattctgaggttctaggactgagatttcttttcagtcccctgggactgtaacttataaaaccacaacaaacatcaatcaatcattaaacagaccaagctatccaggtcttggattttctatttaaggccaacttaagggagttaacaaactcagagggtggctgcctcaagctagcagaatctagaaattggtaataattgccctgcactcatgagccggagtgagtggggctggaataacactggcgttggagtcagacaggtccatgctggggccttgcctctgttggagacacactagctgggtgagctacatggagctcctattttctcatctgtaaaatggggacaatgcaatccattgaataggttttggtaaggattaaataaattctcagtatgatgcctaggatctagcaggagttcaatgtacattgcatatctctcacaattaatattccactctctcactccccttcacaccaataatttctgtccctttaaaaaaatatgttatagtgaccctggctgctgagaagactctatttgagtatgtgaccatggactagctaataaagagataaaagtgtaggagttcctggttaagtagagattgagagtcatgaaaccatggaattctatgagtctctagaggagactggcatgagggaataagggattctgtatggtgtgatgtaaatgagagacagtgggtcagggatgatagccctggaagggtgtgggaggtgctgaccaatctgataggtgtcctgagcacttataaatccatgtgaattcagatgtcatcgaattggaaatggtgtcaaaggatgtgagacacagatcttcatagtcacaacgttactggactcatttttcctcttgcatgaatttgaagtagagcactttcctaaaaatcttgctttatttatgtaatgtgtgtgtgtgtatatatatattttatatatgtatacatgtatatgtgtatatatattttatatatgtatacatgtatatgtgtacatatattttatatatgtgtgtgtgtgtgtgtgtgcatatatacgtaaatattttttaaagatgagcgtcttgttatgttgcccaggctggccttgaactcctgggctgaagcagtccttccatctcagtgtcccgagtagctgggactgcaggtgcatgcccagcacccagctaggaatccttctttaaagactgtcaagattatccagtacagaggcagcttcgtcagccagaagcttttttatttgctgctcctttcatcaccaggatgaagaggtgggtgcacagtcttccaacagcccaaactgcattcatctggtgtggcactgcaaatgtaatcattctaagcattaggaaacaaatcaaattttgggtcccaattcaattggccatatatgcatttttatttttctaaaagcactttctaaggagctggattggctttttatttttcccaaagcatttctaaggagctggatttaatgagcaagctagcaatgaggaggccagccagcagctgcaggcaagtgcagtggggtaactaagggtgcaagtacctttcagaacacactatttatgtcctagtagctttcagaaggcgtgatgataggctatctcagtggccatttcctgccatcggagagatgttgatgggagtctttcattacttgccagttgaggccaggaaatggtctctatgattacaccctaatttgataaaccctaaaatgaatctattgctgtctcactcaaatgctccaaaatgcatatgcttacacaggtatgtagcacatctaatccatcagcaggtcatgtcgactctgccttcaaaaaataacccatgttcatcgacttccctctgtacttgcacccttgtctctactgctgcaaatgaatcaagcttttgtcttctctcccctgcactgttatagtaaggaagcaggatagtttaataggtatgaatatgggctctggaatcatatttcctgagtttaatgcagctctgcttactagctgtgtgattttaggcaagttactgaacctctctaggcttcagttccctcatctgtaaaataggtataatgatatacttcatagagagaatgcctggtagacagtcagggtgcaataagtacaagaccccttctttacctctacagaaagcctcctcagtgttttcccaccttcctctctaggtccgccattaaaaacacaaaaatgaaaagtgtttatcactacccaggaatcaaactttttaccatgggccccagggcctgatgagacctggccctggcaacttctccaaatttatcatctcacattaaacccctgtttcctgcaatccagccacatttgtgtccacatcattcctccaagttctgcagatttccaccccagagcctttccatgccctttcctctccaagtgtgcctccctgaaatcagtgcatgcagctgccttctccccgttcaggtctcagcttaagtgtgcccggctcagcgaggccttcgttgactgcactgtatgaagtggtcttcacaggcccctagattctcttcatcctgtcacctggttaatttccttgctggtagttatcagcgcccattgttgtaacatcagctctcatggcccccaactccagcacctgcctcccagggctgccctcgggctgcaggaccctacttttcccgggaactggaaccaccgaaagcgcagtccacccgccgggtctgaacattccaggttcatcacccctggagtctacactgtctccagaactcctcataggattgagttcaaaagttaccttttgtgaggcttgcttgatttttgtactcggcttggcctccttccctccacttccccactcctcttgcatatttttctggaacatctcctaataagtcctcttcatccaaacttcatgttagagtttgcttctggagtatctaacctaagacaactattatcttgtttatttaattatttatagcactttagcactttactagaatataatatccatgagaacagtgagtattgactatgtgtgtatgcatatatatgtatatatatttaaacatacatgtttaaggatataaatatattgcatgtcgactctcagagctttcaaattatatttataatcagtgtgactttttgggatacaaacatattcacatcctgttaaaagttatttactttagctgggcacagtggctcatatctgtaatcccagcactctgggaggccgaggcgggcggatcacgaggtcaggagatcgagaccatcctggctaacacggtgaaacccgtctctactaaaaatacaaaaaattagctgggtgtggtggcaggcgcctgtagtcccagctacttgggaggctgaggcagcagaatggcatgaacctgggaggcgaagcttgcagtgagcagagatcgcgccactgcactccagcctgggtgacagtgcgagactctgtctcaaacaaacacacaaaaaagttctttactttgggaggccaaggtgtgtggattgcttaagcccaggagtttgagaccagcctgcaacataccaagaccccatccctacacacacatatacagtaacagttccatcagttacatgtcagtccaccctccctgctgtctctgtgtttctaaatggcatgagccaacttatagggtatttgcttattaggtttagtgcaaaatcactttttacgttcaatataaaggatatatggtaaaagcaagagcttggtttggactttcgatggatatctagtataaagttctggaagtacatttttccttaaggatttaccgcctaactatattttctcccttctaagatacctggagagaattttaaccaggtgctgagttctaacatttctaaataggccgggtttgtttagctgggagatacattttggtccccgaggggttcataaagtggagacgtagatggcgccggaggctcgccagagggctgcaggtgatgattctgggtgttgtaatgaggcatgtttctgggggtgaggcaagtgactcatggggagctgctgaagaatgcgttgggggaaaatgctagtgaagttgtaaaaggcttgtaacctgatctggaatatgaaatttgtgggtagttattgatttcccagtgggcggaattagttttcttcgtgatatgctggctggaggagggaggttgtgagaacaaattgctaactgtcagactagaatcatgtctatggagatctccctttgtgtccagttgatccaaccaagtggctttcaacatctgcaaatgctcgcaaaccgaacagaagaaaagcagcctggcagagcagagctggatttacactggtcagccctgcctgggagaattttgggtttcaattacacagggagggcagggtgagctgtgatatctatagcatcccccgccccttccccattgccagtcctccgagagagttgagctgaggagaattcgactttcagtcaataggaacttggccaaagccgaatgaatttcaccttaaagtctgtgaaaaatggaacaggattgaagagtcgattaacccgtgctggtgacaaagtctggggctggttatgagtggaatgagattccaagtgcaggctgccacagtcaggcttagaaacgtgggcactcatgctgaggatgtgactgagccctgacacagatgcattgcttgtgtttaaccctcttccccaacactaagagaggggctagagaagtaccgtgcactacactccagaatgtcctaaaatctgtattctgatggtgggaccaggatgtacctgggttcacagattggcaagcatttccctagcagggatatagtgtccatcttgtcttatgttttatgagtgattctttgggttctccttctctcaacatgagtttcatggaggagaggggtaatggcatatcccatggaaattgcattatatcaaaaggccactgctgaccttctattatttctgggtgagtgcatgtggattggtgtagggctggtcctgaactggtacctctcaaaaaacctggagggatgatggtgtaccccaactacagcttgggccttactttcatttatgggatgacagcaagaatctcactggttttcctgttacatagacaatgaccatatcgtgtgataaatagtaagatggaaatatatcgaaatatattctgggtgctataggaatgaagaagagtcacccaaggcaaaggcggggtgtcaggaaaatcatcctagaggatttgacatctaagttaacagctagaagggaaggagtcaggagaagatggctgggacaagagtattctaggcaaagaaaataacatgcaaaaattcaggagaaggagagagtttgtggttggaacagagagagggaggtggaggagtggaaagtggtgagcgcccacgatgagttaagggaagagcttgctcacagatggcctccagccatgccagagagttgaaaaaactcattctgagggcaataggaagttactgaagaatttcctgaccacaagggactcctgtgcagggagcaggtagggtggttaggagacttgacacagaacatgaaggaagttggcttgagggtagaatggacataacttcatgatggattagatgctgatgtaaagagaagaactgaaagatgatttctttgcttggttgactgtgtgactgggggtgtcctcactcttgagagacagcaaaggagaaagaacagacttgtggggaagagggtcaattcagatatggtttttagaagtgttttctgctggagctggattgtggctgtgattgcagatgtgattttggctggatgcacctcaaggtggttttccaaagtgacaaagaattttcatttagttcttccaatggagctgatactggcaaggagcaggtgaaaaaagggtcctcttatttgaagtgtccctgagccatcaaataattgcaaaagcacaccacacttcaagagggctttgcattcaggtaggtagcactgaccgccacatgacaaaactttcctaagggaggacccagaacccagaaataccgcattttcctctctgcagtcacttggacaaagaaaaccctttcaattaaaacccaaagagttgagtagttctgcagattcccccatggctggtctgaattataatttggacttgtcactcggtggtaagtctcccagcctttgtcagacattggatacctaaggcaggaacccagcctgggtgtgcaggtctctgacattcattacctctgcctatgaagatttatttcagggtgtgaactatttatcttcaaaaccatttgtgtttgttggcttgacaatcaagcagcaatttggaaatgctgcttcctgaagctttacgactaatataatttcacagctccaattacaaatgagaaaaattatttcatctacaaacaggagccagacatttctgagaaatcatggttaaagagaagacagagtaccttctgaaaaacaggccatgttattaatggtctcttcagtgaaaatcttgctgactctccacaccatgagcctccatcttatggggatgctggttttgagaatctgtaaagcagctgcctttcaggttgataaaccattgcttctcctagtgcctggtctgcagctcccacagcctcagtactctgtgagcaaggcaaacacccactgtctttccacctagcaaatatatccttcctcctgcaacttcctcggaacctatgttttgtagaatcctagaattttgcatgtggccttaataatcattcagttcatcccttcatctgatactttacctcttccttgtgcctatctatagacagcaacctactacttgtatacttctaggaatggagaacttactgccagactttcccgtgaaaaatctactagcttagttcaattttaagtgggatttaaagtctggtgacttaccaaggagatctttcatatctaaaatctcctaagtggctttttccttggattcatatcttagtaatgggatttatgtgcggtatctcaactagagtgctaacagaatgaccttttaaggaaaaccctgacctcagttattccacagctctgttttatgaccactcctaataggttgccactcctaagatgtaaaggtactaagtgtttttcctgtctactcaagtctgcttcttatctctgttggctccgtgcagtgctgggtagttaacccttggtcattcctttccaccctagaatagtgactggcacatagtaagccttccataaatgtgtagaatgactgactgaaagagtcagttaaatgtgtgaatgggttagctcttgatctgcctttacatagttccttcctgtaggtccaactgacctcattttacaggtggagaaagttttaaataatttttaatcttgagccacaaaaagctattttaagccttaaaacattgtcatcttgtactttaagctcaaggcaattgaccacgcttgatttgtttcttactaccttgcttcaagagtttatcaaatctttagcttcagcagaatccaaatacgttatgtcagaagctgggaatctaggggacaacctgcgcactcttatactcattgtcatcacctggattgtcatcaccatggcatcttcactgcagtgacacagatttcctgaaggcacatcttttggtgactcccttttacccagaggactgtggaaaaacaagactttctgttgtattttaaatctccttttttagaatctcttattttacttttcaaagaggaagactttaccactttatctaacttagtaagataatgcacaatttttatcttctggttgggcttaattatcacatcaatgaaggcataattgggaagctaagtatcattaagttagggaagttattcgtatcccaatgacaaagcatttaccacttcagatgaactcacctggtttttctacaacaagaatttcaacacctaatttccctctagcaaacaaaagattgcaaaattacaagttcacatccttttgaagataacttttagccaggcaaaagaaaaaagagaagataacttttaaaataaactttttaatgaatattgtaagacatttttttaccctgcttaataaatacatctggatgaaaatctcaactttatgatggcaagatatggactaaatatttaacttaagtaatagggtaattgataaagtaatagatatattttctccaactttcttccttatctttctaaacaaagggtagtggctaatcaatgtattgtactctcaaaagtccttaggccaacgagttggtttttttttcttttgagacagggtctcactctgtcgcccaggctggtgtgtagcggtgtgatcatggctaactgcagcctttacttcctgggctctgatcttctcacttcagcctcctgagtagctgggactacaggcatccatcactatgcccagctaatttttaaatttttggtagagatggggtcttcctatgttgcccaggctggtcttgaactcctgggctcaagttatcctactgcctccacctcccaaagtgctgcaattataggagtgagctaccatgctcagccccaacaatatcttcagtccaaatttctcataaagtgtcattaaagctgtggcctatgattctatctacaattttaagcaaagcagaatcaaaatttttgtcatctataattttctgtttccatagaactgacacttccattgcaattaagaacacttcttttaagtgttatctttcattattctccttccaagagaatataaccctagatttatattctctaaaccaccagtgttccctaaatcctcactcttcctattgcaatattatccacttgtcacggactgtctcaaatgccacctcctccattcattcagccaagatttactgactcactgctatgaaccaggtactgtatcaggcacttgaatattagttcagctctcatggagcttaatctttagtgggatgaatggacattaattacgtttattggaatttaattaaaaactgagatttggctctgagagaagggatatactcttattagatcctataaagtcttctatgaaccttctgaccagagctcatgagagggcttctgaagcattcaatttgttttgtgactctgtaaattgggactctttggtttcaagcaacagaatcctactctggtaaatttaagtaaaaacaaatgtatttagaagaaagggaataatccatagaatcagaggaaatgctgaggaactagttatcggagaggagagactcagaatcttggagggagaggggactcagcatgtgcccctgggcagcctccttggggcacttctgggatgaaagcggagcctgagagactacatatttcttttttctttttcttttttcttttctttctttctttttttttttttttttttttttttttttgagatggagtctagctctgttgcccaggctggagtgcagttgtgtgaccttggctcactgcaatttctgcctccctggtttaagcttctgcctggcttaagctattctcctgcctcagcctcctgagtcgctgggattacaggtgcctgccaccatgcccagatagttttgggtttttttttttttttttttttttttttttttttttagtagacttggggtttcaccatattggccaggctggtctgacactcctgacctcaagtgatccacctgccttagcctcccaaagtgctgagattacaggcgtaggccaccatgcccagccaagactgcacatttcatgtagtgcttaagagcacagtctctgcagtcgggctggatttaccacttactagctgtgtacacatgacaagtccctttgtttcctcatcagcaaaacggggaaataatagtgtctacctcccttagtcactaggagaatttactgagatgattcatgcacgacacttgcaacagtgcctagcacattgtaagcactcaaaatactgtgtattagtaccgttggcagttatcattatgaacgttccctcaagattcagatttcaggaggccatcctaattggggccaggtgtccagcccttctccaggggaaggcagggagcctatgacagcttctcaggattatagcccatgacagtatgactcccccacgtacagtcagggtgctgtgccagaaggagtgggtgtagctcttgggctgacagaataagagatgtcctctacctcttctgacctttgtcttattctaatttctgccattgttcattggttttgctttttttttttttttcctgtaatcacctctgtcagtttttaagtacctaatgggcagaaccacatcttatctctgtaccttgataaggagagtatcttcacattaaagatgtccaacatctatttgttagatttaaaatgatatcctggtgtgtatgattcatattgcagctcaagcagcatctgagtcggggcagcttgacacatgtttggattttttttttttcctcaaggttttctgttttcaagggaaatatggagacaaagctgcgaagggcttcagaaccttccagaaatttccctgaaacagcaatgtcaagagacatacccttctctgcaaaagttttaatttctttctttctttttttgagatgcagtctcactctgttacccaggctggagtgcagtggcaccatctcagctcactgcaacctccatttcctgggttcaagtgattctcctgcctcagcctcccaaagagctgggattacaggcgcatgtcaccatgcccaactaattttagtatttctagtagagacaggttttcgccacgttggccatgctggtaaatgaaagcaatgtgcagaaggatgcaagtggaaggttgttcattttgtactgtctgtaccagagaagaatgttcagtagtacaggtatggctgaatagaaaaatacatccatgataaggagtactataaaacagttaaaaataactaagttggtccctaaatgtgataatacagaaagtgctccaagaaatattagtgagtgaaaaaaaatcaaggttcagagtaatatatacatcatggtccccttgtataaaatggaaacaaagccaaaataactatatgttttatactgataaacacataagtaaaattgtataaaagggtcttggaagtttatagtgacagtaatagacttaaatgaaatgcaaagttaaaataacactagatatttcatatggcacatttttatatgtatgtgtatatataaaatatatagaacatactagaatatacagaataaaataactggttgcctctgggtaggaagggttagaaaagggactagaattgtgaatgatgttctcaggaaatcttaacctaatctttaatattttaattttttacaaggagaatgtcttcatgaactatttatttaatgaaacattgtatgcatatatgaaagaaaagaaactaaaaaatgaggaattctacactactctgaactgtctttattccagaatgccgggacattctgcttcctgtcatcaccaaagagctgaaggagctgctggagcagaaggatgacatgcaacaccaggtcctggagaggaagtactgcgttgaattgctcaacagcatcttggaagtccttagctaccaggatgcggtgagtcctcctgatgatgtagatatcctggactcagactagggctaagttgattacattgtgaaatattgatactgatggatagcagctggagtctaaagataaaagtcaacggcttgctcagcaggcctacttttcctgtgactaacccccattgctgtgaaggatggctaggggactggagttaatcatgttagcattttgtctctgtgtgtcttgttggccaggctttctcagaatgtgggtatagacattattgcagccttttaagatggcttgtccacgtactcacgccctagtttgcaggggtgggaggaggagtttcctatgcctagacagcaagaaaactctcgtgtctgctttcttagctgatttacttcggttttgtttcttcagttaccttctgaaatgacaaaaatgattaagcctcttcctggatgagcagattgctggggctcagattccagagatagggtgtggagtaggatggtggtagggagatgcctgtggccgtgaagttactgtgtattttgtagacgtcattcagagattagctggggacggaaaccaaaggaaagtctcagtgggagtaagtggagggcttccaaagggctgaatctgcagaagataagccagatggggtggtgaagactgagaggtagtgattagacccaggcctggaattcttaagcattggaagatggaaggagggtgctggatctgacccaggttcctctggcagctcctctttgtccttgagtaatgtccaggaggtattcagtccttagatgggactggcttcagaggactacatagacccaaacaaccaatacatttttttctaagcatttgtgtgagcattgcccctttctctctcctccctagaacatcctcagagaagagctttctgaatgaactgtgtctattattgactgtaattcgaaaactctgcagagcaatgttcctttactggtcagatccatagtcaaccattatgatcaatttccttgcatactgtcttctcctgtctcttcctttctacacttaccatcccaattaagccgcttcttgtcttattactacatatgcatagcttgcttcattcattcatgcagaaatattaatacatatgacatacccggtgtgcgctaggcactgggaacaagaaaacctatccccaatatataacgactaaaatctagatgcatatttggggtacaagagctacaaagtgtgtgtgtgtgtgtgtgtgtgtgtgtgtgtgtgtgtgtgtgtgtgtgcgcgcgcgcgtgcgcgtaagcatttttgtcaaggaagcctacacaaaggaggtgaagcttcagctagtgttcagtggtgaataattaatgatcatatctctatttgttggtttctaggcactgtgctaaatgcaatctgcgcattctctctgctcaccctgatcctagatactaaggcttattattcccattttagagatgaaaaacctgaaattcatagacttcattagcattcaaggccaaataaatagagcaaataaatgtcagggtcaaaattcaaacacaggtcagtctgattcagactctgtgtaatcacaggcataggggatacaaaggcatggtctttttctttctactcctacctcatttaatggaaagacagtataataaccaaaagcttagatattctagattcattcagatgatgatgttagggtgatgatgtttctataaggacattcagtagccagctgttgagctggttccagtcttagctatttgatctttttaaaaattgtttttttaaagggagatttcagtcttactcatagtgtagaaacatgagggtttgtctattatttctgtggtaacatcctatataatgttgcctcagccagggaggttgatcatgcctgtgatcccagcattttgggtagcccagggaggaggattacttgaggccaggagtttgagaccagcctgggcaacattgcaagacctctgtctctacaaaaaaaaaaaaaaaaaggaaagaaaagaaaagaaatttgccgggtgtggtggcatgtacctatagtcctagctgcttgagaggctgaggtgaggggattccttgagcccaggagttcaaggtttccatgagctatgatcttgccactgcacttcagcccaggtgacagaacagaccctgactctctgtcttaaaaaaaaatttgcctctttctgttgaaaagccaatccacagtgttttttacattttagtaatgctcagatccctttaaatggggaaaaaaatgtgggtccttgggaatatgccagtggcccccagtttgggggatccagttataatgtgctaattgtcaagttcctggtttggtggaaagatggccccagttcacagttatttgtgaagtaggatgctgaggctctgcccatcccaggggagtggccccctagagctctaccctgacaggctgtcacccttttgcacattccctgacatcagacactggtgagaagaggctgcttgctgtcttacacaccctcgatacttagggcttcaaagccaagaagtgagtgggaggctctgagctccccgtgggggattgtggcatctggacttgaggtgtgtgggaggtgcgtgtcactctttaccgcctctgagtgcagtgctcttataatgaattctgactgtggggactaacccacccctttctccgggtgagcaactgtctttgctggatgagttattaaatactgttatcaccattgaatttggtagaaattttgatgcttttggtgagcttcacatctcacctctcctgctcatgaagatggaaatctctcttcttttctcaaaagcttcttcaatgaataggaggcattcagtagccatgattactttgagctaaactgaaaatgagaggcccaaaagtacctaaatttctcatgttctaatatatagcggctctcaacattgcctcattgcctgcatagtcatatcacctcgagagtttttttttttttttttttgagccaggtttctgcttctgcctcctgagtagatacaactataggtaccagccaccacacttggttaattagttaattaattaattaatttgtagagatggggtttcactatattgcccaggctggtctcaaacccctggcctcaagtgatcctcctgccttggcctcccaaagtgctgggattacaagccacccggggagctttttaaaagtcaaactagcaggagtcagccaaatgggtaggaagatggggtgggtccccggtgaaaccccatctccaagccgaagagtttaaaacctgaaagtcaagctgtatgttaaatcctcagactggattgagaacttgtcctaccatttggcacactttcctctgattgatccccacccttcgcttattttacataaacttaccttttcctaattggttttctacactgtcatgcccacctttgagtggtgtcttccctttaacctttttttgcgtactaacaaacaaatcggcagtccccattctgagtctataaaaggccccagacccagtcacacaaggtgtggggagggacggggaggggacaactttccaatcttggggtaggggaaccagtgccccacctccaccccccaccatccccccgcccccccactgaaagccgttttcactgctcaagaaaattattctccgccctcctcacccttcaatgccccacgtatcctcattcttcttgggtgcggcacaagagatccggaaccgctgaatatgggtacaagctataacatagttggtgagctggatgggctgagtgagacctgggcagggcgtcactggctgggggtccccggcttgcaaagcgactgagaagaaaaatcttgcatcaaaagcagtaatacctaggcccctgtcccaagtattctgactgaattggtctggggtgggtggggcactgcaatgaaaaggtgatgattaccaggtgatgctaactgtcagccagcatgaagagccacaggtgttgagcaggtctcaaacctgagcaggcacccccagtaacctggaggagctgttaaaacacgtttctgatcattagtctggacggtggggtcctggcgtccagtaacttatttttctagcaagttcccaggtgctgttgatgctaccaatgtagaggccatgctcagaaaccattgctctaatatgacctgtctttttttttcctttagtattcactggaaatagaggaatagctgggctcattctcagttctttaccttcttaatttaagaaccctgtccagtctataaaatctagcatcttccggctgggtgcatgtggctcacgcctgtaatcccagcactttgggaggccgaggcgggcggatcacgaggtcaggagatcgagaccatcctggctaatacggtgaaaccccgtctctactaaaaaaatacaaaaaattagctgggcgtggtggtgggcgcctgtagtcccagctactctggaggctgaggcaggagaatggcgtgaatctgggaggtggagcttgcagtgagccgagatcatggcactgcaatccagcctgggagacagagcaagactctgtctcaaaaaaaaaaaaaaaaaaaaaaaaaatctagcatcttccaatatgcatttaataaaccacaaaatggcaaatatttcaaacacattaatttgtactcatgaattcatcttcatgggatagaagggacatggaatatgcaaagatccaactttgaaaatccagactgtagaatgtgctgtttgctttctacaggcaccaacttctcaaaattgaacacttagatgaaaactaataaaaaaggcccccagagcaaatgttctggatttttctcctggttgtttggaccttctctgctgacaagagcatagccatttttactggcttttagttggcatcatggaacaacccattgatgttccatggaacatccaagaatagagactatgtccacctactggaggcattgcccagggtagaaccacgtgtggaaatttagcaattacagtgcaggatgccaagcttccatttggggggcgctgtgtgtttggggaatgggacaggatgcttgtcttcaatagattgtcattgtttgggtaattacagcccagagcagcaagccaaccttattctttgaaaccctgggtgtcatggtaggactcagggggagatgtctgccttagcctggctgttgatttttttttaatcatagtgttgaattccctcacccagcttgctcctggtctcttagcatatgaaagggaccagctcaggtgaaggataaaaggcctgacttcttcctctattaactccttttctcccccctcactgagcaagtttagttgtcaactccagttactttgaagggcggtttcacactgcttcgttctgtgctttgctggctgccgagtaactgataaaatttaatattgctccagacccagagagagttggtttttcccctcttaagacagggtttttgtttttatgtttcattcctcaagaaaaaggagagtcgttgtttgctactctgcttagcagtcttaaagtgggtaaagatgactcctaattctcaagaagaaaaggtgttggctgcatctgaatcgtggacataaggaattctcagaatcatctttttttaaaaaagtatttgagtctattggctaaacctgggtggggggctaccaaggtactctcagtcatgaatggtttaagggttctgattttttttttttctttgagataaggtctcactctgttgcccaggctggagtgcagtggcgcaatctcagctgactgcaacctccacctcctggctcaagcaattcttgtgcctcagctggctgagtagctgagattacaggtgccagccactgctcccagctaatttttgtatttttagtagagacggcattttaccatgttggccaggctggtcccgaactcctgaccttaagtgatctgcccacctccacctcccaaagtgctgggattacaggcatgagccactgcgcccggccaggttttgatgtttttgttcacaacttagacatcagttgggaggcttttgcttttgcttagtgcagtgtctcttgcttggaatgctcttccaatttctcatctttctctgcaggtagaatcctaaactcgtttggagttcagctcagataacacttcctttctgagattttctcaattccattcccacttccttctcctccgctctgcccccaggcagaattagggacttccttgtctgtgttttcagaaccatgtgtgcaccctgatatcccagcgccagtcattttgtgttactctctcctgtgtaacaggaggctttgagtgtggaagctcagggagcttccctgagccacaggtgtagagcaggtctcaaacctgagcttccacactgacttcgcagagtttacgctttcagcttcagtctctcccatcccacttgaactgtctattctctggttccattaaaatcctttcagttcctcacttgtgcagcaccctctcacttctcactgcggcggagtgccgttcacactgcctgaatgcatcacctctgctcttagcctagctaaatcctaccttcccctcagaaatcaggttaaatgtgactctcctgagaagccttctctaatcctcttctccatgtctcttgtggtccaaggagcagcttgtgcttgctccattgtggcacctgtgttgtcaccctctgtggacttttctgtctgcctgcagaaaccagagtgctatgaggagagagatcttgctgctctaccccccgcccaccccagcacaatgcctggctcttgaagctatctgaaggaaggaataaatgaatgaatatgtctcgctccaattaatggcagggcctgatttctccctggggtcttgtgcgctgagtgctagcagggtattcttctttttgccttcttttcttgtgcgctgagtgctagcagggtattcttctttttgccttctttagatgtcaggtgcagagggttgaattaatcacactcctgagttcataacacatcatcttcattggtctgtgcaagatcctcccctgttctgtgtgtgtatatgcgtgtgcattttgtcataaaacaaaattgtatcaaattgattttagtgttctaattgactcttactagtgattcatgagtcaggcattcgtatctaaaagacagaaggagctctcttgggcgcagcaaagcagttggttattgtaaggtagcttgagtaggaaaaaggaaatgggatgatacaaaaaggtgggttggttaacatcaggttacttcaggttactttccttgtaagagttaaagcagggggacttccttatcatgccagctcaaatgaccatgccctttccaactggttgctgtgaaccttctgtttttaagaaagactggtctctttgggggattttcctgcttccttaaagttcccattttagtatgtcgcacttagcgcaagcgactccatcttggtttgatctgggcctagtgcaggagctcagtccaaaacaatggactcctatgattttattgaacaatttcttaccctttatccccgtcttctactcccattccacatgccccccaccccccatgaatgatttgtctaatgcgttgaatatgcacgtgtggttttgggtgcatgtatgtttacacacacacacacagactctctctctctctctctcacacacacacacacacacacacacacacacacactcatgcctctcctttgaagaggatcagatatggacagcaaagggcattagcatcttagctgtgttagaatcccgatgggaggggaggggactgcggcatgagcatgaatcctccagactagagggcattcttggtggagtcctgcccctgacctgcgtgtgggaaagcagtccaccctgcctgtctacgcttgggcgccttcttctgaagtgcatcccctgtggccactctgagctctgggttctctgataaacctaggcagtttgcctgctgcagggtggaagggaggctgccactgcctctttgcattactgtttaattcccaggaatcaataccaccctgcaagagcagcagggttttcttctaacctatctgctccctcatatttgaaataaaaggcagggagacaaggcttgctgaaattcttttgtctatggtgcatgccagagagcagctaattaagccccaaacctgaggttgaaatacatgagatcactgcaccttctgctgtgaccaaggctgctttgttttcaccccttgcttttcctctggcttccgtggagttagaaatgccctcctgaggccaatggcacaacttctatggatgactgtataccacacacttccccagcaccttctaactggcagtgtgtgttcttatacgacacagttgtttgtttctggtgccaaagtggcaaggtagatcttactatccccatttaactggcgaggaggctgagtctcagagaggctaggtgacattcccaactcaacagcctctcaggcaccacgttacctccccccactctgcatctacacatcgccagttaacagcactttcacctgcaccatttccctggaggagcctctacaggctttaagtcagactgcatcttgtatccattccacaaatatttagaaattgcctaacatgtgctctattctgtatgctggggctacggctgtgagcagagcaggggataaattctagctctgctgttattagctgtgggacattgagaagtcatctaacttcccaaccccagaatgggtcctcaaccctgggtccatggcctgttaggaaccaggcttcacagcaggaggtgagcagctggagagcgagtaaaacttcatctgtatttacagtcactccgcatggcttgcattactgcctgagctccgcctccttcagatcagcgacggcattaaattctcataggaacgcgaaccctattgtgaactgcacatgagaggagtctagggtgcatgctccttatgagaatctaatgcctaatgatctgtcactgtctcctatccccctgagacgggactgtctagttgcaggaatacaagctcagggctcccactgattccacattatgttgagttgtgtaattatttcattatgtattacaaggtaatataataatagaaataaagtgcacggtaaatgtaatgcacttgaattatccaaaaaccacctgccccaccatccgttttgtgaaaaaattgtcttccatgaaactggtccctggtgccaaaaaggctagggatggctgctctaacctgtctgtatgatgaggatactcttttcccaggtgtgtcagaattacagtaaacaagaacacctgtgaaaacatccagccttatgcctggcaaataatctgcactctatgcacgtggctttccttcttccctcactgttccgattcactcatatgctctttctgctgttccaggctgcttctaaaacatccctataattcttttaaggacagtacagggtaaagtggcttcctgggagaatgcaaggcaggcactgagcctggagagaactctgtagccccattagtattgagggcaacccccaagccagccctggtggcagccagatggtttggagccctcgcagtctccacagaaggcttgccgggaagcggcagatgctgctgctggaggcaggccttccctgcagggcatctggacctcataggaattcctggagcgactggagaaaggtgtcttcctgtcctttcaggggctcctgcggggaattccagaacttcagggctcctgatcaccactgtacagggcagtgagctggagctggctctttccagctcacaagaaccgagtattaaatgtttaggaattttgtgaggcaattgttaaataaccgttatcatcaaaaattgttataaatctataattaaataaactatattaaaatctaaggtaataagatctcaaaactcaaaaacttcccgatgagctggctccattttatttttatctaccctcttgaggttatttacatctattgtgtctgtgtggtggaaatactgtctccagctctgctgctgtgccttgaaatcaaccagaaagggggtgttaatgccacagaaattggaaaacgttgcatatatccaggactttatttttttctttctggaaaaacaatggacaaacatctaccagcacacccctgccagggactcaaaacaatggccccaaacaagaaaaatccagagacccaagggagatgcctgtgcaattctcttcccctagtggaccctaaatctgccaccctttaagggttctcaagggacttggcaaagccagtatgctccagggatgtagtgtttttaagaaaaactaaacacccaacatagaccaaggaggggagatatgtttcatttctcatgatagttctcattgatctgctgtggcttctttcctaatagcattgagaatgtcgaggtctcctgcagggcagtgagaaagacagccttggttcctgcagtaggtgaggggtggggacaatgagttgggtaccatggatttgctatgcttaaactagatggccaatcccaaaatgtggggaaggtcactgtgacagggagattgtcgtctttcacctggtaggttttggccttaagtaggacataaaaattaggaaaagttgatttttgatttgacaaacaccaccagatttattgttacaaggaagaaccatcgatggttactaaaagtcatggacaaaaatctgataggaaacaggatatttgcataatctcaaagtgtcttcccaaagtatccactgattaatggcacagggaaagcagtagctttacagtggagacaactgatagaccttatcctaaccaaatgagcaaagggaaaccaccagcagggaaacatactgacgtcatgtgcctcctgacacgatgcactgagaaggactctacatctcttctatgggaatcttaccaaaaatgtacagcctcgatctgatgatgagaagacattagacaaaccctaactgaggattgaaaaataccagtctagtcctcttcaacagttaaggtcatgaaagactgtggcactctcacagatttggaaatgtgacaactggattcaatgtgggatcctgaattgaatcatggacgagaaaatggatgttagaaggaaaactggcaaaattagaataaaggttacagtgtagttaatagcattggaccaatgtgaatttcctggtttgattattctactctggtaatgtaagaggttaacattaaccagtgctgggtgaagggtgcataggaactctctgtaccatctatgcaactcgctaggaattcaacattatttcaaaatttaaaatgtttttaagaagcttatttttgaagtatttaagggatgattactcacttatgaagaatgagggttgaaggtgaacagttctgtcaagtatacttatttctatgtgaagggaaattacacatagaaattagtgtaaaaacctgatagatacaggtttttctgatttatgagttaagacaaaaaaatccagaaaggactagccttactagaaggttccatttgcaaaattcctaactgtctcaaccaatcagaaggccaatgtaacctcctaccaaatgaataattaggtaattgcatgactaaaccaacatttagcatgccataacccaggactaggctctggggaggtggaacatggaggagcataggagcctgtcctgttctcagggaccttgcagcctatagtatttcacgtgggctatttgacatccctagccatgtggtaagtcctaggccagggtataggacttgagtgtcacctgatctttgcctggcgggcatggaaaatggttggtttggcattgcttagggatggtctttgggttgtgtattcttggggaatccatctggaaaataagaagacagcttttgctcacagttgactagacctccccctagtaaagttaatgatccaccaggttctgttccatcagcatcagctagaaatacttcttaaggtattctttaatattgcattatctgccattaccaaagtttaaagaagtttgcctacagccaaatgcacgatggcctcacacactccctccttcctatcctcaatctcatacccttcttcactgcctctcagagccaggatgaggtgaggcatggcctgggaggaagggcagaatgtaatggggcaccaaaaattcagtaatcaaatcaaataatactttcacatgacattttaaaaactcagtattttgttattttgtttaccatgagtttttgcattaattttttaaacaaaaaaattgcattaagtgttaattttcttgattactgagttttttgggacccccttcaattttgccccctaggttagtgtctaacttgtatcactccttccccctagtcctggcccctgcacagtcctcttatcaacactggctgcctgcagtaacaaagctgggctctgacccataaatggcgtggcggcttggaggaatggagaaggtacccttctattcaccctccaagactgtagaggggctgcggaagatttctgtctgctgggaacccttgcataaaagcactagttgaaaggaacagccatttacactctaaaccttcactggggcagccacttggtttccaaaaagcatttcttgcatagtgtttgaattaaatctccccttcgaagttgggagacatgagttaaaagccctctcagcagcagataaatatagctatgtttggtccaggttacagttgctgagggaactataactttgatttgctctcctggtataaatgtaaatccttaagtgaaatgagttaagtgagggaggaggcgccctgtttttaaggatgcatttgatcagcagctgtctgtggtgcctcacctgccatgtacaatctgaggggcagcagccaaagactgcagcaaggaagcttccagcaaatgatctaagagttctagaatggacattttctcagggaggttttcagatcagttttgtcttagagataaacacaattggtttaacagtctgggttggaaaataaagtttaatttcagcacagtttctgcaagcaacctagcatgctaaagtcatctttgccctctatttattaccttgcctttggcctgaaatccaaactcagcttaattttcctctccaaccacatttccaactgttttctgcctgcagtttacattctagcacagccagactctcactctcccaccaaaccttcatgctctttcttctttctttgtcatttaccctattccttcactctggaagggattcttttttccctccttttcttttttttaatttttaatttttgtaggtacatagtaggtgtatgtatttatggggtacgtgagatgttttgatacaggcatggactgcgtaatcacagcatggaaaatggggtatccatgtcctcaagcaaccatcctttgtgttacagtcaatgcggttatattcttttagttatgttaaatgtgacaattaaattattgactatagtcaccctgtttttctcccttctgtctgtcctgaaagcctccaactggtggtttacaacctgaatctagcccacagatgtattgtgtttggcttgcagaattatttcctaaaacccacagtcccactcgttcctattgctttctagatgactgggttcacacttttatattatccatcctgcctatgtagacatctgaattgtgacctctgagagccagaccctgcctttcctaataggcccaattcttcctcgattaagaaatcaccccaggttcttttagctccgtctcactcaccacctcttctgcattctgaaaacttttggctttattgtagaatttagcacttaattatatgcagcttgacatttgctcttgtcatggtaggcctttctggcacatgttgagacaagcctaacactttttgttatttctcttttcaactgaagtaatatctttctatccaacagctcactaaacattagctaagcacctatgatttgtcaggtaccatgctaggcctttgggatgcaaaggtgttgaagacaagctcctctcttattagaaactaacttcggaccttatttcccagcacttggcctcagtggtctattcattatttcagaacacatctagtccttcctaagcctcactccctggttaacactcctcccactgctacaataaactttctttgaatagttaaatcatatttgtcttttgaagcctgggtcaatttcccttatatttgccttgccttgtctgtttcacagacatgtgtccacccctgtctcttggaaatttgacataggccatcatttacagaaagtgctcttctgtgggtgtcctgtttgttatttacagactctccaaggacagggctgatccagtcttacgtttctcccgtatttccacactgcctgggcatagtgccgaactccgagcagatactcaataattaatgtccgtggtttgactgatcctcccatcttcaattagtctactttcaagaaatacatgctgacactaattttattttttatactcagtggaatccagtgagaaaggtaaatcttctgcttttgcattaaaacatcgcataaaaagcaggtaccaactttgagtactgctgggctcccaaagttgtttatacatcagtttagaattcagcctgcattttcccacagaaataatgccttggggttggtcacaccccaaggccagcctacgtgaacatgcgtaacccataatgttttgaactctggggcagagattagagctcacatgtacttctcattgcctgaagagtgtggaggttatatgcacttcaccttacctgacaatcaccacactgtgcccagctttacgatgtctgttttctcatctggatagtaacccctatgagcacaaaggccgtatcggtcttgttcactgccatatcctagcacagtgcccagcacatttattgagcagtcaataagtatttgttgatttggattgagttaaattctagttgaaagatgatggactttggagacacataggcatggatttgaattccaatgccatcactaactagccgggtggtactggggcctctctgagcctcagcttatctctccatgttttgttaattcataaaaccaagttgctgagtatgtggttaataccaaaatgttttttctttccttccttactgccttaatccctcaaaagcatctgattaattaattaatgatgtctctttttagccttctctggtggtgacagagaaggcaatatttgatgccagggcctttccgcagcttttgggaagtgttgggttctatttccagctctaattctaacagactgtgtgacctgagataggtcacgcaaacatatctttgagacagcaatgagagatttcagttatttccaggcttttccacataaatattaataatttcaggtgagtgaatataaatgctcaatgttctggggggcagagtccaaaggttgaatttatttgaattcagtcttatgtttcatcttaattattcatgcatactttatatttgtccaaatataaactttttgcttatacttcatcaaagggtacgtaaaaacagagacttcccacacctaatacagtcgtcaaatgtattagtagaaatgccttcgcttttatatctggggacaaggaatgacatgattcagtgaaggtaagtgtagttaacctttccagaaatacccgcaggagaccaattatttatctgcttaaaaactacccttggccaggcccgttggctcatgcctgtactcccagctactcaggacgttgaggaaggagaatcacttgaacctgggaggcagaggttgtagtgagccaagatcacgccattgcactccagcctgggcaacaagagcaaaactccatctcaaacaacaacaacaacaaaactttcctttgctggccagagtggctcacgcctttaataccagcactttgggaagccaaagctaggggattgcttgagctgaggaggttgaagctggtctgagaaacatggcaagaccctacacctacaaaaaattaaaaaattagctggtcatggtagcatgcacctgtagtcccggctactcaggaagctgaggtgggaggatcactggggcccagaagctagtggatgcagtgagctgtgatcacaccactgcactccagcctgggtgacagagcaagaccctgtctcgaaaaaaacaaaacagattgggttccaagatagccgaataggaacagctccagtctacatctcccagcgtgagcgacacagaagacgggtgatttctgcctttccaactgaggtaccgggttcatctcactgggacttgtcggacagtgagtgcaggacagtgggggcagcacaccgagcgtgcgctgaggcggggtgaggcatcacctcatccaggaaacgcaaggggtcagggaattccctttcctagccaagtaaagctgtgacagaaggcacctggaaaatcaggtcactcccaccctaatactgcacttttccaatgctcttagcaaacggcacaccaggagactatatcccgtgcctggcttggagggtcccatgcccatggagcctcgctcgttgctagcacagcagtctgagatcgaactgcaaggcaacagcgagactggtggaggggcgcccgccatagctgaggcttgagtaggtaaacaaagcagccaggaagctcaaactgggtggagcccaacgcagctcaaggaggcctgcatgcctctgtagactgcacctctgggggcaaggcatagccgaacaaaaggcagcagaaacctctgcagacttaagtgtccctgtctgacagctttgaagagagtagtggttctcccagcatggagtttgagatctgagaatggacagactgcctcctcaagtgggtccctgacccccaagtagcctaactgggaggcaccccccagtaggggcagactgacacctcacacagctgggtacccctctgagacaaaacttccagaggaacgatcaggcagcaacatttgctgttcagcaatattcactgttctgcagcctctgctgctggtacccaggcaaacaggtctggagtggacctccagcaaactccaacagacctgcagctgagggtcctgactgttaaaaggaaaactaacaaacagaatggacatccacatcaaaaccccatctgtacgtcaccatcatcaaagatcaaaggtagataaaaccacaaagatggggaaaaaacagagcagaaaaactgaaaattctaaaaatcagagcacctcttctcctccaaaggaaagcagctcctcaccagcaaaggaacaaagctggacagagaatgactttgacgagctgagagaagaaggcttcagacgatcaaactactctgagctaaaggaggaagttcgaaccaatggcaaagaagttaaaaaccttgaaaaaagattagatgaatggctaactagaataaccaatgcagagaagtccttaaaggacctgatggagctgaaaaccacggcacgagaactacgtgacgaatgcacaagcttcagtagccgattcaatcaactggaagaacgggtatctgtgatggaagatcaaatgaatgaaatgaagcgagcagagaagtttagagaaaaaagaataaaaagaaacaaacaaaccttcaaagaaatatgggactatgtgaaaagaccaaatctacgtctgattggtgtacctgaaagtgacgtagagaatgaaaccaagttggaaaacactctgcaggatattatccaggagaacttccccaacctagcaaggcaggccaacactcaaattccagaaatacagagaacgccacaaagatactcctcgagaagagcaactccaagacacataattgtcacattcaccaaagttgaaatgaaggaaaaaaatgttaagggcagccagagagaaaggtcgggttacccacaaagggaagcccatcagactaacagctgatctctcggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctaagagattttgtcactgccaggcctgccctaaaagagctcctgaagtaagcactaaacatggaaaggaacaaccagtaccagccactgcaaaaacatgtcaaattgtaaagcccatcgatgctaggaagaaactgtgtcaactaatgagcaaaaaccagctaacatcataatgacaggattaaattcacacataacaatattaaccttaaatgtaaatgggctaaatgctccaattaaaagacacagactggcaaattggataaagagtcaagacccatcagtgtgctgtattcaggaaacccatctcacgtgcagagacacgcataggcttaaaataaagggatggaggaagatcaaccaagcaaatggaaaacaaaaaaaggcagaggttgcaatcctagtctctgataaaacagactttaagccaataaagatcaaaagagacaaagaaagccattacataatggtaaagggatcaattcaataagaagagctaactatcctaaatatatatgcacccaatacaggagcacccagatcataaagcaagtccttagagacctacaaagagacttagactcccacacaataataatgggagactttaacaccccactgtcaatattcgacagatccaccagacagaaagttaacaaggatatccaggaattgaactcagctctgcacgaagcagacctaatagacatctacagaactctccaccccaaatcaacagaatatacattcttttcagcaccacaccacacctgttccaaaattgaccacataggtggaagtaaagcactcctcaacaaatgtaaaagaacagcaattataacaaactgtctctcagaccacagtgcaatcaaactagaactctggattaagaaacttactcaaaaccgctcaactgcatggaaactgaacaacctgctcctgaatgactactgggtacgtaatgaaatgaaggcagaaataaagatgttctttgaaaccaacgagaacaaagacacaacacgccagaatctctgggacacctttaaagcagtgtgtagagggaaaattatagcactaaatgcccacaagagaaagcaggaaagatctaaaattgacaccctaacatcacaattaaaagaactagagaagcaagaacaaacacattcaaaagctagcagaaggcaagaaataactaagatcagagcagaactgaaggagatagagacacaaaaaaacccttcaaaaaatcaacgaatccaggagctggttttttgaaaagatcaacaaaattgatagaccactagcaagactaataaagaggaaaggagggaagaatccaatagacacaataaaaaatgataaaggggatatcaccaccgatcccacagaaattcaaactaccatcagagaatactataaccacctctatgcaaataaactagaaaatctagaagaaatggataaattcctccatacatacaccctcccaagactaaaccaagaagaagttgaatgtctgaatagaccaataacaggctctgaaattgaggcaataatcaatagcttaccagccaaaaaaagtccaggaccagacggagtcacagccaaattctaccagaggtacaaggaggagctgataccattccttctgaaactattccaatcaatagaaaaagagagaatcctccctaactcattttacgaggtcagcatcatcctggtaccaaagcctggcagagacacaaccaaaaaagaaaattttaaaccaatatccctgatgaacatcaatgcaaaaatcctcaataaaatactggcaaactgaatccagcagcacatcaaaaagcttatccaccgtgatcaagtgggcttcatccctgggatgcaaggctggttcaatatacgcaagtcaataaatgtaatccagcatataaacagaaccaaagacaaaaaccacatgactgtctcaatagatgcagaaaaggcctttgacaaaattcagcagcccttcctgctaaaaactctcaataaattaggtattgatgggacgtacctcaaaataatgagagctatttatgacaaacccacagccaatatcatactgaatggacaaaaactagaagcattccctttgaaaactggcacaagacagggacgccctctctcaccactcctattcaacatagtgttggaatttctggccagggcaatcagacaggagaaagaaataaagggtattcaattaggaaaagaggaagtcaaattgtccctgtttgcagatgacatgattgtatatctagaaaaccccattgtctcagcccaaaatctccttaagctgataaacaacttcagcaaagtctcaggatacaaaatcaatgtgcaaaaatcacaagcattcttatactccaataacagacaaacagagagccaaatcatgagtgaattctctttcataattgcttcaaagagaataaaatacctaggaatccaacttacaagggatgtgaaggacctcttcaaggagaactacaaaccactgctcaatgaaataaaagaggatacaaagaaatggaagaacattccatgctcatgggtaggaagaatcaatatcgtgaaaatggccatactgcccaaggtaatttatagattcaatgccatccccatcaagctaccaatgactttcttcacagaattggaaaaaaactactttaaagttcatgtggaaacaaaaaagagcctgcatttccaagatattcctaagccaaaagaagaaagctggaggcatcatgctacctgacttcaaactatactacaaggctacagtaaccaaaacagcatggtactgataccaaaacagagatatagaccaatagaacagaacagagccctcagaaataataccacacatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggtttgaagacttaaatgttagacctaaaaccataaaaaccctagaagaaaacctaggcaataccattcaggacataggcatgggcgaagacttcatgcctaaaacaccaaaagcaatggcaacgaaagccaaaattgacaaatgcaatctaaataaactaaagagcttctgcacagcaaaagaaactaccatcagaatgaacaggcaacctacagaatgggagaaaatttttgcaatctactcatctgacaaagggctaatatctagaatctacaaagaactcaaacaaatttacaagaaaaaaacaaccccatcaacaagtgggcaaaggatatgaacagatacttttcaaaagaagacatttatgcagccaaaaaacacatgaaaaaatgctcatcatcactggccatcagagaaatgcaaatcaaaaccacaatgagataccatctcacaccagttagaatggtgatcattaaaaagtcaggaaacaacaggtgctggggaggatgtggagaaataggaacacttttacactgttggtgggactgtaaactagttcaaccattgtggaagacattttggcgattcctcagggatctagaactagaaataccatttgacccagccatcccattactgggtatatacccaaaggattataaatcatgctgctataaagacacatgtacatgtatgtttattgtggcactattcacaatagcaaagacttggaaccaacccaaatatccaacagtgatagactggattaagaaaatgtggcacatatacaccgtggaatactatgcagccatagaaaatgatgagttcatgtcctttgtagggacatggatgaagctggaaaccatcattctgagcaaactatcgcaaggacaaaaaaccaaacaccgcatgttctcattcataggtgggaattgaacaatgagaacacttggacgcagggcggggaacatcacacactggggcctgttgtggggtggggggaggggggagagatagcattaggagaaatacctaatgtaaatgatgagttaacaggtgcagcacaccaacatgtcacatgtatacatatgtaacaaacctgcacgttgtgcacatgtaccctagaacttaaagtataataaaaaatatatctatatatatatataaagaaaatattgaaacgtttgcataacattaaaaaaaaaagaaaaaaacaaaacaaaaaaatctctcctggaagacgagtcacaacactacaccctcttggttatatggtgaaaagtgaagaaaggagaggagatggtacatacagggggaataagtaaagaagttgccagcgtctttgttttttgagaagagatgacgtagcacatctattgtttttcatcaaattctgaagtgataagatgtaaagtagtttagacaatgttactcacccatccattcattctttcatccaaccatccatccatccctccactgacatgttcattttgtgtatttatacatgtacttagtgcttactctgtgtcaagcatgatggtatactttggactttcaaaatggaaaggtgtgatctaaagaaatatgaacaaagttttgtgggtactcaaaaagaacaagcaactttgcctggggtaaggtggaagtttggagtggttgagctcccaaagatgatgactgggctcagtttttccctggtgaacaggatattagcagataatcaaagggagaaggacatctcagacacagagaaaaacatgctctcatctctggtggctctcatctctgggggggacgagctgaccaagactggttggggtagggcctgggagaaatgaaacctctccagaccccaaggactgaattctctgaagaagatgcctgtagtccaaggtaaaggtatggtgaattctgttacccatcatgattgtgggaagatcataatcagaattccagggagaaggtaggaatccaagagtggttggtctgactcactgcgagtgagacttgatacagtttcaaggaaaggggttggcagcaagaatatataagagttagttatgtattattaggctacactcttaatatggagaggcagtgttattataaagccttatttactacattgcaaagaactatgttgcatgtttctcccagctggctctgcagcacctccctcaggacaccgtctcacattttcctagattgggtgacgactttttttctgaggtttctcagctccctgtaataacactgtcaggatccttcctttactatgtggttcttccctagtcctatgctgctaatacactgtggtctcttaaaagcaggggctagattttctgtctctgaatcctcagaatccaggacagagcgtggcacgtagtgagtcggtaccactccgtattgaaatttatgtagagagcttttgtagaataacaatacttgagtctcatcaccagagacttagaatttgtcttgggtggaacctgggcatgaatatatttatatatatggaaaatcccccgcttgttttaaaaatgcagctatggttatagaccactgaagcagatgcttagataatgcttcttgaggtattggactataacagatattatcctggccatctcattttttggtagggcagggggttggagaggagctgcaacctgctgtttaggcagcttctcaaggatctcagttcacttcaggctgcagaaacctgggagcagatgactgcttctagatgctgcatacttatctgaaagaaaaccttaatgtgctcccaggaatacgtgcacagatttgcttcaagatgacttggttataataaccagctaagctaggctgtcactggtgagaacggaaagtgactgagcattcatagaaatggctttcctgctcaccagcttgttggggaaggatcagggctatggattaaaggtgggggcactgagtgtgttacagaaactggaaaatgaggtgcccatctttctaccatccagaaaagccaccagaaactatagatcggaattcggaataaatcaaggaaaataaatgagttctccctcgcccaaatttactgtagttgtataggtggatctgggagatttagtggaggaaaagggagcacacagcctaagctttccagaaagagctggggatgatggtgttagaaatgtgatagaactttaaaaatgttgaaatcattggtgacaattagaaaacattaaaaacacacacacacacacacatggtttttcaacattaaaaccgaggcacacactctgttggcgggggtgggtgttgacagagagagtgagtgagtccatatttcccaagatgaggagaaatgcccttgtcctaggaggcagtgattttgccagcaccatggagaagggcacacattgtctcttgcttattttttatttatacagataggtttctggggagggtttttactgtatccaatctgaactgacaaaggcaatcctgatgtctgtgtaactgcatgcgtagatcagaggatacaaattcactccttagatctactggtcttttctggccaattctgttgcattttagatcgacatactccctctgtcatttcttagcaaaggaaaagaggttcaagggtgagattttaaaacctccctttgctagtagtttttctaaagtttctggtagaattaatccctaagcagagcggtcagtgagagtgggctctgaattctggctgaggcataggctgctgtatgtttcatgagatcggcctcccagcttggttttgggcctgcctgacttggaagggatttgtgggagaagtccattttgaaaaatgaggatagtagacctttgatttggggaaaccctgctgaggaaactgtattagtcatcactgaatgagcttctgatgtctatgttctctctctggagggtggtgggatgattaagggtattttcactgtaggaaggaggatagaacgttgtatgtattttttggtttctcccatttcctgtcaaataaccccttagtcttttgtatgtggtcaagctgtgttgtcaggacagttgaagaaatctgtgcccagaagcgtccagatcctctattctagctccacgcctcatctgagaatctctcctttctctctgcaacagttacgtgacatctcctattcgaacttaaatccgcttaataaaatcatggcgattacttattttgtgacaggtacttgtgctaggtgttgagcccaaagtagtggcacagacctaatccctgtcctcaagtaacttaccaatgattcacaatctatttgtttaacagtgtaagagggggcagctccgagtggattactttatgactccctacctcagagaagattatagtccagaattttaatgctctcattcagggctgatgatgatgcagaggcataaataaaaggaaacactagtttgcgattggatgggggagaaaagggaggaaagtcatgtgaggagggagggagcttgttgtgaagctgggaaatggaagggtggaaaccatatctaggatggctttctggaaaaatagttgcaaaaattttcatcaccacggagtcctgttcttattcctatgcccatggatgcatgttttgaaatacattgtctctcaaaaaagcggcatgcattaaacattcagtaattttctgaccaacagagttaaacaggttgcctatttagagtttatcttgtcctcattcaaacaaggaatcttggcgttttcattagcccatgcagtaatactgaagatgaatgagtgtacaatttctgttaagctttttgaaatattgcaaatagctcatgtacccccatttctgcaatgaaaaccttacctgagacgattgctgcagggccatttgttcatgtagttcaattttcacttaagctttgaaagtttacacgttaggaccgtgtaggtacagaacccagggcctatgactttattggctcaggatatttgttaattgacattaaagtattaagtatcaaaattgaaataattgcttaagtatttagaaaatgaacagtatattagctagtcaactacaactcaacagttttgcagttgtatttacgttgtatttatttggggaggttttttctttttaatatctttgacacatgatatgaaatggggccttcaaaagtcaccttgtttagagcctgcttttttgtctaaagagctccaagaaaggagattgagtggtataatttaagatctaaaagcagatgaccctgttcttcctggaaagtagactggagatgcaggtcccttgggcaagacatatctgctatctcctattctattgtgtggataagccatcatttatataataggatccctgatgtggggatatttatcttgcttgttacatttgggtattatacgtaatacaatattgctataaatagctgcacacagtgcaagaaccttgcaaccaaaaagacatgggagcagatccagctccattgcctacagttctgtggctctggacaagttgcataaagctttagatttcctcatttgtaacatgggaagaaccagcgtagcagatctataaggttattctgtgaattaaatgaggtggctcatgtaaagcacttatcataatggctggcatatattaagtgctcaataaatattgaatgataataatcattagaatgaatcttattttgtatcttaaaatggggtaatacttatccccggggttcttgtcaagactcattgagatattgaacacaaagcacacagcccattgcccagcacatagtaagaattcaacaaatttagttttgttttttatctatttttttgcacctcataaatttttcctgttttgaagaacaaaatactaaagtggagcctatctgaggcacatcttcataagtgtctccaaccagcctttattcattggcattaagatattgaacatgcagactttaggaggcttaattttttctgctctggcctgcaggttggaggtttcactacattttaataaaaacccttgcaaagcaacttacagatctaaataaaaacaatgttttgcttatttagctggtttcatagttgtgccttttaaaagaatgttagcccatgttactttgcagtgcttttctgtccatttagtaatgttggcaacagtgatccagcttgcgagccccaaggttacatctatagccccagcatgggacgggagacctgctgggtgtggggaagaaggagagccattcccacagtagcctgacacccctgaacacagggcttcctgggtgtacatccctgggatgtatccactcagtcccctgtggacatgattctttaggattgcagcctgactttcatttctttccaatggagaaagagttctattttcattgttacatatgtgattatgaacatttccaacaaaacatagcaaataaaattatccctttaacctcacatctgtccctcctccctcccactcagtgatatcattgttaatggtttgccatgcattttttccagactttctggacatagaaaataaattttcaaaaaaaaaaggtgtatattacatatggtactctgtagtctctttttttctgaacatatttaggatatttttccaggtcaagatctatctaccttctcctccattgtgtgaataaactgtcatgtacataataggattcctgatttgaccacatttatcttgcttgctgcgtttaggtattataaacaatgcaatatgctacaagcagctgtgcacacaactgtttgtcttatgatgttctttggacagatttacagaatgatttaccatctgcaaagtgctgccacatccattcatttatgtgatccaaagaggtggaggcagaggcagtcacaagcctggacttgagtcaggcaggcctgggctggaacttggattagcagaccacagccaagcacttcactcatctctaaatctggaattgtagaagtctttctcccattttatatgtgcttgcaggattccttaagttaatgtctgtaaaatacttagaaaagtacatgccacatattaaaaactcaaaagatattagctctcagtgttggaattagctatggttcctcaaaacaattctgatattgtggatgccaatgcatccaaaatacagatgaagaaacttgaggctcagaggggcaagatgtgtcaaggtcaatgaccaacaaggaaagagaatagttaatggcaacttcattagtctctgtgcaaggagagacttttgcagagagtttttcataatattgaaagaagttgccagagaagttggagagggcctaaagcaccattccgttgtgccatcgacaccacacttctgatcatggaaggagcatgcaattaggcagaaatgagcttaggttcaggttgggccatctgtgaatggaacattcttgggcaagttactaaatctctctaattcgtgtgttgtgtatctgggatttcagtggagttttataaacagttaaatgagattatgtcaagtctatatgcacagttgctggcatataataagaccttgaaacttgtgttaacagcagtgtcagaattagaacccacatcttcttttcctttttattgcatccttctgccaccaactccaacccttgtcttctagtgaaggctaatacaaagtgcaagacatgtgtgacaacatgaaagcattgcccaagtcccgcctggcacatggggtggggacactcacccagtgggtggggagaagcagagatgatgggatagagcagtgccacccaccctgccttgtttaccctgcctccccttcgctgagctgtctctgtccctggctgcctctgaagcttgcttcacgcaatgagatgtcaatgcagtaaaatctttcaggatggaaaccagttcaaacaggaagaaagaagacagcactaaacctagaactcatgcaaaaatcacattccctctaagggccagagagagagagggtgactgtactgtagatgatatctgttactatttttcaaagttagatattttctttctaggtgtttgtggtagtttcaagataagaaagaaatggaaaagacctcttccatagaacacagaatggacaaaacagtagcagccatagattgctgctgttttcactgtaagaatatacattctttctcttttgcttaaaaaaaaaatgtaggcctttggatttcactctgtagctgtgaccttgtgatcttcatcttagcactgaaaaggcctaaagacaaagcaggcagaggaggtgagattgtccttggcataaacacagggccaaggctgcctgtgtgctggactggaggaagcagtggccccctcaatgttcagcagaataggtccttcattctagctctgatgacatttcctgtcacacaacactggtcatattaccttgtgcaaaccccatcctaaagctgaagtttttctttctgtaaaatggattgcactgtcactatttttgaaaccttagacatttacatgacacaatcatatttttaaaagtgtatcactatcaggtatatgtttaatatatttaacaaaatcacctcacttctaaatattcaaacatgaaaagtttagggcagaattccctgtaaagatggtaaattaaaataggtacatatttttcctccctcttgaaaacctcctgaaaaaatagaatttctttgaaagaaaggtaggaatcatacggaaagttagtacatgacatagcagacctgagaaaagtatttcataagccagcagtggaggaccctgaggactcatccaatctaaaacaaagtttccggaaatggtagtaccaggtgcccctgcaagtcagggtgaaggaaaggaaggagctcaaataaggaggatcagctgagagcctgttccagaagcagtctgactccatggggctgagttattgaaggtgtattcaataaagaagaaaaaaacagaagacatctggcctaggagatgccagacgaaagtgtgggcagtgataccttactcaaaagcaggtttcaatcaaagtgtgcatcctggaggctaaaacctccagcactttcctcccgttcatctcctagcgcactggtggccaggccttcacacatcatgcagggatcagacaattcttatttgtgaaatcctagcagtccaagaagaaagacttgcatatattgatattggcatctctccaactaaatgtcccaaccagattaccctgcagtaagctcacaggccacaagccctactcacatgctcagtcagtgctctccagctaaatgtcccaaccaggtcaccctgcagtaagctcacagaccacaagccctactcacatgctcagtcagtgctctccagctaaatgtcccaaccagatcaccctgcaataagctcacagaccacaagtcctactcacatgctcagtcagtgctctccagctaaatgtcccaaccaggtcaccctgcagtaagctcacagaccacaagccctactcacatgctcagtcagtgctctccagctaaatgtcccaaccaggtcaccctgcagtaagctcacagaccacaagtcctactcacatgctcagtcagtgctctccagctaaatgtcccaaccagatcaccctgtagtaagctcacagaccacaagtcctactcacatgctcagtcagtgctctccagctaaatgtcccaaccaggtcaccctgcagtaagctcacagaccacaagccctactcacatgctcagtcagtgctctccagctaaatgtcccaaccagatcaccctgtagtaagctcacagaccacaagtcctactcacatgctcagtcagtgctctccagctaaatgtcccaaccaggtcaccctgcagtaagctcacagaccacaagccctactcacatgctcagtcagtgctctccagctaaatgtcccaaccagatcaccctgtagtaagctcacagaccacaagtcctactcacatgttcagtcagtgctctccagctaaatgtcccaaccagatcaccctgcaataagctcacagaccacaagccctactcacatgctcagtcggtgatcaccttagcatcacacacaatgaaatgagaacatagccccaaggattaaagagaactaaggaacaatgctcacatagaagagagagtgaaaacaagcaaacagaagcaaatctacttggaggacacagactctgtgaggcaaagcaaactttagaaaagaggcagagagaacttagaaaaatagcagaagagaccattgtaaattgggagatagtacttaaaaaaactaaacattcagagaatgaaaaggaatcttggatttttccaaattgctttttttttggtgggggggtggcatgaaatgaggagtgtgcaagaaatgggaatccatcatagtttacaacttggatgagaatggcatttgcatattcaaaatattttaagtaataaatattgatcaaagcaaaattataccgtaagtgtatgggagggaggagaaatgggaaggatgcatgtgcctcatgggacagtgggaggaaagagtgaaatgcctggtttttttttttttttttttgagactgctctgttgcctaggctggagtgcaatagtgcaatctcgactcactgcaacctctgcctcctgggatctacctattctcctgcctcagccttccaagtagctgggactacaggcatgcgccatcatgcctggctaatttttatatttttagtagagacggggtttcaccatgttggccaggctggtctcgaactcctgagctcagatgatctgcccgcctcagcctcccaaagtgctgggattacaggcatgagtcagcgggcctggccaaaatgcttgttttctatggtggacagttaatagacaatgccaaaagtgaaaagaaatgtttaaaaaagaagtaccaaagcatattattggcatcatgttcataaatgccaaaataacaattacaacagcttaaagaggtacaaaagttcctctggcaaggggatcatgagagactgctgtatttcgtttgtttgggggtttggatttttttttttcttttttgagacagggtctcactccctgttgcccaggctggagtgcagtggtataatcacagctcactgcaacctcaactttctgggctcaagcctgcctcagcctccccgatagctgggactacaagtgtgcaccaccatgccaggctaatttttgatatttttagtagagatgggatttcgccctgttgcccaggctgatcttgaactcatgggctcatgcaatcttcccgcctgggtctcccaaagtgctggggttataggcatgagccactgtgcccagcttgttttgtttttaaatgaagcttgaagaattttttgaactatatacacttataactttgataaaaataaaatttcatatcaaaactgtaagtagcatcatttgtgtaaaagtagatttctcaaattattaaaaatattatcctatgcaattagacactgagcacatcaaagtttcatttaactggtaaaccagggaacaagctgaacaacaacaacctggttcaaaagtattcaggcttcttgatattttgtgagagaagagatacttgtataaaattatcattaggtataaaacaggtaaattttctccagagtaataaaactatgagttttaacaaagcagcaaacatcacattttatcatttttctgcaagttaactactaactctgcaaggttataacatttctagtttctaatcagttgtggatggttaatccaaacaaagttatattcctgagagggtaaaaggaccttccgtgtggtttttccaaatgttctattaaaaatgtcatgccatcctcattttgctttatttccaagttttggagctttttcttgcacacttgccataaatatgaccaacttcaaaaaataaacacaataaaaacaaaacaatgtcattaagttctaagtagatactgtttgctgcctgctctgacctgaagattttcctctttgttagaaaaggtgtttttacaagaactagagaggtattaaagacatataatcaccaaaacgagatttctctacttggtatcatgaaaagtgttgaaagaaaaatgaaaaaaaaaggccacattttttatataatttggtttagtgttatgaaatgctttgtctattgttacttaaaatattctcatatttggtgtgctttcttattctagaaaccctacaggagatcagtagttttgcactgcattctgaaaagtcctaggagtggcctagggtcaagagtgagtcaggaagagagggcttggctcccttagccccgaccctgcctagtccccatccactcccagctcaccttctgctgtgttatgtagtgagctctgcataagacttcatttgaagtcccttccagataccagagcctataattattaaaagaaaaaaaaatcactacaatttgcagtgtgtttaggttggatggattaatttctttgccaaggccataatgggaagactgattttgtcatttcaattacaagctaccgtttagtttgagcccagaagtcactttcctagagtctccctccacttgcctggcactggagcaattaacagtgggtgatttgtggctgcacttttactgcttagcacaggtttatcatcttgaaagttttccatttgcatatatgctatacattctttgggtgacatttagatatcacccagagtttagattatgcattgccttgtactgcactttctgctacgtgctggcaatctgcaagcccaaccagagagctgatgcaaaccaaggggaacgtgagttgcagccaccacttactgagggcttactatataccaacccccagtatcaaagactttacctgcattaccttgtttattcctcaaaccagtaactttgaggttactattatttgccacattttataaacaaagaaacagaaactcagagaggaaaagcaatttgcccaaggtcacccagctcaaatgagcagaattgggattcaaactcaagtatctctaatctcaaaacactctgctatgcaacctcccaatactgggagctttcagagtgaaatgaattgaatttgacagttttctacttttaaataccaaacttcctgagcagtctaattgctgctctttggaacaagaagaaatggctatttaaaagaagcaaggggcaggaggtcaagaaagtgggttttaatatctctattcacaagggaagagatgtaatcctggaaaaaaaatagcatcaaaatgaaaaccattatataaatttgatgaaattgcaaaggaatgcagaaaatataagggagggggaatacatagcattgaagattttataaaaggcagagaaaagatcaaaagtcactgaaggaggtagaagttggtccaattgaaggcagggtctatccatcttgacagatggaaggtggatgatgaaaccccccaagcagccaccagaaatctctgatcgtgttccagtctgcatgggtgagtttggataaggagaatactctggagacaggctgctgggttgaatcctttctcccttcctcactgggtgaccctggatgaattacttaaccactctggcttcagtttcttcatctgaacaatggagagagtaatgttgctcgtcttgatgtgagacgatataaagtgcttagcagagtaccgggcatttaggaagcactaaagactgtcagctgtggttgttgctataaccatgaacatcatgttcacgtagtacaagaaataggagactgtaagtcagcaaaatggcttggagaaataaaggagaaggaaatcaggagagaggttcatctttgggccagaaatatggggagatctgtcttccctggccttgagtgtcaggagtagaaagggctggttggtggggagagaccagcaagtctccagcagagactgaagtctggctgcgcttgatgaagcaggggaacttgtttctgtaaaataaatgctctaacaaaagctccagtggcagaggttctgttggtggctccacagggctagagagtctgggagtagccaaagtaacaaataagtgagtctaaggcagagaaagaaagctctgggttattcatctccggatgccaaaagccactgaaagtcattggggcagggggaggacattttttagtaagcacatcttctttctttttctggccctaccccaactgcaaatctacttctctctcactgtataaccaactccctgcaattccttacattaagtgacaaaaccacacttaagtttaatgcggtaaagcttgctggagtacttgtaaatgagcatgggtggtcatccacgttttcagccactatcgatttagcactttctttgtgtcaggctctggctaggttctggagacacaaggctgttcccaaacccccatctccagagctaaacagcatgtcacatcatggttcttagccatcagaataacacacctaaaattcagaaattgctgacgctcaggctctgtttcagactacaaaatctccagcagaggacccaggcatgtaagttcttccagaattgcacatgtcatttttaggtccacatcgaccttgagagaaccttctacatttttgtagatgagagaattgaggctcagagaagtgataagtgaggttgcacacctggcaaatacagcattgaacttcagacccagagcttctgaagttaagattcctaggcctttccacttggccatggccaccctcgcgtatgcatggtgtgcaactctgtgcctaaatgctatgctggtaaaatgctccaagatatagatgaatatgcttgaaacccttgccgactacaacaaaagctcaaaaaggatcggcaaatcctacagaaagtttagggacctgtatttaaagtagccagaacccaatacctgttacaacctgactcactgtaaatttccacccaaggtgggtaatgtggcttctattatacaagcaccatgtggttaccattatgtaaccctagtttccattatataaccctagtcccggggctccagaaacactgcctcctcaatttgtccctccagcctccaagtgacagtggcttcctgctgtggctgactctaggttaccttgtttggtgtgttggcatttccgttacctgtataaccaattccctgcattaaatttcctccttattccagctcagatcctgactattagatgaagaaaccaaggattagaaaagttaatataactgtattggtctgttcttgcgctgctataaagaaatacctgagactgggtaatttttaaagaaaaaaggtttaattggttcctgattccacaggctgtacaggaagtgtgatgctggcatctgctaggcttctggggaggcctcgggacacttttactcacggtagaaggcaaggcacgagcaggcgtcttcacgtagccagagctggaggaagagaaagaggggagaagttgccacacacttttaaacaaacagatctcatgagaactcactatcgtgatgacagcaccaagggagatggtgttaaaccatgagaatccactcccatgatccaattgccttctacgaggccccacctccaacactggggattatgatttgacctgagatttcgccggggacacagatccaaaccatataataacttaaccaatgcagtactaattattgtcagagctagtattctagctccaaagttcctgattccaaagcctaagttaagccatcttaacttatatttcaggtgactagtggaattttttatgcccagtgtaggtggtaatgacgatggagatatggcgatgatgatgatgatgatgatgatgatgatgatgatgatggcagtagtggtggtggtgttggtgatggtgttgaagatcaccatgtctgaccactgttgtctgtgtcctttgtacaattgttcagatgcagtgtcctggttgtcacatagatgtctctgactgttttacaggccttcacctaccaccatatccaggagatcatggtccagctgctgcggacagtgaaccggacagtcatcaccatgggccgggatcacattctgattgtgagtggattatttcttcttgtcaaatgttgcaagctcttcagcatctaaaaatggattttctgaaaaggcagatcacattgaactcccagcattgatcattgctttgttttggagtagggtgaccagatttttcctgtctgagttgggaggacttgagaattaactcaagttgttgaaataaaacagggcttaggacttgtctagttgagtgtaccagcgctaaattgagcataccagcaagggtggactatcactgctgaagacagagaagggagagcagcttttgtaagtaaacaaggtggaacattccagatgcatgtccactaggaaccttttcctctggcctacagtcacatggtgcccagtctcagggtcctgtgagcttggtttcctaaggggcttcattgcgtgttaattctgcccatagatgctggttattcaaggtcattactacatattgagctattcttctgcataaacagtatgttctgaagatcaggaaatttctgccccgtcatctgattatttttcttctcccgacacagaacccagctcgaaccctttaacctctgcccatcgtgctttaaaccaaggacccaaaattcaaatgctttcaggggccagtcaccaacataaatgagtatgcccaaccatgtcactcctctgctgaaacctgccaatggttgtccatctcactcagaataaaatccaaacattgccaggcctgaaatgcctttgccccatgcttatttatttatgtgttcctcccacatataaaacatgatagatgtgctgtttccctttttttgagtctgatatcacctaagcatagaggcttgccttctctgatcaccctgtctacaattcccagtacctctccatccactaaaagtcataccttacttctttatttttctaattacgtataatcggaaatatacattatcttatttggttattgtctagctatcctcatgagaatatgagctccaggaaagtaagcatgtttttctgttttgtcattgctgtgtctctaggtcgtataacagcacttggcatatagcaggtgctcagtaaatacgtttgaatgaataaatgcatgacatgtgccaggcagggactctaatgtttaaaaaaggatgagggctactcagccttgactgattgataccatgtgggattggaccatatagttgctaggattcccaatatttcaagagaaactgaaaatttccatgttttgtatgaaattttctgatatttcagtgttggcagtttattttaaaaaataatgtttataaacactttgtgactcccaaacagctggattcccttcagaaagccaccctgacattcctgctttacacagtggtgacatccgtggagagcatcagtggtgccagatactcttgcttttttgggccagagagccatgtaaactggtctttgtcatttgtcttacttaccatccttccacctttgaagtatcacatttttcttttttgttttgttttgtttgagagacagagtctcactctgtcgcccaggctggagtacagtggtgtgatctcggctcactgcaacctccacctcctgggttcaagtgattgtctggcctcagcttcccaagtagctgggactaccagcgtgtgccaccatgcccagctaatttttgtatttttagtagaggcagggttttactacatgttgaccaggctggtcttgaactcctgacctcaagtgaagcattttataacctcctttatctttattccttctctttagagtaaacctaaagatgatcatcagtccatttggctcattctgtacgtagcaggcttttaactccctttcctgtagaacagtgattcttttaaatggggcctgtgtcataagaagcactaaataagtgctgtatattattattttgctttctatctggtagagtgaggctctctgtcttttgcattatcaacataggcaagtaactactcagtactgccagtcctatgagccttttgtttgatggcttttgtggctggctcttctaacacacatccctcactgttgccccatcaatctttaccaggacactcccctactctggaatggtcagtagctccctgctgcctaccaaatgaagtcataaatgcattagcccaatcattttcagcttctgtgatctgatctggtcacaaccacatttttcagtcttttcatcaacttttttccatccaaatatccagccaaaatggatgtctggatattgcccaaacatgctggcactgtcttacatgcaggcttagcctctgcctctttctttgcctgaaattccttcttgtacctttcaacatgttgaaatcctacctagttttccaggtccagcacaaatgtacgaagctgctctagctgtgaccgctccctcttctaaatcaccaagctctctttaccttttttttaaaagcagtttttcctggctaacacggtgaaaccccgtctctactaaaatacaaaaaattagccaggtgtggtggcaggtgcctgtagtcccagctactcgggaggctgaggcaggagaatggcatgaacccgggaggcagaggttgcagtgaaccaagatcgcgccactgcactccagcctgggtgatagagtgagactccgtctcaaaataaacaaataaacaaataaataaaaacagttttattgaagtatagtttatacactttaaaatttaaccattgaaagtgttcagtttgacgagttttagaaaatttatagttatgcaaccatcaccgtaattcagtttagagtatttcttttactctccaaagttccatttgcagtcactttctttccctcctctcaccaaccctaagcaaccattaatctacttttcatctccatagattaccttttctggaaaattttatataaatgaaatcatacaattcaaggtcatttgtgtctgtcttctttccttagcataatgtttttgaggtttgtccatattttaggatatatcagtacttcatttcttttcattgctgaataatagtgcattatatgagcatgccaacttttgtttatccagtcactagtggatggatatttggattgtttttaacatttgactattataaataatactgctttgaacattcacaaacaagtgttgtatgaatgtgttttgacttctcttgggtagaaatctaggagtggaattgctggggcatatgggaactgtatgtttaactttagaagaaactgccaaactattttccatagtagccataatgagaaaaacctggaattatatatttttaaaagcattccctgaaactaggagggagcaaagagattaaacaatgacttggatgagtccagcttgaccagtagatgagtttattatgacttacatacgaagtactcctggatgctggcaggacagctttagagatcagcacaacctcccatccctaagctgcttttaagctaattttctggtgctttgcctactgtgtgtgcgtgatggggctgttttccttggtagattctcagctaccctctgggatgttcaggttatcagggacacctgcttctaagctgggcaccttggccttggctcaccgcccagcctttaaagacaagcagcggacatgcactcctaagtaacccggtgggtgacccatcacactacgtggctgtaccacttcacattccccccagcaatgtttgaggttttgtttacccacatccccaccaagtcttattattgtcagccctttggattataactgtcctagtggtatttcactgtggttttaattttcctttccccaatgatgaatgatattgatcacattttcatgtgctctgcctcttttttttttttgagtcatttttatctatgaacttgtcacagctcctctcttagactgtaagagtttaaggcttgtgcctatttgtgaaataaatggagtaataatagatcttcctcatagagatcctgtgtgaattaaatcgtataatacaggataagcatttgtacatgtgcttcttatgcactgtattcatttatttattcctttagcagtttatgagaacctcttagatactcagcacaaagactcagaaatgagttaggcatggtctgtgccctggagaaaatcagacctcttctgatgtgatgtctctcaggaatctcaaatgcactgcaccccaaactcaactcattgccaggtccctgaagcccactccacactccacctgaattcgggatctcagtttatgggactgccatcctagatctcaagctgcccttgcccctccctctctgtcacctgcctgccacttccattcacccaccaagtcctgctgcttttggcccacctgtccccactccctccccacttgggctggacaagctaccctgcctctgtcccttgccctgtgttctccgaggccctgtgcatacttaggtcactgtgcccattgtgcttatgacattgtaaggcaattctctatttgtaggctctccccacatttagtggaccccccgaggtcaggcaccctgttttactcttttatcctcaacacccagcagggtgcctggcgtgcagtgggtacccaagtttgttgagcaaatgaaggcactaatgaaatgaagtgagtgaataagtgaaataatccctgaaaatgctgtcatttcttaccttcatattcttgaatgtgctttcccctcagattgctcttccttattcaacaaatgtgttttctaaatgtgggaatccacatttcagggagtaaggaattgcctgttcagactttctggctcatccctgaagccttgcaaaggttgtaagttgcaagctgtgtcattagtctcaatgactttggagtttgctagtgtaattacaatgctaagagtgctgagaggggagagccagaggcctgcggcaagcatacttcactaggagcagaaatgtacctgaaatagaaggaagcaacaaacagggttttcttaagatatagtttcattttcataaaatgagcctttccagcaattcctagaatagaaatatctcctccaaattaaagaaaatgatgttggaaagtagttactcaggggtcaagggtccctgtcttagcactgaaggccccaatctaattttgaattgaaatttgacaaggaggagagatccccattccacctgtcacttttaattttccagatgtgatttttttggttagtttccattgcttgggaatattaatcaatatttgtggtaaacaccataaatgtcaagtacttttgaaatcccaggagggccccaagtgggtataggatggctggttgcaactctcattcttatacgggattagtgacagtttttttcttcttttcagggataggaacattgcagtaaaaggttttagccactaaaatcacaggaaccatggggctaggatggatttcttgttgggcttagggctttgcgatgaccattcctgatttttctatagatcaattccctgagcaatgaattgttggtgacaaatgagcaaaagggaattttgcaaaaataaaaagcaaatgacttttacatgactagtaccctttcatcctctctttgccacagtctaatttgtcaggtaacttcttgtttacttaagtcctaaggaatttagcttttgtggtgagaaagggagcatggtttgatagaaagtgtatatatatatatacacacacatatacacacacacacacatatatacacacatatatgtacatatatacacacacatatatatatatacacacacacatatatatacatacagatatatgcttttatttcaatacgtttggagtacaagtggttttttgttacatggatgaattatatagtggtgaattctgagattttagtgcacccatcacatgagtagtgtgcattgtacctaatatgttgtttttttattcctagccccccttccaccctcccccttctgagtctccaaggtccattacgttactctgtatgcctttgcatactcatggcttagctcccacttataagtaagaacatgctgtttttggttttccactcctgtgttacttcacttagaataatggcctccagctccatccaagttgtggcaaaagacattatttcattccttttaatggctgagtagtgttccatggtgcatatatcccacattatctactcattagctgatgggcacttaggttggttccacatgttggcaattgcgatttgtgctgctataaacatacatgtgcgagtgtctttttcacataatgacttctttccctttgggtagatacccagtattgagattgctagattgaatggtagatctacttttggctctgtaaggaattcctatactgtttgccacagagattgtactaatttgcattcccaccagcagtgtataaatgttctcttttcccaacattcatgccaacatcgattgttttttaactttttaataatggccattcttgcaggagtaaggtggtatcttattgtggttttaatttgcattttcctgatgattagtgatgttgataatttagatagaatattctcccttatctgggagaacaggaaaaaaattctacattctttctgcagataattggctagtgactttatgccaatttaatctctctagaccttgtttttttaatgcaataaactataccatatttgaaatcttcttcttatatctgagtttcctgacttggctgacaattcctattctctttttctatctcccaagctcctgaatcagagacctaaaatagattttgctcaagtgccagccctggctgattggggatggctgcctgtagaactgtgttgaggaggatgcagaagctacacattggctcagtgggaagaacttgggaattgattagtgctgtctgtcatggcatgagattggagaacagtgatgtatgcaagatacttgcaaatattatgtatttactgcaaccgttggtgtttttctggcccagtccaaaaactcttgtataaacaagattctcttgcacatattcttgcttcctttaaaaaagctgtggtataaaagcagaagagtaatggaaaaaaccgtcttggagagcctgcctttcctggggaacaatttcctcaggctacatgccgtattttatcaaatttaagatactccatgattttatgtgcccataagaaagaaaacttgctgccaattataatgtgacacagattgtaatcttcagagaggttaaaatatattttttgaaaagtttgactcaaaatgcctactgtgtaatggattgcaccttgagccctcacacacaggtaggcaatattgctatctcctgttgtttgggggaacagattgagcagcagaggatgaaagcatcatgcctaaagttacactgctggtaggaataagcaggatgtgaaccagggacaccagagtgcgtatgtctccagtcatctgtgctcccttccaggaagatattgtcctgtctcacaggtcttggagcagcttgaggaaaaatgtccaggcttgtttgtgcgtggtgagggtgtgcctcaagaaccctccctggctgatgcatcctgttactgactgctctagagagggctgtcccgtctcctgccaccccagtgatggggatgaacaatcccatagggagaatcaaccagggaacttgaacactgccagaagttcttggaaggaaaacaatctggtgattttgttgaaattgggatctagcctttattttgggtagttaaaataagcctctgggtgatatattttgggcctaattaccccggttttcacagaggaggctattgagtgattaagtaaaggtaaatgcttggcatcatagcagctccagaaattcagagcagtttgttcaaaaagaaaaaagaaggaaattggaagtcaccttttcctctgctgcttcacctcataatagtgctggagactccaggaggcatctgtgtcatcagagactgggcttcaaagctctgacttcacttttcactcctgggacaccaaattggaaatgacccatctaagcaactactctgagccagaccatgagcccagagactgagtcaaggactgcagcaggacagtagcaactcctcccaaccccagtccgtggcaagcaggagggaggacagtctaggatacgaggaggtgtggttctcagccaggagtggttagttggctcttggccttcactcagcacccctgtaccttgttgaaaagtaatatttataataaagctatcatttaatggcacaggcaccctgtatgctaggcaaatagctaagcacctggtgtgttttaccttacttcacctgcatcaggtgctcatattttactgagataactgagacacagggaggtcatgcaactggcccataaccacacagcttgttagtggaagaactaggatctgaacccagggagtactgttttggagtcgctgcccttaaatagtgtattgtacactcctaagcgatgaataactaaggttagtctttaggaatcaaacattttaaggataataattgagcactttgaactcagttgccgccttgcctagatcatggaatctaatgagatcacctatgtggcaactttcagaaacataaaatggcacagaatttttggtggttttatgatgacaatgatatgtttaggattgatctcctaaattctggtaattaaaccacaaaaactctaaacttagaaagagaactttttctttatgtgagtgttggtacttatgaaatagcaggcttaacagaagaggacaaggctggcatggagtttgcaaagggttctggaggcaaagtgtccttctccttctccttctgcctttagctcatctccaggcacggttcatcttggtccctaaagacctttcaactctaaatgcttccttcccattgagatcgctagcctgagtctagccacaaccacctcttacggttgtccttggcctgcaggacagtgtcaatgaacacctgctaaatgaatgaaagatgtttactgtctacttttatttccacacaaaccatcattctttttctcaatatgcaagtgttattactgttagctttatgtcatgattagatgccgagagtaagggttgttgcagaataactggattgagtggaagacaagactgggggtggggagcggaagcatcccctccacagaatgcactgtcggtattaacagttcacatttatggaccgtttatgtgaccaagatggtaccaagcactttaagggcattctctaatttagtcagtgaggttggcaataattactgtctcatctcaaagaggaaatggccattagagagcttgaacgccttcccagcattgcaagcctgggaaggaggaagctaggatttgtatcccatccgagtctgccagggctcaaagcccatcttcttaagcagctcactgtatgtgtctaggaacttgttttcctgaggtaaaattaatttaattgagaaaattcctgaaagtgtatgtgcaagggtatgtttgtgtcatatatatgtgtacctgtttgtgtgtatgtgtatgtgtgttaaggggagatcagggaaagaatcaagttaagaaagaaaatagtaaaaaaaattagacaagagacttgaaatgacagtttgtagccaaaaggtggcattgtgagcttggggtagcttggttgcagcttaatatggtaatatggatggtgtgcaagttttctggaggcggaagcattgccttaataaggactttggtgaacacatatcagggcatactaggcctaaaatatatatacaaaacatagattcatatctcaattttcaaaggacctgtagcatgtctggacggaagtcatttatcaaggtagacttcacggaactggaactgggtcttgaatgccacgaaaaactttaatggctggagaggaaggcttggtgcattttaagtgggaggagcatttcttgccctatgccttcttgcagtctgcgaaactctcgtcattctgctaggccatctttccggttgttcgttgtccttgtttcagttacaacattaccacatgtattggaattttctctttacctatctgtgctccacagtaaagtgagacccatgtgggaagggaccacttccttttatctttccattcatccttccatccgtggtgtgtagcaggcactcaattcaagctatggcagtaaattaatggaaagaacaaactaattgaaggaacaaattaatgacaagctttacaaagttcaatttaaaaaataatgtgaataaagttttgtttcatgccaatctttcctgtaaagattttttaaaatataaaattcccaaataccttactagctctgggtgacagaattttttcaggcaaactaaaatatgacagctggagcataaaagagcatgcttcattctccaaatctttcttccatcccatgattagctgctgcagaaatgagaattaagagggaatatgaggttccttgatttgttaagatagctactgcattctccctgctgtgtccaatggagcagacctttgctatgggtagggagtgctcctagataatgatgatgatgtcactgctgccattgctgttgctgctgctgctgttgccatgaaagtttcacttgactcagtacatatgtgtattagtctgttttcacactgctataaagaactgcccaagattgagtaatttataaaggaaagagatttaattgactcacagtttctcatggctggggagagcttaggaaacttacaatcatggtggaaggggaagcagggaggttttacacggtggcaggagagagggagagagagaagggggaagagcccctttataaaaccatcagatctcatgagaagtcactcactagcatgagaacagcctggggaaaactacccccatgatccaatcacctcccaccaggtccctccctcaacacatggggattatggggattacaattcgagatgagatttgggtggggacacagcaaaaccatatcaccatgcctcgtgtttctgcagagtaggtaaattcaggccctggggaagctggtgccaaagctggggccttcattggccacatagggactgcagctgtcagcacagagagagagagggaaagagagagaaatagagtttggaaattgttcagcaagagctgggaaatgcagtcacacagaagaatgactggtccatcatcaaatcctaatgaaattacctccaaatatctcggtgcctttcagcttctgttagtggagctggacaaatctgatttgagacaagtaattttaagcgtgttcttaaaggtaagactccactgtatctcttgtcctatttcctggcagtggaagaggggccagctttttcttgtccttggagaacttgagaaacagcgtatctgccatttgggcgttggctgagtacctccatccctgacattgctttccaagtgctgtggaactggggacaagctatgtggtttgaaaggagttgacaggctgggagccagtgtcctcctttcctcaagaagggaggaggtctcctcattccacagctagaaagtctcttcacagtgcagatccccattttgcttctctgtaaagtggggctagtaatggtcattacctgccaagcttgtggtgaagactgaataaaaacatgtttgaagctcacttcacaaggcttaacacatagtaggcccttggttaataatagccattattattcctcttgtgggctcctctccctgctttgacacaagtgtcaggaataagattacaaattattttacaggcctgcctttcaatctttcctgcatttgtgaagtaatgttcagctgttgctatggctgggctgtgaagaaagcctctgtgaaatacaataaggcacactgtgtctgctgtgaaggcctggaacacacattggaaggagaaatcctatcatgagtgtccttccctgggggtgttgttgagggtctgacaattcctgatatggtttggctgtgtccccacccaaatctcatcttgaattcccatgtgttgtgggagggacctggtaggaggtaattgaatcagccaggcaggtcttttccatgctgttttcatggtagtgaataagtctcatgagatctgatggctttaaaaaggggagtttccctgcacaagtgctcttttgtctgccaccatgtgagatgtgccttttatcttccaccatgattgggaggactccccagccaagtggaactgtaagtccaataggcctctttgttttgtacattgtccagtctcaggtatgtgtttcttagcagcaggaaaatggactaatccactgcccctgggaaaatcctgttggaacaactgctaatgaaataggctttctcacaaatctcaggcccatcgcccccgtccagggcactggctttaagtgactcaaaggaatcaattctgtcaaatgatccttcaaaatcaaaacccatttttccagatttatgttacattcatgcagtgatgcatttgtgtagccattaaatgatatttatgatgatttttaacaacacaagactattctgtgaattctatgtagagagagggttgcaggaatgaagcagcaacgacaacaacaataataacaataaagtcatcaaggaaactgaagttcaaggaggggaaagaaatatggcccctcaccagagggcttcgatctcccagagctcagaacatgttctaaggctcacattgtgttagcatcttctgcttaaagggaacatgacttgcatatttctggagttttacttttaaaacaatttcactttccttctataatcaggaaaaacaactttttttttttttttttttttttttttttttttttttttttttttgtggtagacagagtctcattctgtcacccaggctggagtgcagtggtgcaatctcggctcactgcaagctctgcctcccgggttcacaccattctcctgcctcagcctcccgagtagctgggactacaggcgcccaccaccatgctgggctaattttttgtgttattagtagagatggggtttcaccatggtctcaatctcctgacctcgtgatccgcccacctcggcctcccaaagtgctgggattacaggtgtgagccactgcacccagccaaaaacaactttgacactatttctttaaaaataggaattaaggggacagtcaaacttactgaaacatttttttttttttttgagacaaagtctcactgtgttgcccaggctggagtgcagtggcatgatctcagttcactgcaacctccacctcccaggttcaagggattcttgagcctcagcctccttagtaagtgggattacaggtacccaccaccatgccctactaatttttgtattttagtagagacggggtttcaccacattggccaggctggccttgaactcctgacctcaagtaatctgcctgcctcagcctcccaagttctgggattacaggtgtgagccaccatgcccagccctgtaacactttcatgtatataatttcacttttcttctgaacagtctgtaaagccagagaggcacagggtttcattttaatgatagaggtgatgtgtggaggtgaagatattattcaaaattatgcagaaagtcaggggcagaagtcaggacccccagcctgtcctggtctgtctctcttcccctggactgcttttccttgaaatgtctccattatcatatattctcccaattcattcaataaacatatacaaagcatttacagcatctcaggcaatttgagaagcccttggagagtcccagagatggaaatgacaattgtgtccccccagaattttctttctggtggagatgagcatgagagattgacaaaagaaatgtcaatataatatgaaaagtggcagcctgcacaatgtgctctgggtacttggaggatggagtgactaattccatggtagcaacgggggatgaccagaaaaagttatagagaggaggtgacatttaaattgcaacttactgtctggcatcggagttaggagcccaggctcccaagcttggcagaccctcaaagaactccagccttcaccacctcctacctgtgtactctgacagattacttatctccccctaagcctccatttgctcttctggaaaatgggggtaatcataaactaccttgtggtaatttttttgaagaataaatgagataatgcaggcaaagcctttagtaacagctcattgtaacttcaagaaactagagtttttattatcactatcagtagtaataatgcgactctccttttctttcctctaaattaaaattatttcctgtggtagataggtaatggaatagtgtccctggtagggaaaacagaatttgcaaagttactgatatgtagcagcctctgactttttggaaagtggcaaggagatggggttgggggaagtagaccagtaggaagttaggctataagcgctagagtggcgttagattataaggagacttatttgtaggggaaggaatttttatgctctaggatggtagtgggatgcaactagagatataaaaaccagggaatgacattgctagatgtgtgtcttagagagaggccccaggcagctgtgagggggtggaaaatggtaagagaacatagatgttgaagaacagtgcaggggtctacatggaagagaccaaggatcccaatggtgaagtctttcaattaaactaaacaacacttcctggatttggacattacaagatgaggaaagctgctcctactcttggagtttaacgtatggtgggaaaaggggaaggtaatgagaaagagccacaagagaatatgtattggtctgttttaacactgtgataaagacatacctgagactggctaatttataaagaaaagaggtttaatttactcacagttccatgtggctggggaggcctcaggaaacttacaatcatggcagaaggcaaagggaaagcaaggaccttcttcacatggcagcaggagagagagagcagtgaggagcgaagggggaagagcctcttataaaaccatcagatctcatgagatctcacttgctatcatgagaacagcctggggaaaactggccccatgatccaatcacctctcaccaggtctctctgtcaacatctggggattacaactcaagatgagatttgggtggggacacaaaacctaaccatatcagaatacaagaatagcatttggatgggttcaaaaggaggcaatgtgacattcaggtggggtgaatcagaaaaagacacctgcttattgtcagaagctgcccaccagcccctgagctctttggtactagggtagtgtctgcactgcattttccgctcagtgtccttggcacctcacctggcagagataaggggcttgatgactgtttactgaaaaaagtgaatacagactgaggttcatctgagatttttggagctgaggggtgcatattagtggagatgaggtagagcttcaatccttgaaacccactccaggtcagcagcctgagtttatgagtgctgatgttttgtgttgctttgattttgttccctttgatccctgactctcagctactgaaggtatattgttttttattttaaaacaaaaaagcacaccaaagacaatgacaccagcaagtaacttctcatcacctccatcacccatccgtgatttctgtttgtagaattgaatttcatcgggcttggtgtgctcagtggaaacactgtgtgaatcactctcaagttcagcagttaacatgactcagcacttggttcatgagcaagaaggcttttctgtcagcataaccagggtatcatagcagtgtgtctgctacctgggaaaccaagatgaagcaccaagtagaggtcaccatgtttaactaatgatttaagaaataaaggtttttgtcaggagcaaacatatgggtttcatttgagtaaaatctaatatagtatacttacggattctaagaatttgtgaaagccatttatgataataaaactcttatttgcttccaagcaaatgatcttttggtgcgattttactgtcttttcattttagttctgctttgagccaaggcaaaatgctttgcccaaaatgttcctttagttagaccttgtctcttaaattgcattttctccagaatggactaggtcacatgtaataaattctggcattttaatagaaacattacagggaaaatagtcaacaatctgctttaatttcaaaagtcatttactctttgatatggtaaggcagtatctggtaaaatgtgcagaatgcattgggatttacttatgatgacaatttattctgaaacaatgtgaaactggaccatcaatattcaggacaaagatcttggcagggggaagggtactgggagcaaacattagtgtctttttattcctgggtcctgaatgccatgtagacctcagggattacaggtgcacgacaccgtacccggcccctctctcacttctcaaatatcttctccacatagcagccaaagcaatcattgcaaaatttggatgggaataacattacactctcacctcaggagagttagaagccttgggcatattaccagtggcagaccctaatttctataaagagctgagactagggcatgatggtgagaagatggaaaaattgctctttctattcctcagggacttaagtctctctttgagaagactggttatttgttctgggaacaaaactaaaaaaaaaaaaaagaaaaaagaaaatcacacgtacataaaccaaaaccacaataatagatcatttaattctaggaattaaataatcaatcattttgggaatatactatgaaataacttgaatgcagatattctcaattaaaaagataagtattctgtttatatacgttggttttatatttgataagtgttaagtttctgaagatccttttggttttggtggggagcagaatgaggatagagagaattgtttctttatgtatagatttataccatatatcattcaggactgtactcactatggtaccatcctaatatgaggactgaaggaccagggataaactggtgtatgcccagtgaatctaatgtactcaataatttatttctgcaatgagtatttaaaccccatggtggtacatgatggagatacaaaggcaagcaagaataagcgagatggcttccttaggaagacttcagtctagatagataccttgatcaaagaatgacgcagatatatgtacaaggacaactgcgccaaggacttcgatggtaaggtcccttgtgccaggcaaatgtctaagaggggtatttggcatggtctgggctgagttggtggtagccatgggaggcatgacctgggaaaccccaacagagctgctgggcagggagggtggtgtaggtggggagtattgaaggcaggaggaacaggagccttcagggactgaaggcgtggtaggtccaagaaagccaagaaggctggctgagactggaagacaaacaccggaagggcctgtggtgggagcttacaggagaggcagggcaggatgtgcagggcttcgggccagagcaacatacctagtcttacttcctaagtatattgggaagccactgaacagttctaagtcagagtgtaatgttattcccatccaaattttgcaatgattgctttggctgctatgtggagaagatatttgagaagtgagagaggggctgggtacggtgtcgtgcacctgtaatcccagcactttgggaggttgaggcaggaggattgcttgagccaggagtttgagaccagcttggacaacatagcaaggctcagtctttacagaaaataattattttaaaaaaaacattagtgggttgtggtggtaagcacctgtaatcccagttactggggaggctgaggtgaaaggattgctggagcctaggagttttaggctgcagtgagctatgatagtgccactgcacttcagcctgggtgacagagtgagaccctgtttcaaaatatatttaaaaaataagtataaaagaagagattgcatgtggggagacctgttggggaggttcctgcagaggccagttgagaaatgaagtgggtttagaacaggatgcccacagtggagaggcacgctgacctgagaacttggcttagtctggcaatgagagaaccaaactctgtgtgttgccaacggatgcatccctgctctttatgggctgagagttctgtaggaggcagagagaaattagacatttgcaaaacctcaggagtaggggtggtatgatatggtccatcgaaatttaggctgtaaattggtgaaaagaagatggggaggaagttgaggtgaaagtactcaaaaatgggattatgttcattaaaccagtcaaatgtggtttgtgctgaatgctgacagtgttggattaggatttgtcccccgcactttttcttgcaagcaatgcttgatgggcgtagtgatcataaaacatctttgtttcttggcatttataaaaagaaatacatttttagcatacagcaagttgccttgagcagcttaaaatgagagccttttcaagtgaaggttatattgaggattcagctcagctaatgaaggtaagaacgggtttcaagtctagccttatgcttcctggaatggccctggcccctcacacattccacccaccaaccacattgctcccaacacctacttccccacaggattgctataagcccttggacaaatcatttagccttccttaattgacttgtgcttaaaatggaagggacctggctcttaaagtctcttttacctctaggatatttgattccacacaacaagaatctttaattcccggagtgctgtgctgtattttatgtgcccatgtgctcttttgaatcatgggcgactttattacttaacattaactgtcgtggtttctggtggatccttctttttttttttttttttcttttttttttttgagacagactattgctccgtcacctaggttggagtgcagtggcatggtcacagctaactccagccctcttgggtttaagctatcctcctgcctcagcctcctgattagtggggaccagaggtgtgagccacactcttgactaattttttaattgtttgacggggtctcactactttgcccaggttggtctcaaactcctgagctcaagcaatcctcctaccttggcttcccaaagtgttggtattacaggtgtgagccatcgtgcccacagaaagtgttcttcccttgccccgagaaaaacctgtttctgaaaaccactgcagcttcacggaggtatcttcctttctctctcccaatttacttcaatccacaaatgactgaatatgtgcttgttgagcacctggcccaatgtgtaccctacattgtgttcttggctgtcactcagttcattgtcaaggcactcttgggaggcagggggtatatcagaggaatcagaggctcacagaaactaagcaacttgctcaagtttatgcagcaaaaataagatagcagactgctgtcaaacccaagacttctgattctatgtccagggtttgtttttgttattgtttctctaaattgatgtttcccaaagtgggagactcactctccaggtgtaaacccaagctggttttagatggttcgtggagaaggcaggaaaaggaatactgaatcacatgacaggaaagttgttttcttttcaattctctctcaaacatcctgtttagtcaagtagaaaatgggcttggtgtgaatgtgcctttcgtatgtgttgaatatttgctaatctcccatcttaacagagagctggtctcaggcttagcagcctcaatagcaacagggtttagcaagaacttaataagatatttttatttcatattctatttttggaacatgatattgtttttcttcacattggcgatataaatttgccttttaaggaaaaaaattaagggggaaataaagaaaagtactggataaattagagttcaggtgtctgagtataatgatacaaatcatgcctgtacatccatggaatgaggctgggagcagctctccatttattcatgctgcctccctcactcacgggacacgcggggcttcatgtgatcatcgtgacactaagttctgaatctgctctttatttatttcccttagaaatatatagaagcaattataatgaaagccatacttgcccttaggaccattgaggtgtccttcttaagcatacattttataactgaaatcaacccaagctagtaatggagtcttaaaacctagaaaaaatatgtaagtttattgcaaaagataatatcccgtttaaaacagtttagaaatttacaaaaccttacatcagtacatcgtctttaagaaggtgctctatagatgagctggtattaagttccaaggatagtgagtatgcatttatgcattgctttttaaactacagagaaagcagctacataaactcctgcaatttaagttgatgtattggtctttttcctttcaattttataaaagtaatttttgctaagttaatatctctccagcaaaccagataacctcaagtacagcatttctgtagaatatcatggtagatgttacgtaatattttacaaagaagcagtgattttcacatgaataagtgagtatgcagttttggtatatgtgtgtgtggtgttttaaacatagagacgaccatttttgttcatcaggaaaatgtttatggaatcctatttcctcataatgattttaaatatcaatttttcagaagagaactccttcccagtttcaggtcagtggcccaagcaatgcggtgttgtgctttggtgtagaatcagtacagccttgtttggctgtatttctagaaatgtcaacattttatttatttttttcttttcttttcttttcttttttttttgttggggaagtgcagaaaatgtcaacattttctagtcccagttttatttaattcagttaagggttcatgtgagggcctcaactggaaacatatctatgaccacatcagcttattaattttgtgtgaggtacctcaaacatctctttatcttcccaggctaactttggccagtaatccagctcagctctgagtcactcagctcacataatgtggaacgtgctaagagtttataaagtaggaaagcatatgttcttatctgtattcaagaatggacaaacaggccgggaaatttaagccatttgccaaaggctagtggtatagactgcttggttgcctggatctcttaattctgggaacagggttatttacattctagcatgatgcccgagaatataaattcacatgaaattagcgtaagcaaagcaaattaagatggaagctctactacaagataaaattacataagaggtcccaaatgatttcactttattggattatcctctattctgttcttttccattgctggggccaactgacagttgatcgtatggatacaggaaaaaaaaaatctgtggcttttagccagtggtagcatatcttattgaaatgtggcttcttaagtatgacaagtgtatttatcttaattctaacatgacgttatatattccggtctgattctgtgggcttaaacattacactagaaacagaacaagaacatcttgaatgacattccaagacttaaatagtgcaagctgatattccttgccaaatttccctttcattctcactgaaatagctttgttcactgcatcactatgacaggggaaggtgaaaccatcggagtggtttgctcaattaggctcaatttgcagtggggtaggtacatcccacgaacacacaggattctgtgctctgcaaagattctagcttagacactggatcttcagccaagggaattacaaaataccttcttcgtttaatgtatgtttagtttcaggctccctttctagcaatgtcaatctaaccacatgctgatagagattttaattcaaccagaaggaatctgagcctttccatcctacccctcatccacaagagtatatagcaattacttaattatattactttagtagtttgttcagccatgcaagtttgactggatccacatgtatgtaggtcttgtcaacagaatgagccagaccttgaataactcagactttgggatggaaagatatttaaacctcaaatagaaaaaactatatcctcatccatagtcctgctagtttttcaatcaggtgaccattgtctggtcaccaggaagggagactgtgtcgattaatatatgtttgaacctatctacacggctgtttctgggatgaagggatgagaaacagtgttgtgttttatcttagccttatctatgttactcataagatgtaactgatggacaggttgctggatctcatgattttaaatattgcaggtaagttaactatggagtcttaaagttcacaccaaaaacagattccacccatttgccaggtggtctcaggccctaggcagagaagaagcatgatggtttagggtgggccctggaacagctacagctgctgaaatcctctttgaattacacttatccagcacagccacaccaacaagtttataccctggggtggcctgactctgccacaggcagaaaggtgcatgcaccatgagatgacagagccttaatttgggatcaaggggctaattaaaaaggaaaacaacccaacacaccagggtgatcttgcataagcattttatgccctgcccacttctcttgtgcttattatgtatgctgatatcttagaaaactgccagtttatctcatttttttctatggtacctgcttataacctataacctccctctaccttccgggtctgcacaacactatttttttcttttgggtttatgaacccaggatgggaaggaagtgcttggcatcttggaggtgttggaaggtgtagtgtggggttttgctcgtggtgggaatctggtcttaaaactcagcatgagttctggctgagtgtgacagggaacttggcaagcggtcactctagtgtccgtgaagccctcagcaagcagtcgcacgcactcaggtaaggatcgtggtcaggtgtccagcagcggctacatcagctccaaggctcttctgtttcacaggccaaggggctcacagcccagggcctttgcaaagaagcagggcaggccttaagtgcagtggatttcccatctcagggaagtgcgtggagttggggggctgggggatggtcccaaccagctcagatccaccagaagcatttctttttcaccttcttggttttccgccttaagtcctgcttttccggggctgggggttctgctggggactttggtgggggcgatgcctcctcaactggctctgcttcctccagactctgcaaaacttcatggaacctgccttcctgctgccgaaaatcatactctacactgaaaaacacagagaggaaggaaggaaagtgaattcgaatcagcacagactgattaagcatctctcagccccaactaatatggaagagcatgagctttgggatcaaatcctagatccttaggtacctactggctctttgaccttgggaaagtgatgccacctctctgaacctctagttcttcagtgattgaattggcacctgtaatgccttcctcacagggatgttattaagggtcagtgagacctgatggcaagtgttctgtaaatattggctccagtctctctcttaatcattaatggggttttggcatgtgttatgcatgaaaactgtctcattattaaaaaattgagataatgcagaggaacagacaagaaaactgacagctcagtttcattatctgtaaaatgggggtaataagagcacctatctcaaaggctttctttggaattaatgtgtgtaaactgagataatataaatgaaatgctcagagtagtgcctggcgtgcgctaagtcctccgtatgtgttagcttctattaccgctatcatcatcatcattaacataatttctaccaatatattacgtcttgctctttgaattgcatctcaacttcaagatatatcttggagagctttacatgtaagactgccttgtagtattcctcaatacagtgtatttaaatattcctctactgatggatggacattcccaacctctttttcgttgttgttgttgttggctattttacttgtgtgttttggtgtcattaacatacggactgcattgtcccgtgctgattatcacaaacattgaggaggtaaaagtgaacctgtcgcagagcaggggtccctgaggtcaggggaggtgggcgttgaacagaagcctggcctgtagggagtgggtgctgatgctgtctgtgacctctgcatgtctggaagtcaggccagcagacctcagggactctcagcctgcttcctcactctggttcaccctccccagaacccagagagccggggcagaaaaaacgaatcctcttagacatccctgtgggctgagcacgggttccctctgtccttaattgtctttcctccatgaggaggatttacttacagaggagttttcagtgccaagatgcttataagaaagctcttaagctttttgatgtgtttgttacctggtttcataccaggggtctcagaaggcccaaggatgaggagccagcgtgggagtgtgggaagtggaggaaacgtggtcatgaaaacagtgcattctccttgtttagccagaaggaaaatgaaatgttgcatctgggagaccaaagaccccatgttggtttatgatgtggcatgactggccagtgcctttatacccagcaagggctggaaaacagctgtcattaaagggacatctgcccttgcttactctccccatgtcacctcccagggccggggacccgagttcatgctgctgcaaaggcatgttgccgttgccatgcatgacgaatggagccccaaagagtgcctcgtccctgagcattctgagatggaagaggcagggctgaagagtcagaggggcgagggggcctgttttatagcaagactgatgggttgttgcagggctgaagagtcagaggggcgagggggcctgttttatagcaagactgatggggtgttagttcttagggagcactaggaaagggtatctgattgttttgtttctgcatttttcatccaggcttgcttctcctccacttacatgccttctctttctgttctctctggccctctctatggggacataatcctggctggatgacctataggccatcattatattaaattagaattgtattgtggatgaaacataggctgtggtttttaaagcaaagccccacagtttcactgtgagatcttggggaagtcatttcccacttccaggctatggtgtcctcatctgcaaaatgagtagtgcctacgcaaaggacctcagtgaagcttaaatgccatgtgcatatacaacacgcagcatagagtaggcaccaagtatccagtcagtcactcgacaaacatttattgagcatcttctttgtggcaggccctgttctggctgctgaggaaggaatggtaggcagacaatctccctggcctcctggcactgctaatccagtgaatctgtgtcctcagtgctggcatcagtagctgttagagaccttctagccaaagcccagaatttgccaggccagtgggcagaggcatgtgcagactcacatactgactgtctatttcaggagtctctatttcaggaaaaactctgaaaccatgtttttcctctgctctcacaccacaacaaccatcaacacagaagaagacttctatgaccaaatgtgtgggagtttctccccactaccaagcagtggccaccagttgggtgtcttccaattcagttccagtactatctacccagagatagcatcagattccatagattgggggctcaatcccacaagacttccccccacttacaagtccgggaccttggaacttctgactgactagcttcaagttggggttcccaaaaccccttctttgggtttgattaatttgctggagtggttcacagaactcagggaaacacttccttacgtttactggtgtatcataaaggatattgcaaaggatacagatgaagagatgtgtgggggcttcagcccctgtgtagcactcattcctccagggtatgggcaggacccactctggaatcagtctcttgacccacaatcagattagattccggccttaggcaggtgacaggaggacaggagaaggtcagagaaagagactttgtttcctgaggcctgctcctgaggcctaactcacccaacgtgataacaaaagattgtaacaagggctatgggagttatgagccaggaaccatgggtgaaaacctctctgtctgtctgtctgtctgtctgtctgtctatctatctatctgtctgtctatctattgatccatccatctatcatctatctaatctatcatctattatctatttatctatctatcatctatcatctatcatgtatctatcatctatcagtatctattatctatcatctatctgtcatctatcgttatctatccatctatcatgtatcattatctatcatctatctatctatctatctatctacctctagcatctatttgtctctatctattgatccccccacacacatagatcgcacacatacacacatatataatcataacatcacagtctcttcttccaggaggcatcacctggtactgcacccctatttgtctggggtgtggtggagtgggtttctgtctgcaccacctatacttcattctccccagtggaaactggagatggattgagagcctaggcaacccctgcattgcagcaaggaaggactttaacatggtgagttgcaagctctgattctcgcccctctagcaccaggaacacacatagttcacagatagggaacatctatattcacaatgctcctagctcctgaaatagccctgccctccctactgtgacagaaaaacaatcttcatcatagagtaccagatagagccaaagagagtgggtaccccctctaagattttaggagtctaagattttcttgtacaaaacattccatccatcatcagtccatcctgctctgggcctgacactgtaccaggttccaggaacacaacagtaagttagacagatgtggatactgtccccagtgtgtttgagataggtgattaagtaacaattgctttcaaaatgtacttcttatttctctgaactactcctactttccaattcttcatccatatgcttccaccaaattatatgaatacacacatgcaccaactgccttcctctccttatatgtgaagtgtctctgacttcataattcaaataaacaaacaatgacaacaaaccagctgagtttgacaagatttacaagtgtcctaatacctgtttaataaaaataggctgggcgcagtggctcatgcctgtaatcccagcacttcgaaagacccaggtgggaggattccttgaggtcaggagtttgagaccagcctgggcaacatagcgagacaccatctctacaaaaagtaaaaaattagccatgtgtggtggtgtgcaactgtgatcccagctacttgggaggctgaggtgagaggatcacttcagcccaggaaattgtggctgcaattagctatgagtgcaccactgcactccagcccaggtgagagattgagttgtccccatctcaaaaagaaaatgatattaatgctctggatgattctagaatgtgtatggaacttgcaggcctgggtagaaaagaccgggagatggaacggaaactttatctcaccatcacaacttgaagcccagcccaacatagaggatggagtgagggccccagagctgaatgctcttgggtttgaatggaggctgcagcacttcctggctgggtgaccctgggcaagtttcttctcttcccacggctcagttgaacttgggagttacactagcttcctcgctgggtggctgtgcagatgggatgcaatagcagctgaaatcactgcacatggaacactgtcttggcccactccactcttcctcactaggtcctttgccttcccatctcagctcctcgcatcaaccttcagctcttcagtagctgcgcaccttaccagcagcatcactcctcacccctccccaccatctacattcagggaagaacacactctttatgtttctatggaaacacagcagggtttcattataatcactgggatttagggagctccccactcccctcttgtgactgcccccactggtcttgaacaatttaaaggggattgaaagtaactttcttttcaaggccaggcaaatagcagaatatggagaagtgtgtgtgcttcggaaagaaattgattaatgttttttaggccaaagcaatttattaacataaaggaaaattgccacttttctttttattcatccgtttgacacactacagtttggaagggaggagagggagtatattttgctttggtggcagctgccttataaatggggagggacagagccctctcatctgctttttatcttgaggctgggtagaaaagagaagatgcatttctacttcttacttagctactacaccatgcttagcaaccccttgcaaaaaggagtaagttgccaacttggtgaaaattgaagttaattcttagcagagcgttgtttgcagacagtgggagagactctctgctttgggtttcagcccaaggatccaaatagcacaccaataacttttctgacctcacctcgctttcactgcttccacctactctctgtaccctcccatccttaccatcttccaccatccatatttcacatatgctgtatattccatgcaggatcgtaagaaggaagataggtgcagagtgctgagtttgcagaaccctggcttacagtggagggcaaatagtagttaagaaattgttacaatgcaaaattccggacacgagcccttgagatagtccagggcattcatggtatgtgagttggtcttcctgaggatgcatgggacatgggacctgtggtttagggatgctcagttaactgcctgaggtgccttagagcccttcacatccaaggagatgtctgaacacggagccacgttgcatttagagagtgagctatgtgtaaaccagaaatggtaagaactttcaggtttccctcttgggggtacctcactaatctggcttacagatcagtgctccagccatcatgctcgctgaaaagcagaaagatgtttttctaggtaattggaagcagcaagagccccaagtcatgacttggctggaagaagaaacagtgagtaacaaatagcaaaaaatagataagctcatgagcaaacaacagagcgaggttctggatgcaggatcttggctgggtaaactgaagttgggtgagccaaaaggagataaaaattgatgtagaaagaaataacagaagcctctcagttgtatataacttttgaatttgcaaagtattttagatctgtgggtttttttcttctttttttaattttttgattttttaaaattttattattattatactttaagttttagggtacatgtgcacaatgtgcaggtttgttacacatgtaaacatgtgccatgttggtatgctgcacccattaactcatcatttagcattaggtctgtgtttttattttatcctcatgatagcccaggaagataggaaggttgttgcccatttaaacagacaagcaagttggcaaagggaagtcatactgtaagttacaagcagaatctaaaccctatgtcttagtctgcttgggttgctataacaaaatactacagactgggtggcttatacatacatacatacactttatttctcacagttctggaggtgggaagttgaaaatcaaagtgctgttagttgggtgtctggtaagggccctcttcctggtctacagacagctgtattcccttgctgtgtcctcacgtggcagaaaggggagagggacctctctgagttctctttataagggcactaatcccattcacgaggactccaagttcatgacctaatcaccttccaaagtttctacctccaaatatcatcacatggggcattaggaattaatctgaatttgaagggtacacaaacattcagtctattcacctagtttcctgatacctagtcctttgatttttctgcttaaagaaggaccaaatgttttagccatggacctaactctttccagcattttattctaaggagaagaaacaaaaagagagtacctgggccacattagattaggatacatggtaatttaaatgggcaaaaataataattatgataaaaagaatgatggtcatttatggaatgaaatctatgtgctagacactatgctacaagtttacactccttctctcatgaattctcacaatcccatgggataaataatattaccttcattttataaatgagaaaactgaggcaaagagaggttaaatattctgccaagggcatgtaaatataagtgacagagtcagaatccgaaccctgacagtctagccccaaagcttctacactaagatgcactggactgaaataacatagtaatctgcatctgtatgaaattctgattgcaaaatatgtagggtggtgggggtggaggtggtggccaaggcctggtgctcctggatgacctcacagtcccctgtggaaccagacctaaactagggctggggtgcatgggggacgctttatggaccagctgaccagtccaccttggaatactctttctcaatttcagggcagccttgaaagggaggctgcatacccaaaaaaggtgctctccttctaaggaggcagcctattgaagataatatctggggtcagcaatcttgggtctggtatagcctgctgatgtctccagtgagccattttgcacttccttctcagcagtgggtcctgctcttttataaacaggcatgccaacaagccactgccatcaactacactctaagcaagttggccgagaagtgaatgattcatggcgtctccctgaagacaaaccatcttccaaattcccctccacttcttcttcatctcttgttggaacatttctgtggtccctgtttctacagaacccaggtgcaccactgatttactgacctcctgcaactttctcttttaaagaattagctgtaagaatcaatggatgcagcgagagtagtttggttctcgtccatttggataaatcatgacactttggaaggcatctctggggaagaattacagtctcggatcacaggaactttagtttgtatgtttttctctccccagcctggaagggatattgttcctaaaactttctcctaatgacaagtttgctcattttttatagggtttaattttgtgcttcacaacttgcagctatttcaaattggcaagtctaccccttctcctagggcatctatctgctgttgggtcttcagaaaatcacaggttctcttcttggcatgtatataaatgggatcaagctgcagaaatctctgctgatagctatatctgaaagaaatctgtgttttgggttctgtgactctgtgccagtaagatctgcatgtgaaaccctcagaaagggtagatcatctccgagaaagttaacacacttattcactgacgatgcaaggtcacaaggaaagaggggaagggacaggaaagtcttctgaaagtaggacctagttttgagccctggctccctgggatcttgggcagatcacttaacctctctgagcctcagtttcctcatctgtaaaatgggaatgttaatcctatccacattttaggatggttaggagtctggaatgaaacgatagacatatagtgttgggcaaaatgcctagtgcagtggctgattcaacaaatggtaatgattattacactaacttgatggagaaataaagatcggatcactctgtgatcacctgtggcctctgtgccagcagccactcatttgttattcctctgaaatattcaactcgtgtaattttatatttatggcatgtgtcagcctcttttgctattaatgcattaaaataggtttcattttttattacagataaattgctgatgctgtaaatcctacttcttttcctttacactctagggagaaaaagaaaggggtaaagccattcaagagaatcagggaatagagaaaaatgtcttgggaatctcctgttgggactcagagaaattttaccttttacattttacatgtaccccaaacttcatagctgtttcccaaagagacatttaagctgtgtttgctattggttgttttggagatgctcgagggcattgctatgacgttcacggcccagcatttgaaatagtgtggctcagtccatattggaatttgatgagagctgcaaatgcatctgtgattactagaataacagatatgctgtgtgcctttatcattattttttactgtggacttcattgctggccagagggaggactgtggctggaagacaaggttctcaagagttcacctggctccacgctgggacactgtcataagcagatgaaaggaaaatactaaacaatttaagtgaaaagttggctgctaaacccataggactgagtgcatattgcatttctagagaaatgcctttttctctggttaggtaatagctttgagtggcaggcaaggccagagctcagtggccaaatcgcttaaccaagaaggaaactcccagaagcactctcagacctccaaccgtgtgacctcaagcggctcacacagctctctggagcctctctctcctcagtgatgtgaagcccttgcttttctcttgcagggtgcacagctgtgaggctttggcctgcattccagggagcctccttgtcatactctgaatatgaaaactgtgagggggacgtgctaggaacgagaatgctggttgctagatacaaagggaggctcttgcagagaatctcctttacagaatccataagttcttctctgtctggtccagaagaatttatgagtggatgcatcaataatgattaaaataaaaaagcggccgggtgtggtggctcatgcctgtaatcccaacactttgggaggccaaggtcagtggatcacttgaggtcaggggttcaagaccagcctggccaacatggtgaaaccccgtctctactaataatacaaaaattagctgggtgtggtggcgggcacctataatcccagctactcaggaggctgaggcagaaaaatcgcttaaacctgggaggcagaggttgcagtgagccgagattgtgcaactgcactccagcctaggcgacagtgagactctgtctcaaaaaaaaaaaaaaaaaaaaaagcaattggtggtctgtggagtttgagaaaatggaaaatgagcgggtggtggtggcagattctgcgtggcatttagcttcatgcatggtccttggttcccaagcaaggggtgaccatacccctatcctgaagtgggaatgtagtggtaatggtcagcatttggacacccaccttttacacgtgtctgctgttgaccctctagggcccaccagagggccgttcttagcgtttggtcccttggccagggagcagaattaggctttaattactctcaacctttgttggaggaaaaatgtcagcctggattgccaatcagtttctgatctcagatgaggcctgagggactgagagaggtgggaggaaggaacggttacagctgaatctcccaagtattgcataatgtaagcctgggccccagaaaggcctgagagggactccttttctcttctcattggaaacaggaggcatcagaagatatgcctgctccatgagtaatcctctcctctctcttccttccctcgcccttgcctccattctcacctttacccaacatatataattaggtctatatatgatcatctaaccctaaaatcaaagccaagcagaaaggtaattcatctttccaaagatgtagtaagaactaaagctactctctgggctattttacaagcaagtattttttattcatgggctggttgtcacaaaactttctagtaaatcaagtatcttctttcaagaccctgattttttacctaaaaaaatccttctgctttatttgaaccaaccattcccagggagcttgctgcaactgcggattcccatcctccaccccacactctctgattcagtggctttggggctgaaacccagcaacaagtttccatagacacccaggaggttccgatgcagatggtccacgaccacgctttgggagcactgtctagggcctacatcttcaatgtaaaccctcacgatgcccttggctgagtggaactcagtgacaatcgaacattccactgagacctaatatccttcagatgagtctggcatctggaaggcagcatgctgtggaatctggcttgttggaagacagaactgtgttctgctgtggccgttgcaattactatttccagaataattgtgcaagtgcctcgcctctctcagcttcaattgcctaatctgaatgttgagcaagtgcctgacccttcctgagcaacagttccttcatctgtaacatgggggtactttaatcaatctcatcattgtgaggattaagtgtgaaaacaaaaggtacttcaagtgatcagtaaataatggatcctcggtaagtggtagctctcttctttctttcccttaagtttcagcccaacagatctctttcgtcagctgttatcattgtaaaaatcatcagttaaaggcaaataaactggcctccaattatgaggatttattctgagtgtacttatgtccctttgttgaaattaccacaaatttaatggcttaaaacaacatagattttactcttacagttctggagggcagaagtcctccagagctgtaaatcagagtgtcagcagagctgtgctctttctggaggctctaggagagaaaacatcccttgccttctctcacttttggggtctgccatgcctcctggcttgtgaccacggcactctgacctttgcctctggcgtcacatctccttctctgactctgatcctctggcctccctctttctctgcggcccttgtgattacactgggcccaccagacaacccaccctgctctcctcctttgaagtccttcacttcatttcatctgcaaagtcccttttgccaaataaggtcacatatgcagagggtctgtaggatgtggacaccttaggcattattttgcctacaagcctgggttttgatatttagcattagacatttagcaagagaacctgaagatctgatgttctaactcattctcccaaagagatcactgggacaattcagacaccagagaagggagatattttcacctggagggagttttgtggttccccacagtcaaactttgcctttcccactacagtcaggacagaagtcctgggcaataatgtctgatggcctggaagaacaagggtttcaatgtcctatgaaagtgcagcaagctctctgagtcatcaaagaaaggttctctcttgttgaaagtatgtggcattccagttattttgaaactggcaacctacgggcttacattcagcttaaaaagacccattgagaaccagttacatagaagccctccttcctaataagaatatttgcttaatccttcatttcctcacccaggagtggtggtgtacactaatagtaacaatgactttacttctggacaatttaaacagctgtctcaagtccactactggttttccttcctctcctagttaatagagtcatttctttctttaataagaacctactgagcaccaagtatgtatgagacactgatccatgactttgagagactagccatttgctgaaggaaagaaacttataaacaccatattacaatgcaataggatcagtgacctagcagatgagggctcatggcatgggggtccttctggggaaggattggattgtgaggttgtccagataactgacatttaagctgcaagactaagaaatatccacacaaagcagggcagaaaagacgtcccaggaaagcaaaggaacttatgtaaaggcacagaggaatgacagaaccaccagctgagcacctagttccccatggctggagaggagccacagactacctgaatcaggacaagattgtttagcgggggagtgacatggtcagattctatttttcaggtgcaagttagcaatctgcatggaggattacttgagataagggaaaagagacctgtgtcaaaaaggtcaattcacgttcaagtgacaaatgatgagagccttttctgaacctgcggcagaggaattggagtgaaggggttggattgagcagttggaatcagtagcttatttggcatatgaagagaaagtcaagagggattgtgatatctttatggagttgcctcttggtcaatggtgttgaacaaagtaaatatgggaagaaaattaattttgtggtgaaataggtgtgtttggggatatgacaaatttgagttgccttgggatatgaagtggaaatgtctgcatgtagttgcttgaaaattttagatagatagatagatagattgatatagatatcagataaaaggtagcagaaagtggtgccacagaaataaagtccatgagtgcagttgaagtgatgggaagaaactaaggataagacgaggagcagtctgtccaggtggaccctggacaaacaaaacctcttctatttctctcacctctctagcacctttcaaatcctacatggccaatctctctcttcacccaccgaaaaccgtaaggttgcaactctgtctttccaattcctgaacagcatgcttggatgggagatgaaaagttttctgggaaagacctcttattattttcctttaaaacatattggagacattttacaactgaaaccaagcagttttttcctgggagttatgtctagaaaagaaatgcgtgatctctgtaatcaaagacctctaaagaagcactgctgactatttttagcataaacataaagatgaatgctggagatatgactggaaaagtagagaagggagtgagggaaggaggagcaagtggcttagagggacctcgtgcccttgagaaggtgaaaaggagccgattccttagggcaccatttcccaaacttcaatcactcattctccaccttcatggtttttgcaagattccccataccatctacacagttattcacttcactttttttctctaaatccattcgctttttaaatttaaaaacatgttttatgtaaaacaggcaatatcacttttggaaatgcagacctgcatcaattacaaaaagtatttaaaaggactagttttagaagttaaagccttcaataaaaaaagtaaaaatgattgtattctagctagataactattgcttgctcagggctgtgaaactgagacctgctctttctttgcagagaaatgtgataagccagcattaggaaggttttaaagacgttctagtaccaaactcagattttcccctctaggttattggaaggattgaaataaatttgaaaagagaacaactttcttactaagtaatttaatgttatttaatcttggatgctatggtggcattcactcaaccctttgggtaacttgtgctaggattaatgctaaggagaagtgaagggagtgattggggccaaaacagcctggaatcagctggtggtttagagccaattgccactcacttcctgtggagtctacagtagtcaaaaccaaaggatccattcacctttatgtacggaaatccctgcaagctcctgagagccatggatagaatctctaggcattggtgttgggtctgtgctcttggtgagataggatgtatccaagtgttcaatggtaagaggagagccaaggaggcttagggagcagagagaaggagttagatagaaccagatgaccccacatgtcttgataagagcaagcagcatagccatagcctccagctgctggagcctctgggaaataccacttaggaaaccgtatgcatggctaatttagcagcaacatctccagagaagaagacccagtgggcaatccatcatgcgctggatcatgctgctttatgtacagtgacatgcactgagcgcatccatcatcggggagagagatcacggcttaacaaggcctggggatgagtatttcacatcacttattcattcgtttctaagatctgactttccagaacacaacgcaagtttgaagtcatttgaatgttttctaaaaaaaaatgacaactctcatcttcccactgttactacgatggggctgttcagatctctgctttcatcaaattaattgcccgttcccttgcaatggcttagatacaaggatatagattctttctgggagaacagtctggctttgaatggtaatgagggatatatgcatacaattgctgttcttctggaaaggatggtgtgcatgaaggtttgctaacccaaccaggggtgtaacttaatttagaatgtttgctggagatgtttgaattaagtgctagaaaaatgcaaacattctcagacatgttggaaggtcatagtttagccaaatattgtcacttttaattcggtttagaatatcagaatgtcagaactaaaagggactcttggggccatttaattaaagaccctcatttttcagatggggaaaatgatttgcccaaggcgaggtcatgaaactcatagtagacttggaaatcaccccttgccctttttacttatataggccaaatataaaatcattttaaggtaacagaaaatacattatctggctccggaaaagaagagagactatccaaaatttaaatggaggttagttcaaattaattcttcttgtttatgatgaatagttttgtcctctctgtctagacatttaataatttttgtcccttctaatgattagaaaatttgttcaagttagaagatataaaaaaagaagcagcaaaaagagagcaattgatgaaacttctgcttaggctttccaatgctgcagggctcttccggggccctcttttttaaaggaagacttcacattgaggtgaaaggcatttatctgtgagcagtcctgacgcttctgttatttgattaaaaacaggtggttcctctttgtaagcagctgatgggttcaatgaaaagatgctcaaggccctgcctaagtgcaagcaccttctgccttccaggcatatggtctcttactcattgaaatttcaggattctgccagagagaatgagaagttttaaaagaagacataggcaacccaattaggctccagtttgctcaggccctaagctgccagttttcaacaaaaagagaagtgtaatagagaaagcaaaactgttcactttggtcaacaaaattagatgtcgtcaacggaaattactgcttttgaccacttttctactatgccatggaaagtgggcttccagctaagggggcattgatctttctagtaaaaacaggtataaacccttgcatttgttcagaggtttgcagttacaaaacacattcacatatattatttcatttggtcttcatggcaactctgaatagggataattgttccctattcagataaggaaagtgagcccagattaagttagctgatggcagacttggggattaaaacacagatctttgactccaagtttacactgtatatcatgtttcccttttgtcacttataaaaatttactgcagcaaacttactctgtgctagaaggaaatgacatacttagaaatgaacataaagttcttatcatggttcttgactgtgccaagtaagggcttggcatagcatagctactgttgaggaagaggcagtgtggtggaataattaagatcacaggtttgggatttgaaaaatctggatgtgagtcctgagtttggccctttctgctctaggaaaatgctctgtgtgagcgagaccgaatgccttaactttcctgaaggtggaatgagatgcaaatgtgcatgccaagcttaccatgatgcctgcacttagtgtttgataagcctagggatgattacatcaaaagggtatgctcatagactttgttctaaggaaacaaagcaatccctgccttggaaccagatgttaacatttcatagttaaataccttgtttttgcctctcttgactttttgcatttaaaagtttgctagagtgttcagcggaccctatggctttatggtctacagagcaggcctcgcttgtggccaggtacctgtatatgatgcacgccgtgttctggcaggtactgcaattgttgagatcttggccagttcgataaaagttgcgcctgcaagacagagcatttgctggataaatctatgggcaaaagtcacgtgggccacaaacattcaacctacttgtcccttagtccctatagcacagcattcacggtgctctgaagttgcacggccattacaaataaggaaacaagaatgtcacgacaataggagctcacatgtctagaaggctttatacgtgttaaagatttctcaagctgagagttttttcatgctgacaacaatcctgttgtgagatgagggattctgcaggtgagtggaagggaggttattaaaactcctgacctcttagttcagtacatttcattctgcatcatcacagtgtttctctcctatacggcagtgctgattctgattcatacagcaaacagcagttaatgacttctctctcctactgtttttgatgagctttagccattgcttcttctttgtctttagagagcactttctgcagggacgagcatttcgcatctaaacaaataactgccttttcctcctatactggtgctgagtcacccaggaaagcattttgtgactttttttctctttgccgaaaatgaattgtgcaaaatgaattgtgatctcatttcagttccaattagttggtcattgatgggccagcccgtcatcaaagtagtcagtacaggggaaggtcaatagtaagctgagtggccatctcaagtcctttgtcacaatgacatgaagaacagaaatactgtacaaatgcagtagcttgctaagaggagggggatggggaagtgccttcctgctatcattttcccccatcatgtatcaatagaaccctcatcttcataaaaatcatttttgatcttactgctccattgctgcctttccccattctgttaacacctgaaaacgaaaacaaacagcagtagaaatccacagaaatccaccaaagcctagaactaaatgaaattccattagagaaaagggaggtctgtggttatgatttggagaaacaacagtgcttcaaacattttggagacatttttactaaaagaaaccaaagctgtctctgcccctgtgttggcaaatgacttcacccagtcatttttaatatgaaaaaaaaatctccttacccttcagtgagagctcgagctttctccaagtcttgaattacattcaaaaggactttaattttctcttggttcgagtgcagagattcctccacagattgcagtcggccttggaggtcgcagagttcaccccgtgccaggtgaatttgattaatgtcactaatctccctgttgctctgaagtttggtctcactccttgaaagagaggatgggagatgattacttcctggacaatttggaaactccagtgtgtctgactcggtggggttgtttgccgtctgctcctgacacccaggggcagatttcgatgcactgttagttttgagtgacaccagattctggtgattgttacttgatgaaggacagtctgaggctcttcctgggtgggctggctggctgtgggagccttgtgagggggaactgtgagtccgtggagatgaaggaacacacgtttcctttgactgagatgacagtgagccaaggtctttgtcatctgagttgtctttgggcaaaagcaattcaggtttaagttcctctgtgcctggtgtgtggctggcaacgctggtggcatttaagcaggaggtggatttttctgaatctagtggagtcacccttctcccatcacctggacgtgtgtcatccaaagggtgtatggagttacttacttcagctgacctgtctgggctgagagcagactctctagcttcccaggaaggactgtgataaatatcatctggaacctgaatggcagctgtggctttctctaaggacctccaagttcctgcttccaagcatatgctaacaggaccattgctttgcaccttggggacccttgggaggaatgcatgggacaccttgacccttcgaggcccatcctcaagatgctgagccaaccttaagtaggcaaggtcagaagacacaatgtcctgttcagagaggttaccgttgacctggatggcactttgggaggctgttggcatttccaccagggacttactggctgtgagtctcttccttttgaaaactgggaaatgcttcctgagactgggggaagtttggattgcaatgttgcgaaagccccctgccttctgggacctggggaaggagagcgagtaggtggggggaagatggtgcctggttgcttgagtcttccccatcacagccgggtcttctggagtttggacgtcaacctcagctaggccagttggattcttagtggtcccatcttccttgaatctcacctgctgggatttgctcctgcggtggtgaggttgtttcacaaactccactgattctagactgttacgctttagaagcacaggtctcactttcatattttgctgggccattgagcctcagtgggaaggatcaggaccatacacttctcctaggcacatctccccttaggtctttggagcagtatctaatgatagtatttcaatcatagagaactgctggccaggatggagtggtcctctcctcttagtatgggaaatcctgttggccattcccagcctctagagtctacgtaggaactatctgtaatgctttccctgcagttaaaatattaattcattgtagtcataattgctccttggaaaaacaaatgagttaggctaactattaaacatctgatctaccaagagagctggtaggcggtttatcaagggaggctggcacgcggttctgatcttggaagaagctggctgtcttgaacaaaaagacaacaaaagtaccatttagggggtagtgccagactcccaatgagtgaattccaaaagaaacctgctacgtctagaacatacagctttttgtttcccagagcattaatttccagggtgaaactgcaggaaacttaaatgcatcttctttccatagcaggtaaacaggtggagaaataaatgacctggaggtttgcttgtttgatgatacatgatgctcccaagggaacattcccatttatgtcaatcacaaattcctcctttggggccattgttttctttcatgctgtctctcttttcttcagtgagggaaacttatcttcctaaatagcctcacaaaacccagtggggtatgaccaggacaggattgaggaatcacaggggattcagtgggcagagtccctgttgtggtgtgttggccgaagttcacatgtgggcacggtgagctacgtctgcagcctccatgatgatgtatgtttgcttggcctcaggggctgaggtctgagatgagctggggtctgatatctgcaagcaggcgaggagcacctgaaagggaagagacaacagtggccaatgagaaggcagtttctgtggacctggatttctcttcaaattctaacttcctagctgagtattttgagtggagggtctaggaataagtcaaccacgtggcctttctctcggttctctttgtgaaccaggtgctttgtgggtgcaaggccttggaacaaaatgcctgtctgcctggacccttttctctctccatttctgcacagcactcagccaactcctgttcatcagtcaagtcccagcaatttctcaggcagcctttacaatgtctccctcttactcacacacccagtgccaagaccacatcaggacccattgtacatcctcgtcacatttttcacaatacaaattgcaactgttattaaataagcatttgtgtatgtatttatttaatgtgcatctcctccactaccctgtagactccggagggcagaggctggaaccatctcattcactgcttgagcattcctagccctctttctggctcactataggtgcttaagcagaatttgttgaaaaagtggatggttggatgaagggcaggtccttgtgaattaaagagagcctgggcatgaagaggagtgaaggtcctagggtatcctgctagggcaacaggacctgtgaactcgttctgctatgactgcaacatttatttaaggacaaaattctcccctgatgtcttcatttcttattgcttttcaggagataaatgtgcatgaacttctctgaggaacaactacctcataataataatagccaccatttattgagcacatacttttaccatgctgaggactttacatgcattaattaaaacaactcatatttactgagtactaactaatgtgacagatgctgttctaagcgctttccaagccataactcattcattaatcacaaactactctataaggtagataatatttttgtccccatttacagttgaataaaccgaggcccagaagggttaagtaacttgcctaaacatatcctactgcttttccaatattgcattatctcatttaatccttacaaaaaatccatgaggtgccattatcccccttagacttacggggaaattgaagcttagagagggtaagtactcagtagaggagctagaatttgaacccaggtgtctgtcattccaaagtctgcattcttaactatgaagttatgactctgcccttttgggatctgcatgatatgttgacagttgctaagaacaagggtaaaagacccttgcagatctggagtgatctgcatctctctttataaagaaaaaaacccctctttttctttataaattacacagtctctggtatgtctttattagtggcgtgagaacaaaatgagccatcctgggacagaatgagcagagtttcatgagcaggtggttcctcatttgccttgcctgtttgaagagcagggttggcttctgagagtggcattgtcacatacctctctgaggagatgaacctactggtcccgagttgctttacataaaaattccaaacaatgcaacttttagaattggttctatgtttcaatgactttgtgtaggacttttaggtctgggagaatcccagagacaatttcctcagtccatgactaaatcctttctgcatcttcctcctcagataataattaagcctgcctggatacctatgataatggggagctcagtacccaattccctagtccataatagttattttcattaatagtaacaaatatgtattaacaactcactgttaaatgctatgttagcacctggcatttaatcctcaaaataacctcctgtatattatccccgttttgcagagtaagcagttgaaatttgtgagatggtcgcatgcttaaaaacatgcagttcatactcttcatctttgtactgcagagcctaggtatttatatgtctacttttgagggtttccttgactaattgttttttgctttcttcttaactgctcattagcacttcattctgggaacgataactcacacaggctatgattgtctgaggctggttttcataagagctaatgtctagtgcattgattatgtgccaggcattgtgattggtatgtttcatttactctcttccttaatcctatgacactcgtagaggcaggtgcgatcagttccccactttataaatgagggaactgaggcacagaagatgaatatatttataccaagttattcacactgataagtgatggagctgtcatttggacccacagactgaccctgaagcacaggcttctcaccattgggccttcctgccttcttcaggactggaaagattaatatttttgtgcaaggctagcaagcaggtttcaaactccctccacattttcattctgaaagtcagtcattattctggtgttagccctgccttttctccaggaagtttatgtatcctttagatgttttcttttgatctttaaaagcagttggttttctgcttataaagatattatttgttcattgtaaaaattcaaataatacaaataaacaacaaaaggaagaaaaaaatcacctgaaatcttaccacccagaaagagccacagtgcaccaacaatttggtgacattcattctagccttctccctgtgcaatgcttgcacagaaattgcatacacagacaagcttatggacagaaagccttttgttcactgaacaacctggagaaagttacacattatggtgtacagatcacactgtccttttaagtaggctaacatgaatttgtctagttatacaattatctatttaaatagtatttttgtggatatttaggttgtttctaaatatttggtattatttaaaagtctataaataaacatttttatgtaaatcttggagctcttgtctaattatcttcttgaaataaatgcctagaagaagaattagtgagtcaaagtagctgtgcattttagatttcgttgatactaccatgttaccactcatccttctatgaagttctactaacgtgcaactctgccattactgcatgagaaggtctttcaccagaacctctttgttactgtgcctggtcaatttatgatgattgtttttaatcattgccaataaagtagaaaagaaattgtatctcattattctcgatatggaatttatatgagtggacattttttcacatgtttattggttttacacaacgtttgatacaaataaaggctgaaaagttgaaaatgaaaatttgaatagtcaaacgaatgtggaaactctcgtatttttagacagagcctaggaagtttaggaaatacaaaattttctcttgacaaaaatattttgtgtcggaactctcctgcccttgatgtccaccatgacccttgcacagacacatcgtggggaatacacctggctaaaagcaccctctggaggcccttaagtcttatgggctcccaattgtccattaattcacatttccctaggcattggtggttagggctaaattaatatcctggcccaggatccagaatcgttccccacaggtggtcacagctgccctacggctggaattattactgatctttgcaacactttattctgtcctcccttgattattgactttagtgaacatgaaccaactgtttatgttccatctatgcctttggcccacagcaaatggtcctcatggaatcagtgtccattcagtagatacagaaacattggacaatatctctgtaggttgcaaactgtaggctttctctggaattcctgcccagtcctcttttctcagtatctttaggccatacagtgaggggttaagtgcataggcttttgcttaagatctacgtagatgagactcttccactttctgactattgacttggaacaagtgacttgatctttgtaaaaccgcctaaactggttgtgagaattaaatgaaataatctatatgaaatggtcaggatagtcagtgttcactcttcagatagaacccagctggtagccatgagacacttgtgaatttgtctttgtccctcctctttcccttgggatagtaaactgtaggtgcattcatgggaaggaatgtacaaagatggcattcctttgtgcaagaagtcctatctccctgccgtctctgtactttgtgtctttagcattgtgcttgtctctctatattgtgatgatctgctgacttctagcctcttcaactagactctaagctccttgagagacatgtggtaatggtctactctgagtccttacccctccgcttgacacagagagggtcttatataaactcttgtaaaacaaatgaatataatcctgtattatctaatttgccttagcttctaagacatggaatagttggatagttgcatggaataaatatttgcataactaattaagagtgaaggaattaattcacttccaacattttttttcctttcaaagatttattatcagtaggtctcatgtctgttttctagtctactatgctttctctatttacggcagctttaatttggttaaactttatttagattctgttgtgaggtgggcactgtaataaatactgtggagattccaaggaggaaaaagacctgatccctattgtagcactaagaaaggaccttgtaatgccaacctcatatggaatctgttcctaagaattgctacaaaacgttgtacagggtaggggaagacttagaggaaggtatctgattcatttcatgcatccaaattctgccttacataacagggtgctttacgtgttaactggggttcagactatcctttacgccaggagtcagcaagttttttctttaaagggccagatagtaaatatttccatctttgctggccacacagtttctgttgcaaccattcagatctgccattgtggcaagaaataagtcatagacaatatgtaaacaaatggctctggttgtgttccaataaaactttatttataaaatatgcaactgaatggatttggcctgggagccatagtttgacaacctccgctttaggcactgggaagtcattggtggtttttgagcaggaggctcttgattaggttgtttttcagaggaggctttgtttgctgacacattgccgtgtcccttctctgaacttagtaataataacctttactgtttacaccacactttacaacttataaagcattttcaaatcccatgtaatccccactagggaggctgggaagcattatccctgttttaaagaagacgaattcaatccagaaggactcgatgacttgtcctaagtcacagaggtagactggaaccctgtcttcctgctgccagcctcggggctctggtggagaccccgactcttcctccatttagctggccagacatctaattactttatgtgttagtcctgtttcctcagttacaggatgcatttctaaagtgtagggatatgtcttccactctttttctatcctccaaagtcctaagcacagtgctgagtctttaaggagccatttactgttgatcattcacctctgggccttgtggttcaaagtttgttttccttccatttgtcttcagttaattgcttggtcaaatctgttggtaagggttattccatactcatctgaaatcaaagggttaatgcttgtggtccaagtatccacttatctttccaatttgaaatttggaaagctaattttccaaattatatattccaaaaatatacccctttccggcagctttctcagtaaggaaaagggtatattttgggggtctgcctaaatctacattctgttgtaagtggtcaaagaaacaaagggaattgactttctttatagcacatgggttgacttgaggaaaaaattgggcaccaaaaggtgaggttaagatccagacttatatatttgggaccctgaaagatgttggatatgtgctgattgtgaaatcttgttctcatctttctatataccatgtttgacttttttgcacaaattctggtattcacacccaggtctccatcatctctcacctgtatcactgtgagtgtccccctctcttgtcctctttaccatctgtcctccacacagcagccacagtaatcttgataatatttaatcagatcacatcaggcccctctttgaaaccctgcaaaggtgtcccactacatttaaattaaaatccaaactagttccataactttcagggccacaaccttgaacacaagccacaaccctatgtcatctggcccctgtctaccttccttgtcccatctcatctcatgccactttcccccttttctgtgacatggtccctggccctgaacatgctagattcattctcatcatctggctttcaaatctgctattccttttgttaggactcctctttccccagatccttccaagcctgttatctccaggagacactccctgaccccctctccccttccgtgtccctctgtgcagcaaaaccctgtcctattagcttatttgtgtattatctgtctctgctcccatttattgaagaactttagtatttgttgaatgaatgaatagagtaaattcttatagttagaggcttcaaggaatcatacaaccttagaaatagaacagagaagtttaaaactttagatcttgggtagaatcttatttaacgattttcaaaattcccttagcagtaaaatcagctttccaaatccaagcttaagcacaattccaatatctaaaacagaataaagtggagttgttctagaaaatgtaggggactcagtcctgggactcaaagcaaacctaaaaaccacgaagacaacccccctcattatagagatggggaaactaagactctgagcagctgtcttctacctgcaagtgcttcaaaaagaacaaagtcagccgggcacggtggttcacacccataatcccagcactttgggaggtcaaggcaggtggatcacaaggtcaggagttcaagaccagcttggaccagcttgggcaacatagtgaaaccacatctctactaaaaatacaaaaaaattctctgagtgtggtggcaggcacctgtaatcccagctacttggcaggctgaggcaaagagaatcgcttgaacctgggaggcggaggttgcagtgagccgagattgtgccattgcactccagcctgggcaacagtgcgagattccgtcccaaaaaaaaaaaaaaaaagaaaaagaaaaaagaaaagaaaaacaacaacaaccactacaacaaactttagaccttggggagaatcttatttaatgattttcaaaattcctttagcggtaaaatcagccttccaaatccaagcttaagcacaattccaatatctaaaacacaataaagtggagttgttctagaaaatgtaggggactcagtcctgggactcaaagcaaacctaaaaaccatgaagacaacccccctcattatagagatggggaaactgagactctgagcagctgtcttctacctgcaaatgcttcaagaagaacaaacttgctggtgtgtatcccctacacccgcacagcttctagcatggagcaggagctaggtgaacatttgtggaactgcacaagtgacacattgagttgaaggcagaagtggaactaatgtcaatccaggttctcctcttctccagtacaccagtgagaaaggttgagggccatggcccacctggttccagctcaggtgcctcatttggaaacagacctagtggagaagacaggctttctgatcccagaggcctctccgatggatgggcaagccactaatgctatttttttctaccactccaaccctctaattgcatttgtcacagacacccagggagatatgactaccatctacctctacctcctcttcatttttatcctttcttctaccttatctttcttttttcaaaaacataataaaatgtttcaggtgtgcaagacagcacagaggacagtagagtgaacataacaaacatgaccagcctaagacatgaaaggttacaaatctagctggattatcctctggatttcctctctcctttctcttttattgtgtttccctctgtcttcactccttcttttccccttcttctcttctgttttctccagcatggctccccatttcatttctcccctctcctccctgctctttgtctcaccacctttcttgccctcctcttttccacaccctgcccttcctcttccttcatttcttttgttcctctctagccccttctcttgccttctccttctctcttgcatcttcataaatgttttagggtcagtgattcattcctttggctattctatgtcaagggtggggaatcagcatctcttgaatttcctcttttgcaagcctcagggcacctgccctgtagggacaattctgtggtacattcacccctctagccagaggcattggctgctgctgctgctgctgctgaatctgaaaggtcacctccagcttgctttctccaggggaaagcctttactaccaccagatgcaactgctggccaattcatccagcttctcatagaagaaagggcattggcttaatattatctctgtatttctcagcattttgatttctctccagagatttttctgatatttttcaatccatttgtttttcactacataactggggacattttcttacccttttttttttttttaggtcataccactttttgactttaaataatttgatttatttttcctggggtcaaacactgggggagctgcctgctcaaacagatagaagaatctagaatctttttgatttgttgtcagaggaatagctctgtgtgtcagatggaagggagagagcagaagtgggtggtcatgtttcacccctcttctccataagctccatccagaaaaaaacaacaggaagccagacagacaatgatttgcattgctgtgaacagatttactcatagggtacagagttggcacaggccacttctaagttatttttcaatgttgacgtgtcaacattttccacatgggagagggatccagttggaatggaagaaggcaggaaaatcgttttccatctcagcatcactttctgtggttttgtggtacttggaaactctgtttacacttgacaatctcttcctgtagattgtctaaagaaattatgaataaaattggaaaagtctttccattctgaagggacctatgctccagtatagaccagtcacacacatttggctgattaaaatactagtcgttgtactaaaaacgacagactccagtgaccccttgcttgtcaatagcactgccaaagttttcaaagcatttttagatttactagcccttttccacctcacaacaagttttgccaagactaggcattatcactcccattttgcagatgagggaactggtagagaggtgcgagatttgcccaagatgaaggtggtctggcaggaccaaaaggacagcagaaatttcattagatcagagagcttctaatggaggccagaagaagctgggtgcctcttagaggtgccttgggtgggggctggcaggattggcccacagcatgacttggaagtacccccttctcctgacatagatacacattgcacacccaccaaggacaactgttgggccctggactctgcagtgcgccatccaccctggtacagcaaagcattggcaggcagctgcaatgaaggttttcccacttctggatccctgcctacactgaagaattttcacaaggggaagagaaggggggaagtttatggtctgatctaatcacagatgaacagagaactcggtggcacaagcagtttgcaaaagcgcatgactgcagtgccattaaagagcccactcttcatttctgagatgagtaaacagcgtgcccagcagcatgtgcaacacacagtaggtgctcagtaaatggtgacttccactgttcttatctttaccatggttaccattatgcactgggccccaggttacacagagacgggacaaaatcccaggttttgagagtccatgcgggggttgtggcaaatctcaagtaacattaaaaggcagaagtaataaaaacgaaactcaaggagaaaatgctgccaaatgtcccgtctgctggttttggtgttgtggccccccgtgaggtctgccatttcttaaggggccaagaacatctctgtggctttttgtcattcatttcctcctctcgtgcaggaatctcagaccattgctggaatcgatgttgcattctgggacttaggctctctgcctgtacaagctgtgaagccccatccacctcccatgcaaatcacaggctgtgtagcacacctttaattgcctctcacctgatgggctcacggtgtttgcctaatgacaaaggatatcctttttctcatggatgctggtcaaatccagaagtataaaagctcaagtttaaatgtcccccttccttctttctcctttcctcccttcctttctctccctcctccttccctctcttgtttcttgcaaagggaagagcatatggtagagagaaccacccagcctcaaccccacttctcactctccaggataggagactaggaaaggcactgagctgggtggagaactttcctggagatccggggacagggggtggtctcactcctaaccacctatactcacctgagtcttctcccctgcccctagagaaaagcagccagcagccagcattcacgcatcctcttcttttgggggtaggatcacactccctaaagctccttcggtgccccatgctttcaccctgactccagccactgggggttccaccttccctccacgttacctattgtaaccacagcccccgagagcagggtgacattccatctcctggaatgaaatacttatcatgacttggcaaagcctttctcttacaaagagttattcatgcacttacacctaaacttgctgaatgacctaggacaagtcatctcatatctgggttctcagtttcctcatttgaaaatgaaaggagcatttggctcacataacgcagtgcctggcacataatagatatagtaagaatcagccagcagacctcttggcttccaaccttccttccttcttccctattttctggcctggagatgtccccgattaccactacccttgtcttgcctgaacagggacctttatgtgaatgctatgatctcaagcctggccttggccaccctccatgatcctttctgggccaacgaccaggacagcctttctgtttcccagtcccatgtctgagcctgattggctgcactggggcacagggattggaaggagctcccagagcgtgcaggcagatggtgaaagagccagaaaccgttgctcctggggtcggggggcggggaggcagtcagcagtgagcaacttcttaaagctcacatcaacattccccattctggatgagatccagaatcttatgggttcagagtttatctgaagtaccgggaccccttaaatcccatgtggagtggctgggggtggtctgataatttaggtagtgtggcatggtggacaagagcttgcattctgaaaacagacggcttagatttcaatgctggctctgccattttctgcatctttgttggagggtaaattacttaacctctctgggctatgattttctcatctgtaatatgtggctaataatattacttaagaagatgtagctaataatattacttaagaagctggctgtaagatttaaacgaggtgacacactcataaatctttcagaaaagcgcctgtcaggctggaaccacttaataaactttggctcctattatgattactagcattattactataggcagtatcatcattattattatcaaagtgtgagaaccagcaaagatttctatcactcactagtcgccactcaaactctcatctgtgtgaagcaggaatatttatgatatagtccctacccgctgctcacagtgggtgtgggagtcgattgataatgtagaagaggataaatgtttataataaaatgcagatgccatagaactaaaagcaattagtagatgacagaagatgagaggtaaaaaataaagttaataaagaggagaaaaactgagcatcaactttgacgtgagcttcctagtaaaccaaggcagaaagggaatatagtaagacatatttttgtcattacttagtgcttagtgctagacatttcatcatgagtaacaaccttcttttgtagccttgaactctaagagaaaattatcataagaatatttattatgaatttatttacacatctaaaattttaggctttctctatgagaaagagaatccttatgagatttggaaagtatcacaataaaaatggttgaagaaatgtgagctctttttttttgagacagagtcttgctctgccaccaggctggagtgcattggcatgatctcggctcactgcaccttccacctcctgggttcaagcaattctcgtgcctcagcctcccaagtagctgggattacaggcacacaccaccacacccagctaaccatttttgtatttttttaagtagagacaggatttcaccatgttggaagggatggtctcgatctcctaaccacatgatcctcctgcctcttcctcccaaagtgctaggattacaagtgtgagccaccgtactcggccaggaatgtgagctctttaaccaagagaagagcaaacggaaagacatgatggtccctttaaagacttcactactgtatcaagtgggaagtagggttgccctgtaatatttccagagacagaaccacagccccatggttgagagcctggggatgcaaactgagtttcagctaaagacagaagttccctcaaactcaagtaatgcaactctgccttgtgacggggtgagctccctgtccatgcaagcatttgtctagaaggccatcgtcagggccacatggggaagctctcactgcattcttagagagcaaagagatgattccttcatcccaggatactttaattttctccaggtctatgtaatagaggagtggactctcaaaagaagagctgagctttcctcccttgaacgcagatgaacaactctaataaaaaccatttcctacaaagctgctcccctagaaataaaggagcaggctagctagagcaatcaaatcactttttaaaatgattctttaagatgaagagtattaggaaataattcggctgagcaattgtgagtggatttggggagagagtcccctgtcagaagtgactctgtcacctgccaccaaccttcttgtgtgttgttcttcctttgtgtgtcccagctttcatcagtacgttctgagcttctggggctgactgaggctgcatgaacaagtatgtgtccctggggctcccacagctctaccccagctctcctctgcccatcaactggctgccatggtctcctttctcatgggggctccgcttgggaagggccatatattgctcagcaccatgtgattggtgcctgcacagtgttgggcccacagcagccaggtgtactgtatggttaggagcataggttctagagccaggctgcctgggtttaaaatccagctgtctcatttactagctctgtgaccttggtcaggatgtttcaactctttgagcctcagttttcttatctgtaacatgggattgataggagtatcctctacatgcacacacacacacaaaacaacaacaacaacaacaacaacaacaacaacacacaccggattgcagtatgagttcaatgaaagaatgacagttaagctcttaacatagtgtctatcttatctactatatcaggggtcaaaaaactctttcaatcaagggttagacagtaaatatttgcagctgtgtaggccatgtggtcttttttcaagtactcaactctaccgttgtagcctgaaagcacacatgggcaatatgtaaatgaacaagcatagtgatattccaattaaactgaatttacccaaacaggtagcaggcaagatttggcccgtggacggtagtttgctgccgttgtgtaaagcagcaagtcagagaaccagatggaaatgagcaaccacagagactaaagtgaagaagcaaaaggtggtagaatggtggattcaacagcagcatccagaagttaagaactcagtctgtgaagtagaacaggtctggtttcaaacctggctggtgaatggtgtttgctctctgagacttggcttcctaatacataaagtgcaagatggcaagtaaaagggacctttctcaaatggctgatttgtggattagaagagatattagacatggtgccaggcatctagtaagagctcaaaaaatgttagcaaagaggagaatgatgacaaggtggctgctgaagtgaactaaactgaattgaaccacagcctccttttgccttcagcacgcccagacagtatggctcattaggaagagcaagagtcttagatcctcagagtgcctgacttcctgccttgagacttctctcactctctgtaaagtgcagccaattcatattctttctccatgccaagaatcaggttcaatgagaccctggagggagagcctgcctaccacctacctataaataggatggcaagtcagcaccagcatcaatgattgcaggtcaaaaatgagccttggtttctcagtcttgcttgcctcaaatggacttgaggatagaagggccaaaagatcaataatggagaatataaatgtttgtgcagagctgcttgggcactcaggtttggagcaggactaggaaggccctgggctttgaattgcttttgttcgatgttagtgtcctggaaatagacctctctacataccacgttttgttgggagatggtattgccatccaaagtgagactttcaatgttcctttccattccttgttggcatacaaagactgcataacacatgaatttccccaatgtgttcacagtgttgtgccttttgttgactccataagtttttattcttactttctttactctcagattttccagaaaaaaattaagcagactcttacagccctaattaatgctatcaggcatctgccctaatcatgtattacttgatactgattttcagttatgtcatttccttccactaagatcatgagagtctcacaaactgtccattgtattcacttcagggtctccagcactcgaaaccacaagctgtcttttctcttctttcctccttccctctctccatttagcctttcttcctttccttctactaagcacccactatgtgccaaacattgtgctgggcatcaggaacacctccaagctctcagatctaaaggaggagatgggcaggtaataggcagcacggtaagacgcaagctttaagcaaggtcaggtattgtagaaatccaccatcccaggccctaacctgttgggacctttagacaaccctaacctgttgtcccctgatggaggggacatctgagccaggctttctatgatgactaggagttcaagtcattgaaagaaggaagaagcaggttcaaaggtgtgccttgagtctagacgtgaaatggaagtttttccttccacataaacttaattatcgtggctgggcgagatagtggcaaatgtcaggagaagactggctggcaggaggcatggcatgaaggaccttattggccaaacagatcttctggagtgatttcaacatcttaaagcttaggcaagctgtacatttacaaagcaaacctaaatgtcgagtctctctcctttgggctgtaatattaagagtattgactccttcatgcactacttctaattagaagcttcgattagcagtattacatgctttggatgaacaaaatgataaaataagctaattatgacttaatgtgtagagttgttgcccactatctttcaatacaccaagtcagtggggagagggagagccgcaaagaagctcttggtggtggaaaaactgaaaaatatttcctcctattaccaagatacagatatagcctgcctggaattgactgtaagtaaagtgataaaacccagcaaatcatcgattaggagttcaccatatatctagaactgtcttcaccttgagatacaactggtgtaccaaacagccaaggtcctgtctattttggaacttagttacgggtaggaaaggctgatattaagtgaacaaacatccaagtaaacatggatttataaaacgtgctagatgttgtgaccaaaaaatagaggccggtgggagaatcatgagtcctaattgacattgtgggtaagggaagtgccttatgaagaagtgatgtttgcattgaggagggatggtgggtgtgattgaggtgatgggatgggcatgaaaagagggtgtccaggcaaacgaacattgtgcacactggctctgatgcaagaaaggtatttggcctttgtaacagctaaaggaaaggccagcttggatggaatccagagagcaggccacagttggtcttgaagagttaggcaggagtgatgatattggtcctgaaggccacattaagtcttttggttgatttttgaaaacagaatgacttcaagaggtttacgaagggtgtgtgtgtgtgtgggcatgcatgcgtgcatgtgtgtgtaggagagaggtatattaacacgtttgcattttaaaatgatttttctggtttttctgagaaaatggactggatggggcaaaagtggaagcaggatgaaccagtggggaggctgtaacagtcgtccaggtaacacatgatgatggcaaggtggtaacagtaagatgatgagaactggataaactcaaaaacactgagtattacattagttagagttgaagtgtgaggcggaaagatgtagagaaaggaaattaatttgatttgagtggatttgacttagaaggcaacattttgagacacctagaatgatggcttctaataggctttcccagagccaaatggaggggttttctggaccctcagccatgtgctatggtgttaccaccatgtttgcttgcatctgttggagaagaagctaccccttcctctgcatggtggccgccttgcaagaacacatggctctggggaccacagtgccctctcctaccctcaagtttggagcatgagtggtgtacaccataccatatcaggcattggccttcagaagtaagagaccacccagatgcccaatcagtcaaacggtttgtttctccctctctgtgtgccaaggaaaccacagaaaccaaaaacacaaatgaggctgcatcttgatctgtagggttaatgccatctatcagaaataccacaaaaacactgaaaaggtcaaggaaagtccaggaggggaataaccagttagtctagtcgtgtttaactcccctacaaaagagctgatgaactgctgagaaaagctgtcacaggagcaaagaggcacaatgataaccagcatcacttggtggtgactgtggacgaggccatctttttaaggctgtgctattttatatgatcctcatgttcccagtgagccacattttagaaagctgaggcacaaagaagtttagtgattttgccaagccaccacagtagtgaatagtccagcagggccttgtgctccaggggtcatgctcttatccactacgtgattctgtagcaagaggccacaggctattaaggtcaagtagagtggtttctggaagggacagccttgacctgggttgagaaaagtgggaaatactgagggtcagctgttttgtagactgcaccccgctgaggctccctggggccatttgggaagctgggttcctggcatgatgctgagtgttccacagagagggaagcctcattcctgactgtattttttcctcaaatccttctgagcacccttaatctgcagaaaatgggttgggtactagggacacggcagtgagctcagacattctcccagagcccacagagtagtgagggagacataaaagaaaggggtgaggccaggcgtggtggctcacgcctgtaatcccaacagtttgggaggccgaggcaggcggatcacaaggtcaagagatcgagaccatcttggccaacatggtgaaaccctgtctctactaaaaatacaaaaattagctgggtgtggtggcacatgcctgtagtcccagctactcgggaggctgaggcaggagaatcgcttgaacaaaggaggtggaggttgcagtgagctgagatcacgccactgtactccagcctggcgacagagcaagactccatctcaaaaaaaaaagaaagaaaggggtgaatttcaatgtaaggtggtcatggtgcatatctgtagtctcagctactggggaagctgaggtgggaggatcttttcagcccaggaatttgaggctacagtgagctatgatcgcacctattaatagccagtgcactccagcctgagcaacacagtgagatccccatctctaaaaaacaacaacaacaacaataaaaaaaaaaaaaaaaaaggaaaaggaaaaagttaagagcagggtggtaaatacccaccaagaggaagtcggggtgccgcaggagtcccttggagcagcatgcatccctgatatgtttctgtggtggtgtgagtgtgaaggctggtggctaagggagcctcctcaagggcagggttgtctattgtgagcttggaagagagtaggagccagcgggggccggggggcagggggcgttcgggtgggcacaagtggggagatgggagaagggaagtcacttcaggacacagtaggtacaaaggcctccaagtatggagataagaggaagcagggctcttttgtggaactgatagaagttcagacttcctagagggtcgaacttactcggggcagggggagaaaagaagtaagtttggagaaaggtgggtgagagctcggtcactgtagcaggaagtttggacttaaccctaagagcagtggaagcctccagtgggttttaggggaggagaaactgggcggagtggctcatgcctgtaatcccagcactttgggaggccgaggcaggtgaatcacctgaggtcaggagttcgagaccagcctggccaacatggcgaagctctgcctctacaaaaaatacaaaaattagctgggcgtggtcctgtaatcccagttactcgggagggctgaggcatgagaattgcttgagcctgggaggcagaggttgcagtgagccgagatcgttccattgactccagcctgggcaacagagcaagacttcgtctcaaaaaaaaaaaaaaaaaaaaagtttaggggaggagaaggtaagacattttctggggctgcctagatcctttgtactttcttgggtaaaagcagcatactgacctagcctttggcaagaagcctgatgatttggttcccaagagacagtactgcttggcttcaagcaagtacttgaaagcaaggagggctttcccctcagtcttaatgctagttgtcccttcctttttcttgcaacgctgggcttgctgagtagctgagatgtgttgtattttttaaagagcaacttgttctctctaaatcacctacctgtctatggaatttctaccagtgtgttcaaacacctctccaaagtctcacttctgggcagcttccctttaatgggggtggtggggaagggtgcagacaggcaggggagggcctgagggagtgaggtgggaaggggttggcagagagctcaggcctttagagtgctggcgacctcagcagcaccatcatctcattctctctcattcacatggaggccttccaaccagcctctccccctagtgagggccccgcagtcctttaagaaggcttcccatcatttaaacagacaataagtctgacagataccgagggtggcctcagctcagcgagcattaactgtattagctacattggaatttccatcagtgacactgtatggagctaatttgtgggtttgctaatccccaagtcactcctagtagcaacacatttctgtgtgggagggcctgcccagaagactatggcaccttcactgctccacggctggagcagctcagtgtgagggaagaaaccggctctggaacccgagagacccgggtttgaatcccagctctgccactccctagctgtgtgaccttgactaagcaactgaacctccctgagcctcagtcactcatatgaaaatgaagatagtagtcatgacactctcatggggctgaggtcaggattcagggaggccgtgcagagtgctcagtaaatatgaggtgctggcatgtattttctacagtgggtttaggaagggttgcaaactcacatggcttcagggtgacacaagtgggtgaagccagctgggagcaagctaggcagagagaaatgtgccacaaaggggacccctgctgtcagctgcagccccagttggtgaatgaaacccaggagcagtactgttagagccagtgttttttttttttttcaggagaagccagaactctgtgttaaatatcccaacttttaaatgttggagactgaattaagcttttaaaatcatctgggggcaaaccaaacacatctgaaagccagctgccccttggcaacctcttgctttttctttctgcaagaagtggtttaaaattgggtcctcagtataaatagctcgaggctgccaggcagagtatgttgggagaggacagtttgtggcaaaataatttaatgcccccacctctctgagggtaatgtcactcgctcttcaagtcctgtatacgggcttgaatgatgtccagaatggaactgaaatagagagggatgggtgtggggtaggcagggactggacaaaccatccaggctgtgtgctgtcatacagcacctctgggaggggccactaaatggcagcgtctgcacccaggaactgcaaaccacccaggtgtgcagggctcaccacagctgcgattggtcctctgtcctttttggacttgaacaaagtgagaacactttggggcagatgtagcagccaggaagatttactttctgacaagaggatgtctaaacattcattcacagtcaagctgatttcctaaaaacagctgtcttgaacctgactgtatctaaaatgtctgttgccttcgttcagaaagcctctattctactttacccatcaacattttctcttacacaaggtttaatatctcagcaggtgttgactggttggaagtagatggggtactaattataaatgaatgcaaagacatttttcttacactaagagttaccaaacggtcctgagttcgaccttctttacattcattcgtgcagtaaatcctcaatgagcgattactacatgccaggcattgtgcccggggccgtggatagtcagaaagttctttctgacgtcaaacgcaagctttactgtcagctaagagagcctcagtttcctcatatgtaaaatgagtatgatcatagtactgactactgattatttcaaaggctcccaagccagtgtgtgcacatggccagcattcaataagcattagccagcaaacgggcgttcatctcaattaaaaccaccatcatttgggcttggtactgttatccccacttctaacataggagcaaactgagatttttagatttttaaaatttattttattttgttacgttatgttatgttatttcattttatttgtagagacagggtctccctatgtttcccaggctggtcttaagttcctgggttcaagctatcctcctgccttagcctcccaaagtgctggggttacgggtatgagccacccatgcctggccaaaactgagttttgctgtgacaaattaccttgatgaaagtcacatacctgagctggagctgggattgaccagtcatctaagcccattatctttctgccaaatcacagggaagaccattcctgacctccttgctttactgtcagaaagaattgaagggtggttctggtttaagctctggaaagtctatagggaaattagggcctgaagtagaaagactgctagccgcctctgtcctgctggaaatgtgcatgaggctggtgctgatggtgctgagaaagcaaatgctgtctagagggaaatactatcattcaataaatatttattgagttctgctatgagtcaggcactgtcctagggactgggactacagcagtgaacagagcagggtccctgctctcactgagcttatggtctgtcacaatcctgtaggtgaaaagatgccaaacataaatatgaggttttaggaacgccagttgaaatcaatcgaaagatatggccggggatgcatctgggacccatatctgatggctgctgaggcattttggtcaccagtgaaatattttctgcttattggcaggcaacttgattttgcatttggtttgcgtcattcttagggatactgaagatacagcgatgtgcccaagtcagatgaacacgcccaattttaggagaagattctgctttcatctggaggcagtaaccatgtatttctagaagggagctcttggaaagatcctctggccagttctagtctagttcctgtttactctctgctgggtttaagtggctgataattgggctcctgcagagaagcagctaaaatctgtggcttgtttgcttggaacattttagaaagtcaaagtagttaatgataatggtaaccaccacttagcgaagactagttgccagtcatagtggcagaggctttacaggcattatctaattgaatcctcacaaacaacccagtatgttggaaagttcaattacctctgttctacacacaagaaaattaaggctcagagaggtcaaattcttgctcaagatcacacagctggaaaatggcagagggggaaatgaaccaggcctgactttctctagagcagtggttttcaactaggggtgactttgcccccactctgcaaccttacagggacatttggaaaagtctggagacatttttgtttgccacaactgggagggggtgctactggcatctagtgggtagagggcagggatgctctaaacatcctacaacacacaggaaccgttggccagtccgtgtcggtaaacatctcttgtgcaggcacttcttgccaaaacattttgcattttgtacaatattcccagtctccactgaagtgttgtctttatctcctctcttgctctgccttcatctagaagctgtgatggaacaatttagatcaagccatccccaggaaaagctttcattgaacaacagagcaagggaaagcccaatgtattctgcagccccatttcagttaaggttcaagttcactaatgccagaaaggaattcattaatgccttacaggctgcaggacaaatgttaatagcttcacctttaatttaagctcagttttatttttatagctggtcccttggtggcaactagatttattgggacattttgaacagctgaggcaaatcaataaagtatataagcacatgcgattcttgtgttatttgcaaatataattctgattactcacatgcatataggcatactcatacatgctctaagaatatgctttcccctgctccatgttttaaaactaatccccaaatcatgacatttggtcttctgaatatggcccccaagttatgagatgggcaaggattggaatgaatagagaaatgaacacaaataggttcccacctgctagaggaaaataaatccttaaagcatatgggtcctggacgtttttgtctatctataaatgccaagcaacatattgcaatatggaatcatgaccaatgttgcaaaactaaggatacagtgaactatgtttgtagttgttcttcattttacaggtttcaatgcatttttctcttttcttttttctttttttttttttttttttgagaccgagtctcactctgtcgcccaggatagagtgcagtggtgtgatgtcagctcactgcaacctctgcctcccaggttcaagcaattctcctgcctcagcctcctgagtaactgggactacaggcccccactacattattgcatttcaccttcaaaacaaccctgaggcattagccccattttgcagatgagaaaacaggttcagaaaaattaggaattatgtccaaggtcacagaacttgcctctggcagagagagccactgtctggtgctatttctgtcataattgtcagcccctagagtgaatgtgagcgaggctgagccaggctgcctgctttcagtagctgctgctgatgtgaggagagtctgtggatgatttcatcacctttgctgtgcctccatttctaaagccttcattctttatctatcagggctcagctatgatgtgctgtccagtatgggaaccttgtaccacatgaagctatctaaatttaaattaattaaaattttagttcctgggtcacattagctgcatttcaagtgctaatagcccagtgttgctggtggctaccatgttcaacagtatagaacatttctttctattcagtagcactggatcagagtgattaaggaaatgaaatcagtgggacatagaatatttcagaaagatgctatccaatttgcaatgaatttaaaaaaatctaagttttttctttttgaagaagaaagtctaaatatttggttttggattcacactccatcaggtaccagagtgggaatatttccctgtgcttatctttatgtcagtcctgcaaggtgagtattattatctgcaaaatgtttcttttggattaagaaacaggtttagttacttgaccaacatacatatcttctaagttgcagagcaagaattcaaactcaaatctgccctctaaacctataatacatctactttactctgcactgtgagtcctcaacaaacagaattttggttctatcccaaagccagtgtcactgtgaataaaatacaatccaagatgatcacttacaaggattattatcatccagatttggaacttctagaatggtctgagtagataaacagtgggaaaatcacctgagacatactttatggtgaatatcactgagttgtttacttggggctaatcctctcttttcttctcagtcccacaattgacccttgtgcagcttgagccacaaaatgccactcaaattctgcaccagcattttttttaatgactctgcaagtcatcagggtgcctttctctcagccattggaacaaatttgccatgaggacacttaatgtttactctgaatggcaccaaagccaggcttatttccatgtctgtggcctggtgttagctgagccatatgttcctggcccagatggctctctcagttctagatgattagtaccgcagatccagatcccaagtctgtccatttgcaaagaagaggacagtcatcagacaggcctttcatgttagaagtggccatctgagacaaacaggacattgttccaagccggttaccaccgcatggaatatgtaaggaagatctcttttgagccctgtaattaggtaagcaaggtcactacaaagtcatttaaaattgcatctcaagacagttcgatggcagaggatctaccccctcagtgctgatttattgcttactctcttaactttttaaaaaaagatcagcagattgattgtgccgcctgtggttggaggcgtgcttaccttttctcaggcctgattcataaaacatgactgacctgttttcagcatcctttccctgtgtgcccagggagctcctccgaggttcactgcactaagtgtttggcactgagtgaaaacgatatgtcatgttcacagcagatgacccagcaggggccacggcaatgaagtccccaaaatgacctgttacatctctagctacaagactcagggaaacagagaggcagtttctaatggtctcctggaggaatttggactgatgactaaactttttaggtcacagctttcttgagaaatggcaggtgccccttctgcttctggtgaggtcagtcactggctccagcccccagtaggctctctccagcccacctagtcggtttctcctgcagggggttggttaaccatttgtcctcagaacactatcctcacaaggcacaatttctgagtccttcctatatctggggtatgagccacttggaagtgagaataataagtgaaaccctcaggtgcctccaaggccccaggaaaagcatttctacctttgctgatgctcgttggtccactagcaggcagctgttgttctggccactaaatctcagtgacatcagttcttttctaggtttatttcttcattaatgtttttattttattttattatttttcactgacaaaatggcccctagtcggccagttgatttaacaggtcaggtatgtgctgtgctttgaaacagaggataagaaaaaaaggatgatcattattagagtttcatgcctttctcagatccttattacgcctctgctgcattccacacacataccaatcgtgtatgaatttctgtttattagagaactctccttcacttctcttttcatgctatggcgttcacaggacatcagagccagtggagcttttagaacctagagctgttcccactacactgagctgtacataagattgccctccatgtccagactggggatgtttaatgtggccagtgacatttttccaagtctgtttattacctgctggtgagagttcctgagacagtttgagataaaactttaggagtaattatactttatgaggacataatacccttcaggcttcatttcacgtggtgctaaatcaatactcatattcaattcttttctgtctgccttcaagttaaaggccacaatattaaagtttcctataattagccaagaagttggtgctacagagatggtaaaaattgacttcaaaccctttatctgattgtgcaaaaccaacacaagacaggtggcatattgggtcaccaagttacatcagcaagttccacggaaagcctagatgccaggaaagaaaataaagggagggaagtgttttctaccaactgctgggaaaaataatgccccactgtcatcttcactaccagagtctcatggggctattaaatatctttctgttttcatttccatgatgtttcctaggttgaaattgttctctctagaatgattgcataagccaagatccctaacactagagggcatgggctaactgcgtacctatgcacatcaggctgttgaacaaccaaagcaccttgctctttgagacaatggcatccactgagccactcttggtgatacaagggaccctgggtataaaaaaaggaaagcgactattattttttcttctccttctttcttcttttgttttgtctttcagttataggccaggcttttatttatttattattttatttatttatttagaaaatggggtctcactgtgttgcccaggctgatgtcaaactcctgagcccaagccgttatttatgtttgatttacaagtgtattgggttccttggttgaagggtggctcttatttacatgccctttcttatcattgtctattggctttcaggattgttgctctacttgcgaagggtctttaatagtcttagccacacacaaattcatcttttggcacgtgtatgtgtgtgtgcacatatgtgttttcttagggtcttattgagacatcagcattctcccctgtcttaataactactccaatccataactttctttccacttaaaaccattacgttgtaaacagaattctttatgtgccactgtgtgtggtggagtgtatgtgtgtgtgtgtgtgtgtgagatgcaggtgggtacattcattcatgttgcattatacccataatgtatgaaggtagtaggaaaatggagtggtccagcttattgtccaatgccatgtagtttttggtaaagaaaggaggatcaaacatagcagggtggcagcagcaggagcagcagtataaccagagtgttgagattttttttttctaggaggtacttcttttttttttcaatcaactcatttgaatagattacttaattagcatttattgtttgtaaaattccttgtctagaagtaacattttagggtctgcagttttgaagaaagacaatttaatgggtgataattttgtatagaattttcaaattgatttcttggtagtaaattgttcctcaattgtagtgccttctccacactcattagacagcaagccttctttctaaatgcattcataaccattaaagtgttgtctctagtttcctgtcatttgaaacaggtcataacttcaggcacaaacatttaaaggacaactatactttcacaatttcattagtgttctagcggagtcggaatgtgctattgaagtttatagagctttgcagttcctgatggaaactattcggctctactcatcccaagagtagagataatctttctctttgtacagaaagttgtttcacttcaattccactctgcctgagttttatttatcagcctgatctatggctagaactatatagaagctccctagaacctgtttataattcacctcccctcctctttctccaaaaacaccctgggaatagaacaagctcattgccaaggaaactccctggcagtaaagtactgtttggtcctattttctactggcttctttgacttgttgggagatggtgtttaaatgcattactcaaaaggagctctagaaaatttgaaataaaacaaaaataaaaataaacatattgaaattccctgatatctgcagtggtttgtatgctcttggctttctgggagtatgcagcttatgagcagagctatttcacactttgttgtgaaattcagtggagaaagtgcagtcttaccacgccctctgcctggacattttctagccaaattaggtctacaaagtgatctaattggtctaaccctcttatttttgatcaatgaggaattagatgcttcgctattagaataacaactacaatgttgatcccatttaagaactttttgtatactgagcaagaagcttagaggacattatctcttttaatcctaaattccagttgccaagatgataaagaaaatgagattgtgtccatttctacagatgaagaaataggctcagaaaactcacgtgtcctgacccatatcacacagcagtttactaatagactttgatggacacccaaagatgtttactaaagatgccctttcaaatgaagcttttgactgaagaaaaaatatgcatgctctggtccctcagaacgccttttgtatagatattatacatcctgaagacaacccttcaaagcaaaccttggctccaacaaagctcctttcttctctttgacctaactctccccagttcccaaaatttgtggatttttcaacttgatgctctcctcatactatgttctaaaactcaattcaccttaccccattctttctgattctttcataacccatatagatattctcttcctaaacctttctttggttaatctcactgattccttcattcagaaaagaatacaatactaagtgcctactctgagccaggaactgctcttggggaatatccgtgaaccagaccaacaggctcctgttttatggggctttcagttttgggtggagggattgattattggagaactctgaacttggattcaaaagaccaaggctaaatcagaatgttaaaactggcagatatgggaaatggttatatctaatctggcctgcacagtgtcttaaaaattgaattcattggtagcattttaagatcaagagtttccacatagaaaacaacctggatttctggcatcttagtagtaacctgggcccacatccccatctaaggcatcaatccctgcaggaggagcagttctgtagccttctggtggggcagggtcttttagccacctttgcctcaaccatgccttctcatgcccagccagctacactcatgtacatgatctgttgacctctatagacacttttgcatcccatggagtaaatgatctacaaagtcccttcacagactgacataactgttgttgtctggcttcctgtgcattgctgtggcctcttcccacaggcagcgcctgcccagagctggcagccagacaaagagaatctgcctgaccccagaggaggctccatcattgcaaggcaaactcacagcacagtcagtccctggacagcgaccagctgtcttcaccccagagccacttagaatcaattctaggccttgatgttgaggccccactacttgaaaatttcaagagatttagcacaagtggataaaactaacaaaactagaaaatcagaagttgtctctggtggaagccaaacaaatcagaaatgaataaggagagaactttcgggtaaaagcaaataaaggctgtgtaatatttggaggaataatgctaattattaccagttttaaagttagtttttggtactttgaaaatctttactcaaaatcatcagcaaaagcaccagtaagcactaatattaattgcaggcttattgtgtttgtctatttcatttaacccactgctcccattttgctggtggaaaactgaaaaccaaagagattaagtcatttacccaaggtcatgtaactaatatattgaatctcagatgttttaatgattttgactcatttccaatttgcctggctatatagagaaaatatttgaggaattgacagggaacacacacacacacacacacacacacacacacacacacacacacagagggagggaggggagagagagagacagagacagacagagactgaacagattatttctccactgatgttcattatttagatctattttcaacatttaaaggcaattgtcagcatagtcaattcagccattttaaaccatcaagggccaatgagcaaagtgttttactgaagagtctacatatggaaatcaatgatatcccaaaactgagctggtacataaatctaagaaatgcaggtgtgagattgatgacttgggatttgatccccatagcaaatctgattaaatggtatacattggtttagaaaaacaatgtatcagggaaaatcctactcttaagaaacgttatgctgaattctgtaagatgataaaaaacatgtcacactagaccagaaatattacaaatgttctcagattctccctttctcattttctcatgtttagattagaagtatgggaactcagagggctgaatagaggattgccaggcagttaatgagaattcaaactagatttgaggtcttcctgattcccgggatttactctaccgggcagaagcagaagctgcttaaattctgaaaatagagtcttttaagagtgtgggattcatacggaacctcttctaaacaagttacctctgaaatgtgggacaaaataattctaggtgtgtttgtccaacaggagcctgtgacttgggatttgtgtctgcacatgcatggatctaaggaaccagccactttgacaggtggcctttcatcaggctcatcaatgtcttagtcaatttctggccctcctatcacccctgttctggagctgaagaaaccttgccatggggacaaatgcacttagagagtgagagcagcatagcaaagtgatgaaggggatggacgctagaattggaaccatggctctgccactgactagctattgggcaaccttcctgtgcctcccttatttataaagtggagacaatgatagtacctccttcataggatgaaacaagttaatatatttaaagtgcttagaagagtacctggcacatagtaggtattaggttagggattggtaacttttcaaaatatgagagactttttaataacaacagccagtattttggtccattttatgtgccaggcaccagtacaagaatttggcatatataagtcatttgattttcagaatatacaaggtaatattattacctttattttcagttgagaaaactggagtgtagaaatgttagtaatatgcccaagtcacatagctagtaagtaatggggcctagatttgaaagcaagcaacagtctctggaacccataattttagccactatgctgtaaagaaatgcaaatagccatcgtcattactcttccaaatccaggactgaattcgttcattgcaaatatggtggatctcagagagcctgaggcagaaaatgggcacctatatgcctctcttactactcacagcttaaagtcagtggagttgacgtatgatcaagccaccaaatctcagcatttctttggacaaaagacaaccttttttagtgaaggaaaattcacagcaaccaatctgggtagggattccaggtgattcttgccacctcattctcagtcattctcactagggttgattccacaaccacattataaactcctagtagaccaggccaatataattgctcatctcccatgacacccaagtgtcaataaataccaatgaatgaattgactccatttgtttgttttgcaccctgacaccagtagccctcattgcttagagatttttttccagtagtaaaaatagggattctagagtttcctttggtgcaaagtttgagctctagtgctttttaattactgtgactatcagtggagcagattattttttgataatgaaatcatcatagctgaggctctgtggaagacctttgacttcccatcaagagaagtgtaggataaaatgaaaattgaatgttgtttgttgatgattttctaatcgattgcttgctgttttttggtgattgcgaaacactagaaagtcccaaaggaatcagacatgcatagaaagagaaatgaaggggagaacatgtccctagggtaggtccacagggaagataattgaagatgacagaagacataatgtcacactcagaaagggattttttctggccctaccacacagaaaatgatgaccttgcagtggagagataagactggtaattaaggaggagttattgtgctaaagctggtcttccctttccactggtatttcattctggaaactgaaatgggacattaaataaagaatggtgtctcatttcagggcagagggacttacaaactatcaaaaccaggactgaaaggagccctgagctaatgtgtgttctcgttacagaattctgcctttcagcaaggaaaggtatttagctgggatctgaggattagcataaacttctgatattctacccttcctattttgggggaaaaagtcaaaccttagtagaatttgaaagcttaaaaatatcctgttcaatttgctttggatggcatttgttactattaaaattttaaaaatacagaaaccacatatgatccttgtcttgggagactgcacatcctgttttgtctaggacagtcccagtttatatttgcgatactggtataattattactatctctcaaaatgttgtggtttgagtaataaattatactctgcctatatataacccagcgattcttctgctcagtatctaacctagaaaattactcacacacatgtacaaggaggttactgtagcactgtttataaatcacaacataggaaaccacatgcatgcacactagaagaatggccaaatgaactacagaatattcatgctgagagcatcatctcacagttaaaagactgagatggatccatatgtggtgaaatagacaaatcttctagacatgtcctgaggggaaataaataatctttagaatattgtccaatatgatactgtttaggttactttaaaaatgcaaactagaccaggtgcagtggctcatgcctgtaatcccagcactttgggaggccgaggcgagaggatcacctgagttcaggggtttgagaccagcctgaccagcatggtgaaaccccgtctctactaaaaatacaaaaattaaccaggcgtggtggcaggtaccagtaatcccagctactcgggaggctgaggcaggaggattgcttgaatctgggaggcagttgcagtgagccaagatcataccactgcattccagcccggacgacagagcaagactttgtctcaaaaaaatacaaactaatttaaaagatattttaggggccagatatatgagtatgtaagatgaaaaatggaaagacatttataaaccagtaacaagggttatgttggatagaagtgatgggtttggattcaatatggtggtcaagggtgactttaaccataatatttcagccttttcctaaggacactatgatctttgattgcttgtggaattgatcatttattttaaatgtaatttaaaacttaaaactatgttccagaggtgatgttgctcagttcattgttttgaattgaagtaactgaggccttgagaagctgcataagttttccagggtcacaccatcgatatggggcagaggtggggcccaaatgagtctcctgacacccagtttctttctcactgtctggacaatgctctccttgaaggtttatgaagatttactgcgttgccttccctccatagatggaaataaatggctggacacaaactaattcacactcatcaaattttactccccttaaatccccaactaaaaagtaatggccagtatcattaattgaccccaggctggcagccacctgatttattctctgaagtctaccatctggttttgttttgaccttaattctccagcatgcatttctttgatgtggacattaaactgatcattaatggtttgaagaagtggtaagtgtatggtgagaagggtttccctggcgtatttttgtgacagttatcgtggggtcttttgctttggtttgtgtcattgcctttcctttggtaagcagtgcactcatggcctttcccctggcgattctctgagtccccgcgaaacctgctaatgtgggggcaactggaagcagctaaacccttattcttccctggagtatttgcatattaatagagatcaggacctgaagttaaatttgatgatgctttaaaggtggaaacttagacattaaccagcagattagtattagtggaaaggattttactgtacttatttttgcctttcttatttttctgaaattatgccaagtaactacactttgtgttaatgaacacatactttagtgatacatgttgtccgtgttgttgaatatagaacccagcactttacgtgaattatgtcatttaatccacaacacaactttgtgagataatgattttatctccggtgaatagttaaagaaacaccaagagattggctttttgagatttagcgtctcagggagggtaacaccgtagaagatagagctaggttcaaacccaggcagtccatcttcagagactcagctcctcaccaccatgccatattgctggcaccataataatgattatgcagttattatgatgttcaaaacataattaaacacaataaaatataatattatgtaagatgtaattatatgcaattagaagtgtggatactcatttgcatactttgatttcagaaacaccaaggggaagaaaacaaaatactttctgagagttgttgatagtattccagaaagtaggtggatttggcaaagtttgtaaggtggtttttttcccttcctttttggctcaacagtttgttggctggcactcatacttgggagataaatgcaaaccgagatctcaccattcacaccactcccagaggtcacacatcacttattgaataactgatgggtttggaaagagggcatggctgtaactcagctcaagaattccactgatgtcataaaaggtgatagctcagccccagtggcaggtgatggacagtgtagccatagagagcacatcagctctgtgctcattcccgtctcccgtctctgcagatttaatttatagctggaacttggcccttcctttgggcttacaggaaagcctaagagctgaatggctgagcttatcatgatctatgtggatggctcttcttgtctttctgacctccaccctaggacacctgtatctcctccaagcccagtagtgggcagttgttttcctagagatcagcagctcttattgtcaaaaaatatagttaaacagtttattagatgaactgagattcatattgttaggtcttccctcagtccacgggggcactttcctaattacctttgcaagaatatgttttattcctcagttattttccaattccttctggaaattcttttaaagagtctcaatcccagtgttttgcttccataagggaaaagcacgtagggtgatggtcagtaggaatgaatgcaatgttagcctggaaaagtgtctggatggatagggaaagtactcagaaaattgtgtttgtgtttgtgacttgaactaagtccgtattcctcctgatgtaagattttggattagaatattcaagatcatcacttcctaatattatataggaaatctcataatctatataggaataggaaatctgtataatctttatttgtatttactatgttattgttctttctcagcataggggtcttccagaaaaatcgatgagtctagatttttgaggactgctgtgatattcttttaaagatgaagactgtaatcaagccaaattttcccaaacacattccatggaacactaagcacgtggatcaacagttttgtagtcaaatatttggaaaatgttgcctctttcctcctcttcgtaggaatttgctgtggctctaagcattcctgcatccagtaaagatgtctgtttaactttgtttaacccagtgttttccagtttcacctcatcaaagagcccttacagagctgtggagaggagcacttgggagaagccagttttggagatgggattgcatcccaggagtacattgaaatgattgctttcttgaggattagggcccactgataagaacaggctgtaagcagtgttgtgacagtcttctcccagagctcttaatcgaacttttaagtttctcaattgaatagtgcacaaatacaatattttacccttttactgaaggaacatagtaaataatactgtgatagccccttgacagtagaaagatgatcttttaaaaaaatgctccagagaggttggaggagagaattacttttatctgtgtctatcagaatcccatgtacatcctggtcctgggcaaatattattttaagagcttttccatgactcaaataccttctttctattctgctcatttccttttctttttagccttaatgccattccacatttgagagagaacgttaacataaactgcagtaatgtcagtcatcaatatttgcatagctagggtgcagcttttggaagaagctctccagaaaaaattacagtacagtgtgcacattgcctaaaggtatttattgcttccaaagaatgaattatctcatcttatggaggaaaagatgaaggctcagagaagatgagccctaatttatgcagaacccctgataatattcatctggaataccaagaaataatgttaatacataaaaataatgtaatgtaaatcatgttatgcactgcagcagttagctggaagatctggaactgattcacctggtcagtttagagctttctgaactcccttggtattgtatccagactgggcttgatacatttaattatctaagtaaagtagatcttggccatcacctttgaataataccaacaatgagaaaaataaccgttaatggttgaggatttgcagtttagagaatatcacctacattatctttctaagctggtggagttacctcatttaacagatttatagtgctcagagaggttaagtgatttgtatatggtcacacagcttaatgtatacttgagctggagccagatcctaaccccttgtatctcccttaaattgtgctgtctcattccacagagctcctcaggcaaagctgtttgattggatataacctacattgtttgagtatctgatacattctgggtggttttccaaggggaattctttgaaagggagcttgaaatttgtatgttgaagttagataacctctttatttaacaaacacctgtacagtacagtgtttattgtcattacaggcaagcttctaagcactttgtaaatatcgaattgtgaatttctcttatcggtcccacagacagatataattttaccgtatttcacagatgtggaaactaatatcagaggctaaataattccctgggggacacagagccaccacctcatggaaccaggattgtgcctaggctctcaggctccaaggcctatgctcctcacctctgtgctgggttccttctccttctaaattctctgtttacacaagcatgggactgggtagaaaaactggatggagggtgattcagattgagatgttttcttggtgtaaacatgagatgtctgggtggtaagcttatatgaatggtttttacttttttctttgtactttcatatatttcctaaatttcctacaatatttatgtgttactttcctaataatgaaggggcatacgcagaaaacacattggctctagtataggatttcagcctttatagatgttgatgctgacttattagcaacctatttgttagcagcacatgcgtgcgtgtgcatgcacgtgggcacacacacacacacacacacacacacactctttgcaggggaattttgagccagaaatttatctgtaggcccatattcattcctttttgcacatttctattgtgaccttgggcacgtctctatccctctttgagccactgttttctcatctgataaaagaaggataatattgcttcaaagaaggttaataggactaagtaaggcactgaatatgcatgtattttataagttttaaagtgccttaaaaatgtgagtaactgtgtttaggtaaaaacatatatggcatgtttcttaaagtttctcttctctgttatttgcatagatgttatgcaacttgtgttgtagatagtttgccaaggagaattttatcctgcaggcctcagccagtcagtatatgagctaagatggaagttttgtgggataagcaatctgctgctcccttggagaattctctaaatttgcaagtagaaacattgcggttggcaaaatggagctggattaataacgtttatcattcaggtggaggctttgtgtttgcaaagggcctggtaattggtaattagctgatgccccttgtctcctcctgccaccctcttcctccctgccctgctgtgccccctggaatccagaggcagaggcacctgcatgctcccagtctgcttctccctgcacagtgcctggaaagtcccaggggaccacagccatctgacaagttggtactgggttgagttacaccagccacacacactagctctggccctgagctgggagtaaatgaggtcaggccaagagacatcaagcttcaaacatatattttcaaaataaataggaagtctctgtcctcatactctttccctgtcacctttgctccctaaaagtctaacctctttttagtcagtttcctggtatccaaaggcccattttacttcctccaaccatcctgtcagcaaatcacatttccctgttgtgttttctccagtagaaaggacttttctcatttatttgttcctgagaagaattaggaatctgagaatcttgatgatcttttggctgcttcttgggtagcaatttagactctcactgaacacccatctcatctcttcagagctattcaatcatgctgaagttcatttgaacaaactaagacttcctattagcaaccccatcctgcttaaaaaatggagattcccctctgccattaaagcagatctgagaggctttttttgaaggagggctgaaagttgaataattaacaggacatttcttttccaacccttcttttcttttcttttttcatcaatctgaagtatcctgggacgctctttggcctggcacatgggtaggtaggcatattgtcaaagattgagctgcagtttttcaatttgtgacttccctgataactacttcctctagaagtccccagaaatgaaaatgggagtgtgtgtccaggcacaattgcttctcccagtcttcctggggatgttccaatcttgtcaaccagttttcagttttgtttcagagtattgactcaagtaattaaatcatcaataatattagacttccctttttcctttttaatttttctttctctattattctttttcttcactatccaccccaaccccccattcatctgttctttttatggaaggccaaaaagtgtaatacatggtaaagaggggaaaggggactctgtagtagggagctgaggactagttcagtcaggcagccctagcttagcttcagtttccttatctgtaaagtggagaagtcaaacctgccttgagggcaggtgactgaaaccctgcaggtaagaccctaggacagatgggtcctggtaagagcatcgtcttgttgagaggctgaggtgggcagatcacaaggtcaggcgttaaagaccagcctggccaacatggtgaaaccccatctttactaaaattacaaaaattaactgagcgtggtgttgtgcacctgtaatcccagctacttgggaggctgaggcagaagaatcgcttgaacccaggaggtggagattgcaatgagctaagatcaggccactgaactccagcctgggcgacagagcaagactctgtcttaaaaaaaaaaaaaaaaaaaaaaaaaagcattgtcctggggtgtaatcccagcagctctgccattgattggttgtgtgacctgtgggacttctgtagttcagtttcttcatctgtagaacggagtgacaatagcacctgtcatatagggttgtgtgttgggagcattaaaagagatcatgtaaagtgctttccaggatgccagaccaataatggtgagtccttcatacatattatctattgctgctattatcactgtttctggaatttaacaatttctggttccctggggagaagatgttccctggcagctgggcctgttttaggtcttgtgtttcccgcagagactctagggaaattcttaaaggggctttgtgagtatcatctctgagcataactgtgtgcccaggagctcgcaacacacccctcattccatggcaggatgtcgtcagctctggttagtctctgagtccattgcttagagctgagcttagaaaagagaatttctctcttagagacaagtgggatgctgtgggaaaacatagatctgggaagccagtcaggccaaagggatccaggagtaggagttcctatagtcggcatggatgtggataggtagacgcaggcccagtgcctgacttggggaccacggggaagccactcacctgattgtctctcacctgccacctgcagaccctgctccttacttgctgtttgggaaatattgtcgctttgcataggatggcactgttcttacttttgatgaatgtctgaaaaatgaacttcttatcctctacctttttcaactgccatatacatgctggcattactgttaacaaataggcccttttccctgatcacatgagcctcggattatggtctgcattgatcttctgtgagctcaggtggccatgttcaaagaaagctttgtgaacatgatgactgagaaagatgaatctgggtgccgcatgaggctggaaggtgggggcagtgatgtggcacatcagctcactcaggcaggacagaatagggtttaagcaaagaatgcattagaatgcattatgccatacgtcacccacttaccatggcataggactagagggggcctcaaagattatttaaagaaaaacaaaccaatgcctttaaggcttgtgactctgtaactagaggtgaagtttggctggatgcattcatttagcaactagttacttattgagcttttactgcatctcaggcactgcagtggaaacacaggatgaactagacaatgtccctccctctaggtcttctaaaaaaaagaccagtacatgaaaaataattgtaaattatgatacaaaacaaggagcagaatagggaagaactaaagcttggggcagaaatgaggctggctactttaggtgggatggccaaggataacatctctctgacatttgtgttaagaattaaagccatataaagtgcttcccagggtgccagaccaatatggtatattcttcataaatatgctacatgaagagtgggaagagcaaaagagcagaagagcattccagctggaggagcaaacatttgcaaaagttcaagatgggaagatctcggccctttccaggacttgaaaaaaggcccctggctggagagtcatgagagaagggaagcagcttcagatgaattcggagaggtagaagcagccagatcctctagagccttgtaggccacagtaagggggttgagttgtaatgcaaggcagagttctcaagctctatcatgaatcagaatcacctggagattcaatagagattgctggaccccatccctagagatggggaccttctaataagtttgcatgtggtgccgatgctactgggccagagaccagactttgagaaccactgctgtaaggcagtgagaaccctaacagaaggatgtttcatataattaatttgcaggacttagtaactgatggagtgtagggttaaagagggaaaagaatcaaagataattctaaaggtacagtcctgtgtgatcaggaggtaaaacatataggaaaaattcttgttttttgagacggagtctcgctctgtcgcccaggctggagtgcagtggcacaatcttggctcactgcaagctccgcttcccgagttcatgccattctcctgcctcagcctcccgagtagctgggactacaggcgcccgccaccacgcctggctaattttttgtatttttagtagagatggggtttcactgtgttagccaggatggtctcaatctcctgacctcatgatccacccgtctcggcctcccaaagtgctgggattacaggcatgagacactgctcccggcccgaaaaattctttattcagggctggatgatgagatggtataaccagcaggaatcttccttgggtttcagtaggtgtgggaattaactcacagatccatgtgtgtgtatgcattttttcttaaacaggtggtagagagggtacaaatatcagggagaaagtccacagaagcaggataagatactgtcaacctggggttccttcaggccttcccagccaaacccttccccctgcaactcaggatcagccacctcattgacttgccccacccaaggccaaaccaatattgacagcagcctcaatgcaccagcaggaggggtctacagttattgctgccacaggtcttacaccagatggccctcggtgggccagcctgttcttgcccagtctgttcttgccctgttctgaccagtggcagtgctgccttaccagggatgccctatctccacctgaatgaaccaggtctgggtttgcactgctctgccccagaatgccccgctgttttcacgtagtcaggcaggttccccagccttagttctaccagagccagcctcctcgcttccccatgcatcagtgctgctgagagtgaatccaagttacgggagtaaccttgctgagcaggaggccaaaaccagtgagtgacatgaagcatcgtccatccaaaagagaggccaagaaagcatggaaaggacagtgtcatggaggcctagcaggagacaaacttttaaaagaggcagagagatctaaatacatccaaactgttgaagcgtaaagcattagaaaaaaatatgatttctcaacaagttatgacaccttcatagagaacagttatacaggaatgagtgggtggaagaaaatagcaaccacagcccaataatgcagatctaatgttattaggttaaatactacacaagtaattactcagtgatgaaaattattaattgtgcacatgatgctcactctatgccctgggtgtttctgttcctgcttgaatagtggaataattagcagataactgcgctattaattatgccaaagcttgctttgagatagactaaaaggccaaacatgtaggatgaggaggagctatgtgttctgttcatctttgtgccctgagaagagcagatggaaagcttgaggtcaacctgggcccacagctggccaggtagactgaagttctgtcatgccctgccttgaaagggaaccagagtgcctatgcaggaagcccacgcacatagcacttaggcatagcagggggttaaaggtgttttcaagttcaagtcatgacacatttataagccaaagccccaagggccagtattttccaatctcttcctccaccatccttggccatatggtaaacatttctctttcctttccccattgacaccaacaagttcatctcacatgggtaagactcagacaaatcccatagctttttacacgtagattttccacaaagcgaatcccggcaaacgatatacagaactcctagcttatcttgccatgggatgagataagatggtaagaagtcatcctgtggccaggtgtggtggcttatgcctgtcatcccagcactttggaaggctgaggggggaggattgcttgagcccagtagtttgaaaacagcctgggcaacatgatgaaaccttgtctctaacaacaacaacaacaacaaaattagctgagtgtggtggcacatgcctgtagtccctgctactcggaggctgaggcaggagaatcactcaagcctgggatatggaggtcacagtgagccaagaggggatcactgcactccagcctgggcaacagagtgagaccctgtctcaaaaaaaaaaaaaaaaaaaaagagagagagagaaagaagctatcctgctggagtctgaaagcttgacctagcactttcctatagacccttatatgaggatagaaatcttgttttgtgctccttgttttgtgctccaatatggtagccactagccacacatgcctgttaaacatatgcatattaaacatattaaacattgaaatagggctaatgtgactgaagaatagaactttatttgtttatttatttatttattttgtttatttttgagacagaatcttgctctgtcaccaggctggagtgcagtggcacgatctcagctcactgcaatctctgcctcctgggttccggtgattcccctgcctcagcctcccgagtagctgggactacaggtgcattccaccatgcccagctaattttttgcattttagtagagatgggggtttcaccatgttggctaggatggtctcaatctcctgaccttgtgatccgcctgcctcggcctcccaaagtgctgggattacaggcttgagccaccgcacctggcctaatttaaatttaaataaccacatatgggtgatggttaaagcaggacttcagaagacactctggctttagttctccttatgcactcacgactggggttgtctgggctcgagggacctcagagcctcttagggtaatgtgtgtcctctgggatgacatttcttggacaatttcccttctcctctgaaatgtgagcttcattcatggtaaatgagtaaaaatctgcctggaattacttacaagggtgaagaatgaacatattaacaggctatagataataagaaagtcctttaaaaatgaatgtggtggctgccaaatcaatttgtgcaaaataacggtagacaaggatgagctgcggctgacagggagcaattaagttttgtaattttaccttgaattattaatttcaagaagggttgcttctctcactgcagtctacatcttcgccctttgagagtcgggtggaaggcactgtgggtgagcctccatttccaggttgttgagaaaccatctctcttggtttcttttcttatgctttcagctcttcattgggggttgcacttcattttcttctcacattcacaacaaattagccatacacataaatacaataaaggatacctgtcccaaggaaaagcatcctcatcacatgtcatgggccagtcccttttacaaggtgctcctgcacagccatggcaggtactcatgtgtgtgccagacagaggggagtttctaagctaggaaaagtggatttgtgggaagttgttttcctccaggtaaagataaagtggctttgcttgactggttgactcattggccaaactaatgatgctactaacacccttgatcttaggattaagcattgtctgggatattttgagtcatgaaagttaccttcctacagagcccagctctaggaaaccatcttacaaatacatgtgcatcccaaagacgaccaggagagtgaggaaggcttggctcaacccagcccagttgctgacaaagccatcaaagtacaggtcttacttccaacagtgggtcagtgggaagaacacaaacaccagcgtctctcaaagggcttgccttgatattgccgcctctcggcaattgaacacttctcccgttcgcctgaaccctcagacttctttgaagaaactctttccacctatccaagtgcactaagttcctggcatataaaattagatgtggttattttatgaggtggtatcgttttgtggaaagttgttttggggtgggaggtcagaccaattcgggttttaatttcatttcagttacttattcgctgtttgactttggcaaactgacacaagatctctgagcctgcttccttgtctgtgaaactgggctaatgctgctgtgtgagatggtggtgagggttataagtgaggaaggtgaagttcctagcacagtagctcacatgggagaaggtggctggcactgtgcttccaggagatggaagcacagccaagtggcccagaggacaattcccagctagccccagaaataacaggaatccttcctccagggatcatagccttctgaactgcttccctcctgcctgcccttctctatgttcctctttcttcactgtgggtcagggaaaatatcatgcattcattcactcattcatgtattcaacaaatacctctggagcctgctgcctgccaggaactgctctaggtgctaggaatacagccataagcccaacagagtcctgacctcatgatgcttatattttagtggggagttaggcacagatgcagtaaacaaagaagatacaacatccagtggcgataactgctatatagtgagataaagtggcgtaagagcatatgatggaggtgacagaagcctattaacatcaacggtgagtatctgatttttagcatcacctgcacacacacacagagtaaggagggtgggtccctgagtttacagagccctgttatgaggaaggagcactgagtgagggggacactcactcatatgaagggactgcatggagtgggatctaagaggtaggaagtggttggaactatacccgctgcagagtagttgaggaagaaaaggggaaaaggcaggtaggtgacatgaagtagggagagaatggggaaggaagatggcagctgccatgtggcaagagagagggaggctttggagatctctcagttgatggaacatgcttctgggtgtcctcatggagcctcaggaacaatctgcatgcctcactgatgcttttgccgtcagttttgggttttttagacctgggacgcttgacactgaccacaaggtgagggccaggctggatttgtatgtttgttgttttaagtaatccaaaccttataaacacatgtaaggagaaaacccaaggctctttccctgttccctatattccagtctccagaagtgacttatattagaagggaaatgtgaatcctctctgatcctttcctataaatatacaaacactcacctatgcatagtgtttacaaataaatagtggcttccttgtctttttaaaaaagagatgtgatatcataatttcccagggccaaataaaaaaaaataactacaagaatattctagtaccaatcctgcatcctcaaactgtagcagttctataaaaaagcctatctcttcctcccaccgtcaagcccttctaacttcttagcacactctgcctctgtctgccattctctgcaaagaaatggtttctccggcaggtattggcaggcaaaattatatcattgcctttccacctatcctacagtcgttaagtaagagagatgcccttactcccgaccctctcacctgaaacagggtaaggagaagggtgtagaaactaaataattcaccttttggtgtaccctgaaagagagaggagatgaatgatatgtcaccatggaaatcaggttctgtttactagtagcttcccctacttggagtgcatcaggttagcctgtaggacagtggctgtcagccctggctgcacattgcaatctcctggggctaatcaaatacagataccggtgccccacccctaaggatatgatttcattagtttgtgagatgggctggcatccaaggtccttctaatgtgaaggcaaagattgagagtggctgctatagaagagctctttctggtaaatcagtcattatcctgagcatcaagagtctgcataaataaattcagaactgtgttttgttgttaatattgatactgcattcacctggggaaggaggctgcttatttgcccacttttcagaaacaatgaatctttagtccagctccttcccttttcttccttcgttcggcctccttccttgtgaggagtaacagctgtagaagtcaggggaccttactggccgcactaagagagtacctgtgtgtatcagccttcaagcagttttggggtcagacacccacttctcagacttccaggcagctgccaacctttgccttcccttcttggatttctttcaacatgcagatttatgaggtggggaatgcatgaggggtggctggcgtccagacttactgtaaccagagagaaatgaacagagcgtgctccaggggacatgcagcacttcctgaacaaactactggtgtcgccattaatgctactgacttaggaacctcatgtgcctttttgtctttttcttcactcagcaggaccggcatctattgctaatgttaggtttaagcatttagggcagagcatgccaatcttcccttgatccatactgctcattgatcagtggtcacatttgtagcacacctcatgtctgtgggaggtagctgtggggttgagaactgctgaggcagggggttgagtgttcccaattaggggttggcagtaatcaggtactggggcggggcttatgccacttgctttattgttcacgtaataacagtggacttggattgtgaattccttggaacaagaagagtcccttctactgtatttacccgggaagacttctctgatttcctgggctgatttgcattcccctcctaggtactttggtagttgtccccggagtggatcatagccaataccaccctgtgttgttcccactaatttacctatccgcatgcccgtgaatcacaaaccctcaagggcagggtgtccccagtgcccacaccacactggttttgtagtaagaggtgcatgcacatatgctaggagatggaatgcttatcagcacccacatttcttccagcctaattgtatgcgctacattcacacacacctggatctaaatcctgctctttgcttccaggctgtctgaccttgggcaagatacttccccttgctaagtcttgtctccttcctttctaggatgcagctgatgataggactgaaccgattgggtgctacggagtattaaatgtgatagtatctgccaagggttagcacagggctgctcacgggatcagtgctcagtaaatgctagttatcatgcaatccttattgttagtttcattattatctgtatgataaattgattgtagtgtcatctgcaaataggtaaataaagcattatacattgccaaaacaactttaaccaccttacacttgatatttattctgattaaacaacaatgacctgagaaagtagtatagaaagtgattgtgctatgctggatacaatatcagctagaatgcaaacgttagcagccaacatactgactgcagccatctaagattcttgggaaggcgggaaaattaatagaaagagcactggagagggagtccacgtgggcaggaagctaagcagcagtgaagacagcgtggcaagatttggatagaaggactggccagcactgtggagagccctcttaattggagggagcagctgtgtataaagacagtctgcagagcagcatgccattgccgtttctgagtaaatttgtacactgtttgctgtgagtcactgccaagatcctctcttttgtacattatcagatcaaagctttaactcgaccaaaaaaaggtctcatctcccatgcctgtgtagggaaactgaatctcacttgcgcccttctgctcccatggaaccatcgcagaggcctagaatgccctagctttctttctcttcttgtgtgctaagtcaccaaaatctgacatgctgaactgtcaacttaatggtggagttcgggttgagagctgatttctaaaaccactgccacctctggacagcagccattcggatatcaggtcaaggtttgggagactattaagaagccagcaccaagacatgctggtggagaagtcggagttttatcacgtcctacctactttgcggtgaaatgaaggtcttcatagtgaggtggtgatgaacgttgccgatgcggtgaagtcatccttcatcactgtgctattttgcttagagcttcaactgctacattatgtcttaaaacttgtcaagttgtgcacagtacactgacttcataggagaaaaaacgcgttgtgtaaaaatataaaaaatcagacatttctggtagaacgagacattataactcaaaagtcctacagataaataataattaggaatggcatttactccacagagcaggaagaaaacaacattctctatcagctacatcctcaaatggttacagtttcctgtctctaaccacaactaataaaaggccaggtacacagcctttaggaagttaacataaattttttcttggggaggtggcatggcggtggggggaacaactgtaaagaagtctgtttctgtttcctaagtatttttgccaataaaaacaaaatcgttccccacttgttagaaaatgtaacaaaaccacctgtctgcccttgaggagatggagaacaaaatcaacaatatttgcattttgactacacacagaattaatccatagaagcagaggcatttttgaggcccaagcgtgataacacttccgtgcatggttctacagacaagataatgtccgtgcttcaacgacagagatggggctaggctgcagcaagggcagtgggttcctagggcaaaacattttaggacggttattcctcatcctcaaactctgaacttatctggccattttaggagaggaaactgaggatccaggaagtgaagtgattctcaaaggtatcacagctagtcaatagcagatccagtacccagggagggaaacagctgattataagataatcaaaatgaataaacacatctattctatcctgtgtgtatttcgatgggcatgttggggagaatcattggtgattctcagactcctttttttttttttttttttttatgaattagcagatccttggatttcactggagaaaccagtgtggctactgatccattacagaatctagcattccccagagagcaaaaacctcctcctggggggcgcgctccagcctatatagatttggtgcaccaacactgcactgtcctcatgaataatctctgatcagaggatactaattaagacgtggcaatgcccacttagtaaattagctaaattgacaaaactcaatttaaataacaattttgtctcttgtgatagaattataacgacacccttcacttaatgagccagacacttaataattcaaacatacttacagaaaaatcaaacaaagcttctcaatcccagactgggtttcccaccacctctcctgccactgctttgcaaaaatggtagcttgaacactgtggaggagaggctgggtatttggtgaggagggaggggctgaccagtttctgggcagagtaattggtaggtgactccttcaacaaacttccagccagctgcctgtttttgtaaataaagttttactgcggcacagatatgcttatttctttgtatagttgtccagagctgctttcaaaccaccatcaaaaatttgaggagttgagtagtggtgacagagaccttatggcttgaaaagccttcaacatttattatctggccctttaagaaaaaaatctgaccctttgagaacaagtttgccaacccgtagacttgggctgcaccttggatctatggttccctgggtgtgcaaccttgaatagatacttcccacatccctggcctatgattttcttaagtgtaaaatagggatgatacaaagactatctcctgagactgtgagaattaggtaagatgctgcacgcttatctgtgcttggcacatagtaagtgttcaataaaaggctaatgagattagtaaaagcaatgataataggaacatatattgagtacttatatgttctagactctgtgctcagttctttatctatattaacttgtttaatcccataacaacctatgagggagatataattattttaattttacaaatggataaagagtatttattattattttgtctattcttctaaattctcatttagtaacacttttgcccagtagtaactgctctcctggctggcaagctgctcaagggaaggtcctgagggtcctcattgtccctggaccctagacctaaaggcatggatcattctattggtcactgacaacactgaaatcaaatatttcttctctcacgtgagtggtgggtccctttctccattctgcctttccagcctcccttctttgtctttcacatcctctccaggcctttgcagtgtaacaggaggtggacatcacccccaggtatggccagacagatagtgaaaactcaggccagtaaaaactcagaaatcctgggagccattaagttttgaaagagccacatattcatttattcagtacacatctattgtgtgcctaacatgcaccagccatggaggttatacttgcaagacaaaatgctccctgcctctctaaagcttgcagtctattcaagaaaagtttacagctaccgcacagctgccaccttaaagaaatctttctttttctttcttcttttttttttttttagcacaaaagtaaatgtgttcttcctgggatgtccgtgtccaaacacagtcacacatcacttaaggatggggatatgttaagagaaatgcatcattaggcaattttctcattgtgtgaacatcagagtgtactcacacgaagctagatgagagcctacctactacctaggctataaggtagagcctattgctcctacgctgtaaacctgtatagcatgttactctcccgaatactgtaggcaattagaacacattggtaaatgtaatgtgtttttctaaacatagaaaaagcatgccaaaaatatggtatgaaataaaaaatggtccacctgtacaggacacttgccatgaatggagcttggaagttgctctgagtgaatcagtgagtaagtggtgagtaaatgtgaaggcttaggatggttactgtacactactgtagactatcaacactgtacacttaggctatgctacatttattaaaaatattttttcttcatcagtagaaaattaaccatagcagagtgtaactttacaaacttttcattttttaactttttactcttttgtaataacgcttagcttaaaacacaaatattgtataactgtgcaaaaatattttctttcttcatatccttattctacaagcatttttctttcttttttttcttttctttttttttttgaaatggagtcttgctctgtcgcccaggctggagtacagtggcgtgatctcggctcactgcaagctccgcctcctgggttcacgccattctcctaccttagcctcgggagtagctgggactacaggcatgcaccaccacgccctgctaatttttttgtatttttagtagagacggggtttcaccgcattagccaggatggtcttgatctcctgacctcgtgatccgcccacctcagcctcccaaagtgctgggattacaggcgtgagccactgtgcccggccttttttttttttttaaactttttaagctcttttgttaaaaactaagacacaaacacacacaggagcctaggtctacacagggtcaggaccctccctatcactgtcttccacctccacatctggtctcattgaaggtcttcagggacaataacattcatgaatttgtcacctcctataacaatgccttcttctggaatatgtcctgaaggacctgcctgaggctgttttatagttaatttttattagtagaaggaatacactctagactgtgataaaaaatatgatatagtaaatacataaaccagtaacagtcgtttattattattgtcaattatgtgctgtatgtaattgtgtgtgctgtacttttatatgacgggcagcacagtatgttagtttacaaataggtgagtgatgcattgtgttatgacattaggatgggtgcgatgccactaggaggtaggaatttttcagctccattccgtcattgactgagacgtcattatgcatgtatatatatgttttcatataaaattaatatacttaaagttcttataaggaactcagctctatattaaggtccctaaaaaatataagaaaggtaaaaaaagtcaacctagagttagctccttctctgtgtcaggcactgaataaggtactttgccctcttcagctcattaatttcttaccacaagagttgatcatttcccattttatatgtggaaaaacagagattctgagtgtttaagtgtcttgcttaaggatagttggctatgaagaggcagagtcatctttcagatcttacctccaaaccccaacacctcccattccccagggagttttctcactgtgtcatctagagccctggtgacggctgtgggtggggagaggggtgattagggtcccatggtcccctccgtctattgaagtagcgccttcttccacagttttctgtgtgtgtattctacagatctttagaagggacctgctgctttaacaatgaaggtagaactgtgctgagaagttggtggtctttatggagtgccagctgtgtgccagactctgatcactctcaaccaggggcaattttgtctctcagcagacatttagcagtgtctggaggcatttttgtttttcacaccttgagtattgctattggcatctaatgcaatggtctccaacctttttggcaccagggaccagtttcgtggaagacaatttttccacagaccgggaggaggattcaagcacattacatttattgtgcactttatttctattagtattatattttaatttataatgaaataattatacaactcaccttaatgtagaatcaatgggaaccctgagcttgtttttctgcaactagacagtcccctctgagggtgatgggaaacagtgacagatcattaggcattagattctcataaggagcacgcaacttagatccctcacatgcacagttcacaatagggtttgtgcttctgtgagaatctaatcccaccactgatctgacaggagggggagctcaggcagtaatgtgagtgatggggagcagctgtaaatacagataaagcttcacccactcacctgccactcacttcctgctgtgcagctcggttcctacctggccacagactggtaccagttcatggtccaggtgttggggaccccagatctagtgggtaaggccaggaatgctgctgctaatcatacagtgagcaagaattgtctaatagaatgccgatagtgccatggctgagagaccctgttccatactaattcttagataaacagaggtgagaaaaacagacagaaagcctgccctcatgaagtgtgcttcagtggggtaggcagatattaatccagtcacccacgctgagtctttaatctcacaaactgaagccgcgccccgaagggaaagcacagggtgtcgggagagcagataacaaggatcccttgtctgtgagctccagaaaggtgctttttaaatttatttatttattgttattattattttttgatgtggagttttgctcttgttgcccaggctggaatgcaatggataatctcggctcactacaacctctgcctcctgggttcaagcaattctcctgtctcagccgcccaagtagctgggattacaggcctgtgcccccaggcccagctaattttgtatttttagtagagactgagttggtcaggctggttagagaggcttctgtctgaaggcagagggcaggtggagtgggagtggtgtaggcacaggttactgcaggtgcaaaggccccatggaaccagggcaagtgtctgttggaaggcctgtgggctagaaaggagagtgcaagaggtgggctgcacagtgatggaaagaagaaccaaatctggcagaactttggccatcttaaggaatctggacttgattaaactaagagctgtggggaccgtgacggctcctccagcagggtatggcatgattttattggaactggaaaagatcacgctgactgttatgtggaaaacaaactggatggagcaagagtggccctagggaaccagcagacatcgaataccacacgctttcttgcattgcagggatgggacaggggcattcccctccagaatagaaccccacttccctggggctgccaattttggtttgcgttaacagcagggtcacgctgcatcaggaactctgtcacctataaatgtcaagtcccatcctttctcccaatttaaaaaacacacaccattcagaagtaaaactgtattatatcatttcagtttcacatctgttctgtagttgcaaaataacaattccactgctgtcgttagcctgaacgaaaacagttcgacatgagaaggatgtgggcctgtctctaatttcttttttctttattgaccttttccaaggtatcaggaagcagattctctcattaagatgttgacacctgagaaagtctgtagcatatcttatttatggcagtgtgtgtatgggtgatggagaagggagtttaaaaatcaactgtcaaggcaataaaaatattatcttccttggtctattctctctctgcaatgacttctgacttctctgaatcatgaagtggatccatgcctctcccatggtctaattaacttagagggagactgggtaggaggagaaatatgtaaagatgcccagaaacacaagtttgtggagctgacacaattcatttctgattagcaacagttcatgcactcgtccatgagccacacagatgttcaagtgggttgtcttgaggtattgggaaattatcataaatttgaactcatttgcaaggatctatttccatattttacagaaaattgtaattttccctcccaagttccctccattgtgaggaggaggaatttttcaccaagatggtgctggctctgctggaagcagctcttatgagttgaggatgcagggcggtctggagttggccttggccctgcaagcagtacagagaaatagaggacacagctcctgccctccacattggtcggagagaccacgagggttcaggaaacagagatcaccaactagcctgctcaaaggttaactgtcaggaacctcagtctttgttgcttccaaggcttggtctgaactcttcctttcagccttgaccactgtgtgtgctcgcctctgaactcagattttcttactcagctgaaataaagaatgacaataatcccttcacaatgtcattaggattaaatgagagactctatgtaaaacacctggcaaatcgtatgcgtgggacaaacatggttgttgatatcaatagctaaaaaagaggaataagtataggaatgtgttgggctgggctggaggaacctgcaggtctttggaacgctctgcagcttctctattccattcaatggaaatatcattgagttttccccacacccaggccatcaatgtctctgcttcctaaagtacccgtgtgaagttgagtttcagctttggagcatgcttcaggaatttgaattggatgaataggttttaaaatattcattggtacatttcctttgaagaaaacccaggattctgggttggatttatcttgaggaataagcagtagctgtctaaaggttgatcccaccctgagatccaggccctgtggacaggcaatacttaggtcctggacctgtggcccgcgggccatattctacacaggaatatggcccagacttttaaaaaatgtgaatcctttctaacatttaaactctaggagttttcacataaaaagattttagggcctctcttgagaaaacagaaggtcccacattcccatacaagtccatcccacgttgatggagagttgccgttttcacaagattacacatgctatttggttaccctcacctcctggcttgtctattatattaatttatctgcctggcctcatcaggcattagagtttgcagatctgggggcagtggttctcaaggtgtggtcctgggatcagtggaatcagcatcacctgggagcttgttagaaatgcacattctcaggcccttcccaggcctactgattcagaacagttgacggtagggtccagggacctgtgttttagccagcccccaaggtgactctgacgctcattaagtttgagaatccttaccccatggtaagggatgagcactggaaaatgaagggaactgcttctaatgtcatctttgccacttaattcagtgggaaaatttagaaaagccactttgctttcttattgtctctgtaaagtggtaagagtgggctaatagcatggtgtgactctataattctccaggtctgtggactaagaattagtatttataaagtgctgaccatgtgccaggaccggggtaagcactttacctggattatgtcatttaacactaaccatggctccctttgaggactgattttatggatggagaaattgaggctcaggggcgtgagctgccacaccaaaggccctgcctttgagtgccctggatttatgtaactgagagctggtgagccccaactccctgatattctatttcctgtgacctgcccatgcacagaggtgtctgaaaggtgatgacggcagtgtggccggcacctcagaacaaagctggcaggtccttcaaggcaggcagaggcatgttctaccaaacaggaaggattatcaaaaatagaacgtggcagccgtggccttctccagccccagttgcaaggagccagccgtgactctggagagatgctgaaggaggcaggagatttggaaagggagggagggagagcagccaggcctgtgcagtgaataccagggaggctttgaaactcccccgtcctcagtggaatcccagccatcccttatggagtgaccttgggagagcattttaatacctctgtgccttggtttcctcatctgagaaatggggacaatccccacttcacaatgattgggagcaaacaggttaatgaaaagcatctgggatgctgtaaacagctgaacatgtggtggctctcaccagtgctaggaaccttgcttgccctttctggagagctctagaagcaccttgtgctgttgtctgtgatgatcggaaagctgaacggtttctgaccatgggaacagccttcctcctccatctgccttgtgggctccagttgctcagaatgcttcattttccagacatcttgtttccttgccctgtctcttgtctgctacatgttctaacttctttctcccttcagaaatcctctctggggtctatccaacctgagaatggctggcaaatacctctaggaggatttaaatcctgactacaacttcagaggtgtcttcttagcatgaccaggacaaaagagcattcacagggaccctcaattctcagattagggaaccgactgtggtttcattttctttctcttggccccagaagaatcctctgacatggttaaaaaggtgtgggttaaaagcagacaggctggttgtgctgcagctgtatgagcttgggaaagtcatgcaacctctccaggactgtgttatcattcatacaacgggtcaataataccatactaacgccttagcaggcatataccgagtggtagttctcttctctcctctagttagaagacatatataattttgggcagagagctcaaggggagagactggaacaaatttgaactctttgggtctcagagtgaaaaatcagtgagaataaactcaacagaaatgctaacaagtgttattaattgagctgttacttcgtgcctggcacagtgccaaacactttgtatgtgttgtctcatgcaatcttcccaggcgttcttttttaattagggagatagtattgtgctcatttcgaaggtgagaaaatcagggctcagagaagtgaagtctgttgcccagagctcacagctactaactggctgagctgcatctgcagtggcctcttcacacgggtactaggaaggagtagaacggaggctggatgtgctcctcccgcttaaaaatcattctttcagcctgcagaacacttgcctctggttctctcggcccccaaggcttttcttcagcagccagcacctctggcttttgcttattgtttggattcgcccacggcctccgtcctttgtgcagcctgatttttcttgactcgtccttatttgcataagagtctcccagaatattgatgtggctcttttccagaaaagcgagcatcccccacactgctggctccaggaagccacatgagcaggccaggcaggctccagccctggtgcaacaccccggtgccatcccctcctccctgcttccttgcatccattcacagaccatcagctgagcaaagctcctcagagccaaagctgtgtttacccaggaagccccagttcactctggcaggccatctcagcacagcaaatatgaggaaggagtgatctaacagtctccctgcccttgacagaggaggggcctcaagctcccagtcacttgaagagaaggccaagcctccagccctgtaggattattctggactgccacagtgaagaaagcagtgttccagccccccacatccagcccagccaggggtatccggaggcaggcatctgagggaagtggtgtgtttgctctctaactgggcgactgagggggacgagtcacaggaagtccaagaaggctcttccaggagctacctttatgtttcttcatgtgtgttcttagctggttttcatattgggaggaaagggcaggagtgttttggaaattgatctttaccccagctcctgtgttgggcattaggtgggcagaattccagcaaaacactgcaaagaactgggggatctggcatagtcactcatccattcattcattcattcattcattcactttttcattccaccagtctactgaggactcattgtgtatcagccactgtttcaaggaataagataggccagttcctagtctcctggagctacgttctaatggggtggggacagacaataaacaaacctaatagaaaaataatttcacacagcgataggcaatctgaaagtcacacagtaggatcctgtcattgagagtgacgtggggctgagggagactacttgaaactgggtgggcagtgacatggaaagggcctttaggctggacctgaatatcgagatggagccagctatgcaaagatctggggagacagtgttccaggcagagggaagagcgtgggcaaggccctgagtcaggatggagttttgccatatgggaggaatggaatgaaggccagggggtttggagaggagcgctgagtatacccatgctggagtgagtttacaatgtatctggaactgttctcaatgcctaacctgcaacatacgtttatctttacacaacactatgactccctgttaccattttggaaacttaagttcaaagagattgtgcaaacttccaaggtcacacacttaatcagtgatagagctgtgatatgaactcaagcagtctgataggggaagctgtactcttaacctgtacattatacagtcactgcaaactcacttgaatgtattaacaaaatgttccaagattgtgaagaggagatgggtcttggaataggacagaacattttccaaggggaatgaggagggacctggcatttgttgatggtgcctaggctgagtgccaggcactgggctgcatgctttctcatccattattctgatcccaaccctccaaggtagacttcattagccctgttttacagatggtgaaagcacaggctcagagaggtgaagcttcctgcccagggccacgcaactaatatcagattgaccgagtgagggttcagggcatctgccctggcatctgggcctttctgaccctccacattaagctgatgcttttttgtctcattatttcttattcctctccctccaaaaatgaaaatgaatatccccaaaaatgtaaaaatcttaacagtaagtgcaaacctgctttagggtgaagggaatggcgggctgtcagcatgcatgtattgttcttcaaattacctgttacctagaggggaggagcaggaccagatccttcactgtcatggtgcctgctgggtgagcatgagcatacataaatacatacagcataaatacctacagcatacatggtgcctgctgggtgagcatgagcatacaggcattccataaataaaaagtaaatgtcacaccgtgcagtgccgctgcgttctgcaaagcttcacccaggggtccttgcaattgccagaagcagggtcaggatttgtcattcttattcctctcaggcctttcctctggggctgatcctaccttcaggagacccagagagctcatcttgtaaggcaccgagagaagagccaggccaccattcggtacacaccctcttcacttctaagcttaaattctaggtgtgaaaatttcatccaacctcttctcttcattcattcacttgacaaatagttatttgtctgctgtgacctaggctctgaagatactgtggggaacagtgcagatgaaggccctgctctcacagagcttatattttagtagagggattcagaacgttttttaaaaaaaggtaaacaaatacacataagtgttatgaaaaagataaaacacagtaatgacagaaagagatgggtagggggagaatgattatttgcacctttctctgttttttcatacccattcatccatccctccctttctctgtccactcattcattcatccatcccctacatctctctctctctctatctgtatatctgactatcatctacctacacacacatagaaacacatatacatttatagattttcatagatctctctttatccctccctccttcccttctctcctttcttattccttccttccacaattaatttttttttttttttttagagacagggtcttgctctgttccccaggctggagtgcagtggtgtgattatggctcactgcagtctggaacttatggactaagcgattctcccacctcagcctcccaaccagctgggattatagatgtgtgccactacacctggctcacaactactttctgacacccactcagggccagttcctcaggatggtttgtctcttttttttttcttcagctccccagtgactggcacctggtcattcgtccctgcctcctcagtagtgaacatactgtttggcataagggcaagcataacaagcatttgtgaaattatcaaattacaagaatatcctatacttttttatatgcatccagttacaaaggtgcaatagaagcctctgcatgtcctcccaaccttagaatcaccacgttccctgatatgaaggatgattattaaaggaaaagcagagcatgtggataaaagtgtatagccctgtattcgaatttccttggcatctttttgaatattcatgcaaaagtcgaagactgttccatttatgaatcagtttcctgattatcaattcaactccacaagcatttgctgcacgactactatgtgcagaatgtggtagggatccattgaagatacaatccttgccctcctgttctttacttcccaggagggagatcataataatgtggacagaactgtaaatagaggcacctgggaagcctcatggaggcccatgagaggagagatcccattccatgttcctggggctgcctgaagggatggcttttgagatttttcttgaaggagatagcccattagcccagtttggctgaagggaagaaggaatcaatgaaaagtgagaaataacttgtaaaagtagctggagcctggaactccatactgaatggagactgaatttggaggcgttggtacccagaggcgggggagcacagcagctttttaatggtgggggtgatgtgaaatggaatgccatgatcaggttagaatttgatttctttgggctgtggctcacagagtaaatagcatgttcaatgtgatctttaaaataaattacagagatcaaaagggaacagagtaggagagtttctgagtgtacacagaggtgtagcatttcagattcatttaattaaaggagccaactgagaaggttgtcaccctgtcatttaagaatttttgatagaagagccagaggtttcatttttgaagtggcaaatgcaaatagactcttcaccatacatacgtgctcatatcagttagtaactcttctttctcgattttcttttatagttaatactggcttagattatcctctggcaggattcacatttaccagaaaaacacaacctcgcaatgaaggagggttctgcgtttgaggggatcacagatgcttcccactgagggatccagtgccatctcttctgaagcatgttcaagcccatctggcaccattctcagtagatggtggtggcctttctctccctctttctgttctactatcatgagatgagacaggagccatcgtggaaggtggttggaagcttggtcactggagccagcctgtcagattcaaaccccagctctagctccatgcccctagagaaagttattaacctttctgagcctcactttcctcataagagaacaagcagaccttcctcatagggttgttttaggattaagagcattgatatatgcaaagcgcttagtgtctagcatttactaagcactcaaaaaacagtagtattatctcagcataacagtctttttggactttcaaacaacagaagctttctcaagacaaacctaggtaaacagaagtggagatcactgtgtgaaccagggttgagaggcttgagttttgggccacacaacatggcccctctcttgtagcaaagaagtcattctctgggggttgtgtcagtttctcttttggttttagttcttgcacctggatcatgctacagattttctatgtgacaggaggcctcaggtgtactcttttcccctatgaagtattttgtccaatgttgtgttcctctgggaattttgtcgttattcctggtaacagccacattctttcacagcatcatttgatctcttaagattcgggtgtatcaggaccagattctgtccccagctctatgtgatgaaccaccagcttcagcagcctcctctcacagtctgggctgcaggttcttactgaggctgagccaaacactggcagcccacggggcagatgtggcctgtgatgttttgactggtcttcatgatgttggctcactcaaaattataaaattaatttgaatttgatgagactatataaaattgggcggttgaatgtaaacatttagatttccagctgctccgaagtcagattagccagcgtcaccggtcctgcattcccacaccacagtgattggctggagctgatgagacctgcctgccttatctgggacacggtccccaccaaccctttccctccctggctgctctgtcattctcactcttgcagggatagagtcagggcaagagaaaaggggaatggttcttatactcattcctttatcaaatgtgggaagactttgggctttaccttccctagtgtggacagtctcagggattctcccagcttatcttctttggtcctcttgtttgtttcacggacattccttctgatgctgcatatgtggccccagacagaggattcttaatgcttccaaataacacaacacatggtggagtcagggcttgaatccagatcttctggataccattgcagaagatatctgccccttccccacatagtcttctggcttagaaattcttggctaattcactcagagcctgctgtgtgctgcctgctccattctggaggttcagagttggaagacatggacacctgccttggatcacaccctgatcagaccagtgcacccattcattcaacagatagttatcaatagaaatcaaatgtttggatattgagaatagcattatgatgagggtccagagtatgttattaataataatggtataattttgagcttctgttatatacacaaacatatgtatagctacaccaaggattgtgctcaagttttgacttatattagcttgtttaagcctcttccacacactatttaaggcaggtactattattatcatcattttatggatgacaaaactgagaagctgaaaatttaggaaacttgcccaagatcacacagccaagaagcagacaccagaaccagagccccaggctcacaaacttcactaccttgactcctaggctctatgttattctgaccatctctcagccaggaagtcactcccttttatacaaatgacattgttggtgctgatggttaaatatttctattctcacaacatgtgaaagagagatccttgtgatttgttacctaagccccaagggtttctcctaccatttcagagagatagaagcttttctttgcccctgaactgtgactaagaaaacagaaaggaggaaaaagccatcagaagactaaaaatctctcatctttgcaaataagaattcactctaaccgagcttttttgcatgcagcactgggaagagacctgttttttattctatcaactcgtccgtataacaatttattgagaacttgttgtgtacctgatgcactgctggcattgggtatgtaaaaatcaatgcagcatggtcctttctccaagtaactcaatctcctgcttggttctctttcctggatcattttaattatggctcccctttaagtaaaggacaaacagagaagtagcactgagtcagatttttgccgctggtcttatgcaggtgacctgtttttcttaatgctccccacacatgggatctgagccagctgagcccagaaacctcccaggctgagaaggtagtgtggcacttcagcacatgagactgtacaggagtcaatacaactgacatgttagccacagaatccctgctaagagctctggaatagaagggatgcacagcaccccacctgcttttcctaatcccgtggatatcatgctccagccagccttgcccctggaatggagacatctcaggtaggggttgtcattgttccaagcttcgtttgatgccgtttcaatccagggtacagagttgccacatggagagtgaagccaccagaatacataagtgagaaatgaatggaaagatggacagatacctagatagatacataaatactttgcagaagtctgggacagtggaacataggaagagagcctcagatagggagaaaacagtaggttgattgtggtaaagggaaggcttcactttgttattcaatatacttatttattgaattgtttaaacaatatgtatatctttctaattaaaagagaatttggggccaggcacggtggctcatacctgtaatcccagcactttgggaggctgaggtgggcggatcacaaggtcaggagttcaagaccagcctggccaacatggcgaaaccctgtctctactaaaaatacaaaaaattagctgggtgtggctgggtgtggtggtgggtgcctgtaatcccagctactcaggaggctgaggcaggagaatcacttgaacccaggaggcggaggttgcagtaagccgagattacaccattatactccagcctgggtgacagagcaagactctatctcaaaaaaaaaaaaaaaagagagagagagagtttgggctttagaataagactggagtgtgagtcagtcctagcttcctctatttctgagagttatgtgactgtgggcaaattgtttcagatctctaaacccgcaattcccttgtttatgaaatggaggtcttggggattgaatgagattaagtcctgtataaaatgctgatggagctgtcaataacatcagctttgcattattattatttgcattattaatagcattagacgaggctgagagtcagctacagaggagacctctgtgggcagaagagttcacagaggaggtagcaagtagtggtagagccagcaaggaatgggttccatttaatgcagcataaagtgaactcctcattagggacatgcacctccctcccttctcaacctgccagcacttgttttctcctcgggagacacctgggatggcaagcattgtatatggtaaggtggctaagagcatgagccctggcaccattggttttccattctagctgtgccacttacttgttccgagttagtttcctcatcagtagaataggaatggtaattgtaactacctcaagaattgtctcaccaattaagtgagttaatgcatggcaaaggcttcacaagaggctggcacagagtaagtgatttataaatatgagtgcatattctatactctggttctagagcaatcctaagactttcaaagaccctgaacactcttccttttggagatttcaccccacattttatcaaacatactgaaagtcacccacatttcacattaattattattgttattatttgctgtagtatgtttaaaagaggttttaatgattttgcttttagaagtgtttggctgtgactaactcatggctatgaagccttagcaatcgctggacatttttgaaaatcctttcgaagtgagtgattctaaggaataaattgtttttaagtgtaataaaatttttatgaacatcaaacttaacaattaatgatgtttatataacattccattatgtagacatttaattaagcttttatctattttgatttttcagttttatctttttgtattttgaagccccaaaaaatgtgttttcagacctcaggtaaggcaatagatgaaggcagtcaggcagggaccagaaagacctcttggccacccccctgaagctgtggttcagcagaatcaggcagagcctgggtgcagaagggacccataagcttatccatccctgttcttctattttatgaaagggataactcaggtccaaggaggggagtgacttgcccagaatatagtgcagtttggttctccaaatgcagaatcctgggccctttcaaacttgttgttgttgttgtttgtttatttgtttttacatgttccaagatgattttcaaggagtggctctcaaaacccaggggagtgacctcatgagaggtcaacgcagctgatgctgggaaggctcatacaggtccacccaggctgcaagtgtgtgtaacccaatgaccaaatcaacagtgacttgaacccacagccaggggagcgtgggtgaaatatgagcagacgttttcaccagctgttaaaacctagcaggggcattaggaatcaatcgcagactgtgcctcctgtgacttggcaaacctccatgaggaaggctcaagggattggaagagcagtcacaggtctccaccagccaagagcaaacctgagcagagctaagcacttttgtgccctctgaagcaaggcaaccccataaccttgcagagattcaggaatgatggaagctgaggagctacatggccatgtcaggaggatgacgagatcgccaggcagctgccatcaagttagggttcagagtggtcctgcaggagaaggggagatgcccctgcccgggaccacacaggacagaagggcatctggacagtgccaggccatgttcagaaagtgaagtgcctttcccataggaaggttctgggcccaaacacttactgagcacctactgtgtagctggcatattcaataagtgttaaaggaagggagagagagagagagactgggagggaagaaaggaggaggatgcgcccctggacagtacgtgctgtcactctgagtctcctccaaggccagtttgcggcttctaccttacatctttatacctttgaattggatgaaatgtattttctcttggtcattagggcactgatgcaaaatttcagtatgaccttgttggttctttccacctggtccttaaggttctgaggaccgtgtatgaagcagtatcatgcaggagaagaaggcaggcaaacctggttttgaattccagcctagccactatatagctgtggaattacagagacattctttaacctctctgaaactgagtttcttcatctgtgtaatgggcactaagaaatcctgcctcccagggctttagcaaagtaccaacacagtccctgctacatagcagaggctccatcgattcagttccttttcatgtctcatggtcaaggtggccttgcctgaaactaagacatggctcattgtactgctcaagtcagaacaagccaagtgtgctttgggcaactaatgtgcctaagcctgggtcatgagagtcctaaaaaggaacagggtgtggctctggagctcagggaaacaaagagtcaaatgtgggggagacatagatttgaaaaaaaaaaaaaagagcccaggcttggggtctggagtctgggttatcttcctggctttgccacaaatttgctgtgtccttgattaagtcacagcagttctctgaatctcagtttcctcttctgtcctgcaagggcaaaacttgatggtctctaagattcatcctggttgagcaagtgctaagctgcatagcacaaatttcagatgcttctttaagtgtgtgcaagaagaacattctcagagatagttggagtgcctgggagcggctagaaaaaattagggaaatgatgccaagatttagccacaagtgatactactaacttaagaggctgctcctgatctcatgggggtcttaaattcttccctccagtccctctctcgtgggttgtattagaaagattactgcagcgactttaagcacaacaggttggattcagattagatttaaggagggacttccaaacaaatgcttttgaagacatgagcttgtaagtgaacagagagaaaggtatcatctaccttttagaagccttaagatgctgggcacaggtatattttgcattcctgaaaagctatctgctaagaaaatacattgactcaatcttgcttaaaatgcattggagtgttcactatttaaagtcatggggatgcccttaaattcacctgtttataaatacaagctttgttaaaccaggttcttaaagtgaagtttccctagctggatctctctcacaaaaagttcaaatgtaatctttctcagaggcagaaaaataaattcattttcaaggttcctttcagacctatgggtccaggaatgcatcaaatataaggaaaatgtgtaggatgtttctgtattggccaacatgcctggtttctgtccctggagggcctgcagagccagcactgtcttccttgagtatgtctcaatcatgaacaccaggcaaaaccacaggagcaatacaatggtatcattgttctggagagtttattctggggcttactagatgttgagtagaatttggaatcccatttgacttccatttactctgcactttgtactttgcagtaataagactgtcagtgccatgagggcagggactatgtgtgatttgcttctcattgcctggtatggaatgggtactcaataaataatggtgaataaatgaatgaatgaattaattaaaatggacacatcaattctagttgactttctggcctttagccagggacttaactgctctgagccccagtttctgcatccatagcatggggatagtaagagttcctactttgtaggattgtcatcagaattcaatgagacaaaatagacaaagtacttagcacattgtttagaacgtaataggcactcaaccaatgttagcttagtactactttttctgtgtaaaactatgttgtcctttccacagccctgtaaggagaagtataccattcccactgaacagatgagaaaactgaggctcagaggtgtcaggtgactgctccaggtcacaggtgggactgggactccttggtctgcctctttctactgctaaacagtctggtgaaatcacagaaagactcattcctggtaatgagacactagaggcaatgcgcgaggaagcctcaggaatatttggaaacccttctgagtttttcagctccccagagtaccctggctttgtggggtgaagtcctttgattgtctcaggttcctggtctgttcatgaccctgttagcccaaaagctggtagagctccatgtactgctactgttctttgtctccctgactctcccctgctccccacctgcattgccttaggcatttattatttccttaaacatgcctatttgcagagacacactgagctaagcagcaaaagtggaggtttccagtgggaagtccactgcgagggagtagggcgtcaggagaggtcctaccagctcaccttgactgagatgctcatatgctgtgcttttgaaaatgcaagcagtgcaagaacatttaaaattcacccaggggatacgttccctgtgtggaaccaagcaaacatgagtgcaagtgtgaaacatgacgtccacatgcacatagaaggacaaaacacagtctttgtcaacttgattatctaccctgtggtgagaaatgagggcctggctaaatggaacacagataatctggaaactttgttttgcaaaaaaaaaaggcacctaccccatttatactttactgcactgttattaataagaagcttatgaatctattagatatggtctttgccttccttctccattctaagcttgggtttctggggacagtgaaaagccccaaaggtgggaaaagcaagaggagggcaaacagaaaatctgcaaactccatcatccgaataacagggctgatggtttagaatgttctgcttgaaaagctggtgtgcatatttaaattacagctttccatacacagaaagggcagctgttaccattagcccagccccctttccgtcttactattaaaatagaggacaaaaggggtgctttcttttcctgggtttctttttttttggtataaatttacaaaatgtggtttaaatattgattgtataggaacaatgtcacattttaagattgagtgttaggcgtggagctctcttgaagatggttaagtatgtattaaggccaggaaaaaagctggtgtgcagcaatgcccagcaatagagggcattcaggcaggaggggctgtcattcatcagctacccagtcaccctcataattggttcagggcaaaggggtctcaccttttcatgcttctctgttttgccaaaaatacttaagagagtgggggaaaaacctagtacgctttgtgtctctcaaagacaatgtgttttatcagcattagcaactcatagttggctaaggaatgaggcaggttcctagaatccaaatcaaacagctcccgttagtaaactactaacttataaagtatttaagcctaggactgggcagaaacaacatatgaaaatgtaggtagcattgcagaatattctgatgagtagaaatcatgtataaaaagcacaaactggctgggcatggtggctcatgcctgtaatcccagcactttgggaggccgaggggggcggatcatgaggtcaggacattgagaccatcctggctaacatggtgaaaccctgtctgtactaaaaatacaaaaaaaatagctgggcgtggtggtgcacgcctgcagtcccagctacttgggaggctgaggcaggagaatcgcttgaacctgagatcacaccactgcactccagcctgggtgacagagagagactccgtctcaaaagaaaaaaaaaaaaggaacaaactattcccaacaactctaggggagtccagaagatcattctgcagaagtagaactggtgtgatggcttgatgttaccaaaaagaagtttatggttcaacataaggaagaactttctaacaattctaatagtccacagggtgatggaatttctgattaggtagagatttctctctctttggaatcttgcaagcagaggtcactgaatcttttattgggaatgcttcacagaggatcatgcataaaggtaagtgttggactaaaggactttagggagtccgtccagttctcaggtctccaactgtgtgttacttggccttgactagatattttactaacaggtgccatcctagttattccacatccttagagtcatcgtagatctagagagatctagaagtagttctgtggaaaccaggtagaatgctcagagggcaaaataggaaatacaacaataggatggaaaagaggtttggccaggaaaagaggaaacagaagcacttcagagagctgagcctgcaatatttggaaggggtgcaaacagcttgtttggtttctgttgaggtccagataagagtaaataggttaaattaaattcgaccatgtaaagctagatcatcagaggcagagtgtcggatctcaggctatcagtccctcaaagaactgcctttattgaaggtggatgagggaacggtcaggttgaggagcattttatgcttttgtgaaactgatgaaggcaaggtctaccctgcctctctgagttcttttataagtacccatgataaatttccaccagtgtatagttccagaggaggaaataatgtagttcctacagaaagctgtgtatgccttccatgtcaaaagataaaacctctgtacatgggtatctttgtttttcttagctgttagagaattcagagacagatccttgggtatttacatctgctcatttatggtgcctgaaaggtgctatttctggttcttgtagcagatgaactcatttcaggccattgataatattaatatgtcttgtttttcagcctgccattcatctcacatcttttgggaagtgagtaggctcaaatctcatatactcaagatgaaatggaataaaaaggaaaattattgattagaaagaaacatgaggttctaagataggttttcaaggtggattggaggatttctatcacttaaaatgaccaataatggagggccagccatttgactcaatattcttggccatcattagtcacctgtacttgtgtggtaatattcgggtctctatattgttgtcccctcctcccacaatccatggttttactttccatggtttgttacttgcagttaattgtggtccaaaaatattaaatggaaaatccacagataaataattcataagttttaaattgtgttctgttctgagtcatgtgatgaaatcctactctctttgcctaggatgtgaatcatccctttgtccagtatattcacactgtacaggtatgcatgcataggaaaaaatcatagtatatatagggttcagtataggctatgaactgaatatatatactagggttcatagtatatataggttcactatccatggagtcttggaacatatccctgaggactaagaaagacgactgtaactatcatggtaaacaccccagtatattgcatgagtgagtgatggtagtgagacactgtttaggtcaacctgttgcccatttgcaatttcatgcatgtagggagatcagtcatatgtcctacaattgtcattggccatagatgagggggcataaatgggtagccccccaagggcaattaatggatcatcatcatctctaacatttccacacctaggataaatgctgtcagagttctggtatctgtgaaggtttgtggaattaaattaagatgaatggaatataattgaagtgacttgaactacactgaacagaattaaattgaattgcctagtcttgccttgcatcaggggaatgtattacctttgcctgctaatcaactctaacaacagtgcaagaataagtatagcatgctgagcataatgtttgaaatttaaacgtgttcattttaaaactattgactgtgcaccttttacattcaggcactgtgttggatgctgggaaaacatggtggactaagcagacatttctctgcctcaaggagctccacctaggaaaggagacaagcactaaacaagtcttgaataaataaatatctaattaaaattgtgacaagtgctaagaaggacaagtataaagttttttaagaagaatagaagccaggccgggtgcagtggctcacgcccgtaatcccagcactttgggaggccgaggtgggcagattactagaagttaggagttcaagaccagcctggccaacatggtgaaaccccatctctactaaaaatacaaaaaattagctgagtgtggtggcaggcacctgtaatcccagctactcaggaggctgaggcaggagaatcacttgaacccaggaggcggaggttgcagtgagccgagatcgtgccactgcactccagcctgggtgaaaaagtgagactctgtcccaaaaaaaaaaaaaaaaatggagaaaaagaatagaggccagaacttactagaacaaaccaacttgtccaacttggagaaagccagtgtgtctgagcagagtggtggctgatgaacctgggctaagggcttcacgctttattgtggctaagtagagatgtgagtaataggactgggtttttaaaaagtctactctggttgctccctggaggggagggagcaagattggaggcagaggacagttaggaggctattgctgtagtataagggagacatcgtggtggactgacctggggtggagagaaaaggagagagtctggccatatgttataggtgcagtcagaaagaacttggtcaagagttggatatggccagtcagaaaaagtggtaaagatgtcaaaggtttccatagaggcaaccggaaagtgggggaggatggaggttccatttcccaagagaaagaagagaaccagatttggggtgagcaaaggtgtgaagatgaagaattccaactgagcatcttgagtttgagatgcctgcaaacattcacctggagttgtcagacaggtagttgtgtctatcactagatctgcaaatatgtgctgaaagcctaacctgtgtcaggctccatggtgggttagacaaagaggttagacaagatccctaacctctaggaacgtattgtctgttgcttgaaatgacatattggaaaatacggcactaaaaagtagggaatgataactcttagagagaaagagaaggaaatagggcataccataggagttgaaaggggaagagagcactttctgctgagatggcaagtgtcaaggtagacgtcaaaataaggagaaagggtatcgaggccagactggggatgaggcagaattctccttgcccagaacagagaaagccttagctcccctgtccctgcctggctatattctgcaaatacccctaggccaggtataggatgggaagtggaagggtaagggtggaagctctagctgggctaaggccaagggtggaagaattgacattttgatgcttaagtggggctttgggactctctttacagttacagttcccatccctgaaatatctactgggttcccctggaatatgtgtttcaggaaactacaccttctacccctctgctctgtgttcataaggtgctgtaaccaaaagagagtttgggaaggcctgaggatgctcttcataatgttgcctctttaaagtggtccacgtggggtgggtatcagtttatgtccatgaactgatgagatggatgatgacagatcccttattttctctaaatcaaattaaatccaacccacagcagccctgacctgacttggctggcattgacaggaactcaatctcagcctttgattaggcctccatccctctctgctccctccccatccagagagtcatacaaaagtccctggggacctatgcttagcagtgcattcatggtgactcctctggtcctaggcccattgtggtcactgctgatattctcattgtacaattgtgcatgtcccttagagctggaggctttgctggtttggtagtgctgggcccagggaccagccatcacaggggcacttacacagccgttcccctccggtgcacatcaaagcaggagttactgatctttgctacccagaatgttaacccaccccctcacccagtcttgggagtctcttttcaccctttctttgcctcagtttctgcctcttcctccctaccagcagcatttttccctcttccttccccctagcatcattcactcactacagatgctctctaaggccctggctcttatccttgagcacccagcagagtccccgggaaggctggttgaacatagaccgctgggcctacccctagatgctctaattcagtgggtgtggggtggagcctgagaatgtgcatttcaaataagttttcggatgctgctgctgcagctccagggcccacacagagagaaccactgcttcaaggggagggagcaaaagtcctaccctcatggaagtggcaggattgggggagggagaagggggaggagaattaaagaaaggttgaggtacaaataaatatttccaccaccttccctgccatctaccacctcctgttgaatgatgaaattctactgaccagaacataattcagatgcagatttgggggaactcatctgtgtgcagaggaagacccaggagaattacattctgtgctttatcctcggtgaccacaggccttttcttagcctggagttcaggacttctggattgggactcccggactctggcccccatcaggcagtttccagaaagttgctccgctcccacccccaagctcagactataaatttcttttctgttgccttggcctgtcattgggaagactggcatcatctgcagaatgtatttgcaagtaaaatgttcaagcagcaggagagaggcctgggagggggcagctagacgcagtgaactgtgtcagacaggtggctcatgggagctggcggccctgtggccagctcttctgctggaatagaaacccagcatctccgcctggagggcttccttttgccacttttctcagtgcccagagaaagggccacccttgaaggggccatggtcaaagttggtaagccaaaagtcagcccttctgcctcatctcccagcagcagtactataccaggtgatcaggctggagctgccctgtcttcaaatcttattggtgccatgtagtagctgagtatagtttcagatgagctgcttctcccctcggagcaaaagtgtcttcatttgtaaaaggtgtataataatggcatctacttctcaatgttgcttggaggattcaaagggggaactgcatgtaaattgcttagctagtatctggcacatagcacatgtgcaaataaaggtgagtctccgtcgctcatgactattattctgttctgcatattggcattcatatctgttttcctcatggactttgagctccttgagagaaggagccaggtctgattcccttttgaatcaattcattcaatcgccaaacatctgttgaagccctactgtgtgccacttgctgtgctaggggcccatcatccattgctgcacatagtatgtaagtgttacttgatggttaatgagtgaaaggggaggattgcagagaaggcttacaaaagatacattttcttgaatacccactgtgtgctaaggcaatgctccttaaatttccatgggcctaatacccacctgcagatcttagaatcacattctgattcttcagctgcgggctggggcttgcagttcttcatttctaagaagctcccaggtgatgctaatgctgctggtccacaggccacactctgagtagcaagatagacactcctttgcattatgtcacttattgcttgcaaaacattatgggatgagcttagaaatgagaattcatagagattaaatagcttgctgaagatcacacagctggctagtgttggagtcaggtcagcatggctcatttttgtctattgagctcactcacccttaagagcagtggttcccaatgtttgccacatattaagatcacccagggagcgttaaacatcccaatgtcgggagagctggtggcaggtaattctaatgtgcagcagagtttaggaaccatggcctcagagtccaacctcatccaaggaacaagaaaggaaaggagaagaattttgacatctctctaatttcaggaaccaattatagactttcagaatttggaggtctaggcctcttttgatgttacagatgaggaaactgaggcctatagaggttaaaatattcacccaaaatcatttaactcattgatggcaaagttaggactagaactcaggcctctgggctctcacctttgacgtggttcctgtgctggaggaggaatccaggaacagattatccactggaaaaaggcttctccatgctcctccatcagctgggaccttggagactcaaaggagacctaggtttccctaggatgaaccagggaaaaatccactgccttccgaagagcaggaagttttcctttgcaatattctgccaatctcgaaatggcaatgtgcaacagaacatactttgaagttgtaaggcctttaaaattccaagatgaaatatataatcccattatggtaggagcataattggtggcttgatttagtgcagtaaggatttattgttttaatcataacataatgtacattggttggttgcttcataacaaagataaaatgggctgcaaatgtgtacagtaagattattttggggggcgggggttgaggaaatggcatgactcagagtttaaaagccccaaatcttagctgtgcctgtgtagctttaccacataacccattgataacttatccctatgatgtgctggtatgcttaagtgtaaccatttattgagcacttattctgtgagcagaatggcattatccacttagggaatgtaatcacattcaatctatataagatccccatgaagtcagcattacttacagaggcctgcacagcaataattggaggagctgggatgcaaattcacctgtgggtgaattcaaatcaccacactcagcataggacctggctccatacccttattttacaggtgaggaagaggaaggaaaagcaatcctggcacacagggacagcaagtggcaggacagagctgagactatggtctcctcactctgggacaagtgttgtttcctactacctccatggaaaatgaggccggaaagaatggccaggactccatgagctgttcccctccctactcaggctccagccatcatgcaatgaggaggttactttccacacagatcagactttggtctaatgtttttgaggaacctattcaacgaaagagagcccttcaccaatccatgcgccatcaaattagacttaaattaacacatgctatgtagatagctactttcccaatctgtgtcccactgattcttccatctgagaccatattatatatccattcattgagcaattaatggtgaagtacctcctatgtgccaggcactgtgccaggtgctagggataaagagataaggagaaagtaggacactgagccagtctctgccttcctggtccagaggtggacagagatagataaagtgggttcctgaaaactgccatcagtgccatgaaagtgatatgcacagggacatgagaactcagaggagggccctgaccacagctagtggtggagagaatcccagaagcctttccagatgaagtgatttcaaatacgggacctgaagttcagtagaggtgactatgtcaattgtttaaaaggtaggtagatacatgtgttggctcagatgctgaacaatgcttctggtaaaggcaacagcatgtggtcaggctgtcagaggtgatcagaatatgatctggatgtgcaggttggaggggaattagtataagttctgtgtggccggatgataaagtttaaagggaagagtaggaagagtggaagaaataaggctgaaaagggaagagggaccaggtcatgcagggaaccgaacaccatgctaagaggtttggattttgactctgtgagtaagtggagtctattttagtaggattgagatttagtctcatttccattatagagagatcacactctgactgcaacagggagaattgattagaggggccagagtgggaagcagggggtgcgtttaggaggctactgcaataatccaggtactgatgatggtagcgtcaatcagtgcagtaagagtgtagggagagaaatgaacaaactcaagacaaatttcttttctttcaagaaaaatttctaaatccccatggcttgtgatttattgaatgtgggaggagcgagagaaagggtggaacaaaggactatggctggattactgtcctggccaaagtggctggttctgagaaggagcacatggggaggaggaagaaaggtctgagaggggaaggatcatgttgacatgttaatatgagctgcccatgaggtggaaatgtccaggaggaagttggatgctggatgcataagtctgaagcttcaaggagagaaaaccttcctggaattctctttacttatcagaaaagatcccaaagctgacaacactttgtaatctcatgagaaatggccaaaagaatgacagcttgaccccaatcatgggctggttgtttcagcttgtaatatggctcaaggcattcagctaagcttcagtggccctgtgggcactgggatagctgagaagacctttgtcctttaaaatcacagcaaacgaggcagtccttttaacctctttgataggagtccagccactcccctccttgagatatttttactgagtgctttctatgtgtcaggcattgaggatacaggattgggaagaaggttcctgcccttgagtttctccagggccagtggggacagacacatgagcatatgattaagataccacattacaggtggaagaaacattggggggtcaatgttcagggggcccaagtgttcttcgacttcagcatggtaaatatccctatggagttcgtgcagatacttgtgagatggtttttgtttttcattttgatgaatgattgcaaagctcacaactgcagagagactgagtcttcgaaatcttcacatttttcaattttatcacaattttgactcccgctagttattaggaagggtactccctgggtcagctcacttgatgctgtgttaatggtgatgagcaaaataaaaggaggaagaattgagtgtggttagaacacaaagatggactgccctgttctacctggcacagggagaatagagaaggcttcccgggagaagaaatggcacttgtgtgagtctttaaaaatgaattatgcattttaggaggccaaggcaggagaatcacttgagtctaggagtttgagactaccctggataacatggtgataccatgcctctacaaaaaattttgaaaaatagcctgatgtggtgacatgtgcctatggtcgcagcttctctggaggctgaggtgagaggattgcttgagcccagcaagtcaaggctacagtgagccatgatcatgccactgcactcaccctgggtatcaaagtgagactctgtttcaaaaaagaaaaaatggccgggggtggtggctcatccctgtaatcccagcactttgggaggctgaggcagatagatcacctgaggtcaggagctcaagaacagcttggccaatatggtaaaacaccatctctactaaaaatacaaaaattagctgggtgtggtgtggggcacttgtaatcccagctactcgggaggctgaggcaggagattcacttgaacttgggaggtggaagttgcagtgagccgagatcacgccactgcactccagcctgggtgacagagtgaggctccatctcaaaaaacaaagaaaaaagaaaaaaatgaattggacttcatttgtgtcagagagagcatccatggcttttgcaaataccaaatagtgaagagaagttgagagcaggtggtatgtaggagagtggggagaattcagagtggacagctttgcatgccattctgcggaggcattccctagaggggagtggcggaggctgtaggaaaggtcacacgtgcagtgcctacagggtccaggcagataacaacagtgagagaactaggtggggtgaccaactgtcctggttacctaggactgaggggtttcccaggaaaagtctcccagcagaccaagatgagttggttaccctagaatgaggccaggccttgcctgcctagaaagggcctgctctcttcagggggcagctccttggaaatatagactgggattgctggatcttccaaatgtccaagagaaactgaatatccaaaattcaatgcaagttcttctggtttttaattgttgacaacaaattcaaatgttttaaaaacatgatgctggtcaaaccaagcatttctgtgggctatgtgaggcctacaggctgcctttttgaggatctctggctacagtgatgtaagtgaagcctcccatgtcccaccctgttactgccctgaggccccttaaaggcatgttcagatgattttcattatgcagagtgacttcagtgatcaatcgtttggtttttaatttgatgttcttaaccagatttggatgccgtgcacagaatgtaatggatcaaagtggcaatgaatagtggtaatagggacatgcattccatcttttttttgaaagacaaaataattgctcaatggcttgttctgccccaaacctggatacctatttggtcagaaaagtaaagaagaatgtatttctcaaatatcagccttaaggttcatttatcctgggcatctggacagccccctggctgaaataaggctgggaaagaacaatcactttgtttgtaggaaacttggaaggtcaggggactgctgtttgaaggtggtggagggtgatagagtcaactcaacactgtgatcatatgactgggttgtaatgtgactatggggaaaccacccaacctctctggtccatggtttccccatctgtgctgcagggaggctggcttgcagggtagttcccaagaatcatcctccccatcagctctctaactctaagctttaactttgattagacttttgctgggatttctctggccctgccagggtgaaataatcaggggagattttaaagaaaaaatcagtccagacaactgtgacatcttttttcttttctagatggaattagtagatatggggctttaataagttgatctgatatctgggctccaccaggccagctctctgaatggcatttttcattgtgtcagttgatttttctttaattgagtgtggatccgaatatacgtatgggagctgggtgcaggaagaaaccttcaaaggcaggggttttgcagtcagggagccatcctctccaagacaggggagggtggggcagcggggggaggacctgcgttcatgccaagctgctgtgtcacctttattaatgatgacggggagagggagtcagcaggcagctaatgcggactgcagaggatggtaatcgggaggtgttgctaccattccagaggacagggaagtgggacaaatgtgaatttaagaggcaagaggtgaacagagggaaagaaaggcaaaaaaaaaaatgagtatgacatcatctggaaaattgcaaaccaatgaatcaatgaagtatcattcccagagcaggaaggaagctgccagagaaggagccagcctgccggggagctggggcctgacaggaagcacaagctgggttggctatgcagtgccctagccaggggtcagccacagctggcacgtgagccctaggaatggacttccacttccttctgcccctttcctcctagagccttttttttttttttttttcatgaaagacatcagaaggaatgctctatccaaaagggctttacaggagctcattaatgtgaaaccttggagtcagcttttcaaacagttatctctgagttcagcctcataggatttttctcatcatggggatcagcttcataaaagccagagtgtgatgattctgccagtttttgctgttaacagatgaaatagtactccctttatagaaatgaagagcaaggactttgggtagctttctttagttctcaagacctcgtcagcagagctggcctgaaggcaacacagtaggcaggtgcctgcatggcatcctattacctacaaattgaggatcaaagcccttagctaggcatccaaggcccttccatattcttcccctctaaatatctctcgtagttacccatgaacttctgctgtacccaggcactttgttcatttccacctctgccactttcctcatcctgttccaacatataaatatgaagcagcaatttctcagtatatatactaccactccctgcccttgcccatggcagacatcactaattgattgccacactctttcctgctgagctaggacttggccttagaattatttccaacacaacttcccagacagtcactaccaatcaattaaattaatcaaattataaaataaaatgtattttctattattgatctaagatgtcctttcccattcttagctcaatctctatcaatcttgtagtttctcaaatcctacatgctctatgaaattttccctgaatatttctaccctcatagattgttcctgcttattaaaagcctagtgcaaaccttacctatagcatgcattttgcacttatcatttagtatcataatgtatcttcccctttatggatcagagcttctcaacatcagtgctagtgacacttggggctggatcattttctttgtgggggctatcctatgtattgtaggatattttagcagcatccttagtttttaaccaatagatgtcagtagcaacctctccatcacttttgacaatgaaaaatatttcaaggcaatgccctttgagggacaaaattgccccagttaagagccactgtgagacagatagatagatagatagatagatagatagatagatagatagatgatagatagatagatagatagatagatagatagatagatagatgataggtggataaaatctcccctgttagtctgagaccttcagtgtgtggaccatcatcatacctgacatagctccttacacacaataagtgctaaataaatatttgataactgattgattgattgggagtgaggactgaggaattgtctaggaagcgggaaaaatgttctccaatgtggactaagaattacaccttcagtgtgtccttgctgcagttaagcactgcggaattgagcaatgcagagtttgcaaaggggccacctccaagcaaccacccccctccccaataagctgttagcagatcctagtacctgagtgtgctgtgactagcagatctcttgcagcagaaacaactagaggagggaggaagtgctaaaagaggcctggatgatacgtttggcttgaagtttaatacatgatgtgagagaccttcactcctcttcactcctcaagaaggaaaacgaggtaaactgaagaaatccttttatccacaaagtaatcttccctcctggaagctctctggcttggtcacccgatgttctgtgaacatatttatctgcctgccccctccactcccttaaacaatagaggctttgtaaagggagaaaaatggaagaaactataaatcctcacccacaatgcagctgccctcatttccacaggggggtttaaatcatcctctacaagtgaaccagaagcaaactctacacatctccggctgatcacagactgttcctggtgaatcaggaatggaactgaggctgagcattgcaagaagtctttctgaatacctagtgtgtgccaggctttttaagggaccctctgcatgtgtcttctaccttcatcctcactacagtcctacagaacctgcatggttatccccattcacaaagagagaactgagggtccaagaggtaaaataatttgtccagagttccagagcatgtcaaggagagctggcattgatcccaggacttaggatgtgtccagtgcctgccggaaaagctacatctatgagaaactagatatatttcccagtatgcggtattggtacctcatacagaacccttcttagccttcaaatcccaagtaatgcagaaaacaggaggggtgtcctcagccatagagaatagtcattaagagggctggttctgtctatgtaactgtgtaactttaccaattggtctatctgtgtatatcatctagctagctttatccatatgtccatacatccatctattcattcattcatctgttaatttatccatctgtccatccgtccatcatccattcctcctcttctatataggcacaagagatgtcaatgatgtttcctaatattcaaggttaattcagcagggggagaggtggtgaggtggacgatcacacacttttcctttcttcattgacttttgaggtatggcttaattttaatgataataagatcataccatggttgcaaaaatgatagcctcctttttttctaaattaaatgaaagcattctgaagtcaagctgatctaggcaacctatatcccctctctgttcgttggttttcttatctatcaagtaaaaatggtattaccaacatctactgaaagtttggaggattacataagataaagcttacatagtgagtgcttgacccatagtaagtatcctataactgttggctattacgatcatcagtgtactttttaacagcgtctaacacataaacatctgactaatactaacttctctttcttctggttttttcttcctttgttatggccctataaaaagtcctttcagatgggaaatggaggcttagcctagtatctaacatgtatttagcccttgaaatggtgattattattactgttgtttagcccacagtacctcctgtcagagacttcacatcctgttgggacacctttacccacagaaggttgaccttggtgtcattttaccctggatgcacatgtttgcaggaaagagtgggagcggagctgcttaggatccttatccagagctccataccctagcaatgctcctggttttgatttttctcagggaggtgtgaactgaggaatataccgtattttcctgcacagcccttcctgagatgttcagtgtgaggcacagaagcccatcgttgttgtatacatggagaataaatccttgtttctgaacctgttctttttgcaatcatatttgtgacccccctccccccgacacacacacatgtttccatggagagagttagaaacaggataattatgttctgtgccattaaaaactggggtatcctgaatgataacccctctcctggcaagcaggcttctcaggtaggcccccagacttgaatggctttaaccagagactgggagcctccaaaagtaggcttctgttcattcaactctgcatgacagggagatgagcccactggactcaaagataagtggaatcaatgtaaaactaaagtccatgcccacacctgctgaaggagggccagattctgctagaaaataatcatttagcaagaaatgcttgctgaagagtgacaaccatcaggaatgaggaagagtcaacatttaaaacataatttgtgcttttcacaaactcctgaccctaggaacaactccagtctagtgccttggagatgggctggtgtagaaagacatggaaaatgcttctctaaagaggagagctttccagcacacagcagctacagcatgtttctcaaagtccaaatcaatggcttctctttgtacttacaagaaaatcctaattcttgcactgatcccatgggcctccaagggcccgtgggatcagactgctgcctgtctctctgacctcatcatatacggagccttccctcagtcatacctttccaccacactgaacttctttcagctcctccgacgctccaagcacatcccacttcggggcctttgcatctactgttctgccagatttttgcatgacccattttcactattcaggtttctactcaaatgtcaactcttaaagaggccactatgatccatcctattgaaaatagggcagatactccatctccatgctattgctttgtaatatttcattagtggcacatatcactatctaaaatgatcttacatatatatttccttgtttaaagtgtgttccctctgttcctggctcttcccaacggggatgtgagcttcttaagaacaaagcctttggtaacctcagctgtatccccagcatctaaaaccatgcctggcacatagtaggtgctcaagaaatatttgttgaattaagaaatgtgtgaaagaattatctcactctggattgctagaatataatttaagatgggatgtgttcagaggtagaacaaaacttctttcatttctggcctctcctaaggcaaaggtagtcaacacaggaccctaacttttcagcttttatggagggggtggtccctataacattcttttggagatgggaaattctataataaattcaatctcccatctaacaaatatttattgaacccatgcaatatgcaagttcaactctaccttctgacaaagaacaatgaataaatggacacaaatctctgcccatgagagtgctgatgtggaagacgtggcgggtttttaagagaacacagggcttagagtcggaaaggcctaaattttaggtcctatgtcaccatatactaaaagtctgcataagcaagctacctgacctccaggtatctaactttcctcctgtataaaatgagcatgaagctgacctcatgagattactgacaggattcagtaactgctgtgcctctggcacctagcacttggtggtcgctattgagatgatgaatgtagggccctgggcaaaaggaatgaatgaatggaattttctttccttccacttccccttgtgattaaacatctcatcatatactttagaagttttcaagtgatctcaaaaagaaaaaaaagaagaaaatttaaagtgatttcacatcacagagccacaagcacaggctccaaccaggatcagaaggtgttagtttcaaatgaagagtgtgtaatgaattcaggcccctcttcgagccttgattcaaagcagcctgcgcttctggccccttgtctgtgcttaagagctgatctgtcattaatgcccacagcgtcaggcaggggtgcacatggctgactctgccggagttgccatgttgtacagatggaacatgtcagggcacacccagcatatgcaacatccaagtggcatctttctgttttcctgtgatgctatgcctttgacatgtagcaggccacatgaaccttgcggatcaaaaagcttcttaggaaagaaggtgattcagtttattctattgcacagcaggatgtcctgggtaaccaaagaatgtcactgcacgcaaagacagacacaccttcttaaagccaaacaactggggaactaagttttcgatgaagacagttatttttcaggcttctgaacaatttggacactgttgtcacttttcctacctgccagcaactgttcctgaataaaagaactgtcccagcatgctctgttccaagaggcacacactggacttactgaacagtggcatgttgttaaccaaaagcatgttcagcggcagaggctcttagctgttcatcccaagctgtgattgggagtgcttgatgtgtccatagatagtcacgggtaggcggagtcatcatttcctctgtccaggtcaggaatttcaatgagctaatctgcatagcttctctggacttgagtcagcaacaagacaatactaataatagc[450 bp omitted]caccacacagacagcaccaatttcatccaagaataaaatctgttacataaccagatggcagacatgggggtgaatagagaagcaacctgtgagtgcattcggccactcctagtctccaaaggacagctcctagaaagaacttttcatctgtctctgagcctccctcggcaaactttccttcatctcctctcactggtgctttctatattttattttattttggtcgtgcgcattatttgaagttactatagcaacgtgtcaccagctggtatcacatagtaatgttggcatttaggtagcaagcttccgaagttggctgtttcactccctctgcgatctcatcactcctactaatcttaggtgagtgagggttgcatgggcaggcagcacccatgcccctcgcccctattttgtttgtttgtttcccaaggcaaggcaaactggtagcctttccctcagttcacatggcactgcaggggtcctggctctgtgtatgtgtgtgtgtgtgtgtgggggggggggggtgtaggtgtgtttgcattagaggttgttaaatagatatgtttaagttgaatgttgtacactaaaattattggcattgtcaatatcatgatgatgatgatgatgaattttttaatgcaaaagagtggaatgatttggggagtgctaatctcctgatcacaatcacctagtatcccagctaattaattttgatcacacaatactgggtttctcttcttctctctcaccatcacacagtgaagagaccctcactcttttcctttggagcttccaagtgtgcaagacctccctacgtcccgaagggctgaattaattaagaggattgattgtcttggatcactgaagagggttctgtacagcaaataagccctgccactcaaggtgttaagtagtccctcatcagccaagtgcctgcgatgattgcacttatttttacacgtttgacctagtttcaaaccgtgtctcttcatgctgtgattcattagccacattttaaaccatcccaatcggagcgaggtgacactgtctggtttgtgccagagtctcagatacaatttctcactggaatttaatatgcaagtctccctggaattctgttttaagaagcaatttcccatcctggcatgctgcttggatatggatgagtggctgcctcattcctaggtagtaaatatgtcgattacagaatttctgcccgggatgaaaagagggggattcttgctagcctggagactgcaaggggtccctccacccctctgttccccatgcagtattcaggcttttccaggtttctgacagggctgggagttcgagctcctacactgtaaagtttgaacaacgtcagtgttagggctgtctaagttgctagggcaaatgcagtctgctcaacattcccccacccctattcctatgtcccctaaaaatttaagacatggtggatatggaagtaaggtctcaaacttgtacagaggggcaggacacaaatgccatttttgaggaaactactgaaaaagagacacacatcagagaagcaaaatgttattccatgattctatcgctgtatgacaaaagaggtggtttttaaaatccaaatgacagaaaggagacttttctgaatatgaagctgctgcttgtttctcactccatttcaggttatcaatcattcacatcggtgtgatttcccacagatctgataccaaagggggctagacaccatagcagaaaaaaaagatgcttctagtcagaagtaaaacactgtcatttttcattaacagccaaatgcaggtaacttgtccaaacttcagtcacattgcactacaaatcgtaccaaaaggcacgcaaccgggtttttctacgtggtagtgagaactaagaaattaacaagctggtaaaagtaattttgattgatcagtgaactacaacacaccgaccaactcctaatgaaaagataatggtttttttcataaaacagccactctctctagatggggactagaatccccctccctttttatcttttaaaatgaagaatggaagtttctctaaacaaggcttaagacaattcatccttttcaaggcaattccaggcaacttgagatccaaggtttgtttttctttgctttttttcccccttcaaattcaaatcaagccatttgaaataacaagcattccatatccatgcatttggggcagcctgcagttctgacaatggtggattttccactacataccaccacacacacacatacaagctcccagtctcactgttgatttaagccaaagctttaaaagtaaactattgtccaagagacgatcgcattttctctcagaggatcatcgatcataaaaaataaaacctacccacatctcttaccttgaagcagtggaattacctgcagaggatggtcccccttccttgcacaatgagccaggctttgaccagcagcaaaattactccaaaagaaggaataataagtccttcatattgtaattttcactgtttatatgcaagaagtgtagtgggtctgctcacgtaggaataaataaaaagccgaacaaactgctcggcagctaccatgtgaaaagaaaagacctctagtggccacaggctgaattctttaaggaagggagaggagagatggagcagaggaaacacacgctcctgtgtgtgtatagacacacacacacacacatatgcaggcacacacacatgcatatacacacactcctacaccccacaaatgctaaggtttctcctttcttgcatttggcctggctggaggtagaaacgagaataatggttatttcttgatttaagtgggagctggttaaattagcagtgacggcggtgttctgtctagtttgaaagggataatttcacacactcactaccaccccctgggggcctgagcaggaaaaagaatttgactctggctcttcaaggagttgcctgccacccagtgtagaggctacaagttcccatcaacaaagcatcatcagccattgtccctgagagtcccagctttgtgatctccgccggatttgcatgttttctagtcatttacggtgtgtgggtgtggtggtcacttggcagggagagccagcttcctgggtttgtaagcttcgtagtcatgacagaccccttgcttagaagggctccatggctgtttcaaaattctgaatagttttaaacaagggctttgcatttttactttgttctgggactcactaattacatagctgttcctgctgacaaggaaagcatgctatccctaacttcccaattgaaaagaacctagaaacaaatgaaaatccatatcatgggagctactttcgggagtataaacttaagaaacagttttccaaaaggcttcctgtttctctaccactagaacgaaattgtaaacctgggaggaaatatatacacgtgtatatatacatacaggcatacctcgttttattatgcttcacagatacctgttttttacaaattgaaggtttgtggcaaccctgcattgagcaagtctcttggcaccatttttccaacagcctgtgctcacttcgtatctctgcatcacaattcggaaatccaagcaatatttcagatttttttcattattattatacctgttatggtgatctgtgatcggtgacctttgatgttactattataattgttttagcacactataaacaaacttcactatggcaaagttcactgttgtctttttttaagaaattgccacagccactctagtcttcagcaaccaccaccctgatcagtcagcagccatcagcatcaagcccagaccctcccccagcaaaatgattcctatttactgaaggctcagatgatcattagagttttttagcaatatttttaaattaaggtttatgttctcaaattaaaatttatatttttttaaacataatgctattgcatacttaatagactacaatagagtgttaacataacttttatatgcactgagaagccaaaacattcatgcgactggcttgattgtgatattcactttattgcggtggtctggaaccaaacccataatatcttcaaggtatgcctgtatatatttcatatttgttattttattaacaaaagaggaacttttttatataaaaaaggcagcagtttatggtaaaaatgcttttttttttttttttggttcaaacataatacttccagccaggccatcttccacaagcccgtgcttggctggaccacagtagaacttcatttggccaagatggcagccccagtggaaacttgcaagagacagtcaaaaatgacttctcacccctggtggattcgtggctagtgctttgtttaccaggttccagaatagatctccctgaatgctgcttgcagacacagaaaactcaccctgatatggactgataaatctgggaaagaggaagcagaaaaggctatgctgatgtcttctggtgcatgaaagggtgtggttcctcctctgctcagagggtctcctctctgtgtccctgccttgatttccctcttctttgaatctttctggtacttagttggctttgccaattgagggtcttactctttttctctcatgattaatctcgctttcccaactagatcatgaactcacaaagagcaagagccatctcttctcatttctttcatccctctcagctcttaccaagtggcaggccccaggaggtgctgggttgccactggctgattcctggtgatccaactacagattccactgcagagaactttagtgcatttcaaggtgctaaaggagccacctgattcttttgatactgctctagaggtagattcagatgaattattgtcccatttgacagatgagacgattgggacttacacatgtaaaattatttgtcataaaatgaaactgtctccatgattttgaaataggctggatttcctgacacaagtacagtgctctttccccagtgtgcgaacagcaggagaggtaatggatcaggtgttatgtttatgttcggcactgctattacagtcccaggcacataatagtactcagtaaatactttattgatgaatgagccataaggagacattttctcacagggaagttttccatggtcctctctcaactatttatagtatttgtcttcatttcttgcagagtcactttgtggcatgtatgacagccatcttaaaccagatgggtgaccagcactactccttctacattgagaccttccagaccagctctgaacttgtggtgagtctgcaggatgctgggggtgaggaagaactcttccatctctggaacatggcttctgtccctgtcagagagacctgcctgtctatcacataatctagatatgacttaaccaatatttgttgatgaatcacagacattttggggtttaagagcatgactgttagagtcatacattcttaggtttgcatctaggatttgtcacatgctagctgtgtgaccatggtcaggtgaatccttttatgcctcagtttccccatttgtaaagtggggataatgtcatttatgtcatagggctaagaaggggttgcacgagaacacaatagctctcacgtagtaagtgctcagtaaaatatagctcttattaagatcacaaatgcctagaggaagttggtctctgggccaccttcttctagcctctcaggatgcatttgctgcaagaccatctgcccgtggcctgtggcttctatctctgcagctgatgacttcattaacatagagcccagcccaggctgttcctgccccaagggtggagcagagcacactttgccctcagtgtggcctcctttctctctgtcttgttgctaccaggttcaggagtcccactgcttaaggtcactctcaactctccctggagagaccaggagcaccaaaattggatcaacctcagagagtggcccataaaaaaaggaatcattagaaaactaatgccctaccctttcatccattcagtagtgagatgttctctcccttggagtaagattggcaagaaatggaacttttccctcaacctccaatttccctatgtcttaagacatggaaatagaaaaactggactcctaatttttgatcctgtatggaaggaaaggtttctgggggaagaaggtaagaaatggaattcttaatgattgaacatacacattttcttacataaccctcacaaaagtatgacatggaaattaggagtcacatttcacaactctacaatctgcttgctcaaggtcccgtagctagtatgtggtggaggtaaggtctggacattgactgtaacccttataccacactatctcctcattaagaagccactcttcccatctatgagccaggagccttcttcatttccacaggaaggggatgtgcctgtgatgatatccacacttccgcaggtgacatcaagtatgaataatataacaatactcaccatcatcatcaacaggtaatgagaatttgtaggagaccaggctctgtactaagcatgtgataggcagtatgcacttaatcgtcacagtcaccctttgaagtagatattattcccattctgctgacgtggaaactaggacttaaagtgttgaggtagttttccctagcaacaaagattgctggaaaggaacaaatgtcatttccagaattttgcaacttagctaaaagcagtgattttcaaattatgttcctcctatcctcactatgctttaccataaacatgcacacacgtgcgcacacacacacacaattccaccagagctgttctacctttatatattttatatattgggctccaggtaaggctttctttgaacaaagaattctgctgttaaaataatttgaaaaccaccaacttaaggaaacaactctgaacggatttcctctagattttaaattttgcctaaagtacactggtggtatgtcttcactacctccagctcaaaagggtctcagtgccagtggttctggtcttagctatccagatttctttatttattttttattttttgagacagaatctcgctctgtcaccaggctggagagcagtggcacgatcttggctcactgcaacctccgcctcctgggttcaagttattctgccacagcctcccgagtagctgggattacagtgtctgccaccacacccagataatttttgtatttttagtagagaccatgttggccaggatggtctcaatctcttgacctcatgatccacccttctcagcctcccaaagtgctgggattgcaggtgggagccaccgtgcctggcctccagattttgctttaatttgtgttttccaaagatggagaaaaagtatggctcactgcaaaatctagtgaagggtgctgaagtccgctaagaacctcttcaaaggagaggaagagttcctgtcattgtgtctcagctaatctgctcgtgtgtgtgtgtgtgtgtgtgtgtgtgtgtgtgtgtgtgtgtgtgtatgtgtgtgacatatgaattagctgtatttacagcactgctaattagatgttcattttaataagagtttatttgctcaatgacctgagatgctttcatacagtgagattatttccttctcaaatacatatttgtgaaaatgattataaaattgccacatcaatgagtacatttacttctttattcccaaagatggaattaatagtgctttattttgagaacattttcgcatcccatattcatgttccactgacatttgggaaacagcattccagcattcaatctttaagcttccatttaatttagttaatgaaaggctgtgtcccttcccttttcctccctccaaaatataatagcaaaaaaatttgaagagccaacaagctctgagttcctgtaaaacaggatgacatgtgtgctgtgcttcattgtttcaggacttcttgatggagaccttcatcatgttcaaggacctcattggaaagaacgtgtaccctggagactggatggccatgagcatggttcaaaacaggtgagctgctacctgcttccgcaaagctaccttacccagccctcacttcaaagatcacttattttgggttaaattagggacaatttctccttgctgaaaagaaattaaagtgttaaggcatgctttctttctatctttaaacccagggaaggactcctcaccaatcgaagctactcaaaaaatcgtctccaacttctccatttttcaaatcccagttagaatatcatacttcatctctgaagcctttcgttcactcttgggacaggagatcttagaaaagcattttaaaaatatattattttaatttttaaaaagtaataaaatatattctgtgacatggtaaaataagtttaggaagcattaaattaaacagatttgaacagatttccatgctgcaggacttcttcaagcttttaatttgctaatgtgatttttttctaagaggaggatttagggtacagcattccatttgcccatccatttgcacataggatgtgcatttggtgtgtctatgtgtgtatctataatacccgttaacatctcctacactatcagtgtaacccaagtatagcttagatgtcctatggcccaacacaacaagagataaaagtaattctaaacaatttcagtctctgctcctaggtttcttatatcatttcaccaaagtaaaatccaaattataacattcattaatcttttctaatattcccttgggtttatttctaatattccttggatttccccaagcctctctcagaacctgattctcaaatcctgccgatcagttcctttaaaacagcatctttttggttcttctcttttctttctccctgctttcctttggcttattttatttgttttaaattctttcatggaaagcccttcaacttatactggtgtctagttttatctccctctacctattgttcttgttttatatcaaaaaaccaagcattgtctggcaaagatagaaatatccctagagggcagaataaggggagaagttaaaaagacaaaatcagaattctctgaagtggaagggaaagagcaaacactaactcaaacttgcccaagcaaaaagagaatgtattggcacagataactgaaagagccctgaggtgtggcttcaggcatggatgtatctaggtgctcaaatagcaatgtagggaatctgtgtgtgtgtctctctctgctttttctatttacttgattctcaggcagatgctctcttagtggggaaaatgggctctagaagttgcagatatattccttgttgtattttcaaccacaatagaatgaaaaggcttcttttcctataggtacagaaaaaatcctgaggccactcttcaaaggtctggcctgagctacatgcccatccatggacctctgcggccagccaaatgaaatgtgctattaagtcaggcttggatttcatgacccgcctttggaactgggtcagttctaccaaaaccacaaagtcagggaataaggaaagaagcagagagagtagttcttcaaaggaaaatctagaagttgttaccagaaagaggactaaataatgggcaggtgaatgcacagatgtccagccttgatccagggtcttggggttggagccctggccaggcaacttccccttctgagctgtccacacggtccttctggaagaaacatgtgctgggtcccatgggagtgctttgaaggaatatttcctcctgaaatcccagcttcattcaaactttagtcatttttgggagaggcccccagaaatgatacagtaatccttatttctttatacctagaaaattagaatgtaatttcctaacggacctaatacattggaaatctctcctaaatagaaatcatagatttgtatctcttaagggtcagccaagtacttatgttttgtacattaaagaaaaaagttagactctagaacacagcctgggcttcagactctttaattctgccactttctctttcttgggaagtcatttaacctcttggagtgttagtttcctagtctgtaaaatggggataatggtagtttctatttcatgaaaattgctttgtgtgtacgaggatagaatgagttactccttagcacagtgccaggatcaaggaaaatatcaataataatagcgttgccatcactaggtgatgacaacaaacttagctttagactaaagaagcatgtgttaatgtcaaccagaaaagattgcttttttctgcttgcaggcacatagcttagttcgaagatttcctgcatcttctggccaaaatgatctcttatgtttatagaacacatgaaatgttctcactatttttgcattttgtatattataatagctaacatttattaagtaccgagatccatcactgttgcaaaggctttacatgaaattagttcatttaatcctcccaacaactttataatgtagaacaactataatccacgcattatataagaggaagctgaggtacagaatagataagtaacatacttcctgttgcattgctgaaaagaaacagaagccatttcattgaaaacaatgctcttaatctctgtattattattattattattgttttatttatttatttatttttgagacagagtttctatcttgttgccgaggctggagtgtaatggcatgctctcagctcactgcaacctccgcctcctgggttcaagtgattctcctgcctcagcctcccaagtagctgggattacaggcatgcaccactatgctcagctaattttgtatttttagtagagaaggagtttctccctgttggtcaggctggtcttgaactcccgacctcaggtgatctgcctgcctcggcctcccaaagtaatctccatattattaagtgcattttgcccagagaggtgaaatgactctccaaggtcatgccactagtgaacaatttcaacccaatttagataaacagaacaggtaccatgacttatgccagaccagtgttccccagaataccattttcttttctccaaaaaggtgcaacttattcatgtggtcagggccaacttcacttgtcagtatgtctggacattccaactaacttttcttccttccttccatgatctgtatgttatgatagttggcctgtttttataatttttctattatcacttatgatttctgtgttatgtatgcattagtcatctattatttacttatctgtttgttggaaaagggagtggagttttctagattttaatgtctccccagctgtgtactgtttgcgtatgcagacatagtgacacatctcctgcaagaaatacttcctgttagagtgtttttctttttggtaagctgcaacacagtaagatctgatttacatgatgttgttaatttttaaatgatcaagttctttataatgttgtaaatgaacaagattatgcctagaaacctcttttacctctcttccatctgcacctcactctagaaatccaacattttgaggaggcttaggatttatgcatagccctaaagttaccctaaatgcagccaaccaccaaatatttattgaatttcatgagcatccagggttgtaggcaatggacaggccaatttaagctatggtcccagaaggcagagggcttacggtctagctggggaaacaataaatattcccatggaaatgcaagctgcagttgctgtcatgaatttggagcccagacagagaccagaggcagaacagggcagttaggacttatggctgcctggattcaaattccatctgagcaagatccttcaccactctagactctgttttcctcactgtaaaatgtggctaataatgatacctaccacaaggatatttgtgggaactaaaatgaagtaatatgtagaaagtagttagaatagtgtttgacacatagcaagcgcttcataaatgttagttatttttattttatatttctatttctatggtttgggtatagccaaactacttcactgaagcagcaaatctgggctggatcttgtctaccttttcatatggtagttccatcagtgtgctgatgaatcactgacacccattttcccttcatcctacctaccttaatttgtagtgattattcgtttttggggtccccacctcctccaatccatgtaatccagaaagaaagaaccctcttaatgtttttttttttcttcttctttttcttttgagacagagtctcactctgtcgcccaggctggagtgcaatggcacgatctcagctcactgcaacctccacctcccagattccggtgattctcttgcttcagccccctcagtagctggcattacaggtgcacgccaccatgcctggctaatttttgtatttttaatagagacagggtttcaccacattggccaggctagtctcgaactcctgacctctggtgactcacctgcctcagcctcccaaagtgctgggattacagacatgagccaccatgcccagcttacctcttcatggtttcattaatcagcaaagaacacctaatcctgacatccagctggctgcaggatcccgatcccagagcctgctgcatccctaactggaatcccaaattatgcagaaaatgtttccgggcacttggggtgaaccgtgtcctgtcactgagctggaatatgctgattcattcgaaccttttggcccatggagcattttgtgtgttgtaaaggaggcactgaaatgctctgtgggagaataggtatcccagcggctcaagaggagggatgtctgtgtctcccagccaatgcttttatctttagttctaaccagtagaatcaactacatcccatgaatgacaggggattgggatttggagtggccttttctctcccttggtgaatctcaccagatagggcatgtccgcctcctctcccctcttttgttcacatgatactgcctgtgggcatggtccacgctgtgttgtcacatgggagtattatcagcctcatatcctcctgccccagaacttcgaggccatgggcatttaaggataaccataacaacaacagctgacatgtactgaggacatctgtgtgcccaggcactgggcccctgcttcatgtactgcagctcatttagtcttcacacatggctccttttacagatggggcagttgagattcacagaggtcaaccacccagcccacggccgcagctcagaagagtggctgagtgggaaggtgaccctggcaggcttgcagcgcctgtaggactctgtgtgcaccttccattcctgggcctgggccagggagtagtacatgtagtgtgtataggcttattctcggctgcctcctgacaccaggatttgttctgccacatgaagagaagtaggaaactggggacttgagccagcaggctctgtgaggcctcacatggaacagttttgagggtagcaagcctgggtttggctcctctttctgccagcttcttcctactcacaacagctgacttatctgttccctgctctattgcatatggcttctggttcctcatggaatcatctgcccatggcttctgctcaaggctcagactgcgttctccctccttgtgggctatttgaaaggatggatctacttctgtccaggcttgggtatttccattgcacagtgctatatccataagaccacccatgggctgctggccagcccatacaagactgctttgagtcacgtgttggctctggacccagtcagctgtaggcaggcagcagaatgatgcggacaaagtgcgaagggctgcgtgcatggcaggcattagtggaagcatgccagtgccggaagttcaaggagccagtgtgtccttctggttaactgaaaacactttagagaaagacagacctgagtttgggtctggactcttctgcttctttgctgtttgaatgtggggaaattatttgctctttctaagactcagtttcctcttatgtttaatgggtataacagtagctcctatttcagtttatagaattaaatgaaataatgtttgtagaactgttagcacaggccatatgaattatggcaattgatgcttccatcattgtcattattaataaagtgagctcacggcttggattgaacagaactacagagatgtccctgtggacagaactgccctgtggttaaatacctagattctgcaggccgtgtaacttcatgtaaatcctgattttacatgtactggctgggctattgggaaagttacctaaactcacgtctctaaagtggaaaccatatctaactcagagatatgtgagcattagaaaaacaaaagcaacagaggaaagaatccatgcaaagccctagcatggagcctggcaggcagttgaaaaccatggttgggattgttcttcctcctatacagccgctaagcaacacagacgagacacagcaagtgctaggttgagatctgataacgaactttgttttcaacaattcaggttcattgttgagagtaatagagttgagtgtgttttcgtcctaacccactttaccatatgagtgcttaggctttaagtacaattattgttgttgttttgagacggagtctcgctctgttgccaggctagagtgcagtggtgtgatctcggctcactgcaacctccaactccctggttgaagcaattctcctgcctcagcctcccgagtagctgggattacaggcactcgccaccacgcccagctaatttttgtatttttagtagaaatggggtttcaccatgttggccaggctagtctcgaactcctgacctcatgatccacccatctcggcctcccaaagtgctgggattataggcgtgagccaccgtgcccagccaattactgtttttaaaaaaaaaacaagaaaaatgagaagaaaaatgccttacttttccaaacccaaacatgggcacccaaagttaagtgatattctgatttccagtgtgtggctatgaaagactctagagaaagggaggaactttgatttacctgctactaatccccatcatcagcacaggggcaaatcaattcgcggtcattaggctggcctttgaggctggagacaagtttaagctgacaaccaaaataatgactgttactggaatgactgatagctttgttggtgctgagaatgtgtgaaagccccctctttgatattgtattcaagtttctgagatgtttacatataatgtgacaggcactcaatgcatttccatctgggggatcagataactaatctttaaggagagaacacaaaatacaatgttgtttcaaagacatattggtgaataacagactaacaaaaccaaagaaatctcactttgtgacagcctgatggggtggcagattttgtgggatttttatttctgtttttgtatggtgctgcctgcctcaaaactgtctgctgactgatccctgtcctctgtctgccctgttgtctggctcttgcctttagaagaatgaagcagtccagaggggtctgaagccacctcagctagtgaccctgtgaaaaaggttacattactgctatttcacaagggaggagactgaaacttcaggggttatattaacatgcttcaattccacacagctggagagtaacaaagccagaaatcacatccatttgtgtgtgtgtgtgtgtgtgtgtgtgtccaaatcctgtgattccagtgccaggatacactgtcttccgtgttcaacagtcatgaaagtattttaatgaacacctggccctgcagtgcctgatgtagcaaatgctgcagatactccacccaccgactcttggaccacccaaaatccactggcagcttcagtgaggctttcctacttctttctttccctgggctttgtctggctacagagtgctcagctcacctgcaggacaggccagaagtaccagggacttcctgctcattggagcaactttcaatcagtgaggggctacagctaaggtgtaaataacccaaccttcttgttccctgggaggggacacttcttatatgcaaatgtgttctgtaaagtccaggtgtaggatatgagagaaagtcatagtcaaggacgttaccaaaattgtttccttttttccccccactctgagcaattggaagaatagaattgtccttaacttagttgggaagactacagaaagcagtatttcagggtgggtgtagggagggcaggtggccggagtttagtttttgacatgtaagcttgagatgcctaaaagttactcaagtatgggtatagatcatagagctggagtgcaagctggtgtttaggggagaggcctggatggatatacaaatttaggagttaaagtcatgtggactggggagtatgtgagagcatagagggagtctgtgattcccagaagagtagaatctaccaaaggagagagatgttactgagtcatacaagtaaatcatcctagaccatgatgaatgttgggaaagggggttgcaatgaggatcccttggggtacacatgggtgcagcagaccctgccctgcagaagctcatagtctgaaattagagatgcggctgcacacagacagctggatgtaaagtgtgctcataggaggggtgccagaaataacctcagagaatgggggtggtctcagtcacttaaggctggtgggatggtggaaaactaaatgaagaaggctctcgatctggaccatgaaggataatgaccatgaagaatcctgactttcagagatgagaaggcaagggacattctacacaaagaaagaacatagagagggatttgggaaataccagaaacacagggtactagcaagaaataagcctagaaaagaaggttggggtcccatcatgaggggagagactgtccagagaaagagcttggactcaccctgtaggcagtggagagccatgaagtcaatgattgatatgatggagctgtcctttaggggaaggagcttttcaggatgaagagactggaggctgcaagaccagtcagaagggcttggcaaggaggaaggagagaacaacatggagaggaagacacttaaggagaaatgcaaattgacaagtaccaaaatgttaaacatgcatgacatttgaccagtattgttattttttatttttttttttttttttttgagagagactctcactattgcccaggctggagtgcagtgtcatgatctcagatttctgcaacctccaactcctgggttcaagggatcctcatgcctcagcttcccaagtagctgggattactggcgtgcaccacaacgcccggctaatttttgtatttttagtagagatagggtttcaccacgatggtcaggctggtcttgaactccagacctcaagtgatccacccaccttagcctcccaaagtgctgagattacaggcgcaagccactgcacccggcccatttgaacagtattattacttggaggagaacagtggagaaggggtatatataggaggtatttgatatacacagaagagtgatcactggagcattgtttattacagaaaaaactgagaaaaaaacccaaaaagatccatcaataagaaatggattaaactgtgatacatccatacagtggaatgctcttcagtgattaaaaaggatgatatatatctacattcattggcctgaaagaagtacacaatttattgttgagtaaaaacgacaggctgtgaaacagcatttgttgtttagccccatttatcaaaatgataccctgaaaatatcattcatgtatatacatgtagggagacccttgaaattatgttcatcaaaacatggatgacagttttcgttaggtgatacgatgtggtagcaggttgtttatttgtttgtttggggatggggggggtgatttctctttagatcttttctggatagcatgaattttcttccataagcttgtaatatcttaaacataagacaatgcaaattttcaaaaagaagtcgaacagttattgagttcttgcaaggcaaacagccccgagtctagagtgtgaatagttgttaatctgcattagctgacctctctaaatcagtaatttggcctttgagcctctctccaaagagggtaagggaattttagtctggcataaggacgaaggaacttaagggatcatgctcagacagtctggtaattttctgccctcttccagggtcttcctgagagctatcaacaagtttgcagaaaccatgaaccagaagttcctagaacacacgaactttgagttccaggtgagtataagccaccagagctacccttggagctgcccagggcgtctctgacattctgggctgattgctccatcagacacatcccaaaggccacagaagctgtcccagtctctccagggattcccacggggggttatggctggggagaaaattctcaggctttcaaccagggccttgattaaatagtcatcaactgatcatcatatgcaaatgtgacggtataatggcctcttatattaacaaggagatttgcattcattcattgtcagagtctgtaccaccttttaaaaatgtatcaccttttttttacttttctattctctggaaccaaaagggcagccagtcattgacaatgaaaaatgatttacaatcaaattctccagtacaactttgtggtttcctgattcctttgaaagtcatttttagtgctcagccaataactgggacctctaagagattcagggtcctaaaagtatgtgcctggggcaaacagaatgacacacctgccccaggtccaggcccaagaagcacaaactctgtgggaaagtccagattgcttcctctgcctggagatgtgcgagggaaggccccccacaaaaggatcccctccagggaagtctccgatccctagcatctatctcttccagtgggggcttagggggtagtaggcactgagctcatgaactggaatgatggtgttttttccttgctgtaggggtgggatgcccctccacacctgtgggtgtttctcgtaaggtgggacgagagatttggaaaagaaagagacacagagacaaagtatagagaaagaaataaggggacccggggaaccagtgttcagcatatggaggatcccgccagcctctgagttcccttagtatttattcatcatttgtgggtgtttctcgaagagggggatgtgtcagggtcacaagacaattgtggggagagggtcagcagaccaacacgtgaacaaaggtctttgcatcatagacaatgtaaaggattaagtgctgtgcttttagatatgcatacacatagacatctcaatgctttacaaagcagtattgctgcccgcaggtcccacctccagccctaaggcggtttttccctatctcagtagatggagcatacaatcgggttttataccgagacattccattgcccagggacaggcaggagacagatgccttcctcttgtctcaactgcaagagacattccttcctcttttactaatcctcctcagcacagaccctttatgggtgtcgggctgggggacggtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccttcaagcatctgtttaacaaagtacatcttgcaccgcccttaatccattcaactctgagttgtcacagcacatgtttcagagagcacggggttgggggtaaggtcacagaatctcaaggcagaagaatttttcttagtacataacaaaatggagtctcctatgtctacttctttctacacagacacagtaacaatctgatctctcttgcttttccccacacttgctcatctaagttgttcagttcctctctgggctttcgcctctcagaagctgagcaacttcaggcaaggcctggactgtatccgtgcctcaagtgagtcatctgtaaaatgcaacaactaccctttctacttcatagggtttttccagaactggaatgtgacgaagggcttgctggaagaatccacttgtaaggtcccataagtttctgttcaaatacttcctccttaaagaggcctcccctcctgactcctccctgaggatcacccccactcactccacagtcattatgcaaaaccatgtggcttcctggagtctcttcatagcactaaatatcattagaactcatctttcttgtctacctgcgtattttctctttcctcccatagaacttaagcctcgtgagtataaagaccttgaacacacaacaactctatgctctgtacctggcacatagtaggtctccttgaggaggtgacgtctgggctgaggcctgtgagattcacccttctgagagcaccagcctatgagtagatgagtatttgctgagaggatgaacaggatctttgaacaagagtctcttgaactaccttgcattcaaatcaggcaactgagtgacaatgagagcgataataaaatgcgtagctgccattttctgatggttaataatacatgccagatctcacgagaagcactttaagggcattatcttttgcagtctttacagccaccctacaagttggccactattactaatattttttctgctctaaggaggcaggaagtaagactcagagataataaggagatagcatggtgtcaccgagcacatcaatgcaaagttgggaccagaacacagtggtggctgacaccaaagcccacccagatgactacagccacgtgcctgatatagactttcacccttgcagtgggttgactgcctgacagggtctgggtgagagtttctcctggcattataaatcttcgacacgggaacaaagcatatctctttagctggtttgaatcaggagagatgtttgattcccttccaaatgtggctgagaggcctgcaggctctggtcatgggtatgtttagggaagtttctgctttttgggaggggcaacttggaacaccatacctaggggccagaggtgacagggtttggtccatataactgcgagctagtttgttcatctctttccgtgggtatcggctattgcagcctcaaacttgctttcctgacttcactattttccatgctcttagatggatattttccaagagaagctcaacttcagtccttcagggcattcctttaggtttatatcctgttttcctgaaagaaaatctgtatttgagagatgctcagagattgagggtttcatacatgagaagtacgggcttgcaagctgagtgactttagacaaattacttcatctctatgtgcctcagtttcctcaacattaaatcaggatactaatagcagctatatcattggattgttgtgaggattaagtgaattcacgtaaagcatttagaacagtgctggggacatagcagccatttagtaagtgttagctcattataataatagtaattttattatttggataatgattatgatgatcatgcccctaaatgtgtcagggctgggaatgcatgtcagtccttgataaacaggacaggaggcctctttctggtcaccacaacattgcctggggctgtcacacccacaagattctgtaaaacagaagagtggccaacattacaaaataaagtaagtctcttttcctaatgaggcttccatagctatttattgaaaagtacccaagaacaggatcattttccaaccttatctttgttctcctacctcttcctccccctgtgtaagaatggatttgttctctgtaccctgcctggaacacgccttgtctccttcttacgggctcattaattatgcatttaatatcagcaggaacagcatccatcactgactgctgcctgtcttggcagccactgaccagaggagcagcaggtgcaatgagattatccctaatatctttcccagaactgtggttttgtgattcaaagggcagaaagtaagaagcttggtgactgccactctgtaggtgacaagaactgggaattataaaaatggtgttttctggttgcggctaagatcacttgcattccaggccctattcaggatgctggtccttggtgtctgcatcagttcatgtggtcagggaagaccaagagaggatttcaaattcaaatcagcaggtatttttgtttaagagcaattcttatgggcccagactattgcaacatgcttcaaggaactcagaagcaaagaacactgccctaccctcaaggatcttggaatcttgatagaaggctatacaaatccatcttccagcatccaggcttttgaagagggtgactaactttattgggcatctacttagaaaattttgattctcatcataatcttgtcaggttgtgatatacccatttccctggtgaataaactgagcttcagagaattgattgacttttctgttaaaggtcatctaaccaataaatggggctgctgcgattcaaccccaggcctgtctgcaaagcacatcctcttttcactcttctgctctgtttcttaggaaccgggtgcctctggattccaggagacagctctatttagatccagaagcactctctgccctttctagttcttactggcactgggatagagagcgctgagatgattggctggaagatgagactctccatgttgaaatctctgattggccctggaatcagagattatacttgggctccagaaagactctgtgttaggcagcactgtctttggtattgagatcattctctctccttggggatgctctaattggctctaggtgtggccatttctgcctaggccttgaggcatttttggattaccagcctatcctgggaaccagttttgatatcctgtgaaatgaaaaacttctagactatttctagccattagtagaggcatgagagccaccttggtctttataatgggaaatgtaaacagtgatgccaaaaacaggcgagggagagacacatacagagggagcagtcatcaaagccttgcaactgcccatagcgccaccacagggggactcatggtgggatggttggttccaccaggcagaacggtgggcacatgcttgggtgcagtttccccagccctgcctgcttcagcttttaggccccagacattctcttgtctgatatttctcacctgagtccacacctgggaccttccactccccaaatcagaagcatccccagagtggtcatgacagctgtgcctctgccctgcagaggagggcaggctgactgcatttcagcaccactgcatgctggttaatttttttttattgaaatttgggataaataatgattcaaggtcactgagaaagaatcctgattctgattaaaaaatcctggatctctctgctataaagactatagtctttataaacatcggatggaccagtgacaaccttaaccaacaaagctgaaaggacactgagaaaggagaagagcgatttcagcagaagagcagggtggtgaagaatacaagtcctggagtcagataaactggattcagatgccaccttcaccgttttgtagctctgtgatgtcggacaagatattgaacctctctgggcctcagtttcctgatctctaaaatggggagaataattatacaaatctcatattttttttagggaggatttaaccagaatgcatgcagtgtgcttggttcgttaatgaactcattcaaaaaataatttcccaagcacgtgctggctcagacgtgatgtgcgatactgtgtgaacaagagtgaatttaaaaagaaggttcttgcttgcttgatgctgacagccagtagaggagacagaaaataaattaattttgtttaaaatatgacacagatgttgtgaacagggtataatatgggtgaataatgggtgaatctactttgcttggatgaatggagaaggcttttgcaagactgagagtttgctagccagtgatttcctcatttagtccttacaaccataccctttagatactattgtcctcattttctagatgaagttactgagactcagaaaggtagggtaccttgtccatgataatggaactggtcattgaactgaaaccctggaaggcaacctgacagtatctataaaaacaaacaaagacaaaaaacaaacaacaactaaacatgcatagaccctgtgtcttagaaattccggttctaggaatgtatactacaaatgtagtttcccatgcataaagatgtttaaataaaggcgttgattacagcactgttgctagcgaaaaaaaaaaaaaaattggaatcaagctaaatgtctataaatagggaatttggttaaaattaaagtacatcgtcatagaatacaatgtagcaataaaagagaatgaagcagatctgtatatgctaatatagaaacatttgcaagatatattggtaagagaaaaaagccaagtgcagcagacttttaaaaaagatgtctgtacatacatttgtttatgcataaaaaaattctgaaaggctatccaaggaattgttaacattctcttctgaggaattagacttggatccaaggtaggatggaaaataactttctcccatttaatcttttctatcatttatttttttaactatgtgtgtatattacttttataattttttgagagttaattaaagtaactaaattctcattatacccactagcagtatgactttgggtggtcttttaccttatctggactttactgtttacctctgtgcaatatggtagtcagaacagatgacacttaaatttattccagttctaactctctattgtcctataatttcaaaatattaaattcccaatcggaaatcacctcatctcttccccagggcaaagagacctgtgcattttgctaaagacacactgtagcttcccctagtcagctgagctaggcacttagtagaaatatcaccagacagtttctagcagggcagaaagaaaaatctgggaccctttgaagaatttctctgacaatacggcaatagataaataaatattctcaggagcccagctgtattcgagtcattgtgctgagcatggaattagagatacaaataaatgggagacaaaatcttggtacttgtggagcttacaattggagaagacagggcttacaaatactccacaaccaatgctaccatcaacaccaccattccatttactgagcacttggtgtcaagcctatagtggatgcctcgttctcaaattattgatccagtaattacaacagtcctttatggtaggtaccattatgttgggtattttacaagtgaggagaatgaggctcagaaaggtcaagtcactagccaaaggcaacccagctaataagcaatagaactggttttcacaccctggtctgcaagacactgacacatgtgctcttgactaccagacagtgctgtcatgagaaacaaatggagcacaaggccaggtgcagaacagtggactaacatccatggttgcacacaataagtgctcctcaaatcaggaagtgatcaggcagacccaatatgccctgcagtctaggaaggcttcatgaaggaagcgggtcttgaacccagcttggatgtaagaataggacacaatccctgcaggtgtgagaaccacagtgagtgaagccatggagaccaaaatgctcctgtgatctccgtggagtctgagcagaccaggccacctaggtgggcagttgttgaaggagacagcactggggaccatggaaattgtatgagactttaaaagccaggtgggttcatttggatctgattctttgggaacaagagtgaagaaaggcttggggcagaggccttataagtattcagcaatatctagttgtgaccactgctcacctctaagagcgctacacagagccacatactgtgacaacctcctctgagttccagaagtcattcccacagagccccatggccaaaactgggcaggggctatgggtgaggtacttggatgtgccatttctgatccactaagaagatgaggcacagctacagcctcatggctcataaaggtcttccagaatggaagccaaaaccaaaacaaaaccaggtccactccatgagaattgaaacgtatgtccacacagagatttgtacaaaaatgttcatagcagcatagcgtcaatgctatgactcataatagtcaaagactggaaacaacccaaatgaccatcagtggatgaatagataatcgaaatgagtatatccatatgatagaatattattcaatgataaaaaaatgaagtacttccacaatggttgaactagtttacagtcccaccaacagtgtaagagtgttcctatttctccacatcctctccagcacctgttgtttcctgactttttaatgattgccgttctaactggtgtgagatgatatctcatagtggttttgatttgcatttctctgatggccagtgatgatgagcattttttcatgtattttttggctgcataaatgtcttcttttgagaagtgtctgttcatggaagtcagtgtggcgattcctcagggatctagaactagaaataccatttgacccagccatcccattactgggtatatacccaaatgactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaactgaaaaatgagatcacatggacacaggaaagggaatatcacactctggggactgtggtggggtggggggaggggggagggatagcattgggagatatacctaatgctagatgacgagttagtgggtgcagcgcaccagcatggcatatgtatacatatgtaactaacctgcacaatgtgcacatgtaccctaaaacttaaagtataataaaaaaaaaaaaaaatgaagtactgatccatactacaacatgggtgaaccttgaaagcattacactaagtataagaaatcatacatgaaaggtcacatattttatgatgtcacctatatgaactgtcaaaataggcaaatccacagagacagacagtacattagtattcacagtttccaggcagtttgtagcagggcagacagaaaaatctgggaccttttgaagaatttctgtgacaatatagcaattgataaacaaatattttctggagcccagctgtattcaagtcattgtgctgagcatggcattagggatacaatgaaatgcaagacaggatttgggtacttgtggagcttacagttggagaagacagggcatacaaatactctacacccagtgctaccatcaacaccaccactgcatttactgagtgctcggtgtgtgccaagcctgtggtggatgcctcatgcttgtataggttccagggacagggtaggggaaggtgttggtggggagaagagggactgactcttacgggtagagggtttcttttggcgtgatgaaaatgttccaaaattagacaatggtaatggttgaaccccttgtgaatatactagaaactaaatcatacacttaaaaagtgaattttatggtatataaattatatctcagatttttttttaaaaaaaagaaaatcaggaatgggatgacagagaaaatgcttttttgatggattcattcagggtagaatagatactggcaagaggctcaaccatatttgatgtgtcttatgtgttagggggcatttctgaaattattctcacaagtaattgtaaattgacttgctttgttggatacctatttcccatgtaccttaattactcttttgctatcccctaaaatcagagatttctcactttcatggaaacactcatttccatgtcctgtggccacagttttctcttgccctggcttgttgtttcaaattcccatcttaaatgtgagaaggtgtaagctccggacataagcagaccaaagctgcacattttcaaagcaaagccctggagaaactgctaagtcactgggatgccgggaggaaaggcagtctgaggggatgtggacaggagacccaacctgccacatgtgtttacataagcaacgttgctacggaaacaaggagatttgattccaaatgttacaagaaactttggaggactttgaggaagggagtggcatgatctgatgtgtttttgtttttgttttgagatggagtctcattctgtctcccaggctggagtgcagtggcgtgatctcagctcactgcagcctccgcctcctgggttcaagtgattctcctgcctcagtctcctgagtagctgggattacaggtgtgtgccaccatgcccggctaatttttgtatttttagtagagatggggttttaccatgtaggtcaggctggtctcgaatgatctgatgtgttttaaaaggttcttctggtctctgcatggagagctgactttaagggggccatgagccaagaggccacttcactgaatccctagagcagtttgtttttttgggccctgggtgataaaggtccaagtaaagaaaaaagcattcactcaacaaaatgtaaactgcgtgaggccagggatcgctgtctgtgtaaccactgctctgtcaccacactgtggcaatgccagggcacctagcagatgttccagaaatatttgttaaatgcatccccagctgaatactgaccgtggtgtgttaaaagaaccccgaatgtcaatcagaaggtctgcgtgcagatcttagctctgctgtgtatacatcaagatgagagacttacgcaaaatactcaacctctccaagcttcagtctcctcatctataatagaggaataagagctgtcaagtgttgagagatgaaaggaagatgtatgagaaagttcctggcctatagtaaaattagattgcttgttttgcttctttcaaagactggaaccgcaaaccgatttgaaagtcatactctgggcagcaatgatgatgttatgttatcagtggaagagttgcctctttcatagtcttggccatctgcaaacacgaatgaacgtctttgagttaaggaggaaggtttcaatggcagtatgatttctctggctaatgttgcctatcctcttgctacatacactgttgagaggggcctaaagtgggtgggctttgttcagcaaaactgtctcccacatgctccttgcaggaccttggcatcttgcaataattgcccttgagcaccaaaaccctaggctgtatcactggctttcgtaccaaagaaaccactggaataaggaaaagcacaacagcaataaggctagcaaggatttttgagctcttactgtgattcatgtctttaaacacatcattttgtgtcatctttatcacagctttctgcagtgggtaccagagtcacctcagttttgcagacaggtttaccgaggctccgtgatgaatccatggattgtagatccatggtttggacctataatatctctggttctgtatcctgtatcaatattgccatcagtgtggctaatcttttgagcagtcaccatgtgctgacccctttacctgctctatttcactgcaggctggtggagtgggttagcaccaacagatcaggtacatgcaaaaatccttacaagcctgcatctcagctgggccagcaggggctgtaactgaaacatgcatcagaatcacctgactgcttattaacctgcagatttctaggtcccacccccagaggttctgattcagtaggtctaggcagcggccagagaatttgtatctctagcaagttcccaggtgctgctgctgatctggcaaccacactttgaaactattcaactaaggggaaagtaaaggcaaaatattttaagacagaatggattgcagtttggtcctccaagctgtcaggtgaattagggaggacttccagagaggcagtgaatccctgaactatcttacccttcgtcaccctctaattccagggcaagaaccagctctccacagcacgcagctagggcaaattatttgtctttcaaaaaacagaacaaagcacaaggacaaaaacaacaacaacaacaacaacaacaacaacaaaaaaaaaaaaacctaaaattctcctcctctcccaaatcctgttgtctgagagtggacgtggtagcgcctagagaaatccatccattgtcctcactttggccaggatgttaatttcagagtcagtgccagttagaaaattgcagtgggcacaattaaactggttcggcctctgtcttctgccatcttcataaattattcacactacccagcgcttatgccttcccgcttcagaccctctccataactgttctctgctctttcatttacagctgtggaacaactattttcatctggcagtggcttttatcacccaggattctctgcagctggagcagttctcacacgccaaatacaacaaaatcctgaataagtaggttgcatttttggatttcctgaagagggggaggtccatgagatcctctgagatggtgcctgaagcagaggtttttgttcctcctaggtatggggacatgagacggctaattggcttctccatccgtgatatgtggtacaagcttggtgagtaggcacacacatccagatactcacatctgcaggcaccaaactccttcttaaagaccatctgttggagggccacaggggttttagcagtgggagcatgaaataacagttcattactgtgtgtaccccagttcctaataagtgcctgattatactctgaataagaggggttccccatacccacttctacccccagccctgcaagcagctgtgaatatgcttctgcttgatgcccccaatgggttacagatccaaatggaaatttataagagggaccaggactgtcatgggaactcacgtgctcacacatgacacggatgcttgctgctgattggagggtccttctgcatcctgtatagcgtggtccacaaaacgtactccaacctcataaggagaattggctctctgaaagatgagagggtctttttagctgaaaagtgaccccagaagctgtctctgcctcagggagcttcaggaattctgtgtgattacctgaatgatacctgtggagggagagatggaacgaaggagacattattgagagtctgagtcaggcccatgctaagaagattatatttaatcttcacatcacttcctgtaagacggaattgttcccccatccttttactgatcaggaaactcagaaaaggaagtaacttgcttgaaatcaaacagctggaagcctccaagtgtggttttgattccacaaggacaggggctataaaccttgctcatgtcctgaatcctcctttataaatatgtgctgaaaggatggatgggtggatggatgaacgaacagtaatgaattttttatttttctgtccctccttgactctctgattctaaattgctctgccctgggtgtggatattgactttcctgcaagtactaacttgtgcccatctcttggatttaatttttgttccctcttcagactacgcttcttgcttccccagacctcttattatctgccagttcccatgggttttttaggcagcagttgcatgccccttccagcgagttctatccactgtgggggaagcatagagcagtggatagatgatcagtctgcgttctgtggttgctgatagcatcagactcgagctaagagaagtacatgctggataacagggaggttgcaggttggttcacaaagcccaaggcagagccaaggacccaagcccagaacagactgccacttctttgctttgggccttgctctgacatttacaggctgtgaggcctagcatcaccaggcctaagttggggaaataagcaccctcacagggggcttatgagggtcatcagagcacaagctggggcacgtggagccatggaggccaccacacccacatcagagtttttatcattattgtcatccttgccccatcaggatggaacctaatgtttctgttctccctggcctctaccctctaagatgccagtagcaccctccctagttatgacaaccaaaaaggtctccagacattgccaaatatcccctgggagaagggggtgccacctctaccctgtttttctagaaaggcatgtctttctcagtctatcttttgtttctccactctgggtaaggactgggatataggaaataattgacgtttcatttaccattgctttgcaatggtaggggaatgggggaacatggtgcaagcacaggcccacacgacagccggcacctggcctcagggtcaggaagatgagaaggagtaagggcctgcggcagagtgaaactgacatgcccaagcagagaaaaaagacagtcactgttcctctccagttaatagctgtcctactgaaatgcaatcccaacgttgtcatacctttcagtttttcaaaagaagccgggagactgggtttttcaatgtattttccaatttatgaatactaatgaaaactaattgaaagttttcaaaacatcagatgtgctcaacacatgatggacccagattcagttcacttccaagtttgcattcgttgctgtacaacagcagaggctggagaaagctgtggcgggcttccttccccagctcgacaccccaggcactgccagaattgcaaaacagggatctgtgctttgtttgtttcaagtccttccacatggcctgctcttttctgaatgtccttcattgccattgttttgcacacagaagattttatttagatatagattatgttttggcaggcattcctgcactcccaattatgctgatgaatgaaaagatgttaccaaatattccacctgcttagaatcacagaacatcggagctggaagggcccttcaaagatcatattgtccagcatttttcaaatatttatttttagctgaggaccaataaaaaaattctcctgcttaataagtaaattggatgaaagcagaactattgtaattgaagtgaggtgggagacccagagcccattataacaagctgctcttgaacttctcttgtagagggttttctagggggaagccctgagcactgcagagaacagttggaagcaactgatctggtccaattcactattttactaatgaggaaactgaagtccatagagaaggggtttgtacaagatcatgtagtgggttagaggcagaaactggtcaagcaccttagccagagtgtttgctctgaagcatcacagactccctgctgttagcaaaaacctgtaggatgaattaatgcaattaaaagatacatctgtcaggggttgagggttggttgcaaaaaaaaggcattgactgcagctgccttaatcagagaaggtatttattagaagggcaagaaagagccgaagaaccaggcttctcttgttcctggctacctgaacccaggattcagtgttttaggattgcaatgtgctcaattaacaatgccttgtagcagttaacagccacgtgtcccaagtctgtcccatgagaatcagcagaaacatacctgttaggtctacaggaaagtatttttttccaattaaaaacaaaacaagacaaaaaagaggcaaggagaggacagattgaatgaacaaaatgcatttttgcccacagccctcccctctctttctttctggaaaaggacaatatggctggaggggcagtagccatcttaaagccatgaggacaaaacttacattctgagaatgaaggagcaggtctggactggccatcttttggtttcttgttaaacaagaaaattaaagcttcagtttagtcatggtagtcagatttctgttgcatccttaactgatacatcatctaattcaaccctgccgattttataggtaaagttgccagacgaggccaagagaagcagaaggacattcctaaggtcaaaaacaagccagtgactgaattgaggctaaaagagcctgtcctgtctcttgatcccaagtgcaatgttcttacaaataatttttttcaaagtgtatgcatattgtttcaaagggtgtgaaatgaccaacgatctacgctttttcaaagtgtatgcatattgtttcaaaggatgtgaaatgaccaacgatctacgttttttcaaagtgtatgcatattgtttcaaagggtgtgaaataaccaacgacctacgttttttcaaagatgactgataatgagtaaatcataatgcatgttagttttctaaattttgttttaaggccagaagcaatcagggcatcatcatcaccatcatcagtatcatcatcttcttctcatcaagaacaacttgagcaaccctgtgtttataagatagctaattgcaaagctataatctcaggcttgaagattatttaacattcttcaggggcaaatctagacaaattgtgtgtgtgtggagaggaggtatgggcagggaggtcttcatggggagaaagacaacatgtggttaaggagccagccactcaggggttaatggcatttgttgttttggatcccgggcggacgccaaatggaatttacttttcccagtagtatagcatcgtaacacttgatttctgctcggcatgaagaaatgcacattttgctcaaaagactttgcacttaatcctcccacattcacttgggttaacactgagctgctgtattaacattcgttgtgggaaagaaggacacattctagcgcctggcatctcggcctcccatgtagggaggttggcctggccaagcctcgagggcaatttgtccattactgtttaagcgtctacagagtgctcagcttggtgcggaggtccagggagtggagctatctagtagggaaaagtgacaaagtgaaatgtgtagtggggactcaggagttcaggccaaaagggatataagtgaggactataaggatgattccatgtggggaaatggcttctgaattggaaggaggaccatgtcaggactgaaggaaagacagggaaagggcaggtattctaggggagcaaccagcccagcaagcatggcttcctagggttggggagaggctgctgggaataaataggaaatgggattagtgtggccatccgtccattcatttactcattcgtttactaaccaacatcgagcactgtggtaggctccccaaagatgtccatgtcctaatccccagaacctgtggaatatgttacctgacacagcaaaggagactttaaggtgtgataaagttaaagatcttgaagatggggagtgtcttgggctatccaagtgggctcagtacaattacagcatccttataggtgaaaaacggaagctggagaaaatcagagtcagagagcaatttaaagaagctgtgttgctggctttgaagatggaggaaggggccatgaaccaaggaatgcagggagcctctagaggctggaaaaagaagctggggaaggcaaggaaatagattaatccttagatcctccagaaggaactcagtcttgcccagaccttgatttagctccatgcaaccccttttaggcttctgatctccagaagtattacacttattacaaaataaatgtgtactgttttaatttactaagtttgtggtgatttataacaacagctgtaggaaactaacacacacatcctctacatgccaggtactatgccagtagctggggttaaaacccgaatcaggttagagatatagcccctgacttcatggactggtgatcattgcactgaatagttacctactaactgcagcattatttaatgacagttgcgaaggggaaatagctgtagaatggaaacttggggcacccagagaattggtgacagactcctacttagtgagtaagccaaggatggcctccatgaggaagagccagaatccctgaattggaaggaggactatgtcagggctgaaggaaagacagggaaagggcagatattacaagggagcaaccagcccaagcaagcatggcttcctggggttggggagaggctgctgggaataaataggaaatgggattagagtggccatccgtctatttgtttactcattcatgtaataaccaacatcgagcactgtggtaggctccccaaagatgtccatgtcctaatccccagaacctgtggaatatgttacctgttctttagaaataggatacaagccttctaattataaatgctttagtgtctttatttttcaaaaattaaaagaataaagttaattttaacaatacatttaacaccatattctaaagtgttatactaaacatgtaatcaatataaaatattgctgagattttgttttccttttttgggtatctggtggattttttacacttgcagcacatttctaatggactagccacatttcaagggctcaaaagactcatgcagcttgtagcttccatacagaatagcacagccctagaaaatgagaaagggtttacttgcagagacatgtgttggggggggtagactatggagggggggtccaggagagggaaggaagaagagctcgttggtggaggaaggcccaaggtgggaaaagcagtgtgccctggaggagtgggcagtaggcaggtggagggagggtggctaggtgagaggcacacaatgggtatggggagggagcacaggaccagacatgctcccaggtagtttatcctgagagcaaggaaagtcatagggaaaatactctgtgaataaacatgatccaactggggcttttcaaacatctttgaggacaaatgagaaaatatttcaatgagacagagaagagtggagggttgtgagtgtcagccatggtagggaagataaatccatctgaccctttccccagttcagctgtttgctttaaaagtgaacaaataaaatgaccagcctgaaaatttccatgaaatgcttcagggagctccatggggttaggccttgtcttttcatattgcttaatctaaaactcggcatagagctgaacccaaagtacttaccatcagcagcagcagcaacagcatcaacacttcctgagcttttgcaatgtgccggacactgtgcagggcccttcgtttgcacttaagcttcgacaattctattaggcagattttattatcttcatcttacagatgagattatggaggctcagggaaggtaaatgacaagcacaataccacacaaccagggagtggcagtggcaggacctgacccaggctgtcagactcgaagactctacggggcctggaaggaagctgaggctgggcaagtcctgaacaatgaggagagaattgattgcctgtttcagagcattgccaggagggagcttttccaagcctaagacagaggagcaaagatcggtggatctgtgttctgtcttccccttttgaactgattttaggttttttttgtttgtttgtttgtttgtttttaatcagctcagctttatttcaaagtcccccggaggcttgctggactctgaaatccagggagtcgtaacttgccctcatccttgttcattgcagcgtctgtgccagcctttggagagacctttctgttacatgtcagcctcagaagcccatggcttgcccaacttaattctcagccaagttcacaaaagcctccctccctccctcctttctcccttccctccctccctccttttcttctttccctccctccctccttttcttctttccctccctccctcctttcttccttccctccttccttcctttcttccttctttccttcctttcacctttccttccttccctccttccttcttgtttctttcaaggtcatctcctcagtgccctcagatcctttgcattttaccctacagtccactcctgggaggagtgatggaggaggccactgtacagatgagaaaccaagaccagagaattcatgggacccctttccacccacacccccctgagctcttctctgtgcttacattatcagcagatcctctcccaaagcctgtgtaatctggcatttggatttttcctgctggcttattggcactttaatagccttttctaattggtatctgttcccagtgaagttcagcttcaattacatgaaaaagaccctcttagtaaatgcccttccttggcttttctcgaatacagcagcaggtgtgtctcttgcatgagcactttttttcccaagtgagtttgtattcaattagccacaaatgtgttctgcgtgcatgtgtatgcatctatgtatgtaaagatatgcaaacacatatgcatttggatacttgaacacaaaatccaatgtgctgaaattccacttttatgtaaatgaataacatttctgaagggagcattgtaagggccattgaggtcacactgtatttggagatcaccatctctctctccgctttccctattctgccaaatatctcctcaactgactgtaaagaatgcagatcaaaagtatttaagaaatcacgggtctacagcatgtctgccctttattttaaaccatctaaaatttatccttatcatgcccaatgccctccagtattctaaaggcctttgttgcataagcaatttctccattccgtggtggcttatctgacagtttcccatttaccttctacctgtttttgcacttgactttgaattttaaaactccactgtggtttgaaaaagacttaaaggatcttgaaggatgaaatcagaaacctagattagcaattactataaacctgccagaaaggaagctgttgttgttattgttttctatttgggccaaagcaaagactctgaggcttaagtgtaatccaaatgcatcatataatgaagcttatatcctggaaaagtgtctttatttttcactccactctgcctgactccaccatttcattctcactaactgaggatattcctaggatgatgccttttttattttattttaatctgaatcctgggcaactactccaacattaagcctcatttaggttgaaagaaaattcattttcttactgctttccctctcagctccttgtctgagctttaatcgcaagcagctgtgccaggccacacgccataccacctgagtttctgcaccctgaggtgctctctgccccaggcgaagaccacaaatgttcatcctgacaatggatgaaaccaggatgggtgccaaaactcacaaggagaaggaggtagcagctgatgaaatatagaggtgtgagcttcaataatagggttgcttgaatatgctgaccctcacttcccaggaaatccctgcaattcctaagtgctcctctttattccctatctgctacttctgatgcatattttctgaagattctgctcagttctgctcaatacggctcccctttatggttcattttgaccaaacatcacaaagataatattaatagctaatgctgtagaaagtgggctatgtgccaagcattgtcctgggcagttgctaaataatcactcattttttctttgattctttacaataaccttataagataaatactgttattgttccaagttacagatgaggacaccgaggccccgagaagggagacaaacttgatcaacattacacagctgtaattgatagtggagtcaatttacacactcaggccgtctggctccagagttggtgcccttaaccactgggcaacactgcccttggcactgattcttctgcgctctgtgctaagtacatgcggacatatttttgcaagatcttctcaacagctgggtatcacttttgcatttttatgagacatatatacaagtcccatagccagggaatgtaggagctggaaaatttattttctcattcagcaggtgtttactgatcatctgataagtcctgtgctcagtgctatagacacaatgaggagaacagacatggtctctagtgggggaggcagatgttaatcaaacgattcgacatataaagatatcatttcaaaattggcaaaacatataaaggcagtgcaaggaatcttttctagctaagggtgggaggtgtagagagggggcttttctcccagaggaaggagtgtttaagctaagatagcacccatctgggggaggctgcgtggtaatgggtattgggttagggagcagacagggaaaagtattctcagcaaaggggcataatgtgcacaagccttgctgtgggggaagcaaggtgaaattgtgacatttgagcaaccccagctaggctagaatgccaggagccaggggaggggatggagggaatgccttgaaatgaggcagaagagacgagaagttgtggttcatctgatcctcaagctatgttttaaatctccccgttccactgaccacactattatagcgagttcttagtagcaaattttgcttttctcatttcataaaacagttggtaaaatcccatttaaaaactctcagcaacacggcatgtatttcagacagacataatttcaaatgtgctgtgctttgccatctctaacatattcaatcatggccctatttgcagagcagacactgcaggtgaaaacccttgtaaacagtgaagtgctttctacacgcacgcccgtgttattagccttaataatcgggcttgttttggataatgcatgcgctctaacgggagttaatatatgttaagtgttcaaaacggtgcctggctcatggtaaacaactatataagtgttaactattgtttttactattatgcttccctttttttctttccccaggcttggtcggaggaggacctgtgcgtcgccgaactgttttatgtgttcatgttcctcttctctttcaggtcagaacaaaatctgcttcatcccaggcatggtaggacctatattagagatgacacttatccctgaggctgagctccggaaagccaccataccaatcttcttcgacatgatgctgtgtgaatatcaaagaagtggggatttcaaaaaggtaaaaaatgaggccggaaactcatgccagcatgcctaatccccagcccatttccccataatgatatcctcattccatctccctgagcttcattgagaggctcggcggcaggatagggacatttattcatgggtccggaatgagctggcagatcagatttggtcggtattctatcaagcttttccgtccaaggacaagattaaaatgcagtttctggctgtgtatttgcttagcctctttctcaagaatctaagaaccccacatctctacctaatgattccctaaaaatgtgttcccagggcccacccgtcccacctgtcccactctctcacccactcttgtctagtacttcatcttctgggctgactctgcggatctacattatctagaaaacgccggccctgctgggtgtcacacttgtccacacaccaaatctgatagcagatggagttagggacgtgttgctcaggagggacctgtggatctgtgagggaataggacactggcctcagcatggagggcgccagaacctctgtgaaacacgagagccattggccaaatattgtcattgaatatttcgtcaaacttggacaatgaggtccatttcccgggcctggtcacactgggagctctggcagtggaagaagcaccagttgccacaattggctcccggtactgctcagtgacattaccctgtttaggaaggttggtctttaagtcccatcaaggctgcctgagccgttccctcaggcctcaccccctgtcctctctgccccacatcctcagttttacctctaactgagcttctcaccctcctctctcccccagtgcatctacctcttattcctaccatatcctgccttaaaatgggtacttaaaaggcagcagattccaaactgcctttccttaagatccttagggatgtttcccttcctttacccattaataccctaatccccacagaataaagcccacaccctctagccagcatccccggccctcccggctccagccttctgaagaatgtctcagccatcctctccaactctccccgccttacctcttctccaccatccccgcagcccacctgaatggcattgcctctgtgggtgtccttcgggcattttttttctttctgctacttctctgcacagtcacaaccctgcctctcaacaccttctaaactcttactgatcctgcgaagcccatccaaatgccatgtcacctagaaggtcttttctccccattcctgttatttgatgtctaaggtatgactattatctactgccttgctttatactcatttctgtgcatttttcatcttcctcatctgcatctaatgatgatgatgatgatgattataatgactgactttagatatttactacatatcaggcatatgacacctattttctatgtattagttcatgcagtctttttaaactacaactctgtgaagtaggtaacattatcttatcttacccactttaaagatgaaaagaaactgagacttagaaagctgacgtcatctgctgaaagtcacaatcaagaaagtagcagaacaaaggctgcagcaagcaggtcactgcgattcctaaacccatgctgcaacccgtactatccagccaccagtatctcccagtaatactggctgattggtatctgctagagcagtgctttccctaaatatgtccatgaagcactgatccaacaagatgctccagggaagagggtttcaaggttaaatacctttggaaatcactgcatattggaacccatcttagagattcccagtgcatattaatagagtcaaggcactgagacattccatggcaaacagatctgtcatttcttaaatttatttgtgcaagaaacatctattggattttccatcctattaatctcacatgggagaaagttgttctgagaggaataagagactagtttgctatgatgatatcactgtgagaggtagcattatagggactctagtgccagaagggctagtggccagctgcctttttgtgaagagcctgtaaagaaatctggctgagtaggtcaaatggagaaagaggccgtatctgagcagttgggatagggggagtggaaggtgaaagcttggattgagtgtttgaaggcagcttggaatttgctgccttttaagtgggagcaaggtctgtgcagcttgggaccacgtaaagggcacacgccatgagacgaagggcagtttacttaccctcagacccacttctgaggccagcgggtgccttagaagagttcctgggaacaggtgtgcaaaagaaacacaccaagtgcctgatggtgtacaatgtcccaaaaagaaataagacctggtcgttgcctggattgtgacctgacagatgtttggcagcctcagagagtttcactctagtgtgattttccttccctaaaggattctcgtatcttggtttctctgtggcatgcacccacctgttttctccgtatagagtcattccttgggctcctcactccagtgtgcattcattctgagcatgttccctaatcacttctcctcgcagctcccttatcaaaaaagacaggacaatcaggctgactaatgaggcagatgcccatgtgaaaaccagctggcgtgcttcataggagctcagctcggggatacgccggcccaggcatggtttttggttcagggtaagcagtcatggaaggtgtctccaggaaagggaggtgaatccctgctgaatcccaagcagccttgatggccagaacgagagtgaaccccaatactggggtctagaatccaggagggctggtgtgcaaagtggcattagtacatgatgccaaaataatcccatgagagaagaaccaggtccccagaagaccacattgttccctctctaaaatgtgggttgcttaagggaaatagcagagccaagaggaaactgagcaggggctttgctcccaggtcataccaaaccctctggcctgatgccagtttcttgaagttctctagctcttatgcctttgtatgggctcttccttttatatctttgcctgaagagatcctagacacccttcagctgaggctttactttttgggaaaggctttcctgcctcctggggcagtggttcatctgggtacaagagacaaagattttctcaagccaagtatacataggctggaactaggacaggaaggtgttagactctcagtggctcacggttctgggggctgaacaagaggcaaccccagggcaatctctttctctgctctgggtttcttttataagctctgtgccagatttccctgtctcacctctcacccaaatttcatagacagctgatgggtttgactgatgacatttatccctcatgagtgtagcacttcatcccagaccatctcgggggtctctgtccattgtctaggactggatgtcccacccctggtacaccacatgattcccttggtggggttgtggaaggacagtttcagcaagagggccttaggtggaccccattgtggccggcttggccaggacacatgctagtcagaatgaaacgtatcctatcctgcctggattgagcggtcatcacacttgtcccacacagcacaattacctgctcataggtctgtgttccacagcagactgtgagctcttgagggccaaagctggtctctcagtcctgaactcccagtccctgtcaagtgcctgagatgcacgtggtgggcacaatgtcagtgttcccagaatgaatggatggaggcatttagacccccatcccatgtcattcaggggaaccacatcggcacagggaggtgcattccagcaaatgtttttataaactagaataatgggggttgctaatgactgcttgagtaatccccttgccccgagtacaccagctgtcttgctggccaattctttgtggaaagaggggatgtaggtgttctggatgctattggtgggaatgagtgggagtcctggggtatagagaccttggagactggttggctagatgcagattgtagaacaggactgtgtaccagtcagcatggggatctgagccctcagcaggcaggagatcccagagagaattcttctctcagagaaagaagaggggatagcatctgacagcagcacctagaacagtgcctgaacaccgtaggagctcaatctttgctcattgaattaattaatagacggagatagccatgttagcagattccactgagactgcatcttggcgtggagtaagctggtgatttaaattgtttagaacataatgtggaaaagattacatcaattcaataaatctgtactgagtgcttgctgcgttctcggtactgttgtttggattcagatagacctacttcttataagctgaatcaatgtgggtaagttatttaacctctctcagcctcagcttcttcatctgtaaagtgggtatccaactgccattagaggttcccatcccaagctcttttgggggatgaattggaacgattagagacaactcaaaattagaaagccgcgctgacttccagacaccccttctcacgtgacattctcttttccaggttcctcccaactctacttctttccacccaggataactggcatttcataacagaggaggtcaaaggcagacttactggtgttgatgtcatccttgtcatcttcctgacatccaggcctctaataacatctctgctcttcccatgtcaatgtcagcaccagacgtgtgaggaagagcaatcactccccaaatctcatacttctacagggctggactccaatcagaaaacattctaggagaacaagatgataaaaatagccaagatattctaaagcagccaggagaggcaagagaagcaatgcagggaaggcatgaagcaaacacgaggcccatatcaggccagtctcctggaagagggaggcccaggcagaaggtttgggctcctggagtccactcctcctttctcgattagagcttctcaagatttgtattgggcctctgtagaatctgacttctgtagtggctcaatacaaatctgtggatactcattagcaaacatccacctcgcagcagtggggtaaggagtcaatgatgtgatgcagtcatgtagctgtggatgaaaatggaagtaatttggagaagccagagctacatcctcaactctggatggtgacagtgttgggggtaaggactgttgcagcatcatgatggagtgtatgtttgggagagcctttttttttttttttttttttgagacagagtcttacactctgtcacccaaggtcctacgttgcctcagcctcctcatttgtaacatggggatgatgacattcttctcccttggctgttgtaaagattaaatgagagtatgatgcctatgatgatgacaatgacaatagcatgatgagctttgctaacaattattgagcacttactatgtgccaagtgccttatacgtgtgtttgccctttaatttgttacagtaccactatgaaggagatgctatttcaaatctccatttaatagatgagcacattaagccttagaaatgtttattaacttggctaaggtcacagggctgggaaaaaagtcaaagcaagactcaaaccaagtctattcaatgccacagactgtgagcatagccatttctgagcacagtactgaccctgggatatgcctgactgagaccttacccctccagctcaccccaagggctcaggcatggtggtatggtatcatttgtctcacacactccctggaaccctgtaatttccctcctggcaggctcttttgtgatcctgagacaagtgcttatttacctcaaccacttctgtgctccaaagaaaagttcagctcaccaggaagaatcatgccagcatttcccagtgaaccactcagacaagaaaaaatgcacttttctccccctgcgctgctttctagtaacattcggcagtaataacaataacattagtggtgatgacaagtcgagggacacagcacacacttaatgttaggcactttgctagtgctttacatataaaatctctgtgccctatagctactccacactgtaggtactactgttatgcccattgtattgataaggggtagacaaactctggcccacagaccaaatccatccttccacctgcttttgtaaataaacttttattggactacagccatgccaatttgtgtatgtgttgtctagggctggttttgtgctacagcagcagagttcagtagttgtcacagagaccatctggcctccaaagcctaaattatttactgtctggccctttacaggaaatgtttgccagtccctgatctaaatcctgaccctgaggattagaaagacctaccagctttcccaagatggcagagggaagcggtgagggatttaaagccagacagccgcacagcagactcattgtatagccccttagctgtatttcttcctgctctaggcttggcagagaagacatctctaagcatgatagtccccaacccttgacattggataatattcaacacagacataatgcttgacaggatgcaccatagaagggacgtgattcatttgcagactggcagtctagactcttgccacactgggtctcatctaggtgtctgttccctccctccctccctccctccttccctcccttccttccttccttccttccttccttccttccttccttccttccttccttccttctttccttccttccttccatttgtccgtccatccattcttctctgctcaagctgaactgctgtcttcatttttctccacgttcccacctcgacagctttgctcacaccgtttcccccatctggaatgccttccttttcacatttatcacagtcctacccatttttccaggcccggtatatctccttcaataagtcttccccaactgaggcaactcaccggaaattctttggcatttgtgctgtatcagcacaagcttttggtccctcccttagatcctttgtgcacaaaagtgagggaacgatggcatcacggatgatgtgtgaaccagagggaagagcaaatgtggtccctgccttttcatcacctaaagattccaactccatggagctctatcctttatgcccaggaaagagcctgccaaaggtctctgccattcatctaagactttagacaggtcacttaaactccctgagcctctacttcttcatccgtaataataactgacaccgagggttgtaccaagcaagggctggctgctcttcatgcattgtcacatttaaaggtgatccgtgacctccagacttcatgaagtattatgaagaccgggtgtaaagaggtcaagttagaggtcaggactccccaagtcctcttttggtcttggtgacctttgcgaagctcccctttccctctccaggtgccagtttattttttaatggtaaaatgagggaagggtggactgcatgatttggatggactcttcagggtataatactaaaatagtaaaaaccattttgcaacaaaatcatgttaaaaagacgttgggtgacttcaaaacaatgcgttgaataagccatgcactccagtgggtgaaatgcttcttaacatggaaagtagggagacaaagcattctgtggcttcaatgcaacaagatttggtggaactgtaaatggatacttgctttctgatcacttacctaatctgatctctgatcattaccattgtcaccagtcttgactctctgagacctgacatttgctccatgttttatgagtatttttcatcatttctttggttgcagggaacaaaactccaattcaaactggctgatatatacacagatgagctcatatgaatgggaaagtgtcaggtgtggctgaatgcaggggctcacaaatggcatcaggtctctgtctctctgtatcttcccctctctgcttgccctgtattggtgtaattctcagacagactcgttcattgtggtcagcagcagcctgaggctcacaaccttccatcttcagcttgagcaaaaagactcattttgctaagaggtccaataaagcctcagatttagggtctcactgtctcagtccagacctttattaattctgggacctgggcaatgaaatattcggattaggagctaggcttgtgtcaggtttccacatctggaactagggagggatgctcagcccaccagagccccaaggactgtggttaggactggtgtgatcaccaaaatatggagaaaggaatgaaggaatgccaagtgggcagaaacaatagctgaccaggaaacatggcattccctgaagattctgtgttctgtcacatatctccatgcctgtgcacatgtggtgctgtcttcttggaatgtcctttccctttttctgtttctgcgaaatttctatttaacctttgaaaacaagctcaaataacatgagttgtgaaaagtcttccctgactctcctccctctctccctctcctgcactcgcgctctctcgcacgtgctctctctctctctctctagcagttatcacccatggctccccttcactctctgggcactccaaaaaggcagacatagtattctgttccattttgcattcccagatcccagcactcaacctgggagataaagagtgctccctaaagctttggttgaaataatgaattgactaatttcagccctcagccttctgatgttattgttgatttttgtctcctacatcttcagtttgaaaacgaaatcatcctgaagctggaccacgaggtagaagggggccgaggcgacgagcagtacatgcagctcctggagtcaatgtaagttcagtgccctgtgtgtaggaacagcctgtgaaggtcaggtgaggcgggagggctcagaactccagggggctccgagtggctctgtcctcccctggagatggatctagaggctcatgggtattggcaaaactccatttttggaagaaacctcacatttctctctggagtggccatttctttggaactgatagaatgggccaggtgaaaagaatctttgctgtgttgggaagagggaaataatttaccaaaatgtctactttcattacttcttaactgtggaatgtgattgctatttttccttctatttaaatttttgacagatgttggtcatgccctacgtttactgagcacacttaataacttagcatgctattgtgcaatgtgctgtgtaatccctcctttaatcacacttactccctttgatgcccatttcacagaggtgggccctgaggctgagggaagtaagcacattgttcaaggaaactaggacgagctagtggggtggacaagctgcatcctgaacctggctctgcctgactccagtgtccaggccaggggcagacagtggacagagaacagtgcccaagaccactggacttggagtcaggacatcattttaacagctttatcgagatgtaatttacatgccatacaatttacccaaagtgtacaatcattgactcttagtatgttcacagagctatgtaaccatcaccacaatcaattttacaacattttcattactcctaaaaagcaaacctgcaccccttagccactgctctgccaacacacacacacacacacacacacacacgcgtgcgcacacacacccaaacactcccccatctcccctagccctaggccaccattactctgcattttgtcttgcctataatgttttcaaggttcatccatgttgtagcatgtttcagtacttaatgccttttaattgccaaataatatttggtaattaaaatatttggtaccatatggatgtaccccattttgtttattcatctctcagttaatgtatatttaggctgtttctacttttttactattcgtattgattcttctgtgagcatgcaggtacaagtttttgtgtggacataacgtttacagttctctggggtatatacctagaaattgaattgctggatcatacggcacctatatttgaccttttgaggaataaccagactattttccaaagtggcagctccatatatatttctaccagcaatgtataagggttccaatttctctacattcttgttaacacttgttaatatctgtcttattgattacagccaccccagcgggtgtaaaatgatatctcattgtggttttgaattgcatttccgcgatgtgtagaattcattgattttcagtacactcacagggctgtgcatctttccatgtgcttatgggtcgcttgtatatctttggagaaagacattgggttttgatcctggctctaccacttagcagctgcaagacttcacacaaatcacatgagtctggcctcagtatccccatttctgaaatgggaataataagctcctgtggttattgtgagaactgaataattataaagcatctggcacacagcaggtaaatgcttcataaatattcttccatctccaggacttgctcccagtttctgtctttgacagcttggtaattgcccccttctcccgcgaggccttctcctaaggcttaggaacatgacccagacatccccacttctcgctaagtgcatattctctgatttctataattctctgagatcactctggtttggattctttcttcaatcctttttgaatgttttaaattcaataagaaaggcaaactgaaggccttgctctgaccccctacaatgagcctctcgaccctgcccaagcaggcagagcccagaggacaggatggcgccccaggcagtgccatctcagctggcccctgtccccttcctgtcaccatgcatggccctcactaaacacttagaatgcaaatgccatttggccagaaggagaaacccactgtctgcccctcaggtggatatggagactgatgtatctggggggaataaacaatattctggctgagtcagtgtttatcttaaagttctaaacaagaaaatcaaaatattgaccagaagtgaagcaatgtacagtgctggcaatttccatttttataagcggatggggctctgcggcggtcttcagatgatcagcagggttttcaaatccttcctgagtgattatttataaaaggagtccttagaggtcaaagaaattaaagacagctcattatttttctcctgaaacagaggtgtgaatgatttttgcacaaaacaaatcaagcccgacacagggagccaggtccccatcagaacatccatggggcccctgtgcctgctccatcctttcacctctctgagtctcagttttcttatctgaaaattggggataaaatattatcgagcccttagagtttttgttgggagtctagcaatattaattattagtagtacagattgattaggccttatctgaaatgcttgggacgagaagtagtttggatttgggatttgtttttcagattttgaaataattatacttaatagttaagtgtccctagtctgaaaatccaaaatccagaatgctccagtgagcatttcctttgagtgtcatgttagtgctcagaaagtttgaatttcacattttcacatagaggacagtcaatttgtattacttacaggtggatagcattgcgggtttttgaagccatgagcctgcctatcttttctcccctaggctagtcatctcagttcctccagcctttcctcccagcccctctttcagggcctcactgatacacagggcccccactgggcagatacagtcctgtgggcacatggcttggatggggccttggtgaatagagcagagctactccccctgtggcaactgcagccttgcataggaacacaaggtttaaggcatggagtggggctgaatttcagtcctcatgtgctctgcgcagtgcacaagctatataaccttacacagcactccagttctccctaccctcagagctctctttggagcccacgctcattgatccacgtatatctgaaagtgtaagtctcacattgaatggattcataagacacaccgctgcctttctgtatttcattcctgcgaatagttctagaagtggtgagggaatcggaaggttgaagcagatagatgtatgttcttgggcctttatcctacccagaccctttcaatccctggaaaaggacctgtcacaggtcatttcatttcatttcaaggaatgaaagaaagtccagtttcattagcactgacagagagggggagtctgggatcctccctctaaaagcctccaatgccaagtgaaaatcaactgcagggaggagtgagccccctctagtcctcccacaacaggagcagaagcagtgtggcaagtgtccaccacccttcattccactgcgtgaggaattacctatattttcttatgattcccaaagcttttgtcatactctgttgtgggattacaaggtaaacaattaaacaggcttagcatgcggtctggaacacaggaagtactcaataagtggtagtatcattatatattatggttaatttttatctatgtttcccatgctagactgtgatctcctggaactctgaatccctagtttctagaatgccacatgttgagtggaaggatggatagtggatggatgggtcatttctagccaattttcccatccatttcaccaatcctagatggtttgagcacctttcttgctccatgcataaagaataggaaaagaaagaaagccaagacctttttcttctaaaccctggtttctccaagtgtggtccattgacccgcagcactggtatcacctgggagattgttagtaaggcagctgctcaggaaccagcccagatgtgatgaatcagaatctattaacacaatgccccagtgatccccatgcacatggaagtttgcaaagtcttggacaaaaccagttgttctttttttttttttttttgagacggagtctcgctctgtcgcccaggctggagtgcagtggcgcgatctcggctcactgcaagctccacctcccgggttcacaccattctcctgcctcagcctcccaagtagctgggactacaggcgcccactaccatgcccggctaattttttgtatttttagtagagatggggtttcaccgtgggagccaggattgtctctatctcctgacctcgtgatctgcccacctcggcctcccaaagtgctgggattacaggtgtgagccaccgcgcctggccccagttgttcttaatgttagttccatgttggaatctcctagagaatgtaaacaataaaatactgctgcctgggtcccaccctcaaagattctaaggttattgacctaagttgagcattgggctttgtaaaagctcccctggtgattctatcatgtgaccagggctgagaacctcaggtctggccaagctcagaccccgagatgtctcctgccctggaaagctttaaaaaatcacacaccaaacactgggaagaagctttgttgcattgtcattagggtggcacacagggctagaagtgactgtcccaggaggaggcatgcacagctgtggctgagccagacaggtctaaatcacagggccatttgcatctcccattgagagccagggaacaggtgcttctcccagagtgaagatggatttgtcttatcacagccacagtttgagacgtcgccttcttgcagcttggcttggcttcttggaggaaatgaccctcagaagtccttgcttttcttacctttaccctcctaagggcccctggagagtttcagttccatggggagagtagacagatacaaatcacgtggcctgcataatgtctacttgagatacctgggaacacgctctggtgtttctctgtgggaaaaatatctcccctaaatttaacaatgattggcttgattcaacttactatcacactgatactgggaaggtcctttaatctttctcagccttcattttctcacctgcaaaatgggggaaataattctcacttatcagaattactgtgaggatttcttaagaaaagtgactagtacagtgtctggcacagaataagtaattaagaagaaatagtcatcaaacaaaattttaacccatctgtttctccccacctagtctgtgggctgccagacagtaggtgtggttcttttctatattgatgtctttctctctaccacacaatgcctagcaactaatagatgcttaaagatgttacatttttatttttgtttttaaaatttagaatataaatactaaaacaaatattataattttaaaaaataatttacacatacttaaatagaaaaatggaggcttttctttcctattttcccacctaaagccttgttggaaacagccatcactacgagtttggtgtctatccttgctgactgtacatggcactttataagcacatagagacacatgatggccatgtacacttgcacacacatgcagtgttcggcagtagagacacggatgctggggccagactttttgatattcctgaccatgtgaccttggacagcttagtggacctctccatgccttcgtttccctatctacaaaagtcccatctcataaaattgtgacaggaggttaaatgagttaccatttgcatgaggtttagaataacaccctggccatgctaagctctatgttagttggttaagtgaaaagcaaatattgttctgagacttacttttctcacctagctctatattttatagagcttttcatgcccagacatattgaatctctccaatatttttaatgtcttcatagaattccatttggtgaatatactgtaatttatttaggcctttcccaattgatgagcatttaagatggttccatctatttcactattagacacatttgtgagtattatatctttgcatacttctgagaatatttctgtagaacagattctgcaaagtagagttgtggggtcagaggatatgtgcatttacaatttttacagatactttgaaaattgcttccccaaaaaagttttcttgatttattctcagcaggggtgggtaaaagtgaccatctcccccaccatcattatctatattggaaactattttatttttattttttcccattctgatgttagaaaaaaaattgctgcactatatggataaatacatgaataaatgaacaaaaggagcagtcagggaacttgggttgactgactgattttgcatgtgctccatcccaccgcccactggccccagcacagtctttctccccagccatgagctcactgccctctggtctctgccgcagcctgatggaatgtgctgcagagcacccaaccattgccaagtcggtggagaacttcgtgaacctggtcaaaggcctcctggagaagctgctggattaccggggtgtgatgacagatgagagcaaagacaaccgcatgagctgcaccgtgaacctgctggtgcgtggggctggcgggtccaagtcagaccagaaccctgtgggggggcttgggcttggctttgggtctcacgattgttcttcatagggaagcagtgcttaagggctttggaaagcagacaaatgtggaatggaacgtctgctgcgctttctgctagctttgtgtcttgaggccgtcacttcacctttctatgcctgcctccttatttataacatgagattaatgcatattccctttagcactcaacacatcacatggaaggaagatgacagtatagactggctaagagtatgagctttggagtcacacagcctctgggtttccatcctatatctgataattaatgggatggacaagctaaggaaatgttctgaagtcttagtttgcttatctattacatggagaaaataatggttccaatttcattaggttgtgttgccctggcccatggttaaatgctcactacgtattagtttccttcttcttatagaatggagtcacactaataactagaattgctgttactatgaaccaggttaaccagagaagctaaccccagacccaagttcttaacccctatattccatgagctcccatgggctggctgccaagcagcctctctcacacgctctgtgattcgaccaggagacaggtaggtaagcagccataatgcttcatattcaccgtgtcatcccaccttaaagtggtttaaaagaatgaagttgaccaaaaggccacgtgacatccatcacatcaacctccctaccattcccaaggctcctgaaacacaaaacctgtccccagagctctgttgtgtggcctccctttaccctaaatagactttttttttcaacagcctagatattgccattgattttctagaatgccaaggagagtttaaaaatcccgatgacagcagaaaggaattcattgctaataactccaccaggcccagtttacataaagatcatgaagaggtgttttccacgagctgagcagcttctctctaaggagagacagagttggttgaggaaagtgacctttaacagccagctaagatcagggagaatgcttgggacagacagttctccaagcactgagacaccactagtttttagtgcattgcttaaatatggtgtcaaggaggagggtggggatggaggtggtatcaggacaaatgatgtccagtatgatttgccacccattgactgtgtgctctggaacatgtcaccacccttctctgaccctcaggtgcacgtgggtgtgctgcattaaaccaggatatacacctggtgtggctcatggattggaccaggaccacctggctcagaatctgtagggacttgtttaaaaaatgccacaggattaggatctctggtggtgaagtccagggcagctactaatctaaatggcccctgagctggaatagggacctagattcctacgtattgccaagtttaaatgttttggcgacagaatcccatataattcctgatagttctgcactatcaggaattctgatctcttactattaccgaggtgctaccactcactttccaactcaggttctttccagtgcaaggcctgagctttgaaacatcaagctgggctgcctttcaatgtgggcctggttaaagtagactaccccagtcttggcagcccacctctcaatgcagcaaaacactgaactgcccctcctgatatgtgatggctgagacacatcaagtcctctctgttcctttatagtctaagggtcagggaagtgactttcaaagcagaatcttccaattaggctgtttgatgcatctttggggcatccaggaaaataagtttcttattcctatctcagggtacccagatactagacagcaatcttcctctcatcttcatcaccacacccttgaccgctgtgatattgcagagaacaacactcatcattgtttttcctcccctacctagaatttctacaaagataacaacagggaggagatgtacataaggtaagattcatattttctaaaatccagacctgctgtgtcactttcctgctcagtatccatcgatggctccctgctgccttcaggataaaatttaaacttctcttcttgacattcaggccctctgtgttctgattcctgtcaatttctccagattcaattcctttcattctcccacagtcagccccataaaaccacgtgaaatcgtctggccttccatgctgtcctgttgttcccacagatcatattttccttaagagtgaatactttgtgatttgaactgttggggtgcatttgcattgttgcgggcctgaccttggataaattactgtgaagcctgagtccagacatgtagtaagaccattgactagcccagttttgaagggaaaaaaaagatactaagatgcatgatatctgcatccttgtaggcatttaaatgatattatttgaatatatcatgaaggttttttggggacattagcctgaagcaaagaactcctttgccagtttttctcagaatctcatatttttttctgcaatttaaaaattattgttacttttatttataataaaaaatatatacttattacaaaacaaaaataaacttataaaatatgggcaagcaacacaacaaatgaaataaattcccataatccatacatatttccaggacttttttatatttatatatacattgaattctatgcatgcatattttttgcaaaaatgggtttatattacttgtaatttattctttgctttttctaacttgacaagaactccatgttgacagatgtatatcaacatcatttttaatgaaactataaaattttttccagaatatatcatcatttatatagccaatcctatattgttgaacatttagattgtttccaactttttctacaataaaaagcacaaaaacaaattttttttttttttttttttttaaagacagagtttcgctcttgttgcccaggctggagtgcagtggtgcctattcagctcactgcaacctctgcctcccgggttcaagtgattctcctgcctcagcctcccgagtagctgagactacaggcctgcaccaccacacctggctaattttgtatttttagtagagacggggtttcaccatgttggccaggctggtctcgaactcccaacctcaggtgatccacccaccttggcctctcaaagtgctgggattacaggcgtgagccactgcgtccggccacaacaacaaaattcttggacgtatacctttatgcacatccttatgaggctggagcccttgaggtagagtcaaccagaagattgaggagcaaggtatttacagggcttttgtcacattctgtcagagggcagaaacttcaagtctacgctcactctgctattacggcagatatatctaggtacctagtttagcattactccagaaataggagctatcatttggagaaaaataattttataggttgtcctgagtttgggatatttataacatcactagtcataccttattgtagcagcacaaagctttggggtctgaaggacctcggtccttgcctcactttttctgtaaccttggataaattactcaatctttctgggttgaggttttcctacctgtagaatgtttccgtcctaccttctgttttgaggattaaatgaagtactataggtaatatggctgccacatggtttcctccctccaaccttgtttctccccttctcattttagaaacacagacggcaaatcccagacctccacaagctttggagatttgaggcccgtagtaatctaagaaaaccatatttatctaaaccagactgcaaacagggtatagtctgaaaatctgttctgtttggcaggcagaatatttaaaaacatttttaattggctgccaacatttaaaaatctggagattttacataaaaatcaaaatttcccttttctcctggaaaactcagaaggtgtgacaacactgggccctcgtcctattctgacgactgttagccgaaccgggtggtggcagccattctggacaggcctggagcactgtcatcacgacatcatctctattccctactgtgctactccccgtccacctcgctcaagcacctgccatctggaggtgcttgagtttggtatccctggttgagggacgtcttctttttactagggtgccttcttttgggttctgtagcagatcatcagacccttgagttaacaaggaagaggagagggtgccaaaggaggagttgaaagtagcagggaagctctcccctgggctgctctccccaggttttttgaactcagccatctaggggtctaaggcatcgaggatgggcaggaggagataaggcagaattaagccatgtgtgcacacacaggtgtttctaaattccaaactctctacatggaggtcatgtgcaatttcacggttaactccgattggcagaacgttaggcgggaggaaagtggaaaggctgtgtctgtgaaagcagaaatcactaagcttgaaatctgcttctggctctggctcttttaacctggatctcagttttctcatcttaacagagttattggaaggatgaattgataaaaatacatgataataaaacacccattttttgaatgaatgaatgaacaaatgtttctgcctgggaagctctcccaactcatccccttccccttcagatcaactgttatgccatgggaacctttttagaagcccctcttctccccacctggataaagcgtgctctcctagtaccatagaccactccttcacaacacatatcatcgctgtgttcttgctgttatgtatctgatgatttgattcatgcctgtctcttctcctagactctaatcccaaaccctgagaacagtgcctgcgtttgtcactgtttatctctaaggcctgttatagcctggatgcccggtacagctttgctgaatgaataagtgaatgaacaaaagactgccagggcatcccagcacagcagctatcaaatcaccactaggtgacctttcctcgcctcaaaatctttggcggtccctgccctgatttcaggcagcctacatttgacccactgacccattttatgtggcaggaacactgaacattcacttctcctttggtgagcttcgtgcagaaagcctttttcccaaaaggaaaataaaccagagcattgagacacgcattgagtggagatacccgagaaaccctgtgttccctggtgtgagacagtgggtcagggtagaatgctggcaccatggcaggcattccctgcctctcctctcacatgaagaaattagcatatcccctcaccacattacttagagttgggtttaaataaatcctgctaatgatatgcaggtcaccgatgcagtggttcattgcctctggattctgtttccaacggtggcaggagagaatgttttgtagaggaatctagttcacagtgataataggtaataactgtcactgctcagtgccggctacaggctaatcactttcagtgcatacttgcatttcttagcagcaatgcaagctgtcatgtattgagccttttgtaagacacacatggtctccttggccctttatatgcccagtcactttatagataggttctgtgaatgttgccattttacagatgagcaaactaaggcacagagaagttaattcactgccccttaatacctattatggatcagttatctaagaattttccaaagcgcccttcctttgtccttgttctcatcctcagtaccctcagttatattgccatctcatggttcataactgggatctcacttttcaaagggacaggaagttaaaatgtgactgcagtcaaatagctaactcttcctactgacagctcaaggtctacatatgaatatctattctccagccccgatccacttccttttattaccaaaaaatgcacttacttacacccagagaactctgcagagaggggtaggaactgccccttatagctgctgtggcttgttcatactccttcaatgacacagtgattaagagcaggcatcatgtcctgactcttctgtttattagcacagaactcctgataaattgtctctctctccttcctttatttctcttgcttgtcatattgcattggccagaccattcattatcaagttgcatgttagctggaatggcacctaacttatccaggcaatagttctctcatctgaaaagaggaattcctgagactcatctcatagggttgtcataaatattaagtaatctaagaaatttaaaatagttaacttagtacctgtcatgcactaagtaaccaacacacactaggtgctgtcattacccacacaaagttctggttatccagggaggaggactttcttgcgacccagagaggtgcccagttgttctctgggctcctgcttgtccctgccaggtgtctccttttcactgcacctggtagcttactgcatattttccctcaaacaggtacctgtacaaactccgcgatcttcacctggactgtgacaattacacagaggctgcctacacgctccttctccacacctggcttctcaaggtacagtcactttgggtgaagggcatttatgctgggatcctgacagggcctcacagcaagttgaagagtgaaaaaagaaaaaaaagaaaaagaatccaaatattttgttttgccctgtgtctccaaactcttgagctggcaggatactttttgcactgcttccctggtcacatgtggttttgagtgatctttacatttagcaaaaacaacccctcttcgagatacattttgcagctttatataatatctaaactgctattaacggtaaatcattggcatgcccactgagctgcattccttctgttgagaacttagctgtagctgggaaaaaaatcagaatgatttcctttggctttgggagagctgggagcatgtttcttaggggttcaatgtaaatatctacaaacaacacacagagagccaataaagagtaagataagtgcaactcaacaaaaaccaggagccttcacaagtggaaattgcagcccagcatctctctgactgacactggcacccaggacaggcagggggaagctagcagaggggagggtgtttgcagggcttcatctgactcctgatcactgtggttttaatatttcatgttccctcatttgtctgttttgggacttgggacattagtgctgcctggagggcaacctccaaatatcctgagtactcatgcctcaaaagggcagcctctccagtggtaccccaagtttccagaaataagctgagttcaagaaaggaggagagatggaaaggacagggtgtgtgttggcagggtggttcctgcctttaatcctaggaagacacctgctcttggcagcctctcggccctgtgtgacttcctgtgtcttctcttcacagtggtcggatgagcagtgtgcatcacaggtcatgcagacaggccagcagcacccccagacacaccggcagctgaaggagacgctctacgagaccatcataggctactttgacaaaggaaaggtaatctgtccctgcccaccccccgtggggaccctggccactggaaggatggttctctcccataccttacatccaatccatcctcagctctgtcagatatccctgcaaatcctaactctgatcacttctctccacttcctctccatctccattccttccacctccatgtaaggcaccgacattgctcacctggacactgcgatggatcctaaacaattttcctgcttcctccactacccccaacagatcatcctccatatagcagataggatgatcataaagcatagattggattatgccattcccccactcgcagtttctcaatggctctcccaatctacttaaaacaaattacacaatccttcccatggcccatgaggccccacatgagctgtgccctggctgcctctctcatttcatccctgctggggtccctcttgctcacgtgctctatgccaagctcttttcaaactcagggactgtgtacttgcttttcccagctggaagcattcctccaccatagctgcccactggaacgctgggctccactcagatgtcacatgctagggaggccttccctgaccaccactaggcaaaccagcagcaccactgccccaggttacccttatggcttcttcaaagcacttgttcctatgagacatcatcttgttcattttctttttacttgtttattttctggctccccaatttagaatgctatgagagcagagacttgtcttgcccactgctaaatgcccagtgactaggacagaacctaggaagttcccagtgaatatgtaggcctatgtcctaggttctgttctaatcactgggcattcataaatgaatgaactgaatggataaatgacatgcagtgtcatccttgatctttaaacagcaaggatgcttggctgggtttggtcaggagattggccagaccagctgctgctcagctccagcctctggtggaccttcaggaagtaccagccccaaaactgccatgcaccctatagagaacattgctcggtggccacatgctcaagttttggggccagatggcccatctgcaatccttgctcctctaccacctactcttcccttgacctaagagactccaattccccacccataacagtgagatgctaatagtaccttctttctagttgtaccgtgaaaatagagtgagaaaatgcacgtagagcaccctgcataggacctagtgcatagtaatagctggtgaaatgtcagtaaccgtcatcattatcctactccaccgcttcctctcccaagcctttcctgagtcctctggcttacctgcagccctccctctcctctgcaatgcaagacctcttacagttcatcaggacataatttagcactcaatttgggcctgtcctgtcactgtagtttattgcatctgtcttagtcggacccttctaccttctctggaaagataaaatgaggtaatgtctgtggaagggcttataaattcccaaggctcaagcagttggagagcactgttttcataatttacaattataagcctcttgagggcagagatgctgccatcccttgaacctcctgccctgctgggtgtcaagtcagagcttactatttgtttatcagctgattaagtatgttgcagtgtgagagcctaaaagtacacgttgagctttgtcctcagcaagatattcaattcagcccactctgtgctgagcagagaggaaaaaggcatgatccccaacctcaaaaaacttactgtctagtgagcaaaacagacatgccaataataatattttttgcattgccctttggcattgtgcaataatggggaaaaaggcaaaggaacagggtggtgccaaagtactttgagagcagagaggagggagcagatgggtacagcttaccctgaaagccactgctatggaagctcctagaaggaagcccaaactcctcagtgccccctcagctttcgttccctatacctcctcagggaggctcattgctccaggcacacatgctggctttctactccataagttcatcttgccatcacccgatagactcctctaaattcctcaaaaccaaacgatttcatctattgatgtatatcctttgtccacttatgttccatgagagtagagtctgtgtctcgtccatctttatatctgtttcattactgcacaccacaccatgcccagaacccaccgtgtgcttagtaatgaatgtgtaagactcagagaaattagtgactgttggaggtcccagtggccacacaggcagacctgagaggaaatcccaggcacctgacttcctgccccgccctttccctggtctcttagtgatctcttaacccatggggagagcgtttcttttccctgttcacattatggtgagaagtagacaaagacctatacttgagcccaacagtcccctggcccagcccagggggattaccccaaacttcaggttcaaggtgaagagaaaaccccagcctggcccatatacttgattcctcttcccagcacataaagcatttttatgctgcttgctgagctgtccgtgggtttacagccgtggcttctccactcggcacttggttttatttatttttatgcttggatgcagagagagcacttttgctacacagctcacactgcattttggcaacctcccctctctcctcctcctacctcccccagcttctccatttaggtgcattttccattttaaactgaaggtgaaatgtaatggctatccctagagattgccagcctccggtccaccctgcatctcccctgactctgcagaccgtcctgacctccttcggtctaagagagtgaggtgatctattgactctcgtctaagacagaggagagaagaattatccactatgtctagggtttctttgtttagaattttttctcttaagatggagaagacctactattaaaaaaaaagtcttaatttttttttaatattctagcaccaccccttccacctctatgctacctgactctacttccacacatcaaataatcccattaaaaagtgacaggattggcagagtagaagaatcccaggactgcatatcaggagaactggggcctggtcccaactttgtccctggaaactctgaccttgagccaccttgctcacttctctgtgaaccatttatctttggaaaagggggccaacacctccctgaggaggctgagggaatcaaaggtttccttcactaaacacgagcacgtgggaggcagggactgaagagcaaggccctggagacacacacgggggcttgcatcctgaccctgcttttagtgaggcgttttgacccgggacaggttgctgggcctctctgaacctctgtttctgacccggacaatgaagatgctgtcagttacctctcagagtggttgtgaagaatcagagcacgtaaataaagggtttagcctcatctgtgcctactcaattgtttatcaagaaactccggtgagaggccagaggaaggtcgtcctctctaggaagcccccggcccctctgtatgggggtggatctgggtcagagcaaggtttcccctcagtcccaggaagcacagctacgcctgagtcccttcctcagcaagcgctctgcaaacccggtggtgccacctcacctttgtccctgtgaccttcctgtagatgtgggaagaggccataagtctgtgcaaggagctggcggaacagtacgagatggagatctttgactatgagctgctcagccagaacctggtaaggcatcccctgggaaggctgaatgccctgcaggctgggtgctcagggcctcagctcaccccagatcctggggagatgggcatgagggccaggcggggttagggaaatagaaaatgaacggaagtaggacctgagagaggctgtactgagcatctcccttcccgtggggagtattttcaaagagagatgtcgtggggaaatgcttcggtgacagctcctcaaagggagcattgagtacctgcgaggggctgcaactgccaccgctgctgcagccccaataaacgctgtgttacatttgcagtaaaagttccacaaatcactaaaccaattaaataaaaacacaaatttgtgctttctgattaacagataaatcacattaaaatgctccccatctggttactcccattagcatctccatgctcaggatttggtgggggaagtggagagtgggggaagccagcccagccaatcctgcttgtactgcagaagcctgggtttggcggggagttggactctgcagggaaatgcagaactctttggctgcttccctcccgcccatcctccccacatgttttctggctgcctgagcagcaggaccccagggacccctcttagcccacttagagaggccaggccagcgacttacagagtcagaatgttaggagaggattgatagcttttggtggggggaaggtatagtgatcttgttaaaaacagctgagctgttaactgttttcactgtttgtaagataatacacaaatacacacacatgtgcttgcaccaagagacacctaatacctgccccgcgtgtacctccacatagatgtttgccaatgcctatgcccaagacacacacacatacacacacacacacacacacaggatacattcaagcacacactaatgtatgtgcacttgcctgcacagagtccacatcacacaggcccccgtctagatccacatatatcttccagattgtatcaaatggaagatgccatcgatcatacaccattctttttattgtgccatgtcatgattccttcagggccaactgcagttataagatgccattaggtgtaaagtaagattcagactgtttccagagatgttaaaatacgaaaaacacacacctcttagaatagatgaaatgtcttaggtatacatgcacaggaaaacatctgtatcagggggcatttattcattccatagcctcacaaatccatgcccaagtgtgcatggaggtgggagcagagatgcaatgatgggaaccctgaatgcaactaactgggttcagctccatgcttactggctgctttacgagataccatttctttatctgcaaaatggagatactcatgggattattacaagggtgattcaagtaaccacactagtgcaggtagagtgattaacacagtccctggtatactgtaaatatagctattactattgtgattatagacatagcacagatatgtaaatatgtgcacatggctcattggctctggtataatgaaaatgtcttcaccaaggcctctttgagttgaatgtgcctttgatacacatctgtgttgcaacaaaccttgttttcttcctttagatccagcaggcaaaattctatgaaagcatcatgaaaatcctcaggcccaaaccagactactttgctgttggatactacggccagggattcccctccttcctgcgggtgagtttgggggtgacttggacaccaggcgagagccccagggcctcggcatctcagcggtccttctatgctttgaggatttgcttgtgctcagaagcggtgctcttctctgtctgagtgctgcccccatccccaggagactccccagtcaatagccctcatcataatcaccagcatttctcatctactgtgtttctctaactacacagcaattacagctgcctcgtgaggtagtgagttccccgtcactggaatgaggtgttcaaagagaggctggaggatgtttgctggcagagatttgctttcaggagttactgtagagcagtcgttctcaggctttttggttccagaaccttctttctctcttaaaaattattgaggatcccaaagaacttgtgtgtataaagataatctctatctacatttactacatgagaaattaaaactaagaaaatgttttttgaagtgttcatttatttgaaaataacaataatggtccaggcatggtggctgatgcctgtaatcccagcactttgggaggctgaggtgggcagattacttgagctcaggagttcgagaccagcctgggtaacacggtgaaaccctgcctctacaaaaaatacaaaaattagctgggcgtggtgatgcgcacctataatcccagctatttggggcctgagacaggaggattacctgaacccaggaggttgaggctacagtgagtcatgatggggccactgcactccatccagcctgggtaacaaagagagaccctgtctcaaaaaataaataaaatcttaaaaataaaaatagcactaataaacccattacatgttaacataaactgcaattttaggaaaaatagctctattttccaataaaaaatcagtgaaaatcatgagattgcttcacatttctgcaaatctctttaatgtctgacttaagagaagacatctagattctcatgtctgcttctgcaatctgttgcgatcacacatcacgcagcctcagaaagctccatcgtacactcatgggagaatgagaatgaaaaggataaataacagctttcatgttattgtgaaaacagtgtgatcttgtggttcctgagagggtcttgggaacctcaagtgtccctggagcacagtttctgaaccactactgtagtggcctatttacccatcacgtgacgaattggattaggtcaccagtaggcttccttcagtctgtgagcctatggttcaactctggggtgagggaaatacaaaagaaatggctaatctgatctccaacctcacttgatttagtctagtcaaggagataaatcactcacaattattaatcaacaatcaatgtggaagtgagagtgggcctgcaggagtgattgccatgagccgcagagaggggtgcaggtttcatggaggaagtagaggtggcttcccaaacctggctgtacgtcagaatcccctggagaacttgttaaaagtgcagactcctaggccccactcccacagatccacagattccatttcttgctctgtcgcccaggctggagtgcagtggcttgatctcggctcactgcaacctctgcctcctgggttcaagctattatcctgcctcatcctcccaagtacctgggactacaggcatgtgccaccacgcccagctaatttttgtatttttagtagagacggtgtttcaccatgttggccaggatggtctccatctcttgacctcatgatccgcctgcctcggcctcccaaagtgctgggattacaggcgtgagccaccaggcccagctgggaatctgaatttttaaaagtgtcctaggctccttggatgatcagccaggtttggaagcactgatatgtagagatgtatgacagatgtgtgtttggacagaggaaattaggggccattttaggcagtatgggtggcacagatgtctagagcagagtttctcaacctcagcactattgatattttgggcctgaaaattcttcattgtggggctgtgctatgcatcgtaggatgctagcagcatccctaaccactaccccgtaggttctagtagcatcccccattcccagttgtgacaaccaaaaaacgtttccagatactgccgatgtcccttgggggacaacatcacctttagttgagaaccactgatctataaaagactaacatggtcaggaaggataaagagtgtgttttcacaggcttagagccagaagccaggtgatgaggatatgaatgctgaaccattccagcccacaggtccagcccacatggcccattacaggcaacggggaaatgttgtggccatgtatataggagagtgggtgtgacacagtgaaacctgagtgagtaattattctggaagctgtacataggatggtaagaagaagaaagttctcagcatccatgatcttcccttcctctagacccagaccctttaaagtagtgatggcctctgctaggtcagtgagttgagcccttcctttccctgtggggaaaccaagaggagagtgatgcactggacatccccatggaccgtggtcattttacaagctccccagctttgcttggcccctttcttcacacctgggtccccaaatctctaatgagcatcctttctctgcagaacaaagtgttcatctaccgcgggaaggaatatgagcgaagagaagatttccagatgcagctgatgacccagttccccaatgcagagaagatgaacaccacctctgccccgggagatgatgtgaagaatgccccaggccagtgtatccttggagaatgccctagccaaggggccagacctgagcagccctgccagggctgcagcccacaaagacccaccttagagctcagggctgctgccagaatcattgcagtggcgccatgttgcaggaacatgcaacatgttctttggatccatgttctttggatccttttctggactcttcatgatcctggcatcttgagctctgtttgctttggaaaatttgtctccctttggtgcttttcaaaaagtgcatgaatgtgagctagaatgtcaactgtataaggaaagacgcttgctctggcgtgctccaacttgctccctgcagtaagttcccatctcccacggtgcctggtacagagtgactcccagtaaatatttgagatgagatccaaagaacctatctcaatacattgtaaatgttgcatgcattgattaattcactcactcactaattcattcttatattgaatactctcaagccctgactctatgctaagcaaggtgcaagggactggagattttcattcacaaagtggtcctacgttcagggagcttacagtgtagcaagtaaaagaggcgttaagtgactaattgcactattccatatttatttacaaaaatataatctgtgccttgaggaagccatgcagagtactgtggttgggaaaggagagaaggtttccttgaggaaggtgatgtttgagattactagcaaccaaagcttagcaggaagtggggagaatatcccagacagaaggaagaacacttgtgtgcagaggcctttggcaggaaggagcatagcaggctccacaaactgaaatgacgccatattgccatcataataaaatcaaaactgctaagcaaggcctgcaaggccatccatgatctgacccctgcctgcctgtccaacgtcagccccacccccatccttccttccctttctcacatccctctgaccacagggttcttgtttctgttcctgtgatatgcccagcttgttcctgcctctgagcattcatgttctctgttccctctgctttggatgcccttcctcagctccttacatgactagctgtctcttacccatcagatcctagcttggcgtcaccttctggaagaggcctgccatggcctttctattgtctaatgtggccttctctgaactcttcatgaccctggtatctcaagctccgttttctttggaaaatctgtctcaatttgccattatctctggtgctttttaaacgtgcatggaggtgagctagaatgtcggctccacgagggaagatgcttgccctggcttgctccctgcagttaagtcccccactccctcgtgcctggtacaaagtgactcccagtaaatatttgttgattaatagaaataaaaagaaaacaacacagaaagaggaaagaagaaaagagataaataaatagagaaagggaggaaggaggcagagaagtagccagctcacttggagtacatagtacacagaagtcacatggggtgatattagggtgccgtataagtgggtgtcagtgtggccaagcatggtctttagtgggccagcagccagtgctgggcaacagacaggattcgcatggcagggagcatataaatgcaaggatagggccaactgctgagccagggagcacattaactcagcctaactcccagcattgcaccgtttagcacaaattaagttacagcctttaaaatggggttgacaggtcgcaagtctggtctgctcagtctgctgtactttaatccaaatattcttctctccggtggtaaatattcatctgtaaccttttcattatgcttgcctgccctgcgtacctgctctaccatggttatttgcaggatcaaatgcaactggtggtgggctgggctggttacaaatatgaatttggttataggcgagacataggattagttctaaggcttttctaagtggatctcctgggattgaacagctctgtggccttttaacatgaggcaagggagagagtacgtgttcctgggacacaacatctcccctggttcagtgccaggaggcaggtgcaaaagaaaaggggaagggctaatatttgctaaatgtccttttcttgagactgagggctttatatcctataaaaccctctaaggggagtgttaattttccctatttcatggacaagaaatatgtggggcagagatgtaaagtggtttgcctaaggttacaaagctagttagtgatggaactggtacttgaaccccatgatctgtctgtttcaaaaactatgttctagtacatcatcctttttaaaaagattgatgaacagcattctctttattaactgtttaccatgtactaggcattttacacgcattgttgttttaccctccaatacttatacaagttaggtattattgctttcctgcattttgctaataggaaaactgaggctcacagaatttaagcagcttgcacaaggtcacaactaggaagtgatggagcttggatttgaactcaggcctactttttgacaaaacattgagttcttaatgctctcttctcttgccttcacttgttaaaaagctgataagcagtctgagagggtgacagatctcatttctcacttaggtatccaagtaggaaatgataattgaaagccaaagtctctttgtagggagtctgcagttgcccagccctctggggccccagttccgcgcatacattcagcctgtggcataacaacctcaccagccatcctcctggtacaacttcaggggacttgtgtcacgggcttccctaggacagatttggattctcctcttgggccaacaccagtggctaagatcagtaaacatgacctagaaccttctctaaaacaggggtctgcaaactttctggaagggatcagatgggcagtatttgagtctttgtggcccatgcagtctctgtcacaactactcagctccgctgttgtagtgggagagcagccactgaaaacccaaaaatgcgcgggtattgctgtgttccaataaaactctatggacactaacatttgaactttctatcattttcacgttacaaaatactctttttccctccattgaaaactcttcttagcctctgggccttacaaaaacaggcagtgaaccagatttgaccgcagggccatagtttgccaacccctgccctagacttaatccagagtgattttcttcccagagcaggctgttggccacatggcttgagaaagaaaatggttttcctgaaaatcatagaaataccttcactgagatttattcattcgtgttaaacattgccatctcttaagaagagaaatctatttaaggcagaaacaggcatcagaagtaaatcaatgaaacacctaacttcttagcatagagtaagttcatcagacagaggcaattcaatttaatttggaactaggttttggtcatttcttatgtgtgaaagaaccatagtctctgccatgaaaaagctcacaatctgggcaggatggagggtgtgaggtgggctggggggatgaggaagcctacaaggagctggagggtggatcctaagagaagcaaagacgaaggctgtggaaagccaaaggaaggaaaacaactcctaactggggggtgaattgttttcatggactgtggtatttgacatctgtccaaagggttcacaagagagggatgctgataagggaaaatgttccaaggaaaggaagtagtaggatccattggatatccagataatgatgaaaaaatgggtgaaggccatactggcctagctttgaatgctagccagaggagttcttgattccttagttggcagacatgtcaggcccaggaaaagattttttggagtcatggtggtcattgggtagaatagagggaggaaagaccttgaatacctaaataaaagacgtgggtaaagaagaaatgggaggtagggaaagggaagaggggtcaggagtgggaccagtgaccgctgacttttttcattcagtttgccatattgtcagcttaaaaggactaaagacagacctagaagaggcatgacaagggtctgacccacatagtgcttttccaatatctgtgcctgttgcaggcatcactaatccaccatgggactcttttccactgtctgaacacagctccttaccatcctgccataggcagttgctttcaaattttcagagttggggtgcaaaatgacatttatttgcatattctatagcagtgcttcacaaattttagcatgcatatgtttcacccaaggatcttttacagatccggactcagttggttctcagatagtccagagtctccacttctaacaaacttacgggtaatgctgacactactggtcaaagggccgcctttgagtagtgagtccagagtgaaagaattctgagcttagagttagaagacctaaatacaaactcggatctgttcttacaagttgtgtgaccttcaacaagtggcctggcttctctggcctcgaaggggacaatttaggttaataaggcaactcagtggaattgaggagatcaaatgagatcatgggaagatgtactctgcaattgatttgagagctataaattcattcaatagtattattattaatgataatatagcaatgatgatgattaaacaccactagacaactctgtttgtaggggctgagccctggcataaggttgcagggtgacagcactgataaggacctcagtgactaactagtcattagtgcctagtgggcagccagcaacctgaggttcatcattcagtaaaaatgtggccccataaaggctggcctggaaggtctcagcaaggaccagctatacttaaaactgtccccgcagccaacagatataagtccttaactacagggattccagatatccagtgcttcactgtccagcctgtcttggatgaacatcccaggttcaagaataagccagtgcctgaccagattataaagtaagactcgttgtccacagggaagaaggatggggaagagaacccattggggccaccaaactgagctggtggcagaacagaccccagtgtctttctagttccttctctatcttagccagtttttccccccttttcctcttgggcaaagaatcaccctccaattagctgggctctgcccctgacaaggctgaagccaggaaggatgggagagccagggttatggctcagcaaatcctcagcaagcatcgagcatttgctcaactggatgcagtcagcctatttgttgctcaggttgatctcagagtggccccagggagtccacagacagagtgtggctgggcaagtgataggcagggtggagacagggggccttgtccatgctgagcacatgctcccagagggacatctcctcagcatttgtgaaggttgtacattgacaatggtgtgttcaggctctgataaaggaacagtagaggaagtgccgtgaaggctgatgtccacctgttctagatcagattgcaaagtcactgatgaggccacaaggtggggcctctgtgggacccaaggctgtatgcctcccagctgcccagctcattccccctaccccatgcccaggttgtaatggagcacttgagtgtcttagagtaggtcctcccctctggatgggacagtcagaaacaggatctgctttgcaagatgaaggacccttcagggagaggcagcccctcccagcagcctcacgaagtgccacagcagagcaggtggagctcagcttgggtcttaacctcccctcaccttctcaccttctcagacaggcacccatgagcaggggacaataactgtgcagctagcacggtgttctgctggccctgaagttagaatctcaccaacgattcagggagactgatttagggggttggctgggacacctaaagaaatcctttgaggacacctctgggaaattaggctcagacctcagctcctttgttgcagatcacaggaaatcatgacctaggccatcaatgttagaattccaattgcctggatactctaggggtactatgttctcaaaggggcacaagaccagtctaccttctaaattgccttgtcaggaaagcctgtgcaaaagtcactcttacggagcccagaacacagaccttgattttaaatgcaccacaagggactctgccaggcctgaagtttactgtaatgaacctccctggacagtgcagggtcagatcgggtgtcagcagccggggatggctaccaggagcctcagcctcttcctgtctttcagcttctacaaatccaactacgtgcaaaggttccactactcccggcccgtgcgcagggggaccgtagacccagagaatgagtttgctgtgagtatcttccctacccttgatcattccctggagccacctggaggaaccagagcatgcatcggccagcctcagaatgggaaggaacttgatagaaagccagagaaaataaagccaacctccatggataccatgacgtccgttccccaatctcttccattagggcctgtgtccttatttcttgagcctttttccccttaatacagaacccaggcctcatgtcagaggcactttttcaaccacagggcattcaggcattgccagcacgtagaaaccctcaggctaagaaggggtgttgataaaatcaaaccttccagcaaacaccagtaagaagccacagcaatgtagtcatcactgtcccctgagtgctagtctcctctgtgtgtgtccagctaggattcaaacaagactggattaaggaggtgtctccaagtctcagctctttggcctggacagtaattcttaatatttttggagccactgcctctttgagagtctaatgaacactgggaacccttccccgagaaaacaaatggacacattcaatattgcctaaaaattcagactgctaataaacccaggttagtacttacttggcctaagtccagggagagcttacacttaatgttgggaaagaattcttaagggtaaggtgagagcgtgtttctgggtcttgcaatatttattctgctttcgggtagatgggaggcccggggacctggctgggtttctgccaagcttctccgatacccaggtttcataaatgtgtttgttgctttcctgcccttgccacccctctgcccacggacagtccatgtggattgagagaacctccttcgtgactgcatacaagctgccggggatcctgcgctggtttgaggtggtgcacatgtcgcaggtgagtctgggacattcgtggcagggccacccttcctccgatgggcagggcacagccagtctccaaaggcccctttgactttaaaaaggagacatgtttttctttgaagctgctgtgtgagtcccagaattcccatgcaggcagcattcagaatagtgcctttcagattttttttttttttaagcatcagataacctttttgttccctgcaaatgaaactttccatggcctccagtaataaagctgatgaatggggagcttctgttgggtgggtggggtgtagcagagggcctggaacacaatcattaatcatttccatctccccctcatactcctctcatcacagcacccccttgggggcacctgtgcagtatcccaatatgaatccattttatagttggaaaaactgaggctcagaagggagagatcatttggctagaatccaaatgtttgatctcccttgtgcagataacacctattttgcttctcagcacagcttagggtctccacgtcctcagacagctaaagatcttgcagtccccaagatacagaggaatggtcagtgtggttgtgaggaaaccttgtaaatggacatatttaggatgtcttatttatttatttattcattcattcagaaaatacttaatgtgtacctaacatgttaggcactgttgtaagacctagagattctgcaatggagcttccattctagtgggaaagacggactaaaaagtcaaagtaaatatatgacaggtgataactgtgatggaaaaaattaaagcagaaaggtgatatatgagggattgctattttaagtagggtagtcagagaatgcttccctctatactggctgttgaggagaggcctggaggaaatgaggaaggggtccatgctgacattgaagagagagacattccagcagaggagacagcaagtgaaaagccctgggcccagagtatgcttgtgtccagatcagaacaagtgagggtgagtaacagtcatctgataccagatcatgtaggaccttgtagaccaccataaggactttgactttcccactgagtgacacagagccatgagcagaggagggacgtggtctgacttgcgttttcaagctattgtatcagacgatagcattgagaccgtttcacttctacccttaatgcccctctcttttcagcgaacccagcagctcagtagcccttcagcctcctttttataggcatgacctagaccttggaaaagtataacaatgatggtgatagcaaaaaacattgttttgagtatgggctcaactgttcatatgcatgatctcatttcaacccctcagcaaccctgtgaggtagatattattattcttcccattttacagatgtgggaactgagatgcagagttaattagtgcattgttcaaggttagtaaaagagatagggtatgactttaacctcccctgtcaggcacctggcttggactctttatctttttttccttaagaaaaagaagagcccaccccagcccaccccagcaagtagtacccccaaaaggaaggaagtgtctgtgcccttgcttcatggcacataagtttcaacaagtgccccaggtgctgtgtcaaaggtttatagctatatctcatttaattctcatagaccccagtgaggtacatactattatgagccctatttaggaggtaaggaatcagaaactttctgtcaatctgtagcctctgcccattagccctgactgagccctgtcacctggtggtgctcagcaaggcgcctcttctgtagtcattcctgccaaactgtagcaaactgagagagcccatccctgtacttcccattccctcagctactgtgtgtcagcccaaagcacttatctcctaatagcctacataattttcttgtttatttttaatattaagagaatattaaatataacagtagaccataagctccactagaatataaattccaagaagacagatattttgtctattttattttctgccatacctccaagtgctaagaatagtccctggcccacaactgatgctaactaaagaatacttacataaattaatcagtcaatcaatatgcagacacccgtaatgtctaaaccggttaccttattttataaactcagcgttttgaagttgggaaagaaatagtcaagatttttggcttgtttctttcatcccgatggcttctcatagatggcattggggaaaccttcaaaaagttggccagagtgaatttatctttaatggcctctctcagatgagttaccaggaatttcagggtgtctcagatgcaaaagttgaatgctcttctaagtgacttcatttccaaagattgtttttgtgttatatgaatttgtatcttgttcttggttatttcctccataaattatcatgactacagtaatgtttatatagacaggcattttctgatgagcttcaagtataagttctgcctattggggttttattttgttcttgttcttggccctgagaaatggagactttacaaggagccctgatctaggggtcagagatccaaattcaacgtggtcactaatgagctatgtatgttagataaggactgtatatctctgggtcttagttttaatcatctgtaaataggaattgcaaaatgatggaactttagggagcttaaagggaccttaggtgtcttttagtcctaaagctataaactggaataccttcatagcctagtaagggctgtggcaaagtgcagtagcaacagccccctcctccatctctgttgaattacatttttaaaggctagaatcaatgtgctagctaagtgacagacctccgccagcctggtttggcttgcagttctccaagttttttgtcctgattcttcctggttcttgtctacctgcattattttgtatatgagaaaactgaggcctagcaatgggacttgaactgccaaagcaatttgtggcagaactcagaggtcatgagagagcacctgtcctgtgcagctcataggattcctgggtagacttaagaaggcaatattggtaaaatggctttgaaaaatatgaaatgctggggtgggcgtggtggctcatgcctgtaatcccaacactttgggaggctggggtgggcggatcacaaggttaggagttcaagaccagcctgaccaacatggtgaaaccccgtctctactaaaaatacaaaaattagctgggcatggtggcatgcacctgtaatcccagctactcagaaggctgaggcaggagaatcacttgaacccgggaggcggaggttgcagtgagccgatatcatgccattgcactccagcccgggcaacagagcaagactccatctaaaaaaaaattaaaaaaagaaaaatatgaaatgccacctaattgccagggattgagatcactttctctttcatcttatgttccctcacccatccacacacacttttacatttttttccaaagcaccctcccctgataattcattttctcttcacagcaagcctggcaagagttactatgtcgataaagaaactgaggctcagcttagggaaaagaccagagatttgagggctagattaagtcccaacagcccgttgatagcaagtgtggtatcaaagcttgatttacgtgtagtagaagaagcctgcctttggaatcacaaatacccgagttgtctttccagctctgccccgtggctcagggataagtgacttaacatattgctgggggaatgaaatgagcatgggtgtaatgtggccagcatgggctggcacataggaggcaattgataagtgaggtcatcttcattatcatgatcattacttttattcctgttattagctaaaccgtgggtttaacttctgaaatctaggcctttcaccaactatacaacccctgtaatgacctgaaagttacatatttggtttatacaaatgcccgtaggcgagaagccaaaattattttcattctctttctctgttcctaatggctataatgaggctaacactttgggaatctaaaaatagtttcaaaagcaaggaggaaagccaatcaactgctctttccatttttaatgacttgtcttaaagcctgagtctttcagatatggcagtctattgttcaaatgcaggtgtgttgctgggctcaatctgagcggtggtgatagattttcagtacaactcagtctacaccttggcccctcagagcccccccagagttggtctgtgtacttgacagatactagaccgtgggtttcaccttggaggactatggctgcagccaagctggacattgttctccttcagttaacattatgtgtgtgcatgcatgtgcagttgtagggtgtgtgggtgtgcccagggtgtgcatgtgtggatgcatgtatatgtgtatctatgtgtgtatgtatatgagtgtgtgtgtgtgtgtgtgtgtgtgtgtgagagagagagagagagagacagagagagtgagtcagtcaattcccagggccttctcactgtagagatcagtcatcttcagaaacatccagactcagggtaagggagtaaggaggctataatttcacagaaatggttttaaaagatgaccaagaagacaattagcaacatagcagactaggaagctcctgggtctccctccacccccaaatgcaccagataaatatctactcatggatcaattccctctgagagaaactcagagatgaagtgagggacttctacctaccaggcactgagtaaacatccacattgaaccgatatgaaaagctgaggcacactcaggcatgcaccctgctctgacactgtgctataaaatcaggaaagaaattcccagtactcatcttctctccctgtggagaggagggcttggacctcacatatactaccctaattctaaggttccccaggagggcttggacctcacatataccattctaattctgaggttcttcatgggttggctcttaacttatcaactctgagactgcgcagagttagacatatgcaagtctctttagaccacaggaaaaaatcagtggttttatatgggtgcacatgaactttcaggcatcctatcccctgagaggagtgtagtaaagggtcttttaaaaatggaatcccctgcttctccccagaaggcatttatggcacactcttccagtggctacttggcagcctggcttctacataacttccactgaggagttaaggggcaaacaaatattaacccactggcagcctgagaagcaggctgtcacttctcaaaccttgcctcctggctcaccctagcaataactacaggtttattaatctctcctggaaggagtctgtgcacacattgagtttcccaacttttacagcttccacccaagggctatattctaaacaccttagctctgggagcagaggggactggcatatgcatgtcgccaaagaccacaggaaaaaaaagcagcagttttatacaggcatgaaagcacttccagggcttcattccctgagagttggtgcagagaaagggcttaaaaaattgcaaccccctattcctccctagatgaggtttatgctatgcattgaatgtcccaacttttagatctatttctaaaaggactccatctaaacctcttagctctgggaacagaagggagcaggcatatgcaattctccccagatcacagaacagagagatggttttaaatgggtgcacaaacacttccaggggttacatccccttggagcagtgcagaaagtgggcagaaattaacagctcccattttctttctggaaggggcacacacttccagtggctacttgatggcctggcagctaacaaacttgcatcaggaagctaatagggcaaacaaacaatagctctccagcagccagagccagaggttggcacttcactagcctttcctctgtctcaacctagtgataaatccaggtctatccattcttcctgcaaggagtttggccacataccaagtgccacactagagctcccacccaagggactgtcctcttaaggatatagctctgggagtcaatgggactttgtcttcctgagtggccctagaccacagcaaaaagaggtggatatacaatgggtccaatttcaacaactatatccccagaagcagagggtgcggcctgaacctgagtctaggcacttgccacagattctctccccagcttagggcagagagagtgagaggtaatcgcccatgctcagcttcaccatgaagatggaaaaaactggaacacacatttaatacccccacctttccagctacatctagagagtctagcccctgccttatctgtcactgggtactgacaggaagtggcacatcctaaactataggggtctacaaaaaacagagacagcagtctggacaaacagagagatttgagaggaaccctaacatttcacactggatggcttggtcagatccttcttctacacaaggccagtctgacaagactgggagagagagctgtcttatctaatgcagagaaaccaacacagacactgaaggaaaatgaagaaacagggtaatatattccaagtaaaggagcaagataaatctccagaaaccgaaatgtgtggagtcaagacatgtgatttactcagcagggaatccaaataatgctcatgaagatgctcaccaaggacaggagagcaatgcaagaacaaaccgagaattctaacaaagagaaagcataaagtgtaccaaacagaaatcatagagcttaggaatattataactgaactgaaaaatgccatagaagggttcaatagctgactagatcaagcagaagaaaggatgagcaaactcgaagacaaatcactggaaatcatataacctgaggagcaaaaagaaaagaatgaaaaagaatgagactggtataagagaattatggggcaccatcaagtgtaacaacatacacattattgaggtaccaaaataagaagagagagggagaaaggaacagagaacatatccaaagaaatgacagaaaacttcccaaatctagaaaagaaactagaaatctagatccagaaagcccaaaggacaacaaatcagataaatccaaagagaaccaaaagtatttctcaaacaaacaaaagctgagttaagcaccattagacctgccttataagaaatactaaaggtagttcttcaagctgaaggaagaggatgctagttagtaacgtgaaaatatgaaaatataaaacttagtgttaaaaaataagtacattgtcaaatccaaaacatgctaatactttaatgatggtgggcaaatcaattatctagtataaagatttaaaggcaaaaaaaatataaaaagacacctaaagctctaatagtttgttaaagatagaaattatttttcatgtaaattgtgacatctgaaacttaaaacatgggaggagagggagtaaaattgaagtttgtgtatgtgatcaaagttaagttgttttcagctttaaatagccagttatatgtatgttttatgtaagcctcagggtaaccacaaagcaaaagcctataatagatgtacaaaagttagaagaaaagacccacagcatatcactacagaaagccatcaaatcacaaaggaagaaagtaataaaggaaaaaaagaacaaaggatctataaaataaccagaaaacaatgaacagaatggcattagtaagtccttacctatcagtaatgactttgaatgtaaatggattaaattcaacaatcaaaaggaatagagtgactgaacaacaacaacaaaaaaacctaatgatattgtatattagtccgttttcacattactgatagagacatacctgagactaggcaacttacaaaagaaagacgtttattggacttacagttctacatggctagggaggcctcacaaccatggaggaaggcagggaggagcaagtcccatcttacgtggatggcagcaggcaaagagagagcttgtgcagggaaattccctttaaaaaagggatcttgtgagacccattcactatcacaagaacagcatgggaaagacctgcccccatgattcagtcatctcccactaagtccctcctacaacatgtgagaattatgggagctacaagatgagatttgggtggggatacagagccaaactgtatcagatatgttgcctacaagagacttacctcacctttaaagacactcatagactgaaagtgaagggatggaaaaatatattccatgcaaatgaaaactgttttttttttttttttgagacagagtctcgctctgtcgccgaggctggagtgtagtggcgcgaactcagctcactgcaagctccgcctcctgggctcatgccattctcctgtctcagcctcccgagtaactgggactacaggcgcccgccacaacgcctggctaatttttgtatttttagtagagacggggtttcaccatgttagtcaggatggtctcgatctcctgacctcgtgatctgcccacctcggcctcccgcaaatgaaaacttttaaaaagagagtaggggcagctatatttatttcagacaaagtagactttaaatgaaaaactgtaaaaaaaaacaaaacaaaagacaaggtcattatatagtgacaaaggggtcagttcatcaagaggatataaaaattgtaaacacatatacacccaatgttggagcacctaaatatataaagtagacattaggagatctagagggagacataatgttagtagggtatttcaatacctaacttttcaacattggactgatcatttagccagaaaaacaataagaaaacattgaacttaacctacattttagatcgtaatggacctaacagacatatacagaacaatccaccccacagcaacagcagacacatttttctgaagtgcacatggaacactcttcagtatagatcgtgtgttagaccacaaaacaagtcttaacaaatttaagatttttatttagtttgtttctgtttagttcatgggtcagcaaactgtggcccatggactaaattctacccgtcacctatttctgcagttttattggaacagccattctcattcatttacatactgcctgtaggtgcttttgccctacaataacagagttgagtagttgcagcagacaccatctggcctgcaaatcctaaaatatttactatctggcccttttacagaaaatgtttgccgacctctactttaggtttctactccagatctcatgctcttgcaaactgcactttttgccggttagcttttgatggcactctgtttatatcgccttctaagaggtgttggacaggtgttctgtttaattttcccaactaaagtgaatctaccttggaacagtgaacccctctaacaaccagtcttaggacctactatgtgccaggctgggtgcccacatcgcaagctgctctaatctctctggccaataactcacacatagtatctgcccaaccaatactgaaagggttgaattggcatgtgtttcacccagataataagaagagaaaaccttctctggggcacactcagcaggtacctgacacttcctgcttctgcctccccaaagaaatccctttctcactaagcagaaagccagcctgtctctccccagagagcagacagcccccagagctcagtaattacaagatcctgttacagccccttagggagcattgcctcatttgaattcccaccccaagtgaaatcaataccaataatatctgtttttaaagtgacttaactaaggccctttcttcttggtgatctcattttcaacagaccacaattagtcctctggagaatgccatagaaaccatgtccacggccaatgagaagatcctgatgatgataaaccagtaccagagtgatgagaccctccccatcaacccactctccatgctcctgaacgggattgtggaccctgctgtcatgggaggcttcgccaagtatgagaaggtgaggatttctgttctccaagtctaggggagctcggtgagcagagcagtggtgggaggacccagggggcagatgcaggtacatgtcacttatcctactttgactgtccttgtccccagagggaccctcagcttggttggccctcatgtttctatagcctcatgtcttagctgagctcctgtcttcctcccagcctcttttccataccctgtgctggggcagggaggggcaggaaggggcaggggtcataaggtccccttatctcactgggcagattcaggtggctctattaaggaaaggctctgggatgagtgtgagccagaccataaaagtacgtgccagttgtataaacccacctcttccacagaggatgtgaaatgatgtatactaatggaaagaaatgaaactcagaatctgtgaaaagccataaaaactaagagatcaactccaaaaggggagctataatctagatatcaaggtcataaggtccctccagaaagccccacatgtttgagccacagatttatttttgagcttcctggtgttcacggcaaaaaaggaaatagcatcacttatatgagttacattatccactggaaggaaaaatacccatttctcagtaaggatacgtagctgttcttggcattgaaatagagtagaaagttcttacttggttttcacctagcagacactgaaggaaaaatgaactcctcattctaacaaatcttttgatgaattccctattatctttcctatgttatccattgatgtaaaactaagaataccacacagtagtataatttggggacaataattccagtcacctaatcaatccttccaactaccctcagatacccatgcagtcatcattggtaaccctttgctcagccttgagcagtgatgggatatgtctgtttatacatgagcacacactaaggacatgagccccagaaaggggctgccagggtcacttgcaatgagggaggccatgaggtgagctggaacacccaccagtgagattccttactgaattattttccacagagcaatgttctcaaacttgaaaggagcatcagaatcccctacagtgcttcctgacacacgggtcctcaccccacccccagagtttctgattcaggctgtctgggctggggctagagactttgcatctctaacaagttccaaagtactgttgctgctactggctcaggaacctgactttgagaacagcttccccagagtttgcagcccattcccactgggtgctgatctgagcctcaaagcagataaaacaatgtcagtctctccagacctgttactcttgttccatccacatgcctgtgacctcatccttgcccctttcaaattgaatcttctcccagtgccaaagagattggctgtgaaatgccacatgaacaggaaaccctgacctcctatctgtcctccccaggccttcttcactgaagagtatgtcagggaccaccctgaggaccaggacaagctgacccacctcaaggacctgattgcatggcaggtgaggcagcgctggccaggggagcatgctgctctccttcctctccccccaccgtggttcacttgccccacgctaggctctagctgaggcagcctgaattcacatgccctcctgtcccttgcttttcagcccctcttccaactctgtatcacacctgagcaggttcatcctggaacagagatttggggcatcgcactcttgggtgttgcatggtgccaggcagcaatgctatgctggatggtgccaagattatcttatttgatgttgaattcaggggatggcttttcacagcgggatgcaaataaacaccaggcccccacactccaaaccagcaccttcccccgacacccagcacaggccaatctgataatagaagacttgagcccctactcccacttctcctccttttagagctgacccactttgttgcaataatgctcagatggatatcaggttttgaaaataattgaggcctttgtgtgggtggttgtgagtcaaagggtctacatcccacacaagccgctgctcagcccacgggcttagaagttaccaccctgctgtttcgggctggccacttacctgcctctccttccattctctctttgcatccctcttcttcctgtggactctgtctttcctcctttctctctttctctctgtgcatctgtctgtctttccctctctctcttagaagcctgcacttctattccttgcctctctgtcttttgccccccacccccacacatcttactcctctcttggcttctcttcctcttctgtctcattctccatctccctgcagaagcaacagtcggctagatccctctcatagaggcttacacagggctaggcttccctccaggcccagagcagccccctcctcagacattcgcccactctgggctctcagcaaaccacccatcagaacacaggggtgggctccggagggcaggagctggcgggaggtgagcagtggatgcaggggcaggtggtagcagcttgcagctgcctgccctccctcgctttcttcttgccagtcactgtgcaaagaaaagcaagcttttgtggttgggagtttttgttactctagggaaatcagggaatgagaagcattgggtgcagcctcttttcttaaaataagaattcctaattcaggtccttctctgcctctgccaatttatgcaaagtggggctttaaaaatgaaacaccaagcactgcacagacgcgcttttcccgaatgcatgttgtgtgtctgtctggaattttctctttctttttaccttgtgccacctgtgaagcccaaatatcccccaggtccccagccttctggggtcgtcatgccctttattattcaaataatgatgttctcccttagcatccccagtttgggaagcaggaaggccaggctttgactcgttcccatcctcagatattgctgggaggcctcagggaaggctaacatgtcatacagatttgcttagttgttggatgtcactctgaatctatacaattgccctggtcctctccactggggacctcttctcctctggaaacagcttctccatgctgtgtttactgtacccaaagaatgaactgcagcttcacagcacagcgaataccaagctgtaccttccaagaaaattctactactgtcttggagcttactagagggacattaccaacaaagccggaaggctttgaaagcatgtactctattagatgtggcggcttctgagaaccgttagctaggcgccttcagacaccgccccctagtggccgccttctccttagcaccacccgctgctcctgagaccacctatacagaggcccacctaacccccaaacgaggttgacctcagccatatccctcccacccagcgcccaggcaccctaactatgggcacccgcatgcaaaagatgcagtcctgctcatagtgaaggcagccttttaacattatcacatgcagcagattagctcttccctacctgtttcattccgtttgttcttgcaacttatatttattgagcctctgttgtgtcctaggcaacagtaatagtgatggacaaaattgggcctgctccctgctcacttggagcttaattctatgttggattttggttttgcaaagccaaatacactttgaatttacttaaaacacgagaaggttagatttcaaggggagtgaatgtatttgtacctctagcaaccgaacaaatgctgaagccttcaaagtacatttggtgttcaacgtttttgcagatttcaagatcgatagcttgttaatttattttctttctgaagactttctattttttggcataaaaagatgtctatagtatgctcttcttttaaagcttttgttgtgaaatattatgtacagaaaagtacacataaaaatatataacccactgatttatcaaaaacatacatccgtttgaccaccacccagatgaaatagaattctgctagctcccctaatcctatcttaggcctccttccctaagagtgagcactgttctgtttttatagtaatcatttccttgctttaaaaaaaatactttaccacccaaacactcattcttaaacactatagtttagatttgcttaattttgacctacatataaacagaatcacataatatacagtctttcgtatctaacttattttgcccaatgttatgtttgtgaaagtcattcattttgtttatgagtcataactatgattcacattcattttcattgctatatagtagtccgtacagctggcttatgtaactataccaaaatgcatttatttatttttatactaatagagaattgggtttatttcagcttggggctattataagtaatgctattctgaacttccttgtgtgtttttttggtacacatatgcaaaatttttgttgggtatatacctatgcattgatttgcttggtcatagcatgtgaggatattcagctttcataggtactgccaatcttctatcaccataggttaggttattttgcctgttcttgaacctcttataaattgtattatacagtacagtatgtactactgtatctgtagcttctttggctcaatataatgcctttgagattcctctgggttgttacacatactagaggtttgacttttttgttgtttctaagtgtcatctattgtatgtgtatctaaattaccaataatatatcaatttatttatccgttctgttggacatttggatgttttcaggtgttgtatattatgagtaaagttgctatgaacattcgtgtttgtgccttttggtggacctaagcacccagttccctcagtatacatgcagtagtggaattgctgggccatgcacatttaaccttactggacacaagaagcagtttttcaaagtggctaaatcaattttcactcccacacaacttctaagtcagttgatccacattctccctgacacttgatactgggagtcttttttaattctagtccttctggtggatgtgtaatgatatctcagtttagttttaatttgcatttccttcatgagcaatgatgttcagcaccttttcatatgcttactgctaattggattacccttttgtgaaatactttttcaaatcttttacttatgttgttaatttagttgtctctttattattgatttataggagtttatatattctagatatgcatcttctgtcaaatatatgtattgcaaatatcttctcttagtctggcttgtctgtttgctttcttaatgatgtattttgatgaacagcagttgtaattttggtcaggtttaatttatcatatttttaaatgattagtgcttttgtgtccactttaagaaaccgcaactaccccaagatcatgaagatattctcctatgttttattctgagtttttattgttttgtcttatacatttaggtgtatgatcctttttgactgatgtaaagtaagaggcagattattttcttacacagatttccaatttctttagcaccatgtgttgaaaagactattttcccccacttttgaccccccaaattgaccatatatgtgtttttctattctggactttctattctgatccatcggtctatgtccatgcttataccaataccacaccatcttaggtcttgaaatctaatagtcagtgtaccccaattgttgcttttcatcaagtgtgtcttgcctcttctaagtcctttgtatttctctataaattttaaaataaccttgccaatgtttacacactcctcccaaacacattgagatttggattaattgtacattaactattagattaaattggagagaatggctatcttctcatccatgaacatggactagctctccatttatatagttctttaatttctctcagcaaaattttgtggttttcacatattttattttctttcatatatcttattagatctgctctttggtatttgatattttaaattctattgtaaatggtattgtttttaaattttattttctgtttgttaactttttgtaatacactcatcttatgatcttttatgtttgtacttcttgtaattatgtttttcaatcctaatattggttattagtaccttgtattttcttgattagtcttcttaggagtttgttaatgttgtatcttttcaaagaaacaaattttggctctgttgatcctctctgttgtaaatttgttttctatttttattcgtgtccactctcacctttattattttcattccttttctccctttgaatttagttcgctgttcttttactaatatcttgagatggatgcttagctaatttattttctgtgttttctaatatgtaaaactaaagccataaatgtatctccgtttacaaccttatctcactactatttatatgtagtttttccattagcttccttttttatataaaatctttgtctttttcatgaatgaaggatcttttctgttcctatatattagttaaattttttagaaaaacatgttttcttaggctctctttattctatttcttccaaattcattctgttttttcttcctttattctttccttcttttcttccttatttgctttcttccctatctgttggtctggtctctgtctttcctattggagactttcctccagtgtctggtgatacttggcattctcttcatagttaagagcaaggctaaagaaaaagaaaatctgagtacaagagagagggccttggcaactgggtagcattgctgtgtggcaacggaatgacccacagacgtctctctctacatgggaccattcacattctccagagtcagacccttcaagctgttatatagaaagataatcccagctgctactctgctggccatttgggaattgggaagtggagctctcaggacccaaatgcagactttctcttcaacttcttatttgcagtctggcttctgcttctgccttctgttgtgcctgatgcccctaagcccagagctccttgttctaattgttctagaggataaactcctccttcttgggaaaatgggaaaaaagaacacttggctgcagggtgaggcagtcaggcaatctaactgctcctgatacagaacttcaacacattcctctgtgtttggcccctcagctcacccgccttctctgtagtacctggtgcctccaatctctgaggccctcctggcttcatgtaggcagattggcttcttatcaccacctccctcctctgctctggaagctctggaaggtcagttatgtcctcccacctcctggcacacatattgtgtggcaggtttatgaatgtctccaagtttcactgaagatttcagtttctccttcaccttgtcatttctgggagacctccaatagaagtaagcagaaatatctttatgtcaccatcatgaaagcaatttttcccccaagtaattcataatctacccctttgctcccctggttatgtttccctgagaccacacaactaaagttctcagttctctttctgacagtgcccaccatggctctgctactctcccttaaggtagctgacacttagacagtatccactgacctcctatggggacaaataagacttcaactccctcacatcaatcctctcttcttccctcatcttcctaaggcttttattatcatttttcagagctccctactggggggttaactttatgatattagcacattcatatccttcttcagcagctgtatgaagtgcaattggctccatgtggtaagatgaggctatgccccctcctctgttttctctcagctcttgccttcctctatctctcagcttctgacattcatcctttcactttagtattgccaagaacatcttaggcaaggttttaaatcaatgcaacagagattcccctcctctgatccccacactctgcccccaagtagattctttaagggggcaattttcccaaccatgtggcctttcatggggaagaggggagtccagccctcctatgaggcaagggaagctgggggtctttctctcctttccagagcaaacctcatgtttgcaactttccccatttcccatggctggggaccgtgtgtgcaggtttctgaggaccctgaagcccttgatgaattcttagcaggcagacttgactgcagctgccttgatgggcggggtgccaggctgaggcccaccggtcagcctctggctcattctttaccactttctctccagatccccttcttgggagctgggattaagatccatgagaaaagggtgtcagataacttgcgacccttccatgaccggatggaggaatgtttcaagaacctgaaaatgaaggtggagaaggagtacggtgtccgagagatggtatgggtggttcctatggcttggaggggtgggattgtgcagggtggggcagggaagcatgctggaggctgaagttggaggggatccagcaaaggaagctgcttccaaagagaagataatgatggccagcattgctggatcccatccaggggaaccctcctggaaacttggtccagcaaaagtaacccccagacaaactccagttacaactggattgtgcagataccaactactcaagggactgtgtaataataatgaaagctacactgatgcagcatctactatgtgccaggcctgattcaagcacttgacatctactaggtcatttaatcctcaccacaagcctgagaggcaggaaagatttttaatcctttgtatttcttctgaggttcagaaggtcaggcaacttgccagaggctatgtggcaaatgaatgtggggcagaatttgcatctggctctgttagtttaaggccagtgattttgaccgctgagctccttggcctaaagaggccatgagcctggtgcttacggggtgcttcttcatccttttccttattaactggtgttataaaatgtcaaggccatgcaattcctttaaaaccatctggtccagccttcccattttacagatggtaaaactgagacccagagaagaaaagtgaattactggaagaacctacagatgcactcaggtctcttgattcaaagatttttttccatgaggcagtttgtcactttcaatactccctacatgaagtccctgtaatgcaattctggtgctaactccctggagttaggtcacatttcacaggttagaagcacagtcttagacacttcccacttcaaacaccaaccataagcttcagggacccaggccacccacacttctgcctaactggttacaaactgggagattcccactaccccatcaggtttcataattcactagaataattcacagaactcaggaaagcatgatacttatgatttcagtttatgatacaaatcaagaccagccaggtaaagagacacagagtgaggtccaggagggtcccaaacatgaagtttccacgtattccagatgcatcccccttctggcacattgatgtatgattaccagccagagaagttcactagagcctaatgtccagagtttttattggggttttattatgtagtcatgatagattgaaccattggccatgtgatggaaatcagtctctgggcctgtccactccctggaggttgagctgataccacatggcttaaagccccagcccagccctataatcatagagctggtctttctggccatcaggagccatcttattagcataaaatcaagtatggtcaagggggccaccatgaataataacaaggatactactatcacataggaaattccaaagttttagatattaccttccaggaaccaggagtaaaggtcatccacattcttcattctacaagaacgccctagcctcagccagccaggaacttttgtgctgatgctccactcagccccacaactctgccctgcctaggtggaggaagaaggtgacaggaaggctggggccaccttccccaggctacagctgctaaccaccctgttctcccaccacagcctgactttgacgacaggagagtgggccgtcccaggtctatgctgcgctcatacagacagatgtccatcatctctctggcttccatgaattctgactgcagcacccccagcaagcctacctcagagaggtcagtccctgcaccccaaggagccccccacacccctgcctccctggctctatcccccctccttctctctcttctccggcaacatcccttctacctttcccttcctcctttcagtttaaaagccttttcccatctgcagtctcacaactaccccaggaggctcatggttagtaccatttttaggggattatcagaggctcagagaggcaaggcagctttcctgaggacccagcaggagtcacctgcagcccccagacttctagtccagtgatctctgtcagccaggcagagctcctcaccaagcctgcatccttctggaatattgtcacctctcatagggatctgttccctttcaaggaagctcctcccaaccacgatgggatgtctccattgcagagctcttcctcctgcaccacctacccacccctctgtcgggggtcttccctcccttgccccttccaccttcctggagccctctggccatcattgttggaccctccagaaacttccctgcgggcctcagaggttactcttgcccagagggaaaaggatggaaacgtcttctgtttcacagttctagggggcatcattcacaattctagggggcaccattcaccctgcccaactcatctgttctaatcatagatacatgagcaacccagcacttaccatatgccaagaatatgccaagggttcctcagacatcatctcatggccactctgcaaggtctctgcgaagacctccatttactgaaaaggaaatgatggcttgaagaggttgagtgatttacccaaagttattcattcagctaagaactggccgtgcctggatttgaatccacattcatgctttcaaccagtcttctctcctcaccaccagtttcttttctatggctcacttctttcaatttcattttaccacgaataaaataaagtgaactttactcatcacatttaactgtttgtgcattgagcaagttgctccccaaatcctctgccagatttgctgatctactccagaccctgtagtgacagctcaggcagcccaaaggtccccttcagcttcctgggtccttgcaaggcagttctactgaagctctaactgcagtttctattgctgcccctctggcctttcagctttgacctggaattagcatcacccaagacgccgagagtggagcaggaggaaccgatctccccggggagcaccctgcctgaggtcaagctgcggaggtccaagaagaggacaaagagaagcagcgtagtttttgcggatgagaaagcagctgcagagtcggacctgaagcgggtgagtggctgaggcagattgcctctccagcgctgttagcacatttccactacatgctgggcacaaaacccagggcttccagatatgggcttcctgaagcctgccactgcggtgctatgggtattgcagaggcggcacctgaggagctgagaggtgaagtgcttactcgtgcccaggcagctggggtggctgggacatgacagagctgggagttgagccctgacctttgcacttcagagcctgtgtgtatcctttccaccatcacacagggcttttccaggctggggagaatccacctgttctcccaccaaaagggagagcagcccacttggtactgagctaggtgtttctatagcccccagccccaggcctattctaaccactgatgtctcagacccctgcaagcccctcctgtgtgccaggagtccaggtggggatacagggatgaaatctcactgtcctggctttgagagtgttggtcttgtaaactaacgattatttaaaaatgagacttggtttcagacagccctggattcaatcttagtttccccctggaaaagaggtttgttggaagtgttctgggaacctgggagtgggagatggattaactgccctggcaagggaggggtgccaaatgaaagagcaaggggccaaccaagatgccttagtgaagaaagggccctccagaaacttcccagtgggcctcgcaggctactcttgcgtggatggataagaatggaaatgtcttctgtgtttgtcgattctaggggacaccatttacatgatagtctaaatgaatgtccgccacccccgcctgtagttgtgtagtgtgcaacctgtgcaaccatatgtggcaggctggcatggaatggtataatacagaataaatgaacttggagccagcttcatagaaaccatgccacgccctcctcactgatctttcagagacccagatctgcctcatgctaagcctctgtctttgtgtgtgtgtgtgtgtgtctggtgtattcctccagctttccaggaagcatgagttcatgagtgacaccaacctctcggagcatgcggccatccccctcaaggcgtctgtcctctctcaaatgagctttgccagccagtccatgcctaccatcccaggtatgccccctgctgccaccagcatgagggagtagagatagtgcaggccaccagccttgtgggtggaggatggatgggaactgtgtctacacaacaaagtgggccaggcatcctggagtgagaggctctgctcatagccacccaccctctaatctctccccacacccaccacttcctgggggtgacaccatcccagcaagctccagcagggacaggggagaggcctgctgtcccttgggccctcaggattcactgagcatccatttgtcacactaggtggccccttgttctcagttagccaggcctccccaggggccagaagtttgcccttggtatgtccctaagacctgtggcttctttgtggacctggaagactctttctggctttacagaaatggccaccacatcttatagctgcaaagtgtttggtgcatagatgctacctatctgccaccgtcgtcactcactcactgtccagtgaggaggttagagcacagccgatggtcctaactcacagaagggaatctgaggccctaacaggggacatggcatgcctgagagcactccatctggtaggcagaagtccttgacgtctgctgctatgtgcctggctctgtgtgctaagggccaggtcagaagggaacaagacaggaccagtgctgccctgtggaactcagcaggccgatcatggtgaagacgcttgctgtttcctgaacattgagggtgccaggccctgcgccaactgctactccttctttatttcatttactccactgcgcatacccaggaagtagttcatgttatccaccccattgtatggatgaggaaactggggcactgagaacatcactctcttgcctatcaccagccagcaaatggcagagactgagttcagacccaggccctcttccctggaacaggcacctacccactgccccgccaccacccccaggatagcctgaacacagctgcaacatttggcccaagccatttcactggtatctgctcagcaggtctcaccacaccctggcggtctgggctctttctcccatttggccaatgtcaaaaccagcagtcagagagtaactaatttttcatgtctctgtgacgccaagctggggctgtaaccactaggtcatctggcccctccaccaggtgacacgtgggtttgagactctcttcccgctgtctcctgcaatggggagagaaatccagggtgttggtgttgggagctggaggaagagtaagctcacactgtcccctgccttggagcagaaggttctgtttcctggggatgtcagggctttggggcaaggttttgaccaggagccaggaggctgaacccttgtctgtagggtgggcaatcttcactgcaagaggacagcttcaatgtcccctggcacggcaggaaataggcatcctgcctcctgcttggcacatacaatgtgtgatccctggatgctggctctgtcccccagccctccccctgtctacctcccccaaggcactgcccctcctctacccacccattcacaccccagctctgctctccttccagccctggcgctctcagtggcaggcatccctgggttggatgaggccaacacatctccccgcctcagccagaccttcctccaactctcagatggtgacaagaagacactcacacggaagaaggtcaatcagttcttcaagacaatggtgaggacattgagggtggaaggaaaggaaggcattgggaggagaaagggaagagagcaatgcagagagaagaaaatggggggttgtgtgtgcatatgtggtcattcctagggaggcatagtcaggaggccctgagttctgggacactgtgcagcaatgcccagagggcagttctcctctggggcctcaggcagctcctctgaccaggattgaccccagctagggatgtgcaggacccagggacctcagaagcagtaggtggcctaccctcgcctaaactgccccttagtgctccagcccttttttattcaacctatatcacaaaatcctacaaattgaacattagtttccaagcgctgattctgcaagtcccatctcctattgttacttgttggcctttgctcaagatcaagaaggtaccataacacatctgatcctcaaggtaatatgaaatcaggactctgctactacaaatatctcaagtttaccatgagcacacgatgagtcaggcaccatgctaagcacttcccaagcatggtgccatttgagctcccactcttaggattttatatgggaggctcacagggtttggtaagtgaggtgcccaagtccacatggctagtgagcctgggctcactctactgtctaccactgcctttctggccaaagccaagggcatagcagctcacattcactgggctttgggcaggggtcagtgttgaggcccttgtgattaggactgggaagctccattttggtgcttaatctgataatcgcatcttggttttgtgcttgtttattctctcaaaagctggccagcaaatcggctgaagaaggcaaacagatcccagactcgctgtccacggacctgtgagctgctgctgactagggctgcatgggagagccagggaggggagtttctggaagaggaaagccatgcgtggaacatcgaagcctcagagagtgggagactgtccccatcagttgtccttacttagaggagacagagaggccaatcaggtcccagagcttgaatgctaacaagcccagcatcccctggggctgtgatcatggtggatgaggaagcctcaacgtagattcctgaactcaaggtaccagcaagaatgccttctcccagtgtgctctccccaacatcctaggcacagctttcataacccagtttcttaggtgtaagaaactgtttttatctcatttattaagtctcagaacttaacagaaaaggaagccttttaaatattctttttaattttattttagattaacagttttgtactttacatttttttatacaaccaaccagtttcttttctagccaatcatctctgaagagttgctgtttcttactgacaataaaaaatgttctcttggttcgaataa

SEQ ID NO: 1687 - DNA, 250395 bp, Homo sapiens
gacagacgaggtttgcgcttggctgggcatgttccgcggctactctgcggcgcgccaggcccccgctttccgcaccccgcgaccctagaagccaccgaaccgccggcgggccatggccactctgccgagcgcagagcgccgcgcgttcgcgctcaagatcaacaggtaagacgccccccgcggcgcgcaggttgcggccggacagcccagcgctggtgtgaagcggagcttcgctgcaggggccgaggccggacgagtccattcgcgtccgcggcggggcgcgcctgagacctggggcgcccggttcccgaggctgcggcggtggagccgctggacgcgcggcggctcctgcgctgggcccggcgaggtcctccccaagaatctcggtgctcctggatgtcctcagccgccggggatcccttccccgaacaacctcgcccgctccgccctccaggttcttacaggtggccgggtcccagaagggtgataggcgcctgggtaaccgtgttgggcgcgccacggagtgtctcataaacggctccttcctttgaggcaagtctgagcgcggggggaagaagtgaagtggctgaaattagagttgcgtttgaggcaggctgcaagccttctgtcgtcctgagcaaggctccgtcctcgcctgcttcattattccagaaagagcttggctcctggtggcatcgctatttttataccctggtccaaaggagccatgaagtggaaaaagtgattttttaaaaaatctacacttaaataaaccaaaagaaatggcctgtggctgacattttgagatttacagaactccagcaaaaagctaaggactgggggatcccaactcaccatccaattcctaatcaaagttgcacaaactaaatatgtaagcacatttactgctcaaagttctcagtaaaggtgctttaactgcagtttttcctccactaaaaactgctgacaagtaattgggacatttttgtcttgccctgagaaagctagactgtctagttaaaagataataggaaactcattctaaagtgtcaacttattctattgcccacagggctgtccgatttgttaatcttcacttagctgagcctgtgaaaggtggattccaccgtaggttcatctttgtgctgttagtgtgtgaagaggtttgaacaaggaattaaaagcctagaaaaacaaggcgataaggtcttctagagggcatatcgagctttattgacgattttatttccacttgatacgtgactgccagcaaactgtttctcttaccttactatttcgtcatctgtaaaatgagtttaattatttatgtatattgcatattaatgttggaggccaaaaggtactagtcaaaaggcataaagaggctgggtgccatggctcacacctctaatcccagcaatttgggaggcccagatgggaggattacttgagcccagagtttgagaccagcctgggcaacatagtgggacccctgtggctacaaaaaaataattttaaaacattagccaggtgtggttgcatgcacctgtagccccagctattcaagaggctgagacaagagcatcgcttgagcccaggaggatcacagctgtgatcatgccactgcattccagcctgggtgagagagtgaaaccttgtctcaaaaaacagacaaaaaaaaaaaaaaaaaagcaaaaacaaggcatgaagtatatcagggatctccctatgggaatttttttctacattaaggttcatagctgttgcatgccaggaggggtaattcattcaaggagtatagggaatcaaactgaagttactgatgggtgtattatttgctatagctcctgatcctctgtctttgtgaattttagatcaggaagtgtgactggggcagaaagatgttagaaactatggggttgggcagggttgatctggggtgagtggccgagacccggactaatcctacaggcagtcttgcaagcaactgcggggtcggtgtcacctgggggttaagaataaaggccctggttagtgtctgatctgcttgcaaattggctctctgctacaaagtcactgtgcaacattggacatgttacttaacttctctaagctttggtttctttatgtgccaagtagagttgatcatagtacctacttcttatgactgtggggaggattaaatgaataataggtacaaagtccgaattgccaagtgctggatgtgtaacatacacattggaatttagagacagtacagaaaaaataatgcaaaatgtcttgttaatgattttcatgttgattgcatgttgcttgtagtgtctggctcagaataaatggtgaataattcttagttgccatcattaacattacaatcagcttcactgctgtcattatctccatcatcaccatctttgagagcctaagatagaaaggtaggaaggaaagctgaagttggagagcttcaggcagagatcagtttgggttaggtatggagatgccagtggctggctgggagctttcttggggccagtgtttctccgcctgtgccttccatctggtgctgagaacccaaaacacattcaatggaagaaaatatgtgatgaaatctgatcaagaagagccccctcaagtttaataaagtataaaaggttctataatcctcaggcaagaaaatggattggaaattcgtattcttagagttctgttttcctttttgaagcactctgtgtgttgtgtgggagagttatgctaaggagcttggcagaaattattattcaaaggagcagattaataaggacatacctagtattcatatatcatttaatttcaccatttattgtttacttattgtgtcccagacactatattatacagttaatggattttatgattaaattctcacaaaaagcctatcaaactcatgaagtcttgtacagaagaggaaaaggaatcttggagatacagctgcacaaggccatgtaattttttcaagaccatacaaccagcaatggcagagctgggattgcaaactgctccaaagactgtgctcttaattgggccgattgttattttgatgcatatgtatcccaagaatttcctttaaagcaagaggggaattaatttttaaaaaatcatcattttggtagcagcattggcaaagtgttctgtttctgattagtgtttaatatataaacattaacaatgtgatgttttgcaatgttgaaggtggaaaagaaatgttttcccttacgtgcctacctattattttttttaaataggtcaaattccaaaagtaagactgtgttgaaatatggccattagtacattcagcatgtgctcatgtttttcaccttactactcagaatagtgtaaactatctcttaaaaatatttgtgggataaaaccagtgtgcttcctgttaatgaagtattcaaatctgatatattaaaaatattatttgtaaagcgttcagttctgaccacaccagtctccagaaggagtgagcagactatctcacagtctgagaagaaaggtgaaattaattttcttgtaagtgctatatacttgtcttcatttccatttttttgttgctgacttgcgtgccaaggaaagactagatctaagttaggcagttcgtaataacatttgcgtttgggatttcaggtgctgctgcattaaatgtcataacatggtacttgtgggaacatctagtcttgttaattgccttttttcttactggaatttagtgcctttgtagattataaaaattattactagtactctgaaaatttattaaacaaaatcttagtgtctttcaaatacagaatagatgtaaaatttgatcaaatattaaagtaaaataagaaccttggataaagaggacgaaagtgtagaatgcagaaaaaaacattaaccctcttgtggacagtcaggattgaaaggaagaaaaaataatggcttacacttctagaatgctttctatgtggcagagacagttctaaatatttacatatcgtaactcattcacctctatgagataggagcaatgactatctccgttttacagatggagaaactgagtgcagagaagatatagaaattgtccaaactcacaaacaactaattaaggtcacagctgagattcaaatgcaggcagcctggctccagagtcttctcttttaatcattataccatgctgccatctcagttttattttaaaataataataggtaacatttattaattatttactatgtgctacatattgtgctaagaactttatataccttcatttcgtcctttcagaaaaggaacaaacagagctgggtgcactggctcacgcctgtaatctcagcattttgggaggccaaggcgggacgatcacctgaggtcaggagttcaagaccggcctggccaacatggcgaaaccccgtctctactaaaaaatacaaaaattagccaggtgtagtggtgtgcacctgtaatcccagctacttaggaggctgaggtgggataattgcttgaacctgggaggtggaggctacagtgagctgagatgtgccactgcattccagcctgggcgacagagtgacactctgtttcaaaataaaataaaataaaaaataaaaaaggaacaaagtattaggcataataatcatcaccagagagtgattttatgaaagacaaaaacaaggtggcaagaagagagaataaagttacataaagatagcatttaagaacaaccacaggctgggcatggtggctcacacctgtaaccctagcactttgggaggcctaagctggtagatggctcgagcccaggagttcgagaccagcctgggcaacatagcaaaaccctgtctctacaaaaaatacaaaaattagccagctgtggtggcttgcacctgtagtcccagctacttggaaggctgagatgggaggatcactcgaacccaggaagttgaagctgctgtgagcagtgattgcgccactgcactgcagcctgagtgacagagcgagactctatttcaaaaaaaaaggaacaaacccaataattttgggcataacgaccagagcacaatgagctacagagagctttctgagaagtatttgctaattttatctgcaaagataatacaagcataaaaatatatgtattcaaatgtatagatgtgtatctgcagtgagagcagagctgttcctcagtagtgggggtggctggcagagtgaggtagtgtgctttcaggaattgctttatttgtctgatgtgttctagaccaaagaccaacagaggggcttgggcaatcagacacagaatttttggcctttcacatttagaatcggttccttccagattcttggaaaaggtccatttgtgctttaggcatctagtgctattctgaagatgccttacaaaatgtatgctgaaataaccttctaccagggtgaattttcttcatttggagttctttgagttctgaccatttatgtatattgatgaagctaatgtttacttcttcatagaccagtggaaagaaaacgtagtaacatgtagttgcccagggaaagatgaagaactcaggggaccaagtctcccatctcaactccccataaaggtagtgatggaatgggatgatgttaaaaacacctcaactttccgtcctctttaagggaccgtgagaaggtagggatgttaccatactcagacttcttgctgagaaagctaagaaacaaaagcatttagtttttttcagtggcaggtgcttattaacgtttggcctatttgataaagggttaaagcaacaggaatgtgctactgctgttcccacaagcagtagtctaatttctttctttttttttttttttctttttttgagacagtcatgctctgtcgcccaggctggagtacagtggggccatctcggctcactgcaacctctgcctcccggattcaagcgattctcctgcctcagcctcctgagtagctgagattacaggtgcgcaccaccacgcccggctaatttttgtatttttagtagagatggggtttcaccgtgttgttcaggctggtctagtcttacccagtcagcagcagaaaggctctctgggctctaggtaaacacatgaaatttatatagtgtgtttaagtgtggttcctgtgcttctggagttggcacagtagtggtaccatttgctgtatcgacaacagtgggggtatagacgaaaaacagattgacacctctgaaagtatatatgaacacatgtcgatgcagcatttctggtgaaactaagcaaattgataaagttggcctagggtacaagacattatgtcatgtcccactgcattatgattaaacccaagattagaaaggagaaatgatggcaacagaaccagtttctccagctgtctattctcatgttcatcatcacagataggaaagggcagccggccctctgcatctgtgggcacatccctggattcagccaaccacagatcaaaaatatttggaaaaaaatgtagatagttgcatctgtactgaacatgtacagacttttttcttgtcattattccatacaaaatatagtataataactatttacatagcatttacattgtgttaagtattataaataatctagagatgatttaaagtatacaggagggctggccaccgtggctcatgcctgtaatcccagcacttttggaggccaaggtgagtggatcacttgaagtcagaagtttgagaccagcctggccaacatggtgaaaccccatctctactaaaagtacaaaaaaaaaaaaaaattagccaggtgtggtggcaggtgcctgtagtcccagctactcaggaggttgaggcaggagaatcgcttgaacctgggaggcggaagttgcagtgagccgagatcgcaccactgcactccagcctgggtgacagagtgagactctgtctcattaaaaaaaaaaaaatcatgaacaactctgcatgtaaatcaatacagagctgcattataatttacataggctgtataaaatcctgttgattagatgtaaaatgatttattaaattaattttctattattgggcatgaagataggttccaggctgggcacagtggctcatgcctggaacctgcctcccggtgctttgggaggcagacacaggagaatcagttgagcccaggagttcaagaccagcctgagcaacatagtgagacaccagctctacaaaaagcaaacaaaacattaggcagacagggtggtgcatgcctgtggtcccagctacatagaaggctgaggtgggagggtcacttgagaccaggagtttgaggctgcagtgagctatgattgcgccactactctccagcctgggccacagagtgaaaccctgtctcaaaaaaaaaacacaaaaaaccaaaagagataggttctgacttttcacaatagtgtatagagtttgatggagcagtcttatacatacttttttctgcgctagtgcaaacacctccttacaaatttctaacagtataattggtcataggaaagaaacatttttcaagcttttgattgccaaattgacgcccagaaaaggtatacctgtttctgctcctaccagtggccctacgaatgctcctttccccacattcacacccccaccgagttttatcattcttttaaatctttatttgccagtgttgacctcttctcttaaatgcctgtaacctcttcctgtttagcttctctcctaggtcagagagtgaactctgaagtcattctttagggattaaaatagtcatgcatttctccttttttctttgccttacatgcaaccataaatggtgagaacttctatcctttttcactttctgcttctgttcctttaataggtggattaatgataaaggtagattgttcaaacaacttagttatttcttaattttgttgtaagctctagttgccagactttaaactgtgctttttactttgcttaacaatgtaatccaatctacctcctcctttgggtgcctaagccatagcccttttaaataaaatagcaaatggaaaatcagaatccctttctatcgcaaaataagagtccagattacataactcattgtatgtgttttcacttggatgagagaatagagagtatggacctctttcatactttttttttaatgttccttttcctctagaattggtttctggggctaaaaggaaacagtagttagtaccactctgctcagaaacctcaaaaaacttcgacttctgtcattctcatcaaagggcaaaattcattgttcttctgtgatagagaccaaaaatacaaatagctaaactggaactaaattaagaaaaacagaagttaataaactccaccgcctcactcccatctcttcgtaagttagtaggcttgtaagtcctaggctggttagttcattcatttgttcactcatgccagccattgaggattattgtgttctaagtgctgtgctaagccccagaaatacaaagacaagtgagtcatgggcctgcctgcaaggagtgaggagatttactcaaaattgagagctggaaaaagaaaggcactttccctggcctcatagccctccgtgacttcaaagtattcctctctggggtcatgccactagggataatagcattatccaaaaacatttttggaaatccttttagaattattctcagggactggagtacatttatttttaaaaagaaacttggtgttttaaaatctttttttttttttagggagaatctgctttattatttgagaagtttcaaaaaatatagaaaatacagatgataatatggcaagtatctaaaggtctccacttaacagaattaacatctgttaacattttgtcacttttgctttagttgttttttttttaattaaaaaagagaacattacagataaatgtgaagtccctgttattctgttgcccatttctgttctccctgctgctccctgagagtactaacacaaaggtgtacttctggggtgtgtgtgtatatgcatatccataaacaatatatggtatagcttctggagggatccaaagtcattagcactcaagcaagcctattaaataaaataatatcagcttgagttaaagataacatatagccgtgaaataacggagctgatttttaggtaccttgtcaaatagttctgaaagtaattgcaaagaggagttccaaaagtgagttcagaaagacagctttatcagaataaattgcatggtactgcatacaggaaactataaagaacaacggttatttagaactgttcattctgacagtgtttttcaattactccttaatattataaccacttactcatttcctgaaatcaccaggaaatttttcaaaaagatttttctcccccgatgaatatacccacgatttgcatttgacccaagataagcagttgagtcgataacatgttaatttttaaatacatggttttaaaacacagaataaaaattctacctcattgcttggagactcaattaaggagagtatgcacattagcaaaaagaagatgtgatatttgctcagaagtcttgaagtggatattttggccttcgtatggctgaatggtcaagcttgactctctcgtttgctcagggaggcccagtccctctgctgccacgggtagaaatactttttcctaaatcgctgcttcttctcactgccatacagagcaatattcaggacacagccaaaaccttctttggcagacctttttgagttctctctactcagctttctgctgtgtaatatgagcactctagagaagttgggctgtcctcaggaaattacacttggggtctgtggttccccaggaagacaaactggagctccctaaggggtactagtcatcatacggcatttatactagcattgcagtccactttcacctatgcaagtagaaaaactcaggctcaaagtccactgacaatgcaggagtcccttatctgctggttaacataaatgttgttttaagatgatggccatctgttgtctgtgagaacaagactatcacccacctgttgacatgctggctggtttaatatcttactctttcattccaaataactacctggtctcacagatccccttagatggggtatccaatttacctcctgtaccttattctctgtccaataatttcactcaaatcaacaagatattttattgcctatgacttcctctaggtattacgggagattcaaaacacaaacagacaagcagcctatgccctcagaatccagctggggtgagtgggtgactataaatgcaaaagttagagagcatggggaacagtgtttgattgtgtggctggggaggggtaaggacaaaaactcagagagagagaagcctgtagccctggctacagaagggcaacacctctgaggagatgagtctcagctgggccctgaagggaggtgactcacagatgaaacaaacctggtgggaagaatagttagcagtgtgcagaaggcattggaagggattccaggggaggagtgaggagggagccacagtcattccgatgtgaggtagtgagatctgggattagactgggtcatcagaatggaaaaaaagggcctgcttctgcagacagtttaaaggaatcagctggatgtgggaagcaactacatacttattcattcattcatttcatgcatattgcttatagcctactatgtgcctagcactattctaagtgctgaggatagagtcatgaataagatagacagggttcttattctaaaaaaagtaatataccagtggggagacaatgaagaaataaaccactaaataaacaaggaaacatcagataaaataagtgtgatacagagaatgtaaacgggccattgagagggcatggattctttagatgggatggtcaaggaaagcatctcttagagaaaaacctctgagccaagatcaagcaggggaatgacgaagcacatgactgaggcaggagtaaatttgatgtgttggaagaaaagcaagaactggtctgtctctagtggagtgaatgaggggagaggaggagagctgaagagggaagttagcaaagaacgaatcacataaaagccttaaaggcaatggaaaaaatttaaatgttattcaaagtgcaatggtgtattagtccattttcatactgctatgaagaaatacccaagactggataatttataaagaaaaaaaggtttaatggacttacagttccacatggctggggaggcctcacaatcatggcagaaggtgaatgaggagcaaaggcatatcttaaacggcggcaggcaagagagcgtgtgcaggggaattgccctttataaaaccatcagatctcgtgagacttattcactatcatgagaatagcatgaggaaaaacctgcctccatgattcaattatctcgcacaacatgtggggattatgggagctacaattcaagatgagatttgggtggagacaaagccaaaccatatcaaatgggatggtttatggagcagggcatgatgcgattgacttttgtgtttaaaagatctattgtacaaagaagcaaggaaaccagctgggaggcagtggagaatccaggggaaagatgacgatggcaaaactagagagcagagctgagaaggagagaaccaggcagctctgggataacattctggagctagggctgacgaattagatatggggtggggcaatgaaaaacaaaaaaaaagagaaatcaagatgtctccagggttggatattgatgcttttaacagagattgaaaagactggaggagaagcaggcttttagggtgaatcaagggtttaactggggacatatggagtctaagatgcatgttagacattcaagtagaattagctactatgcagttttatttaggaatctgaaactcaggggagaagtcaagactggatatttaagtttgcaagtcaataccaaacatatttttacataagaaggaaaaaatattgatatgattttgataagtttttaatagccagaaagctatatgcgtaatatggtatcattttaattaaaaaataaatatatgcataactctctgcagagataaatgatcaatacatataacaaggagagaaccagaaggacatacgccaatatgtcatgagtgttatctctgggtagtagaattattgatgacttttgtgtacttgggacatgcatgtatgagtgtatgtatgcatgcatattttgcaagttttcctcaaaggatgcttttgtaattggaagaagaagcaattataaaataaatggcacaagatttccatcctggtcaaatgggataaggatgatgccaatgagaaattatgaaaattggaaattagacttagttttggggggatgattttttacttccctcgtagaggttttgtttaagacgatgtagtagactgtacctttacatatatttgctgtccctcccgatgggaggattttacttttcacctgttgaaggtgatgtggtcacttggaggtgaagagatagcctggactttgtcacattatctttctcctattctaaacaatctgcagcgttccaggtggtggatgatctgtcatcctgcatcctggagtaaagatgattaaagcagagctgcagctgccctctgaaggcctttgtttttgtaaaccactgagatttttgaattgtttgttatctcaccataacctagcccaccctaacacagatgaacataaaatacagaacatttctattgggcggcttgaaatacaggcttggggcatcagtggtaggtcagcatggaaaatgttgattaaaaagtcatctgtgaggtggagattgggactgaagaatggataaattttctgaatggaaagtataaggggaagagaagaggaatgggcctagaggaagagtcactgtcaatccatacaaaaagaagagatacgaaaagataggaggggggatttggccaacacatggcagaccgttgtagtatcagaaaagagagctaggagggtagttacaaagatcacatgccaaattatgagggcaaagagccattggatttaccctgaaggtggtcattgaaaacctctgaattagcagttttagcggagctgtggggaaggaagtcaggtttcataaggttatagagggagtccatgcagaggaaatagaggaagctggtggaggccactcctttaaaaagcctggatgaggccgaagagaaatgggacaagtggtaaccagaaggcccctacaaggctgtgacttttacacaaatatgacatacaatgctgaacaaaggatgtgctgatcttacagaggaaggatgtgttttattcccaaaaaaaactttacatatgggtaaagttattcaagagaccctgtgctgtctaatatgcaacaaatttttctttgcaccagcattaagacttctaacaataagtaaaatattctatttagatactttttacaggagattttgaaactctgatgacactgacatactacctttcagaacatggtactgtttaaaattttattatttttatatttatcttcatatgtttaaatttgaaaaattacaggaaagagtacttttataattatgtttttctgtttacaaaccacctcctgtgtgctgaattttgcctccccaacatttttcaggggagcatggccctactcgcactttgagttcagatttctggccttcagaactctgagaaaataaatttcttttgttttacgctatccagtttgtggtagtttgttacagtagtcctgggaaactaacaaaccaccccaaagtttagtgacttaaaacagccattattatttctcacaattctgtgggttggcaatttgggctgggctcagctggacagttattctgctggtcttcctgtagacattcacatggctgccattatcgggtggctcaagtgaagctgtagggtctaagatgggctcactcacaagtccaggaccttggtgctgactgttggctgagctttccctcttcacacggtctcttgttgttcagaaacctagctggtcttttttgcattcttagctggtaaagggaacattctaagagaaggaaggtggaagctgcaaggcttcttgaggcttaagtctagaactctccaacgtcacttccaccacattcattggttaatgcaagtcataaggcaactcagcttcaaagagtaggagaatagaatcaacctattgaaaggaggggctgcaaaatagttggtcattttaaccaaccacagcacccaaccaaaaaaattaatactatcccgtttcagatttcagaatgtttaatcagaaggccttgtctttccctacgtatatcacaatacccattttagtggcagagaaactgagaccaaataaaactgactcctttaaagttaccaagtgagtcatgctttgtgagagacatgaagacaactatatgtctggaagagctaaacatagtcctgcctggaggcaggtatatgaacttaataatcccttgagatgctcttaaatcccataattacactgatggactccagattgcagagctgtctggtccagagataaagcagcggtttgagagtatcagagagagaaggtgcctgaaaattgccacatgtccccaaaggcaggatttgaggctaaattaaatgataaagagttaccaagctctttattctcaagagttaccaaataagcttagaaactcaatgactgctgctgtctagtgttagttctggaatgggagaattaaaaatgagtagaaaaagaaaatagagacagagagactaacatatctgaaagataggtgctgtgggcagtcttagaaggatcacccctatatcaattaggattgcttttagctgctgcaagtaacagccaaccaaaccatccaatggtttaaacaaattaggggtttatttttttcttttcatttatttatttatttttaaatttaattttattattattattatactttaagttttagggtacatgtgcacaacatgcaggtttgttacatatgtgtacatgtgccatgttggtgtgctgcacccattaactcatcatttagcattaggtatatctcctaatgctatccctcacccctccccccaccccacaacagtccccggtgtgtgatattccccttcctgtgtccatgtgttctcattgttcaattcccacctatgagtgagaacatgcggtgtttggttttttgtccttgcgatagtttgctgagaatgatggtttccagtttcatccatgtccctacaaaggacacaaactcatcatctttatggctgcatagtattccacggtgtatatgtgccacattttcttaatccagtctatcgttgggcatttgggttggttccaagtctttgctattgtgaatagtgctgctataaacatacgtgtgcatgtgtctttatagcagcatgatttatagtcctttgggaatatacccagtaataggatggctgggtcaaatggtatttctagttctagatccctgaggaatcgccacactgacttccacaatggttgaattagtttacagtcccaccaacagtgtaaaagtgttcctatttctccacatcctctccggcacctgttgtttcctgactttttaatgatcgccattctaactggtgtgagatggtatctcattgtggttttgatttgcatttctctgatggccagtgatggtgagcattttttcatgtgttttttggctgcataaatgtcttcttttgagaagtgtttgttcatatccttcgcccactttttgatggggttgtttgtttttttcttgtaaatgtgtttgagttcattgtagattctggatattcgccctttgtcagatgagtaggttgcaaaaattttctcccattctgtaggttgcctgttcactctgatggtagtttcttttgctgtgcagaagctctttagttgaattagatcccatttgtcaattgtggcttttgttgccattgcttttggtgttttagacatgaagtccttgcccatgcctatgtcctgaatggtattgcctaggttttcttctagggtttttatggttttaggtctaacatttaagtctttaatccatcttgaattactttttgtataaggtgtaaggaagggatccagtttcagctttctacatatggctagccagttttcccagcaccatttattaaatagggaatcctttccccattgcttgtttttgtcaggtttgtcaaggatcagatagttgtagatatgtggcattatttctgagggctctgttctgttccattggtctgtatctctgttttggtaccagtaccatgctgttttggttactgtagccttgtagtatagtttgaagtcaggtagtgtgatgcctccagctttgttcttttggcttaggattgacttggtgatgcaggctcttttttggttccatatgaactttaaagtagttttttccaattctgtgaagaacgtcattggtagcttgatgcggatggcttgaatctctaaattaccttgggcagtatggccattttcacgatattgattcttcctacccatgagcatggaatgttcttccatttgtttgtatcctcttttatttcattgagcagtggtttgtagttcttgaagaggtccttcacatcccttataagttggattcctaggtattttattctctttgaagcaattgtgaatgggagttcactcatgatttggctctctgtttgtctgttattggtgtataagaatgcttattatttttatacattgattttgtatcctgagactttgctgaagttccttatcatcttgaggagattttgggctgagacaatggggttttcaagatataaatcatgtcatctgcaaacagggacaatttgacttcctcttttcctaattgaataccctttatttccttctcctgcctgattgccctggccagaacttccaacattatgttgaataggaggtgagagaggacatccctgtcttgtgcccgttttcaaagggaatgcttccagtttttgcccattcaatatgatattggctgtgggtttgtcatagatagctcttattattttgagatatgtcccatcaatacctaatttattgagagtttttagcatgaagcgttgttggattttgtcaaaggccttttctgcatctattgagataatcatgtggtttttgcctttggttctgtttatatgctggattacatttattgatttgtgtatgttgaaccagccttgcatcccagggatgaagcccacttgatcatggtggataagctttttgatgtgctgctggattcggtttgccagtattttattgagtatttttacatcaatgttcatcaaggatattggtctaaaattctcttttttggttgtgtctctgccaggctttggtatcaggatgatgctggcctcatcaaatgagttagggagtattccctctttttctattgattggaataatttcagaaggaatggtaccagctcctctttgtacctctggtagaatttggctgtgaatccatctggtcctggactctttttggttggtaagctattgattattgcctcaatttcagatcctgttatttgtctattcagagattcaacttcttcctggtttagtcttgggagggtgtatgtgtcgaggaatttatccatttcttctagattttctagtttatttgcaaagaggtgtttatagtattctctgatggtagtttgtatttctgtgggatcggtggtgatatcccctttatcattttttactgcgtctgtttgattcttctctcttttcttctttgttagtcttgctagcggtctatcaattttgttgatcttttcaaaaaaccagctcctggattcattaattttttgaagggttttttgtgtttctgtttccttcagttctgctctgatcttagttatttcttgccttctgctagcttttgaatgtgtttgctcttgcttctctagttcttttagttgtgatgttagggtgtcaattttggatctttcctgctttctcttgtgggcatttagtgctataaatttccctctacacactgctttgaatgtgtcccagagattctggtatgttgtgtctttgttcttgctggtttcaaagaacatctttatttctgccttcatttcattatttacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagtgctttactgccaactatgtggtcaattttggaataggtgtggtgtggtgctgaaaagaatgtatattctgttgatttggggtggagagttctgtagatgtctgttaggtctgcttggtgcagagctgaggtcaattcctcggtatccttgttgactttctgtctcactgatctgtctaatgttgacagtggggtgttaaagtctcccattattattgtgtgggagtctaagtctctttgtaggtcactaaggacttgctttatgaatctgggtgctcctgtattgggtgcatatatatttaggatagttagctcttcttgttgaattgatccctttaccattatgtaatggccttctttgtctcttttgatctttgttggttgaaagtctgtttcatcagagactaggattgcaacccctgcctttttttgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcccatttacatttaatttaatattgttatgtgtgaatttgatcctgtcattatgatgttagctggttattttgctggttagttgatgcagtttcttcctagcttggatggtctttacaatttggcatgtttttgcagtggctggtactggttgttcctttccatgtttggtgcttccttcaggagctcttgtagggcaggcctggtggtgacaaaatctctcagcatttgcttgtctgtaaaggactttatttctccttcacttatgaagcttagtttggctggatatgaaattctgcattgaaaattctttcctttcagaatgttgaatattggcccccactctcttctggcttgtagagtttctgccaagagatcagctcttagtctgataggcttccctttgtgggtaacccgacctttctctctggctgcccttaacatttttcccttcatttcaactttggtgaatctgacaattatgtgtcttggaattgcttttctcaaggagtatctttgtggcgttctctgtattttctgaatttcagtgttggcctgccttgctagaatgggggacttctcctggataatatcctgcagagtgttttccaacttggttccattctccctgtcactttcaggtacaccaatcagacgtagatttggtcttttcacatagtcccatatttcttggaggctttgtttgttgctttttattcttttttctgtaaacttctcttctcacttcatttcattcatttcatcttccatcactgatacccttttttccagttggtcacatcggctactgaggcttctgcattcatcacgtagctcttttgccttggttttcagctccatcaggtccttttaggacttctttgcattggttattctagttatccattcgtctatttttttttcaaagcttttaacttctttgccattggtttgaatttcctcctgtagctcagagtagtttgatcgtctgaagccttcttctctcaactcatcaaagtcattctccatccagctttgttccattgctggtgaggagctgcgttcctttgcaggaggagaggcactctcatttttagagtttccagtttttctgctctgtttttttcccatctttgtgtttttatctacctttggtctttgatgatggtgacgtacagatgggtttttggtgtggatgtcctttctgtttgttagttttccttctaacagacaggaccctcagctgcaggtctgttggagtttgctagaggtccactccagacgctgtttgcctgggtatcagcagcggtggctacagagcagtggatattggtgaaccgcaaatgctgctgcctgattgttcctctggaagttttgtgtcagaggagtacctggctgtgtgaggtgtcagtctgcccctactggggggtgcctcccagttgggctactcgggggtcagggacccacttgaggaggcagtctgcccgttctcagatctgaagctgtgtgctgggagaaccactcctctcttcaaagctgtcagagagggacatttaagtctgcagaggtaactgctgtctttttgtttgtctgtgccctgcccccagaagtggagcctacagaggcaggcaggcctccttgagctgtggtgggctccacccagttcgagcttcccggccgctttgtttacctaatcaaacaactaactcggcaatggtgggcacccctccccaagcctcgctgccgccttgcagtttgatctcagactgctgtgccagcaatgagcgagagtccatgggcataggaccctctgagccatgtgtgggatataatctcctggtgtgccgttttttaagcccgttggaaaagcgcagtattagggtgggagtgacccgattttccgggtgccgtctgtcaccctttctttgactaggaaagggaattccctgaccccttgcacttcccgggtgaggtgatgccttgccctgcttcggctcacgcatgttgcgctgcacccactgtcctgtacctactgtctggcactccccagtgagatgaacccggtacctcagttggaaatgcagaaatcacccgtattctgtgtcgctcacgctgggagctgtagactggagctgttcctattcggccatcttggctcctccccttatttatttttttcttacataacaagaatgccagtggttggccctgcaggcttggtgtcatggcccccaaggtaccactggagactctggttctttgtgtctttgtgtcccaccaaccttagtgtgtggctttcatccttatggtcacaggatgactcctaaaactctgtacagtgaatcagtattggagacaggaagaagaaaggaggtaaaaaagacatgccagctaactttgctcccattaggaagctcttctagaagctcacagaattacatttgtttatgtatttcattattcagagctgcgttagctttgtctacaagggagattggcaaatgtagttttcattagcccagcacattgtcacccccaacaaaactagggttgagttagaatgaaggggctagtgcatattgataggccactagtagtttctacacagcctccaacaattgctgtggatgtagattagtaacagaacttccactatggcatcatagcacctctatcccactagtacctgtagtaggtccaaatcatctaattccaggagcctggcttaaagaagaggaatattgaggcttctaggtccagtattaatcaaggtaagctagctgtgagaacaaacaatctcaaaatctcagtgaacgaaaccaacaaaaacttgtttcatgtttatatcacagtctgatgcagatcgagtggttctcctccaagcagtgactcagggacccaggctgcttccatcttacagctctaccatcttgtgactttcagattatgttggcatcattcagccagtgactaggaagaagagagaatgaaagattgtgcacccaattcttaaatacctccactcaacactgggacacatagcttctactcacacttccctggggaggactgcttacaagattcatcaatctgcaaggagggctgggggaatatattatagttcttgcctggcggcacttccagcaggaacacttcactatgaaaagggagcacaagtctttggggggacagctagccttctgtgccacaaaagcccagtcacaaagaaaaagccattaccaaaatgttccataaacaatgtagacctactgtggtttgctgttgtctgatagataaaaactgtgttgttttagtcacaaggatttggatgtgggagctgcaaggaaagcaaaagccaaacaagtacagctgaagcacctgagatcctaggaggagacaagaagaatacaaggtgccattgtcctatcagccaggcagaaagatggtaggaaacaaggccatttaaaatctaattgcaattgcaagggctgggtgctgtggcttacgcctgtaatcccagcactttgggaggctgaggcaggtggatcacttcagctcaggagttcaagaccagcctgggcaaagtggtgaaacctagtctctacaaaaaatacaaaaattagccaggcatggtggcatgcgcctgtagtcccagttactcaggaggccaagatggaaggatcaattgagcctgggaggttgaggcttcagtgagctgtgattgtaccactgcactccagtctgggtgacagagcaagaccctgtctcagaaaaaataataataaaataaaatctaattgcaggcaaggccacaggaagtggcaagtgcaactaaagacttcctagaaatcccacacattgataagcagccgggttgttcagccagtttttttttctgagaacaaccaattttaaaatattttaggaaaaaccacaatattgagatatttttaaacagcttatatttaaacagcatatatttaaacaaagtgattaatttagaattcatattttatttgagaaaaaaacaagatgttcctggtctggcagatgacattctaaattattcactcccacttgtggaatagctgagttatagtccggcccctcctctgtagaggaggatttataggagaagatgagtcacgttactttttgtgactatttttctttgcatttgttgactcctcttgttttattcaccttctaatcattgaataatctgtacaatcagactgccttattcatgttggcagttgttttaataataacaatgcacagagccattgctactaacagaaagcagggcagacctttgagtctgagtttggggatacaagtttgattccatcccagctccactgattcccagcgagatgtggttcaacatcataggaccaaatgaaataaaaagcgtgaaaatgctacacaaatcaaagagtgctaaagacatattaatgaaacatctgtaaaatgggaataagtaccacgtttctgaggtagcatgtaatacaactggcacagggttccacacttggtagatactcaaaaaagaaaataaaaagttaacatggacaaagtaaaataaactggaaataggagatggagaaatgttaaaacaacaggcaccataataatgtaaagtaggatttcagctcatttacaagcacagaggttatatggtaagtcctcacttaatgttgtcagtaagttcttggaaacagtgtctttatgtaaaacaacataaaggaaaaccaattttgccataggctaatggatataaacaagagttaagttccagtacatatgtgatggcatatttccagttacaaaatatcaccaaacttctaaataaagaccaaaagactcctaatattaaacattgaaataaatgtgagctatactttcatataagaaaaattaatgcaaacaagtacaataattatttactgagttattccagttcggggtcgtggatggccagagtctatcccagccgtccagggccaagtttggaacccaccctggccaggacgccatcctatcacagcttgcactcacacacactctcactgggaccatttagacacaccgattcacctactctgtgcatgtttgggatgtcaaggaaaccggagtaccctgagaaagcccacatgggggaacatgcacactccacacagacggtggctccagccaggaattgatttattttctcatcaatgttataactaaatgactttgaatgaaacaatgttatttgataacctgctgtatttagagttcacaaaatttatccctctgaaacacatacacacacgcatggccgcacacacacgtgcatgcacacactgcacacacttaatgctaaacttgaaagagatttaaaggctaaaaggaaagttggactttaaatttcccctggagctcacattttctgggtactgaaagatatggtagatacatatgattgccttttccaaaaataacttctatggaaaatcctgagagttataagagactacaaaggtgatttgatagagccacttaagtaatgtatgcaatatgatcaccaggtatacttgtatgagagatgggaaagaaaggaaatattgaaagagcagaaccatgaaggagaagaagcaattgatcctgaagaatagcaactgtagtcagggattagagacctgcaaacaagtttcctattcttttcaaaaatgaagaatagcttcttattacaaaagctgtatatataaattatagaaaagtcagaagtgcaggtaagcaaatactttaaaaatcaaaattatctctaattctttgacttattaatcattttaacagcttgattgatattttttcagatacacacatacatacatacttctacaaaactggaagtatgcttatatattgtatcataacctgcttttttatttaaaaaatatcatgaacaacttttcatgtcattaaatattgttgcattacatttctaatgaatgcataacattccattgtaaggatacagcgtaatttaactcagtctgtattgagctacattgatttccagttattcacattagaaacagtacaccactgaataaatttatgcattcatctttgcttacctctttaatgattcttcacgataaatgctagaaatagaaccacagacttaaaggtctccattgatatgtgtggctcccttgttttcctttgcaaggttttgtgtggcatctgcctttaaaaggttaaagatatttttacttataacatccctgaactttacctcaagtcttggggaaagttattgaaaagtagtttgtattcaaataagtacaaactggcaaggtcaatcttttatacaggttatcagaaacaaatcaacctcataagatggaactaaacccattattatgattgagtcagcaaacttaaagatgtgtttggtttggacaaatactattaattccttaagttccctgtggccacagtttttttttttaatgaatgtttttctgagtaatcttggtcctatttgaggccatcttcatatgcactaccaatatttccagctatacccaacaggtaaactagccctctgtaggcaattaaatgtatattttcctgaagaaagtaaggttatatagaatataagtataaggtcacctagaagagctattaatgtattatggacaatttctttttattgccagagctacatgttacttatatttaagtctgatatttaattctctattatattcccttattattgaattaattaattcatccattcatatgacagatatttcttgagcacttacttgtgccaggcactgtgttagactctggggatttggaaagaccctgcttccctcatgaaacttacattccaatgatggaaacagatcatctgtaagtgcgtaaactaatatatcatgtcagataatgtctcatttccttatctcttaaataaaaaaatattctattccatagggctgttatgagaactgagtgagactatgtggaaattaccatacacatgtttaaaaaatattgtttctttttcctcttatcttttagaaaagggaaaatgattattgtttctttttcctcttatcttttagaaaagggaaaatgatttgtataaatcattaaatactcccttgatattacaaaactagcaaattgttttttgattttattttttaaattgtcacataataattgtacatattcatggtggtacatagtgatgttttggtacatataattatagtgatcagatcaggacaattagcatatccatcatctcaaactctaatcatttctttgtattgggcatgttcaatatcctccctttaagtatttgaaacgacacaatacattattgttaactacctcatcccacagtagtatagagcactagaacgtattcctcctatgtagctgtaatttcgtatcccttaacaaatctctcccatctttcccttccccctacccttcctggcctccagtaaactctgttctactttttacttctatgagatcgaagttttttagcttctgcatgtgagtgagaatgtgaagtgtttaactttctgttcctggcttatttcacttggtgtaatgtcctccatttccatccatattgctgcaaataacaggatttcattttttaatggataccattccagtgtgtatctatcccacattttctttatccattcatttattgtcagacacgtaagttgattccatatcttggctattgtgaaaatgctgcaggaaacatgggggcgcagatgtctcttcaatataataatcttttcctttggataaattcccaggagtgggattgctagatcatatggtagttctaattagcaaattctatattccatattaaaggaaggaataggtaaatttttttcaaattttttattttgttaaagatggagtaatcctcccacttcagcctcctgagtagctaggattacagaggtgagccacagcacctggcatgggataggtaaacattttttaaaatgtttgttttgtttcaggcaaaattaggtatcaactgtttctccacaaagaagagcagcttaagccttcacagcacatagttctgataattcaggtcttcttttgccatttctcaaacatagctatcttgtgttggtacatgcgatctgcagggccttagacgaatcatacatttcatctctctgggcctcagtttcctgaagatgaagttatgttatatggttcgtaaagttcatttcagggctaacttcactttgtccttgtaaaaattatctgcctagtgggtccactccccacctcaccaccccccaaaaaatgactgctgtgctccaacccaagccaatcaaaaatgataaacacttgactgtgacttttttcaagactctgttttacagagaagtggaaaggtctactgtggaatgcttatattttaatttgtcctcattgataggagaggacaaatgtaaactaggagaaatggaaaaaccagtgatacatgtcttgttatgttaaaggaaaaagctagagacaatatgattattaataattattttttaaaattaattcttgcatttattgagcacctgctgtatccctcatatgcattaccttgtataagtcttgtaatagcccaaaaagttaagagtgttcttattctcccaaggatgcagatatggaaactgaaactgagtacggttatgcagtatgtgaggggcaatgctgccacagaaactcaagtctagctgagaccaaacccatgtttttaaccacttgcttcttgcctttgccaatcattgccaccaacgagtcaaaacttacttgttgctggaacatggtttcatcctggccttccacggaatctgttgagcttgttttttttttttttccatatgccataatatgtttagtttcacctcagatgagacagaggatttactttcaagaaagttggacgctgtccactctaaacagtaccagaggtagccttacagcatcagaaaatcctgtggtagtatctcttcatcggaacttggaatatgattttaagagttttttctatcttttcattagagcaggccaacactgacttgatttttctctgaaattagctgtggacaaagattccttttcaaactaaagattctaagcttattttcccccatcactttatcaaaactagaaacaatccattaaaaacactgcccagccttcaggggcttaatcaactcagtggtataaagcatgaaacttgattctgagatccaggagagaatatttggattgccgggaggtgacctttatatgtttctttacgtgtataacaaatacatttcaattcgcgtctagccccttaaaaccagtgcatgtttctgaccctgagtgctactgacattgtgaatcgcactgcaaacagaacacgggtcactgttgttttcctgatctgggaagacatcatggtgtggtgaaagggacagtgcgctgctgatcagacttgggttctgtctctcctctgctaccagtgaaatgaatttcagatgcaaagtggaaagatcaattgtttcttggcctctttgctgagatcaagggaagaagaaagatcagattagttccgtgacagtccaatatttactgactgacccatgttctgtttcatctcaggatttccagggggctccaatttggaccactgcagcggtcccaactgccaacctatgttttcccttcttccctacctttcccctgcagcctcaagtggttccagataaagtgttattccatgtatctcactgtctgaatctagaggactctgatacccaaatgtgtttctcagagtgtgtcaatgaaagggactctttgacccacaatccccctttttcttcacaactccatcatcggcatcctcaaagacaatccatggtgcctactactcctcatcttattgacatgattttaatgtcagctctcgccgggcgcggtggctcatgcctgtaatcccagcactttgggaggccgaggcgggcagatcacgaggtcaggagatcgagaccatcctggctaacatggtgaaaccccgtctctactaaaaatacaaaaaaaaatttagccgggcgtggcggcgaccgcttgtagtcccagctactctggaggctgaggcaggagaatggcgtgaacccgggaggtggagcttgcagtgagcagagatcgcgccactgcactccagcctgggtgacagagccagactccgtctgaaaaaaaaaaaaaaaaaaaaaattttagctctcaaagttttcctccatgttccatgaaaatacactttacaatctagtattccccccaccacacacacacacacacgcacacacatatatactgaaacgaaaccatatccaacttcatttccatttccaattcattcaacattttctattctgttctattgcatttaaaaaacgctggtcacaagccactaaactgatctcagatcagactttaataaatcagactcccccttttatacgcacagagcactctctactgtttcttcctagtacttgtcacaatttgtaagtcctaaatcatgtgattgcctacttaatgtctcccgcaacctgcccctggtgttctgtaaacttcaagaggatatgttttgctcacctttgaatttttagatcccatacaacacctatcatatcataaatgtttaataaatatttattaaaagaattaataaatgaatgtggccaaacctattcaggtctgcatggttcctccctagagttccatcacacttcacagatctaaagtttcctcccagttgtggaggtttgaagctcaaaactgctggaggtgcttcccaccatagctcgtgaaggccctattggtgttttcttcctagtccgtctctagttgatcatgacagatgggccagtgtgttttgaagaagactggctgatgcctcaccaaattctggggacaggtgcctttctccaggggaattcatgaagagactctccaggggcagggcagaccactgggaaaaacaagacccttgggttttctgaccactggccacttgtttttcccacatcaggagagtttatcatctgtgctcatccacctcctgaggttgctttgctggtgctgatttcaggtcccaggcccctaaggtctcacactcactccacaagccacctacacagctgtagttgttttcagccgacagctaggttattttgccttccaagatattttcttttatttatttattcatttatttattttttgagatgaagtctcacactgtcacccaggctggagtgcagtggcacaatctcagctcactgcaacctccacctcctgagttcaagtgattctcctacctcagcctccccaatagctaggattacaggcaagcaccaccatgcctggctgatttttttgtatttttttgtacagatggtgtttcaccatgttggccaggctggtctcgaactcctgacctcaggtgatctgccctcctcagcctcccaaagtgctgggattacatgcatgagccaccatgcccggccaatagtttcttttttgataggcagctcttaaagccctcagaatacatctctaatgatgaaatcatcaggcaacttgacaaagagtgaagaaattgaagggttctctcaatagcatcccaaggaggctgacccacaccctactgcctaccataggctggcttcatgtgctctagtgctgtgaataaaggaaaaaactaacatgttgaagcatttatttagtgccaggaggcaggtactttctcagataccctttttcttctcacataattccaggtcattggcagaatagagatgcaaaccaagaacttgggcagcaccaagatgtagatgctaaaactttaaacttgctggacaaaatgataggggactttgaaataattattcagacaatttaggcaagcaaacaaaagcaattaaaaattgggcatctggctgggcatggtggctcacacctgtaaccccagcactttgggaggccaaggagggtggattgcctgagctcaggagttctagaccaacctgggcaacatggtgaaacctagtctctactaaaaatacaaaaaattggccaggcatagtggcgtacctgtagttccagctacttgggaggctaaggtgggaggattgcttgagcctgggagatggagcttgcagtgacctgagactgtgccactgcactccatcctaggtgacagagtgacacccatctcagaaaaaaaaaatgggcatctggccaggtgtggttgctcatgcctataatcccaacactggaaggccaagtctggacaattctttgaagccaggagtttgagaccagcctgggcaacatagcgtgaccccatctctacaaaaaaattaaaattaaaattaaaaacagccagacatggttgtgagcacctgtagtcccacctactagagaggctaaggcaggaggatcatcaaaactgcagtgagctaagatcgcaccactgcactccagtctgggtgacagagtgagaccctgtctcaggaaaaaaggaggcatccaaaaaaatgttcccttagatccattttttgtctgacagagacaggagaggtgatgaaagggaatgtaagagtatttaagggattatttctttatggtagcagaaggacaaagacatgtttgaaaaatttttaatattgtataaaatgatgatattttcttagtggtcttgttgttgaatccagagattgtggtcatgtagttcataggtaatttatcagttattatttattttttaaagcttttatttatttatttatttattttagagatgaagtcttgcaatgttgcccaggctggcctagaattcccgggctcaactgatcctcctttctcagcctccctagtagctgggactataggcacacaccactgtgcctgtctaatttgtcaacttttaaatgagatcatctgcaagttcaaggaagttagataaagggtgataccacagaaaaaaaatgagatttttctctttaagatgaatattgaatttagaattccttaattaatattgaggatcacatgcgagctacagatagggaatattgagtatttaaagcattctgaatgacctgagtgttttccttctcatgcttattaaaaacatttaccacttacagctgaattggaatatagttctacataaattgttatttacacctgatacacagaaagaaatgtgtttccttatttatcatactattaatttgaatgtgctattctttttttaattgctttaaagtcaattggggaatcagattatgaatatctattttactgcttccacatttcctaagttaatcaaatacgacaagttagtgagcttgtggaatttacttgaatttcctaatcttttaactgagagggtattttcgacagcaaatattttgtagcatccatttgtcattttttaaatattcaaactagttttttttaaaataatgccaagtacacttagtgcctagtaaatgctggccactgttattgctgttatcattattcttttttgtttgtttgtttgagagggagtctcgctctgtcgcccaggctgaagtgcagtgacgtgatctcggctcactgcaagctccgcctcccgggttcacgcccttctccggcctcagcctcccgagtagctgggaatacaggcacccaccaccacgcccggctaattttttgtatttttttttagtagagacggggtttcatcgtgttagccaggatggtctcaatctcctgacctcgtgatccaccctcctcggcctcccaaagtgctgggattatggcagagaaatgtttgtttcaaaagtgtgttagtctctaaggaaatgaatacttccagactaaattctgtttatagtattatcattaataaataaactaaaacattacttctgtttcattgccccaatgtatattgtattaaaatgttcttttctgatcttctctaagttaaaaaaaaaaaaaagaaacaaagttgagtaaacaagctgagcaaactttgtgttgaaactttaatatgtccgaggaaaagaatcttgcattaagtccaatacagagagtctgataatttggtggagcagagagcctcatctgaggtggctttccgtgaacagcatctctgaggtgtcacctgctaccacattcactgtccaccctgggctttgcccctcaagcaccagggctcaggtctcttgttttgcctgtttctccctatagtctccctggcctgtgccttttagacaaaacagattaacatcacctttaagccgtcaatactgaacattctgtctttataaggcctgactcattaccaattttatttggtcaattttaccttccttgctttcaaaggaacaccatttgcctatgtcaagtgttctctttcttttatttttcccttccttctgtctttcccctccttccttccttccttcctccctccctcctctctcctctctttcttccttccttgcctccttccatccttccctccctctctctctttctttctttctttctctctctctctctttctttctttctctctctctgtctttctttctctctttctttctttccatcttcttttctttctatctttcttacttttgatgtagctgtcacgacctaatgaaaatactggcatgagtgatgccacctttagattctccaccttcctgttcctgtcctattcaccaacatgaattggtttgtggctgtaagtacttggtgggttattgctcatagattcagttgcatttttgctgagatagtgctgttaccaaaagcaggggtgctgcttgaagaagtaaacctaactctgaaaaatagagactctccagaaacatcataatcttaaggatggacatttgtggcctgttattgttacttcattctaggtgacagagtgaagtgagtgagggcaaaaatgactgcacacttatggaaagagggctgcctccaccacagacaggtagtgggaggtcccactcttccaggttgaacccaatatcctatcttctccttccgctcttggtacctgttgttgctattgtaaacacttccctcacctgggactgcatatagatgaaagattgctggggggtttcccaggatcttgggccagtgccaacaaatggcaaactttcaagtctagagatggtcctatggcatgactgggggacaccacttccttcaccagaacattcacatccttcccaaggtgccacgcccagttcttttgtccaacaataaactctgcgaagtggagtgaagtcaccacccaagccttagcctacctctgaccacagcctgtgactccacaaagataaatgaaaagaggaaagtcagtgatgttttctatactgtcagcagcaatctcacagcctcaatacattttctttcaaaagtttaatatgtaataactggcatttcttcttcattcctagttggttagactgcatcacatctgccatgccaaactattaagagtaatacaattcttactcttagtttattaagagtaaaaactattactcttaatagtttagcatgctattactcttttcttattttttaatttttttaattttttattttttgagacggagtctcgccctgttgcccaggctggagtggtgcagtggcacaatcttggctcactgcaacctctgcctcccaggttcaagcgattctcctgcctcagcctgccaagtaactgggattacaggtgcccaccaccatgcctggctaatttttttttttttttgtatttttagtgggcaaggggtttcaccatgttggtcaggttggtctcgaactcctgacctcaagcgacgcccccgcctcggcatcccaaagtgctgggattacaggcgtgaactgctgcacctggctgacgtgctattactcttacagcatctggacaatccctaacagtctgaaagctctataatgttgcaggtagtccaaaggccctatcccttattctagaacacaggctttatagcacaggctttggcaagtctgtaacagtctgaactcctccactgtattccacatactagggatcttttaagttgtcattatgtcctggcacaagcatttatcatatttctgggagcatgtagggttcaagatgcgagggcaagagagggctgagttgtttgttattaagctgacaggaaatggccaaggctcatgtgctactgcttgcagttgggcaaaagaggataaattaattgctttgtagaaattcctttctgcattctttagggaaaatttttccatgtgagctaaatgagtcaaagggggtggttttgggctcaacagctttgacattgtcccttcaaggaatgaaacaattaaagaaactgatctcctctgagaaaaagaccatttacaataacctatctactctacataaaatattcccagtagactcatcaaaacaagaccctctgataccacaccatactgggtttttccttattgggattcccccatgttttttctttaatgcttccccatgttttagaaacagatttgcttacccggaaccttccacactcaattccaaatttatcatagtactatcatttgggagtaaacaacatgtaaggggcctacacgggtggaaagcccattcaagaaactgaggatgatcaaatagtagagttgatagtatgtgtataatcccagggaggagtttcatgacggattagaaggtcaacactgcctgatgcagccgaaagatcacattaaaacaggacaggaaggaagtcctggctgtccagcaaaaggtctttagtggctatatcaagagaagcttttacagaagggtgagggtggtagcctgcgaacattggattaggagtgagagggactgaaggaagtagaaactcgagctcaggggaaggggagagaatgagcttgaggaaggccctctgatgaagggaaggctcttttctgatgccagtgagttgagcagacttataggaagcaaagaggagtctagggacagacagggattgtccaggtaatgtaggaaacatttgacaaggacagatctcgaataaaaacatgaatgcaatttctgtttcagatgtctcctttgcctgccccatcccacattctagaaaaatatttggtgcattaacagattttggacttcacagggcttcacttttattgtgcttaatatttgttccttggtgaaacacaaagagacaaactacacaaaaagagaatcatacttgatgaaaaaaatcaatgtttagaagttgctcttaaatcttttacccattgctaacatgggtatttggatgccatttggaacgtattccaggactacttatccatgaaaggattaatgatattggagccaggttcaaagtctcagcaacaagctaaaacctgctctttttagtagtcaggggcaaagcttagtatcctttcttctgaaagctttcgcatgctaagctttccattgccaagcccccgggaaggaaaataccagaagtttcactccgatagcagctttttctgagatgcgcctggtgataacattttccagtagggctatcttctgtctccttccttctctgtgtgtaccagtaaagccttgtacaagtctcttaacctttcttggcttcagtttccaaatttgtaaagtgaagataataatacctccctcatagagttgttgtgaggactacatgggctaacgatcagacagaaagcactcattaagtgtgactagcattgttaattgcagtaatagtagttctagtagcaggcttttccaggttataaggattaaagatacgctcatgttacctaagttaatggtgcattattttaagggtacaccaaaaagtaagaagaatgggaaactacttaaccagcacatggggtgcagaagcgagagcaattgtgttttctttttttttttttttttttgagatggagtcttgctctgttgcccaggatggagtgcagtggtgagatctcggctcactgcaacctctgccacctgggttcaagtgattctcctgcctcagcctcctgagtagctggggctacaggcatatgccaccatgcccggctaatttttgtacttttaacatagacgggggtctcaccatgttggtcaggttggtctcgaactcctgacctcatgattcactggcctcggcctcccaaagtgctgggattacaagcgtgagccaccgtgcccagccccaagggaattcttacagcctgacaggtttggaactctgagtctctctgtgtgtctgtgtctctgtcactccaccatatgtttagcagggttaattaatttgcccaagatcacacaattagtagatgattatgcaagatttgaaccagttgttattcattggaatatgattactgtgtaagttagcatgagaatattgaaaataaatgtcttgttagattcatttattttttaaaaaattcctatgtaggtcgggcacagtggctcacccctgtaatcccagcactttgggaggccgaggcgggcagatcacctgaggtcaggagttcaagagcagcctggccaacatggtgaaaccccatctctactaaaaatacaaaaaattagccgggcctggtgatgcatgcctgtagccccagctacttggtaggctgaggcaggagaattgcttgaacccgggaggtcgcagtgagccgagatcacaccactgcactccagcctgggcaacagagcaagactccatctcaaaaaaaaaaaaagtcctatgtatacttcttcacatcaatttaggcaggctttatttgttaacttttgttggtagccaacatgcatttaaactacttattattgtcctaatctaagaaaaactgagaaatggatgaagttggtcctagggtatcccaaagcacagagtgttttattctgtccttgggacagaggtttgattcaaaatgttttttcggaaactagccttgaacacctaattttattaatattctttttacactccatccctcctggaaaaggactggaccccaattcccaccattgcttttttgggacccattatcttccttagcttcctatgcatctacagggtagtctgggcttcacttcctcagtgtccctgtatgaaattaggtggatatagattagtctgatgtaggaatatcacactgtactaaggtttagtttgtatgttattctctcaagtaactgatctttcaatcgaactaaacacttcctatgtgctttaaggtggtgggaattacaagcatagcaagttatgattggtcacggatttctttcctctttaaatggtgacctactgcccattgtacctactcaaagcaactttctttaggaaaaaagaccacagtctactttcctaagcataaactcagttctcattccacctctaccacctgcaagatttgttaggcttaagcagtcccttaacttctttgagtgtttgttgccttgcctacttcattggaagtaaggctctggaacagggaaggtttgcctccataagactaaaagttatgctaatataagagactagcaaaatgggagacatattcagctctcttcttgtggggaataccttgcccttgaccaaaagccttgtcccagaaagagccgtgtgggtgttggctttgtgcccaacatgtggctcctctgccatgattgatggcttcatttaagaaacaggttttaggattttttcccctaaaatcttattcctgttaattatcatggatcaactttaccttagctcgtttaatacacagtcacctggtataaaagcatgtgaaaacccccagggatcgtaaccacatttatgcattgagaaaagagagtgaggccaagattttgagatgtgttcaaatgcaagaagcttttaaaatgcaaagtattctaaaactgttgaaagttgaagctaactgttgttcccttgttgaaggtaaaaagtaaagcatttttaggaaagcacttttccttatgtgtctaatatttgggaactgcataggagaacagtttaataggaaccctgatattgacagtaagatatattcttaatgtagtaaccagacccagggcagaatttgcaaacccatggtaggcatacaggtggctgaagaagaatcgggacagcaagatctcactgagatgcaattccattcctccatttgatacagattaagatttctgaaaaagaccatcctcctaaaccctcatggactctgcagataatatgaggccagaaaatgaataattcccaactcttgctatctcgttactggccagtgtgtctggcttcgctgagtgtgtgccttctgaagcgtaccctataattattcagcaggtatagtccagttcgtcctacttactttagcaagattacctttcttttatttttcctgtgaaaatccttctcttccttctttcctcctttgtctttcctctttgttaactttttaaatctaaagtgccttgaaaaacttgtttacatagtagtaagaaggaaaatgttgacttgtgctatcctgggaaccttgaccttcctgcattatggataaatcatttccctgcaggtggaagtggaaaattgcagatagaaccacattgactcacattctccttctacttccatttgagtgagcaccaagtatgcatcacgacttgagattataaagttggcttaatgatgagacaggtttctcagtcgggttttccattggctcgaagttcacaaggcagttgttgcttgtctcagagtgtccttaggtggactacatctgaacccttggcgttattataatgcagattctagctgtgctcaaaccaatgaatcagaatctcaggagggtggcgctcagaaatctgcatggttgatcagttctttagcagattcttatttttgtatgctaaagtttgagggtcaccactggagagattccagaacagggcctgcaagggaattgttcaaagtttgctcaagttaactttgttgttacagcattagcttgaatatcaggaggttttgtatttaagttctctaaaaaaagaaaaagaaaaaaagagaacagtctcaatatataaaaggaaaggttttcatatatgtgcccaattataagtatcttgagtattctaggagtctaaacagaatgtctttagatcatccttataacgatcctgagactcttttgactgttttgagttgaagacaggtaataagaaagaaatcaccaattaatgcagaaggaaataaatttctgtatataataatattcacatttgccatgtctcttttaaaaagtccaaataacaggcagagcgcggtggctcatgcctgtaatcccagcactttgggaggccaaggcgggcagatcacctgaggtcaggagtttgagatcagcctggccaacatggtgaaaccccatctctactaaaaatacaaaaattagccaggcgtggtggcacttgcctgttgtcccagctactcgagaggctaaggcagtattatcacttgaacccaggaggtggaggttgcagtgagccgagatcgcgccactgcactccagcctgggggatagagcaagactccatctccaaaaaaaaaaaaaaaaaaaaaaaaacagctcaaataactttaccgtacataactttaccatacatgtcctctagtctcttatcatttcttcatatgaagaataatttatactcattgatgtaaattttgctatattttatacaacaaacatagtattattttaatattgcacatagagaaaaatacctcttcccctcaaaattagaagggttggtatttttattcaggcttattgatttaaaatacctgcttgatccgtaattcaggccatacgatttcaccaaaacaaatatcctaatagttgtcatcttgaataactgtttagtgcacagaatgtagtctcatttattaagaagtgatttaagagattattacttctgcatctatcacactaacatgaccaactctttagtaagggaagagtaagggaacttattttatatctagatagaaattttattaaggatacagtattaggattcataggggaaatagtggatagatcacaagaacgaggctctttctgagccctgcaggaaagaatatttgcagaacaataaaggacatggtggcttcctggagaatgttggccgaagactgagccttacttctggaaaaggctcagtgctagagccaagtgagcatcgatatgccaatacaggcaagaaaatcctgcaagaggcagacttggttcttaggtcggaacaggctctgcttcagaacttgatccggtacccaattcgtttctgcttcagcttctttttctataaaatgagggtagtacttatcccatgagggagctgttatgaggataaatttggctttattgaatgtgcatgattcctggaacccataaagatgtcaaatttagaagcctcagagagatttcctttgctctgtgaataactaaatttggttagctggggtggggtctgggtacttttccttgtgaagaatttttccctcattctggtcatctcctcccctcctatagaggcaccatatatttttcttgtctcaggtacctatagtgataaaacaccctgagctgaaaggatcgctggatagggcagtctcaatacaaaagaatgtggcagaagctcaggcttcagtgcacatcagaatagaagcttcatgagggcagaggcttttgtctgctttcctcattgcagtatccccagaactttgagcaagtgcacactcgatgaatacttgaaagaataaatcaatgtcagacatctgggcttatgtctcatctttctactgttctcaactaagagattctcgtcattctacaactttcctgagcctgctctccttctccaaatattcacccttccaggcactgactccacctcccacatcagagctttttcttaaagtaaataacagtcaacaattaatagcttcataactttggaacagtgcagtgtctttggtttaagaagcattgtttccatcctccaaactaaaataaattttgagaaaagatggagatggtttgggactggggaagaagggaatggaagaagtgattatttgagggcacattaactatttgtacaaagtagaatatcttagttaaatttggctacatagcaagcaggtatcattaaatggatgtctgttagaatcttgattttcaaattaactagatagtcagcgttagttagactgagggagggtgattacagtcctatgtcactgagggagaatggtgaaagggcaagagaaggctggcaggtagagctggaatttttctgccagcaatagaccagtggttcccaaatgtaagcctgcaacagaatcatctggagggcttgttttttgtttgttgttgttgtttgtttgtttttggttttgtttttttgagacagagtctcactctgtcgacaggctggagtgcagtggcgcgatctcggctcactgcaccctcagccttccaggttcaagcgattctcctgcctcagcctcctgagtagctgggattacaggcatgtgccaccagcccagctaatttttgtatttttcgtagagacggggtttcaccatgttggccaggatggtcttgatcccttgacctcatgatctgcccacctcggcctcctaaagttctgggattacaggcgtgagccaccgcgcccagccaggagggcttgtgaaaacacagatagctgggcccatccctagagtttaggattcagtaggtctggcggaggcctgatagtctgcatttctagcttggccaggggatgttgatgttgctggtcccaggaccacattttgagaaccactgcaatagagagtgtgcatgaaaatacaacaacaattacctgatggtccttagcttagttcagttgtcccccacaggttgaagcagtgttcaagggcaaacaaaaactttctctctcagccacctccataagttccatagtttatttaacaaagcaaactcacaaagaaggaggaagttaggactgctccatttccccttatagcaaaggcatgtgtatttcacaactgcaatcagcttgaatagcagaggctggaaggctctccatgtctttactgaagtcacgtcactaagtcacacagacatgctgctaattcactgccttggccagcacatctgaaaataaatagcaccattataggccctttcatgaatatacagcatgtggcctctaaattggccaaggagctggctatgctgggacaaataacttagataaatcacaaatcagagtggagaaatgaggtgtttttaatcaacagcatccaacaatgtgtgttgagtttaactgaatccaggtagaggagggagtgggtgcaagagctcaaagtatgctgagaatagttttatttcaaaattccaggagacttagaaacaacatggtaatgatgaaaggagcctgaagagactctttttttttttttttttttttttgagatggagtcttgctctgttgcccaggctggggtacagtgtcacgatctcggcatactgcaacctctgcctcccgggttcaagcaattctcctgcctcagcctcccgagtatctgggattacagacatgtgccaccatgcccggataatttttgtatttttagtagagatggggtttcaccacgttggccaggctggtctcgaactcctgacctcaggtgatctgcccgccttggcctcccaaagtgttgggattacgggcgtgagccaccatatctggccctgaagagactcttaagatactttcataatagtttaaaaagctgtatgtgtgtttacaatttctgtcataaatctatggtaaccacagcacaaacattttagaaaaagaaaaaaaaaaacaactctcggttgagtgtggtggttcatgcctataatcccagcaatttgggaggctgaggcaggaggatcacctgcatccaggaatttgagaccagcttgggcaacatagcatgacccatctcgacataaaattaaaaattaggtatggtggtacatgcctgtagtcctggctactctcaggggactgaggtaggaggatctcgtaagtcctggagtttgaggctgcagtgagctgtgatctcgccactgcactcagcctgggtgacagagcaagaccctgtctcaaaaaagaaaaaaaattctattttcccacctctctaacataactgtgaatagtagtatttccttctagtttttaagtacactatttaaaaacatggaaggttttcaaataatgtacttagatttaaatgcatttttaagcttatacccatataataagcatagtaactaacagaatgttctttggagtcagatagtcttgggttcaaatcctccagacatttccagccctgagttttgcatttgttaaatagggatgataaacctggttcatagcattgctgtgtggattcactgaggtgctcatcaagtgctcagcacagagccctgtgtcatgtaagcactcagtaaatagtggcatcattttctgttttcacacacaaaaaatgagtcgaccttctgcaatcctaataatcagtaagttcttcttaatggccagaagtatacctatttttagtctatgcatttggcaaaatttcattccacaaattgtttggtggtcccaggagctgctttcaagatcttctctgaccagcttgtcgagagcttttgttatctgtgttttcctcaaagattagactcatgaaagatgtgtgaaagccaaaacaaaggaatgaccactggtgctcagagtgagagagattggtttagttgtttagccaggctatgtggctttgttcccagaccacagattataaccacaccattgtgggcaccacatatagccattttggtaaactagatatgggttgctagggacatgggcaagaaaccatgggtggggaggtgtggacctctcagccctgccctctcaagcctggccaacttcacatctgcaactgggactttgtttctgttccagacctgtttatccaactgccaacttgacagccacttggagtcctcatgagaacctcaaacttagtatgcccaaatgaaattttcagctcaccagaaggtaaccatactgtcttgagtcttacagttaccctgtaaacaaagggattaactttactagatagcaacttcctgcccataaagttaagaaaagagcccctcaatgcaaatgttggttttgcttatcaaataaatggattcttggttcttcaggatagttacagataacaatgggcagaatagccagtaaattcagtaactccttaaaattgttgaaagtattttgtgcactttctttatatcgctgcttagagtgttaattggtaaaatactctgaaggactaatacacaaacactttcacccagcaattccaattctaggactttattccacagatatatttatacatgtatgagttcacatgtacagttttctgaatttttttgtgctggcagaaaactagaaacaacagaaatgaatgaaagagactagttaagaaattattgcccagttttatagtagaatacatatgcagctgtaaaaaaagaatgagggaattattatgtatttatctattaagtgaataaagcaaaatgaagatcaccagcaaacagataaagaaattgtggtattcatacagtggaatactcctccataataaaaaggaatgaacaatgggtgaacactacaacatagacgactctcaagtactgtattcccatttgtgtaaataaaaatgtgggaaagaatgtatacatgtatttgcttataaactctatatgcacagaaggaaacacaagaaattattaccccgggaggcagagcttgtagtgagcggagatcgtgccactgcactccagcctgggcgacagagcaagactccgtctcaaaaaaaaaaaaaaaaagaaattattacctagattgtctatgcagagggaactgggtacctggcagacaggagtaggagggagacattgtacaatatgcttttttatactttttatatttaaaattgcaaaatatcttacatgctcaaaataaaaatagaatagcttatataactatgtctaaatattacatgtagttttcttctctggctattttctttttggtttttatataattttttaaaatccacttacttagcccaggcacataaatggaaagaaagatatgcttaaaattatgttatttgcaaaaacaaatatttagatgttttagagctagtatgtttttgttggtttctagtttagttctacatggcatcagactagctactctatatgatttctggacctttgcaatttgttaagatttgttttatggtcggggatatggtcaatatgtaaatgtttaatgtgtgcaagaagaatgtgtactctgaagttaggcatagtgttttctgtatatgtcaattagcacaagtctgtttatcatgttcaagctctgtgtatctctgggtttttttaatctgcatgatagaacagaagtatgtttgaaacttttattgtagttgtggatgtaatatttttcctctacttttgcagttcttgctttatatattttgagcctatattacttggtacatacatatttagaattgttgtgtcttcctggtggattgccctttgattatttaggaaatgtctctctcttcggtaatgcttcttaaagtccattttgtctgatagtactatagctacctcagctttcttttggctaggtttcataactttttaaattctttcactgtcagtctttttatgtccttatatttaaaatgtgtcaaaagaaagaaggagaaagaaagaaagaaagaaagaaagaaagaaagaaagacaccgcgatttacctatgttacaaacatgtatatgtaaccctaaacctaaaataaaagttaaatataaataaataaagtgtctcttcatgaaaactttcttagcatcattagtcattagggaaatgcaaattaaaaacacaatgagataccaccacatacaacatgtctagtataatggctaaaatgaaaaatactaacaacaccaagtattgttgaacatatggaaaaactggaacactgattatgggagtatacaaccatgttgtaaaacactttaactggtcatttacccaagaggaatgaaagaatgtatccatataaagatttgaacacaaatgtttacagcaactttatttgtaataggtaaaaactgaaaacaactcaaatgtccatagacagatgaatggatttaaaaaaaaccatgttatatccatacaaaggaatactcctctataataaaagggagtaaactactaatacacagtgcaatatagatggattgcaaaatgattctgttgaatggaagaagccagaccaaaaaaagagatatattgtatgattctatttatgtaaaattctcgaaaatgcaaaggatctacagtgacagaaagcaaattagtagttaccaggagacggagggtaaaaattaagaaggggcatgaagaaacttttttattgtagtaatggtctcatgggtctatacgtatgtcaaagcttatctaattgtatactttaaatatgtgcagttcattgccagctaattatactcaatctgtttttaaaagtaaaatgtgcttcttataagtaacaattttttaaaatgtagtctgatgacctttgtcttttaattagagaatttaatctgtttacatttaataactgatataggcagggcacggtggctcccgcctgtaatcccagcactttgggaggccgaggcgggtggatcacctgaggtcaggagttgaagaccagcctagccaacgtggtgaaaccccgtctttactaagaatacaaaaatgagccgggcgtggtggcaggtgcctgtagtctcagctactcaggaggctgaggctggagaatcgcttaaactggggaggcagaggttgcagtgagctgggattgcaccactgcacttcaacctgggtgacagagggagattccatctcaaaaggaaaaaaaaaaaacctgatatatttgggtataaatgttcaatcctactgtaggtttttttttccattttgcccacttgtttcttgttgctatagtcattacaacaatacatgtttgacttattagaatcctagtattaattagtacttttaccatttcccagatgatataatatgggctttaaaacacatgaaatccgtttacccctcaaaccttttgtgtatcattgatgttttaattctatgtatattttaaacttcacattattatcattattatatttatattgcacagtcactatcatttagatttacttatgtttacccttttggtgtatttcaatgctttcagcacttctgtgtttccctttgggattgcttttcttctgcctcaaaaactctccttactatttattttagtatggctctgctggtgataaattctctccatttttgtttatctggtaaaatatttttccttcattacttatgaagaatattttcactaggtagaaaattctagattgttagttattttatttcagcactttgaagatgtcattgcattggtttgtggatttcactttttcaattgagaagttaattttgttggttgcattattacactttgaagataatgtgtcttttccctggatgttttaaagatttttctctttgactttcagtagttctactatgatgtgtctaggtttgatttcctctgtattgattctgatgggcatttatagaactttatgaagctgcgtctggtatttttgccagccagtatttctttaaatattacttctgctccagtttcatctctcctcctcctttgggatccagcttacacaggttacatctgttactttatgactcaacacacttttctggaaagactctcttttctttaaacacaagacactaaatggttacaggtgttcttttaggtgattatgctgcttcatcagcagatggtgattatatcaagaaggaaacttatatgatgacatataaaagctggggagaggagatgtctctgaagacagtgagaaatccttctctagtcttgctgctggaaccctcaaacacttaagtcatctaataaacattctactgtcttcagaggaattttctcagtgaaagggatttgggacacccctgtgaggaagaaacataagttccatgccttccaaataaggggcaaacttttctttgtagtcatgtttccacctgttgaatccgttttatggaagttgtacagttatggcttgtctgtttatgagaagagatagagaatatgagaaacgataaaacctgaaataatccattgtgaggccacaggctgaagaacttacaaggaatttattctagactttatggctgaaaatatgtatgcatatatgtatatgagtgtatggagatacagttatggatagagatctatagatatatgtgtagatatatagatacataaagtttgctacagaaattcattttgtacacttttaaaagtgcactttactaaaagcatccaagaatgcatctcagaaaaagccttagatttcttttatgtggtcaactccaggaactactcactcttgagatagatgtgtgttttcagagcttatccatgccatgcacaatgatctaaccctttgatagctgcatcattcaaagtcagtttttctacatgcaacaaatttttaaaccttgatttttatttatttatttattttgagacaaagtctcgctcttgtcccccaggctggagtgcaatggcgtgatctcagctcactgcaacctccacctcccaggttcaagcgattctcctgcctcaacctcccgagtagctgggattacatgcacctgccaccaagccaggctaatttttgtatttttagtagagacggggtctcaccatgttggccaggctggtcttgaactcctgaccgcaggtgatccacccgccttggcctcccaaagtgctgggattacaggcttgagccaccgtgcccggcctaaaccttgatttttaaaaaaatactaccctgccctaaccttgtaacttaggaagtttggggagaggggtgtgtaacaacctttcactgcttatttgatgtaaatcatttctagtcctgaaacaatggctattttgcaaggtttaattatactgtgtgttgtggttgcatgcataggtacacccacaaatgtctgtcattaatacgtatcactagctttgtactttacactgtatttttggagtgttttacagtcgttcgttaccaagagtaaattatatatttgcttttctttaccccacccctttcactattgtttaaaacatgtcagattcaggaaaacctcaagagacccaaacctctttcaatacttatagacaaagtttttttttccttaaatcagttttaaaatccatccagccattttggctgccggccataccagcagataatgaaagaattttccttgagggtcaaaagccagggagaagccttccagggctgtttggtttcctagcacagctgctggagtagctcgtggtgctgattgatctgcttggagattcttgtgcatcttcacctgttagagctggaaagatgctcaggactatacagcccagcccttctggtttacatataatgaaactaaggcccaccttagtcaactaatgtgcttaaactcaagcaaatggcaaatggcaaaactcaggactctgtcaatgagttttcattctttttctttattcttctagacacatattttataaagaaatgaggcagcatgatgtttaaaatacttaaagtgagaatgagaaaaactgatgtctacatatcatgaaatggttaaaaagtttaacgtgcattgtcttctccattagaacttcttttacgaatttttttctcaaaatctggctcagaaatcttgttttaaaagctccctaaacattcctaggcagaattagtaacgccttcctctttgctaacaaggaactgtgcatattcctgtaatagaatacttaccatattatattgtaagtattaaattattcatctgccctcctcccacctacccactggatcaggcttcccaggaacagcaacagagagcccagcaatttgtgtgttctcagtgtggaatgaatgaatgaatgaatgaatgaatgaaccaaccattccttcacagtcttgcactatcagtgaatcttatgctttattgaacataaaaatcacctggaattgctgacttaaaatacagttttccaggctataccacaagagatgctaatacaggactggggtaggtccaggaattcgaatttttatctaagtagctgatgacttaatgcaaatgatccagcagccacactttgcaagctctacgctatgattagttgtggtttgtagtcccaattgtatatcataattatctgctgatctgaaaaaaacatagagcttctctacccactccttaccaccagtccatcaccaccattctgactccttagtcacaatgggtattgacattttaaataaatcccaaggctcccttccgggagaataaagaggataatatttataaactattttgagttccttagaagaagggtatcttagctcattaaggaaatattatcatgatataaatctaacatcatgaaacttatcttggacatgtcaaatttggtctaagaatcaaatgtagaggaaaataaaacccacacacagtacctgcatggaaacggaacctgtgcaaacacctgctttggctatgttcctttttgtggagacagatgtcccccttcactaggaccagggtagagatgaagaaggttgatttggacattggggtgctatatgttcttttgggactgaagttccatattaggaaacttaatagctgacatttacataacttttaaacatcccaagtagtacgctctgtctgcacactattttatatgtatgcaatttgtttgtttttgtttttgttttgagacagggtctcactttgtcacccaagctggagtgcagcaggcatgaacacagttcactgtagcctcaacctcccaggctcaagcaatcctcccacctcagccccctgagtagctgggactacaggcacacaccaccatacctggctaatttttgtattttttgtagagactgggtttcaccatgttgcccaggctggtctcaaactcccgagctcaagtgatccacctgctttggcctcccaaagtgctgggattacaggcatgagccactgtgcccagccatatggatttttttaaaattatgaacttacataacttcacaggagacagacctgaatgaggtagttattaaactactttctgactatggaaaggatttctgatccttgtagtatatttccacgtatattgttatactgttgtgtgtttgtatttagttgctcatactattttttactgtagcttactttatatgcaggtttccatgggtcaacctaatttatatttttgtcattttaaatggaaaaatgatatcccatatattttgtagtattatttgttcagtgttctttccaatgtgggatgctttggttatttctaattatttgctatcatgctatcatatacagaattcttatgttcatttctgctcaaaattatatttttgtttgtatgaattccacggtgtatatttcccaaagcgagatagttagataaaagagtaacagcagtttcatagttctggttgcatattacagtattactttccagacacacagagccaatatacaaccccaccaggggtgtgaggcatgctggttttcccacagcttgaccaacatgaaattttatcattccagcctatttctgctagcttaatatgtgtgtagggcctcactagagatattttattttgaagttcttcaaatgatatgaagcaattcttttccacgtggaatgattcactattttcattttaaggacaaaccattcgtttgtatttgacagttttgaagtgacaggtttaattgccttctgtataattgattctgtagggagagaaaataggagtgctattaggtattgggttaggctcaaagagtcaagaaagaagattagttgtgtagttctgaatttggaaacttgtatgtggacgactggaacagaaataccagttgaccctgtttaagaagggctagagagcaggaacattctgatttcatgatgacaaaaatactagagttttgacataggacaacagatcttgcttcaaaatgaaagcaagaccctatccttcctgcctctttgatcctctcacagtgccactttctttcctgaacattttcagatattcttatttcagatagaccactctggtgtataataggaccagttttagagtggccatgaagctaagacatgttatttgagagctcttaggggaagacctggacacagcagtcgcaggagaagtcagtcttatctgtaaaaaggtcagcttgatcacagaaaaaggctttggcttggttgtgttggccctccatggcttatgatcctctttcaagtaagcaaataaatgattgcagtgttggtttgagtcctgtggtgccaaacacaagacacattgttgctcatgcaatatagacctttgttttggacagtggtctaatctgctggtttttaaaacattggtgactgtccaacttataattaaaatcagtctatcaagcacttggagacaaaatctgaggttattctttcattcctagttgtcacactaattttttgccttcacttttgtctctgtagaatatttacacgtacacctatctatatctatttagatataatttatatactacaaaattcacccatgtgtacagttcagtgatttttaatgtattcacagtcatcactacaatcaatttcagaacattttcattactccaaacagaaaccccaaactcattagcagccactctccatttctctacaatatccccaaccttaggtgaccacaaatctactttctgtctgtatagattttgcaattctgggcatttcatataaagaatcatagaacatgtggtcttttggtttagcttatttcacttaggataatgtttccaaggttcatttatgttgtggtgtatataggtactcttttcctttttattgctgagtaattttccattgtgtggatatacaactttttgttaagtcattcatcagttgatggacgtttggattttttccattttttggcctttatgaataaggctgctacgaacattcatgtgtaagtttttgtggggaagtgtggttgtctttttttttttttttttttttgcaacagagtcttgctccgtcacccaggctggagtgcagtggagcaatctcagctcactgtgacctccgcctctcgggttcaagcaattgtcatgcctcagcctcccaagtagctgggattacaggcacacgccaccacacctggctaatttttttgtatttttagtagagatggggtttcaccatgttggccaggctggtcatgaactcctgacctcaagtgatctgcccacttcagccccccaaaatgctgggattacaggtgtgagccaccacacactgccagaagtatgttttcatttctcctgggtaaatacctttgagtggaattgctgggatacatgggagctctgcttaaatttttcaggaactgccagatggctttccaaaatggctgcaccattttatactcctaccaacagcatatgcgtgctccagtttctccacatccttgcaaacacttgttattgcccctctttcttgttatagccagcctagtggttgtgaaatggcaactcattgtgatttgatctgcatttcccatttccctcacggctagtagaatacttacttcctatcctagtttttccttatacttttaaaaaattaaataaagaaaacgctgtagaaaattaaggagcaaaatgtatgcttgcagctacagcttcctctggggtttcacacttccttgcctcatcatgtaacgggccaccactaggatgaaggtgctccagtcttattcttccaatcttctctccatttgtcattcagaatcctgggaaagagagacacttgtcctgccgtgagttatgtgcccactcttttgatttgtgtttctgcctagacagtgcacagcatgagtgttggcatcttgaaaggaaactggggtgctcctgagggagaatagatgccaaagttgggacaagagcccagtttcctgcctttctaggtgtaactcattgccaaggtcgggagcaaagcaaaccatgtaggaaacctcatcatgctgggtagttaataagtatgccctagcacacgttttcacagagaaaacataatacgcttcatttgtaatatttaagtattacatctaaagttacaatgtttaaaaatttatatatacccttgttggatacaaagcatgtttaaaatatgtgacctcatttgatcctcagtaatctctgttagtttctaattatattcagtagtggtattggtattgtatgttttggcctcattgtggtttaaatacacttttgtgaactagcctgagaatccaaccaccaacacaatgatgtaatgagaaaacgtgctctgagttccaaacaaatggctaacagataagtgctcagaagtcaacctttttgtaagctggggtatcactggccagcagtcacatgccagcaggtgtgagtagacagtggggaacaatttcctctcatgtgtatggctccctaaagtgttggctgagcattgtccacatgggtgatgcaaaggatcactgaactaggagcagttgggaaaaaatacaatcattgggaattcctgtagcatcgaaggtgcctacagggaggtagaagtattcatacaacagttctctggtgttctctgttgtagcaaccagtcagccaaaagggttcagctgcttgaaatgagaatggctggatcaaaatggcagctcaggatttaaaggattctagtcagataccagacatcctcacatagagaaaactctgaatggctgggggagaaggagtcaaatgccctggatctttttcttgggcctcaaagtcctccttctgtcatcatccttccagtattgggcaggacctgactgcaggcatcatggcctctgtgaacttctcaagggtatgtattatctgacaaaaactacgatgtccactaacaggccactgaaaaggtatcttagtcagttctgctcattgcccagccaaggcctacgttttataacatgatatcaaagattgcatctaaaattgtgatgatttcctaaaataatcatttcatttagatttttctattttaatccaaggtattcttcagcggaaataaggaaacagtttactctcccaccaaaccttggccagtaccatcgacagagcataagtacctctggcttcccctctcttcaactagtaagtatgagttccaggtttacttagcgattggtcaagtgcaaaagtgcccagggtatgtgtttgcctcctgttccttagatcttcctaccatcacctcacattctccagtcaccagatcctaactctgtgactgtgtctggacatcagacaatatccctctctctctctgccaaccggtacttagggtacataatagaacctctgggagctgtggttttgatgtctctagactaggtgggcttccaggtgactcagtctcatccaaattatggttcatatttgggggagaagggctagcccaaaaacttaccaccatttgtagtatgcatttttttggaaaagcatattccaaaatctgaaatgccaagttacagacctcctttttgtaaaataattttcttgctagtataatttacatataataaaattcacacattttaggtgtacaatttggtgaacttgggcaacttagagtcacttaacctttcctcagtcaagatatagaacacttcttttatcctaaagcgttccccagcgcgcttttacaatctcctctccccaggccacaccctccaactcacgcaatctctgactcacttctgtcaccataattttgctctatctggagcttcatatcctgttacagtatgtacaaaccttctttttttgagacagggtgtcagtctgtcacccagcctggagtacagaggtgtgatctcagctcactgcaacctcaacctcccaggatcagatgattctcctcccacctcatcctcccaagtagccgggactacaggcgcatgccaccacacctggctaatttttgtactttttgtagagacaggggtctcgctatgttgcccaggctggtcttgaactcctgggctcaagcgatcctcctgcctcagcctcccaaagtgctgggattacagtgagccactgcacctggccctaaaccttcatttttaaaacacatttcctcttaaattgaagattgcctacatttttatatcaatgccaattgttgagtgtgcctatatgtgttatattatttgagcactaaatgccagatgtgtgccaagtgagataaatctgacaaatgagatggtttgtaaaaccagcagtgaatattcacttcctctgtgagagagctccagccctcctgtactcacttcctcacacagcacagcagcactcttgctggttctgctgcttatcttgaagaggttaggttactttttgtttctacttattacttcgaaaccacttctgccttagaaattttgtaaccttccgctcagtttccggtaaccgccattttgtctcctgtaacaatttacgcgccgtgtaactgtgaatctttcaaaggtatgttttactggagtgatttctggttatttcagaaggataatttgtgtgttgcgtcattaatgaaatagtagtacgaaaaacctatagcatcttttactgcaggaggtaactttccatgccattttttcagaaaatctacttatgacttcagtggcttgctagactggcctttttatttgtacttttcctgtgtttcagaattgcagagtataataaaggcatgtcaagtgcatattgtgtccattttcaggtatattagataagctttacaccaagataaattagatatgcttattggtttaatttgtgctaatatatatttaattgaaaaatcaaaaaaatttttttaaattgactgaagttgtattccaaaacatgcaaaatttagtttaaaatagattggatacacttttaaattttaaacaaggtagagggtttagtgctttgcttttttaaaaagtaaatgaaggctgcagctttctgcagtagttgtcttgggaagtagtgtggacatcactcctaagagacgttaaggaagtttagctaacaggctttaaccctttctctccataccagcttttactcttttttttttttttttgagatggagtttagctcttgtcacgcaggctggagtgcaatggcaccatctcggctcatcgcaacctctgcctcctagttcaagcaattctcctgtagttcaagcaattctcctgcctcagcctcccgagtagctgggattacaggcatgcaccatcacatctggctaattttgtattttgagtagagacggggtttctccatgttggtagggctggtctctaactcctgacctcaggtgatccgcccgcctaggcctcccaaagtgctgggattacgagcatgagccaccatgcccggccaccagcttttactttaatgccacagccttaaattttctttcaggagaaattattttatgtaaagttacaaaggaaaataatgcttaatatctgtaagcattcgtttggtaagtttgctgcctcctcagtaagttttgatgaaagtgaattttgatgaattactaccttagccgggtagtgacgttaacatgtggcttagctgtccattttctaagatatcaagaaaccagcaacaataagtaaaattgttaaattatgcaagaatcacatgttcctacctgtcatcatttagtcttggttctatttgcatgtgaatatcctttagaatatattactcccagttattccgctttacttttctgaatctcttttcccatctcttgacttcaacttcagtatatggctcttgttccttctacctggagaacggaggcatgtggaagcccagaggattgaattcttttttttttcttttctttcttttctttttttttttttagatgaatagtctgcttaggaaatccatctccataatgtttacctggtatcgtgttgtaatgtcagaatgaagtggctgttcttccccttgagtcatcgtcccgaatgaaggttccccaaaagaaatcatcaacttatgtggtgatttccttttacctttaaaaaaaaatttcttttcatggaaagataatggaacatgtcggtaagattcatttctaggaaggcaaaggagtagtttatcatctaaagactctcaacctaaagctgttttagaaaactttccttaaaatgagaagccgtaggttttcgttgcattattttggctaattgaaaaataagaccaagtgcgttctgaccttcgtttctcttacctttatttttacaaccaccatttcaatggcccacttgctgatacaaatgattgtttaattttaaaaagcatttaattgaagtcaagttatttagaacctaatcatttacacgtctttgttgttgctgctgttttgcaagagtgaagagcttggagtcaggtgaatctgggatgaggtacagttgtcatttattagtcatgtaatttgtgacaagccacttaatctctctgaagacttcagtttcttcatttgtaaaattggcataataatgctgtccctagtagggaatatagaattatataatgggtcctttgtatatattggctagtattgctctcttacgatttggcactatggagacactgtgggagattaaaagaagatgatgaataaaaggtgacttcagctctgaagggctttatgatccatttgggagaacaggtaatgtagaatatactggcttcaaaagtggcaggtgtttagaagagaaaaggatacatgatgtgataggaggcaaaggcttgattgagaaggctgagaagacttagagtaagggttctcagccctgactggacattaaaattatctagggacaattcaatcagaattcctgggggtggggaccaagcatcagtattttaaagttccctggggactttaacttgaagcccaggttgagaatcatttaaacagctctgttatttatttatttaaaattttaatgtattttttgagatggagtctcgctctgtcacccaggctggagtgcagtggcgcaatcttggctcactgcaactcctgcctcccaggtccaagctattctcctgcctcagcctccccagtagctaggaatacaggcgtgcaccaccacaactggctaatttttgtacttttagtagagacagggtttcaccatgttggccaggctggtcacaaactcctgacctcaagtgatccacccacctcggcctcccaaagtgctgggattacaggcatgagccactgggcccggcctagttttactttttttttttgtaatggaatttccctctgtcacccaggctggagtgcagtgatgtgatttctgctctctgcaacctctgcctcctgcgttcaagtgattctcctgacttagcatcctgagtagctgggattacaggcagctgccgccatgtctggctaatttttgtatttttagtaaagacggggtttcgccatgttggccaggctggtcttgaacttctgacctcaggtgatccgcccgcctcggcctcccaaagtgctgggattacaggcttgagccactgcgctcggcccatttaaaaaaactttaaaggtagacgtattccaaatggggggaatatataaagaaaggtaacacttattttgccctgtgtgctttgaatttcagaaggtgtagtaagcaaagaccacttactaaccctacagatatatccttagaaaatacagtggtttctgtcataaatctgataaatcagatgagaggaagggtgtatgtttgatgttgatttttctttttgttttattggggtttttaaaaactataaatatcaggtctgatgactatgtgtataaacattttctaagtagataaaatattttcaaattttgcattttttagtatgaaggggatccatcatttgaagttggttttctagatgtgatgataaacttgtcccaggtctatttgacactcctaccaaaatcctttgtgaccagggctagaaggcagctgtggctagtaaataaccctgtgtgtagactcacttattggctttggcattctctattgccacagctgtgtgaatagattaaccagagaccctctggtgccagccacctattcaggcaaacaagtctataatcagtacctctgttaaaatgaaactgtaatatactattgtcttttcatttatttatttatttatttagagacagggccttgctctgtcgcccaggctggagtgcagtggtacaatcttggctcactacaacctccgcctcccaggctcaagcgattctcctgcctcagcctcccaagtaactgggaccacaggcgcaccattgcgcctggctaatttttgtattttttttgtagagacggagtttctccatgttgtccaggctggtcttgaactcctgagcttcagtgatctgcctgccttggcctcccaaagtgctgggattacaggtatgagtcattacacccggcctattttctgattgttcaaagtagaagccaggcacaatggctcatggctgtatgtaatcccaacaatttgggaggcagaggcaggaggatagcttgaagccaagagttcgaggccagcctaggcaacatagtgagaactcatctctacaacaaagttaaaaagaaaaattagccaggcatggtggcacatgcctttagtcccagctacttgcgaggctgaggcagaaggatcacttgaactcaggagttggaggctgcagtgagccatgattgagccacagtactctagcctgggcaacagagtgagaccctgtctcagaaaagaaaagagaagagaggagaagagaaagagagaagagaagagaagagaagagaagagaagacatacaaaagaagagtaacatacaagagaagagttaggagaccctgtctcagaggaaaggaggggaggggaggcgagaggacaagagaagaaagagttaggatctatgccctaaggaagtaaggaggatttgagactgtgtaggtggttaataaccttaagctacatattttatggagggaaaaatcctatttttaaaagtgagaatagaacaattttgaagtgaaatggaatgaattagctggaccataacggctctgactgaagaaaaggatgtaaaaagccacatcctggatatgtaccaaacaccatggttacatggcatgtttgtatatgtaacatttatttaaaaaaaaagtctcatagcttagaaggcatttatttttgttatgtgtataggcttctgtgcaataaagcagccttttttattttacagctcatgatgacttaaatggttaattgcctgataaatatggtcctcttttattcttctgattctgttgttcttttgcacttcatctttcaaggggttgggctattcttaggtttcactgattgcactggaagggacatgacggaaaatgaagatctcaagataattttcttgcaaattcacaatggaagataaaaggaaagagtggcaggcattctgcacacagagcagacgtttctttattgtcattgttcagcagaggaatcaactcagccttggtgaaactagagtgatgcccatggtggcatgtcagcatctccctcttagtggcatcagtgctagattgttgttgttggaagcaggagagtgtttagtccataaagtacagaacttcgatatcacagaagctagaagaactttactgccttcagcttcgtttaaagatagtagagagcttactcattcgttttagaaatatgtattgggtctctatgtcaggaactgctggcacagcagtgagattgaagatacaacagtgaatacaatagagggcctatcctcatagagtttgcctttcagaatgagggacagacgcagacaaatagaaaatgtcgattgtgtcagggagtattgagggctttgaagaatgaaatcgtgacccagaagagatgcttttagattggatcatccgtgaaggcctctatctagaaaggagacacttgggcagaattctgaatgaacttgacggacatctgaaggaaaaatattccagtcagaaggaacagtacgtgcaaagtccccaaaacttcaataagtgacgtgctccagaagcagcaaggaagcagaatgaggcctgaacagagtgggcagtaggaaatgcagtcatagagaaagcagggctgggtcacaggcctcagagactgtagaacattggctcctactctaagacaggaagctgctgtgagcattgaggttgggcgtggaaccatttgactttttatgaggatcactctggctgcagtgtggaaaatagactggacgagggagggcagttaggaagatgtcacggtaactcaggaaagcaataccggtgctttggacgagggtggtggcagaagagaaagtgagaagtattctggatatatttcagaagaaagtggataggattttctgatgggtgatatgtagagtgtaggagaaagagaagaagcaagattgactttaatgttttccacctgggcaattggtggactggaattgccacttgcagaagtgtggaggtatggaaggtatgggaagagcagattgccaggaaagttgagttagttttgaactcattgtgtttgagaggtctgttaaattatcaagtagtgatgttgaggtgtaattggaaaagtcaacctggaatttatggcagaagttgaggctgcagatataaacttgtaattttaaaaatgtatatttaaagccatgggagtgaatgagttcatttgagattgaatgcagattgagaagagatttagaattgaactccagggcactgcatagcaggaggaaaacctagtaaaagtggtatctgtaaaatagaggaacgaactgtcacaatttgcctggtactgaggattttctcagtacatgagactttaagagactgggacaccctgagacaattggttgccttccatgggaagaaagtatgtcaagagggagagagtgaacaactgtgtccaataaaccaggactgagcaaaaaccattgaatttggcatcatgaagtcttaggtgactttgacaaggcttgtctgttgtgaacagccaagtaaatgtgaggaccactctccaaaaggtaaagaaacatgcatgaggatacaggtgcgccagctggagacatcatgcctcttccccgtccccaccaggagtggcgtgaagcctccccagtgctgtaacgaggcagccaggtcctgtgtgactgcacatgtgacttggggcaagtcatttaacctctctgttttcactatcctatttgtgaaatattgtttagatttgtggtttgagtcagctatctgtatactacactgtgttaggagctatgtagattaattttcaacagatatggttctggggttgtaggaattttcaatttgagaacaaattgaatcttaccctttgtcaggagaaatagcctttgacatgtgttaggggcaagggaaatctcaaacttgcttaattttaaaaatgaatatttggttgtggataatttaagctttggtgatatttctaattattttttgtgtgtttctagtctactgaccagaagtctgaaaaaaacaactaaaaagaaagactgcataagccttcactagagaagtattgaaaattgcttgagggaagtgacggtttctttagcctagtgtctgtaggaccccagtgtagtgtttgttgaatgaatgaaaggaggcgtatcagtcaggttcactcagagaaacagaagctgtaggaaatccatatggatgtgtgtgaaggtattggcttgcctactgctggtgtgtggctaagcgagcttaaaagtccgcagggcagatagtcaggaaggaaatattcccaacagactgagctcccttgggcacaagctgaagcctggagtctgaactgccagagagcctctaccttcttagaaaaggcttcccactggctaagtcaggcccacccaggggaatctctcctttgattaacttaaagtcacctgtttagggactttaattacattggcaatagtcccttcacagaagcacctaaatgactgatgatgtaactgaaaaaatgtgtgtgtatgctacaaaatggctgcagtctcccttctgtcctccagctcttgcaggagaactctcttgtagctcaccctgtctgaaaacatactggaaaggaattcaaggaaatgtagttcagcctagccacgttgacacatcatgaagccgtcacaaaaggtaaagcctggtttaggagcatttgcatttgcagtcttaagtatttttgtcttatttttcaaaaggggttgggcacggtggctcacgcctgtaatcccaatactttgggaggccgaggtgagtagatcacttgaggccaggagtttgagaccagccaggccaacgtagtggaaccccgtctccactaaaatgacaacaattagccaggcgtggtggcgcatgcctgtaatcccagctattcaggaggctgaggcacaagaatttcttgaacccaggaggtggaggttgcagtgagccgagatcccgccactgcagtccagcaacggagtgagactctgtctcaaaaaaaaaaaaagtagttttggtttttaatttttgattttttcttatgttattacatataacgaatgatatgcatactctgaaaaatcatgacataaaggtgaccttgaaattactttgatgttcatttaaactagtctttggtctccactggctaggagaccacatatagcagaacagcagagaaagcaaaacagttaattttcatgtttggcttttgagcttccagggacccaagtcttgccttgaaccgatcttaggaaattcctcattccctacccgaccctgtttctaaactgcatccctgctgaaatgcaatgccactgtaactctctccaatatttgttttcttctttggcttaccactagatgtatgtatatatgtttgtgtgcctgtgtgtgtgtgtgtgtgtgtgtgttgactgcctcatagtaaagcctactcttgagattaagactcctgatagtttagagaacagaaatcttttttagttcctggttattacttgaatttgcaagaggaacaactgctaggaggcctagttaacagtagttagggtctccacccacttgccaagggcaagactagtttacaccacatttggaatgaccagtttcctcccactttagtttcagtgtagaaagagtaggggagacgaactattcaatgtcagcttgggtgtagtgccagaaccgtactcagtaatgctgtcattgctgttggtgcttaccagctcttcagtactggaatagcttcagacctcgagagtttatgactttatcatcaactgggtgtgttgcccttggcacattgccacacagtgcttaatgatgatatatgttctttatcaaattccccccaccaaataatggcattatttacgtgtgagaaagttgcacatttcaccacctcatggtttattagagtgcaattccgtgagaacaactgcctgtgatcctctgtatccccagtggccaactcaggagctcagtatgccctacccagtagatgctcagaacatcattgctgagtgaggaagtcagccatcattttctccctggatagtctctcctgtagataacaggggccgttatcagccaggtttttcatcatttgtggctttgaatttcagggacatgacaagtttgctttttgtttcgttttgttttttttttttttttggttttctagagacagggtcttcctgtcactcaggctggagtgcagtgatgtgatcacagctcactgcagcctcgaactcctgggctcagtgtttctcccatctcagcctttggagtagccagcagtataggtggtgtaccaccacacccatctaactttaaaaaaaaaaaaattgtaaagacagagtctcacttttttgcccaggctggtctcatactcctggctcaagcaatcctcctgcgttggcctcccgaagtgctgggactgcaggtgtgagccaccttgcctatccaacatgacaagtattattctctggcaggaagtgaaattttttctcactgatgattgcacacaaatgtcatatctccatgaggcttctactcactagttttacggctcatgtcaccttgcttcaaactatgcttcagtataattttgaagtgtatatttccattgcctctccttgagtaattgatattcttcacaataagtttacatttattatcacttttatttacttactattattactctgagcagccaatcttatgagaagctcagagtggaacgtgtgggtcctggtaaatatattatttgactcacttccaaacacacttaatattgcctggtgttttgattatttcaaaatatacagatttcttgaaaggcctgcaaaaggaaacaatcaaaattatagcggttaagaatgtgagtctgccttggtttgaattccagatgggccagtccctagctgtgtaatcatgggaaaattattaaatctctagcctcgctttcttcatctgtaaaatgagcatacaggctgagcatccctagtccgaaaatgcaaaattcaaaatgctccaaaatctgaaactttttttgtgcctccatgacgccacaagtggaaaattccacacctgacctcacgtgataggtcacagtcaaaacattgtttcatacacacaatacttttttttatttgtataagtttaagtggtacaagtgcagttttgctacatgaatatactgcatagtggtaaagtctggacttttagtgtctccatcacccaaatagcatccattgtattcattcaggaatctagcatccctcaccccctcccatcttcccacctctccaagcctttcatgtctagcattctgtgtccatgtgtacacattatttagctcccacttctaaatgaaaacatgtgatatctgtctttctgtttctgagttttttcacttaagataatggcctccagttccatccacgttgctgcaagagacatgatttcattctttgttatgactgaatagaattattcaggcacaaaattattaaaaatattgtttaaaattaccttcaggctatgtgtataaggtgtatatgaaacataaatgaatttaatgtttacatttgggttccatcccgtggatgtctcattttgtatatgtaaatatgacatgatatgaaaaattcaaaactctgaaacaccaattgaactcaatttgcagtaagaatgcatacctcacagggttatagtgaggattgaatgagacaatcctagtccaatttctttgcacatagtaatgctcaataattattacttaaatgggtataaactttatagtaatgaggttggggctggaaaaaatgcagtttcataatttcctatagaagtcattcaatcctgactctaaactctgtattccatgtggtggttgggtggcgtgggagagtcctctttatcctgtggggttggtcctatggaggtgtctgtggcagattggcagatgcatttgtcttgtgcatagatggtgtctgttgtttcctctggcagagttcaccagtgtcctaatgcaaacttagtcctcatctggctcctgcacaggctgatctctggctcctttagcccctcatggttcctgttgtttcattttcagagggacccttgtaaggactatagtcctctcttcagctgaccttcaggtccccagtcagaaccaagggaaccgactctgtcccttctcatagcacctgaaaaccccgggaaacgaggggaatgctttgctctcagctactgaggttgtcctgtcaccttctcttctgccctcctttgccatggcataggataatgtaagtcagcaatctcattactcggtatatagccagaggaatataaatcattctaccataaagacacacgcgtgtgaatgtttattgcaacactattcacaatagcaaagacatggaatcaacttaaatgcccatcaatgacagattggatgcagaaaatgtggtacatatacaccatggaatactatgcagccataaaaataatgagatcatgccttttgtgggaacatggatggaactggaggctattatcctttgcaaactaacgcagaaatagaaaaccaaatgctgcatgttctcacttataagtgggagctaaatgatgagaacttaccaacacaaagaaaagaacaacagacactgtggcctacttgtgggtgaagggtggtaagagggagaggagcagaaaagataactatgtggtcctgggcttaatacctgggtgataaaataattgtacaacaaacccccatgacatgactttagctatgtaacaaaccttcacatgtacccccaaacctaaaagttaaaaaaaaaatcccagacaggaagtagggcatattttgcctaatttgcagcttcatcctcactccctaacttacgccactcatgtctcctccatcatcagggacagcaagagtggggaggggacgaggcctgccacatctccattctctgatcttatttcctcttgcctcttcaacagcgctttgtctctcctctccagcttgaagcccttactctggtatgtgatttcaaagcgatgaaaaactggtttcgttagtacttcccttggatctgcccttgtctcccatcaaggcagtgcaagtaaagaatccaagatatttgttttgttggtccactggagggtagagatagagaaaaacagtaacttccccaccacccccaacctcccttgggctgatgactccaaagactgccataaatgaacacttcatagagctgctattaatatgacacaaatctacttgatctaagggattcttttactttcttagggtggtcattcctaagtctttggatttcacagaaaagaaaatatattttaattgaggactgacaaaggttgccaactttttatcaattataagaattgtttttataattaccatcaatttctattatttcttttactccccctctttccaactgtggaaggtaaaattgaagagcaaagaacacttatttcaaagtgagtaaatttagctatatgaaaactcagcagattgccctgagtttccttgcgtagctgcagtccagtggaaatttcttccagaccagcaccagtcgccccagtgacatttagaaatcactgccctggattgtttcagccaccgaaacactcggtgttcactgtcagctatgattatatatgaagtgctttcgagaaccaatgtatagcataacttaggccaaaagaaacactgtgcctaaacactcagccaaggagtgttgagtttgcctggatttctggaaaattgtctccgttccctagttcactgtatttgggtaaacaaaacatggcctcggagagcctttgcgggagaaattataaaaattcagcaaagctttgtgatctcattttggatctcctcaggattcctcatcaagttgcaattaaggagagaaaaattccgccttggggtgggattttaattactcatcatgttatgacttgactttctgtgctgcatttttttccatatcactacttctgtgtttgacagctcctccaaagagtcgctccgttttatgccaggagcgaagtacttactaagtcaaaggaaagcaaggcaaacatctactattgcctttgtgcttttaccagaaaactgggtgagaacctccttttccttttccctgcccctccagcctcagttttatgaccctgtggagccagtggactttgaaggacttctgatgacacacctgaacagcctggatgtgcagcttgcccaggagctcggggacttcactgatgacgacttggacgtggtgttcacgccaaaggaatgtaggactttgcagccctctttgccggaggaagggtaaatagttttctaaaatgtagatgtgattgggattgtcatgattgttttcaataagtgggtaggggagatgccttcaatctgaacttaaaaataaaataaaattactcaatccattcaaatgtgtgggacagctatatgatatcatcatgtaagtatagatagtttttaaattagtttggccagagattttgaaaagctatgtgaagactaagccagtgcaagggatgcaggaggaccaaatgaaatgctcaagaggaggttaaaagtgcaggctctggagccagaccacctggctgccagctcagtgaccttggctgtcacatgacctcccaaatcctcggtttctccatttgtaaaaatgtcaagatttttaataataattactgaaatgccaccatccagaagcattttaattgcttacagttatgagactggatcaagttagaaacataaggtaaacccacatttattgagcatctactatgttctgggtactgagataaaaagatgaataagtcaaagtccctcctttaaagaaagtgtcatgcagtgctaaaacagtggggagagctctgtagaataaatatgtgaatagctaattagggcttgagtttctatagttggctcttctatatgtttataggcttgggcattagtttttggcatcaaactaactgtggaattgtagctaaatgaaacgcctgttgcttctaaaatgtaaaaaaaaatgtctctttggaggtttaggataaacttttatttacatttattttaaaagccaaattaagattcatatcctcctggacaggttccatcttctcatcttccccagaaggtcccagaaagaagatcctgacacacagcccctgccctctttactctgagatattctagttctattttggattttatttcatcacagtttaaggaggttggatgataatgggctggtattattgtgaaccgttgctctcttgttcagacagtcctcactcacataggagaactgaccatatgtgtagctctgatgttttaaaaatacacacttcccaggaaagaaaaacattgtcatttttgggaaacatactcccccattttcagtccatttattcaggtatgactttagtataagttaacacctactatttcatctttagtgaagaatcatttaatttattcctttatgtaaaatttatggatgtttccaaatatggtcagaatcttggaaaaagctgtttaaaatgcttacagtagccagtcaccgcagcttgttcctgtggtcccagctacttgggaggctgaggcaagaggatcacttgagcccaggaatttgagttcagcctgggtaaaatagtgagaccctgtttcttacaaaacaaaaacaaaaaacagtacaatgaatttagaggaaggaggaggtttttttttttttgaaatttgataaggaagataatttctttacttagcatcagttttttagtatactgttgccttgtcaaaagaatttataggtaacatacctgtctgatgtctttaagacagcctctactatttcagttgttgccaaaaagtcttctgtataattaaggcaggggaaggtatcatcatcacaccagagtaaacaatagctgactcctgttgaacaacctgtgcctagcccagaactttatgttgagctgtgatggcgtggtagtgaaaaacatgaacgctacaggtgagctgcctggattcaggtccctgctccaccacttgctgtgtgacttggaacaagatccttaccatctcatttttctgcaaagtgagaataatagtaatgcctgccctatggtgctgattgagaattaactgaattaatacatataaagtgattgcctcagtgcataatgcacagtaaatgctacctaagtgtaaactattaatatcatatatgcgtcttattgtgtgccaggcagtcttctaagcactttgcacactaaccgatttaatcttcatcaaagctgtctactaaaaggggcactcttactactctaacagctttaaggagaggaaactgaggcacagaagggttgagtgactggcttatggtcacatagctataagcgatgaagctgggatttgggcaattagggcccagagactgcatgtgtaacctttacaatattttatctaatactaacagcatgtctctgttcttacctccttatcacagatgagaaaattaaggcttgtagcatttaagcctgtttatttctggtactaatgcatttgcaacaatagcaaaaagctttgctacaattgttatttttgatttcaagactctgaagcacttgaagagtattgctcatggtgcattccttaagtagacatgacaggaaccaactgaattaatgatcaccaacaaaagccagtgtttgcaatttcatcaaagcataagacaactgttctttttcctggctttcaaaaaggagaacacgcgtgtcctaacaaggttacacatgcataaaaaatatgtccaaattaccctgtcagagataggtatttatacttattttccttgttttgtattcgaatacagctagttctacctgtcttgtgtctgaatgccttcggggatagttataatttaacatgattctgtataataaagaaaacccacaaagcaaaaaaatgccaacatgtttgtctcatcaaagtaaaaatgtttattgccccaggaatacttcagacatttggaatgattgggcaagaacatcctaagcattctcactgataaggatttaaattcgtgtcatgttccttgctcatgattaggggttgttttgttgttttacccagtaataacgtgtttatttcattttctacctcattagggttgaactggaccctcatgtcagggactgtgttcagacctacatccgtgagtggctaatcgtgaaccggaagtaagttactttttttccactttttgtatataaatattaattttatattgctagtttttaaatatttcttaatactttgaacagttctaggtttacagaaaaattgcatggcaaatagagttctcatgtatgccttccttatccccactccatatcacacacacagttccccctattatgaacatctcactttagtgtggtacatttgttacagtagctgagccaatatggatatgttgttattaactaaagaccatagtttacattaatgtttactttttgtgttgtatattctatgggttttgacaaatgtgtaatgacatgtatatgcctttacagtatcatacagaattgtttcactgccctaaaaatcctctgtgttccacctgttcatcctccctccctggcaaccactttccttttttactgtctccataattccaccttgttcttcaatgtctttttgtggcttgatagctcattttttttattgctgaataatctttcattgcatggctgtaccattgtttatttatccattaacttactgagaaagaaagttctattttaaacataaagaatagactgcaagcttgcccaacccctagcccgtgggcaacatggagcccaggatggctttgaatgtggcccaacacaaattcataaactttcttaaaacattatgaggtttttttttttgcgatttttttaaagctcattagctattgttagtgttagtgtatttgatatttggcctgagataattcttcttccagtatggcccagggaagccaaaagtttgggcacctggaatagagcctttttgttgtcttctaattctgatgaattcccagggggaaaaattaagtgaattgaaacctggcctcagcttcagaggtggcattcgagtttatgaccaagaaataaattacttgctggccttccagtaagggatctttctctcctggattaatcaaaccttctgtgacattgttctgagctttttctctccatgccatggacctggacagcactctctcatgagaaacatctatgcacattgaaattctcagcctgcatgggtgtacctgttggggagtgagatgtggactctctacagattagggcacaccccactagagacacgtcacagaacctttgacaagacattagtagtttaaaattctgatagcctcactcctcctatacctcagtaagaattactattctatggggtaaatgatgaaagactttgaggattgggttttatctagctcctggaagggtgccattgagtttgtgctgaggttttctggagtaatgtcaatatgcacacattttcagcagcagaaaaagagaaagcattcattattaaaagttattaagagaaagttagatgccaatccatcatctgttctaaaatgaatggaaaacaaagtttgctgggcagtcagataaaattatggtttgctgataataaataaaagatttcagaacaagttgttctcaagtttttaaatgctatcattagaggtactttctggacattaaagatctaaaaaaaatctgagaaggaacaaatagaaagatccattttgatacatttggttttcagatttattttctatttcgggcttgtccactttttcatttctcatggcaatgcacgcttcttggagtagtgatttttcttgatcttgcacaaatgtaagagaaaaaaatgactctttttggaatactcgttgaaattttagaaataattatgaaacacaaatcactcagtttcactctagacagataatcatcatgaacatttgatgtctgtcctttgaatagtgttgggtttttttggtatatatttgcgtgaaaactaaataagattataatatcatttttgtaacatgcattttcagttttcacagtaaagagtgattctcttcctttgctattaaatatgcttcctcaatacaatgattgatgattgcataatatatttataccaaaatttatttaaccaattttaatatttaggtgattccttccttttcagtgttgtgcttaaaatgcaaaaacatccttctcaggaaaaatttgtacatatttatgatttttttctttggaattaattcctacaagaggaatttctatgtcaaaggatatgcacaaatttaaagatttggaatactagatcaaacattatgccgggcgcagtggctcacatttataatcttactcagcactttgggaggttgaggtaggaggatcccttgaacccaggagttcaagaccagcctaggcaatatacagagaccccacctctaaaaaaattttttaaaaaattaactggatatgatgacatgcacctgtagtcctagctactcgggaggctgaggcaggaggatcacttgagcccaggaggtcaaggctgtagtgagtgacgattgcaccactgcacaccagcccaggcaacagaggaagaccctatctcaaaaaaaaaaaaaaaaaaaaagccaggcacggtgctcatgcctgtaatcccagcactttgggaggccaagacgggtggatcacctgaggttgggagtttgagaccagcctgaccaacatggagaaacccagtctctactaaaaatacaaaattaaccgggcatggtggtgcatgtctgtaatcccagctacttgggaggctgaggcaggagaatcacttgatcctctaaaaatagctaaactgggaggcagaggttgtggtgagccaagatcgcgccattgcactccagcctgggcaacaagagtgaaactccgtctcaaaaaaaaaaaaaaaaaaaaaaaaaagattattgacactacatgcatgaatcctcaagaatattagatgttataatttatcaacatttccaattttatttgataaaaggttgtcttttttttcattttcttttactattagattaggcatctttcttctatatatttcttggccattttttatttttcctggtgctctgcttattcgtgaaatttgtgcatccctattaatgtatttgtctagtctgatttatttttataagcacttttttggtaaagatattaagccttgtctaccatgtattaaaaatgtcttccccagtatgccttttgtcttttaaagttgtttttaattttcaacattcagaattatttatgtcattaaatctatattaatatttttccttatgtttaattttggcatcatgcttaaaatttgattcacaaacttattattattttctaagagtatgggattaaagcattaatccagatcattagccacttgactgttgcttctgttcccttatgtgtctccatttgtttttatcttttctacagaagcaatggttacccatatatttattatatgcaagtttttgcatcttgttcccctaaaaaagaaaggaatatgtgttttaattttatgtttggcaacattctagggatgggattaccattggcccagttctctgcacccctgtgtaatggagcagttcccttcttaacggtcacctagtggacagggagaagtgtacaacttcagaactcattgtcagtttctggcaagctttcttgtagaaaagttgcatctctttctatccctctgcctcattctcttgcactctgaatctaacactctgcccatgaaaactaaaattcctagcacacactcctcccagggatcattctgtctctatatgcacctgtcgtattttatctgtggggagaatccagtacactattgccagatgtccttcatctcccaacctcacacagtacatttttagcttattgttttctgtgagttgtatctgtattgttttagaatgatggtagaaggagaaggacaaggagaaggtggtgattcatataaatgaaaccagctggaagctgtgatgctttcatagataagccactattatgaagaaggagacttcagatttctgtatagacactgaccagggactcgtgggcaggaaggtgtgcaacaccttcttatctttattcagtgagttcccctttggggagacaaagtttggtacatccttctctttccagctccatctgatccacagaggttctgtccagattcaggcattaagttatctcttcatttggatgagtttccagtttttctgtgtcttcataagtggtttactagaaagtcggaggaggatgcaataggggttgctggccatttgttaattagtgattaattatttagctctcctttaattggttatgtgccaaatcatgtatgattgttttgaaagaaatcaagtaatatggaggtgcattaaggaaaaggcaaatctcatgcctcactacttaccagtgtcctacccttcccttaactcactcttcactgcgtaaagcccagctgtgtagcttccagatcttttcataccctcacaaaaaatatttgtctatttatatttttcacataaagatatatgtattaatgtatgtacttatatattacaaacatttctttaaaataactgtccatgtcagagctatatcccattctactgaaatgctgcctagtattcaaagggtgaaggaatgtgtcctaagttactgaaactaaatgaccattttggttgtcaccatttttcataattgcaaataatactgaaacaaacatatctgcacatttgccccatacatgtgtgtgaatatttctgagggtagaaatgaagccagtgtacatggtatgctctgataggtactgccaaattcttctccagaaaagtcgtgctgtttcattccattaccaactgggcattaaactggcgtgttcccatattcttgccagtgctggatattatttattaaaataaaatttcagttcctccagtcttcttttagttattattttaatctggaagctattacacctactttctgaatacagtttcctatcaccaagtttcctttccttatgtgttctaaaatcccagttaaatatgcacttaaccatacaaccgtaagtcccactcttgagtatttacataaaacctatgtgcaaatacagcagtttagcagttttatttgtaattgccaagactgcatagcagttttatttgtaattgccaaaaactggaagaaaacccagattgtactcagttgggtagtagataaacaaactctggtaaatccatacaatggaatactactcagcagtgaaatggaacaaacaattgatatatacaacaacatggatgaatctcagatacagtatgctaagtgaaagaagccagacaaaggccgggcatggtggctcatgcctgtaatcccagcactttgggaggctgaggcaggtggatcacttgaggtcaggagttccagaccagcctgaccaacatggtgaaaccccgtctctactaaaactacaaaaattagctgggcgtggtggcacgtgcctgtagtcccagttactcaggaggctgaggcaggagaatcgcttgaacctgggaggcggaggttgcagtgagctgagatcatgccattgtactccagcctgggcaacaaagtgagattctgtcttaaaaaaaaaaaaagaagaagaacccagacaaaaaagataactgcatgattccatgtatctgacattctggaaaagatgaagctacagggatggaaaacaggtccatggttcccagggtctgggagtggggaagagggctgactacaaaaggacacgggagtgccctttgcgtggtgctgggactgtagtgcccatgatgtaaaatctgccttggaccattacattagaagaaatcaattccagttatcccaatattccctccaagtgaaatactttggtagcatatataataataattcaataagtattagctattatatttattaagtagtacctatcagaaaacatacttatattagcatgtcaaaggaatgaacacaaaattctctcccatatattgaacgcaccatggaggggggacctgccttcctctggaggaccatacttagtgaagccactttgccttataaggacatgcctttgttatccagaaccaagcagtcaaacactgatttagttagctcctttatttctcagttatctcctgctgatattacatttctccataatatctagagataggcttttatgtccttgctagctgtggtaatggttttgaatcccacttagggggcagaggagtagagtaatggccacttgtgttccctcccaccctcatcattctacagggcatttgccactcaagtactgtaattgagacatttaaatcatacaaataatgctgcccatgaaggatagaggaaatttttagatttccttttaaacctaacagagaaagattaagttacataaaaatgtaaaatacatgatctccagtacattgaaggaaatgtattttcttacttgaaatgtttgtgttacttagactggaagatttattaaatgatttccattctatcactcatgtttacagcaccaaatttggtgtccttgttctaaaaacaatagtacttttctccccatgacttttgaaaatgattactggtttactgattagcatggcgccatgtttgcttgtttgtccaaccttttatctgcatattttgataatgttgtgtggattaatatttgatgacatcctttgggtgatattaacgattttaagctttatttcttctgtcattttctctaaatgaaccaaagagggataaacttcagaatgtttttgatgcctggtggagagctgaactcttaagaaattaaacttgtttacatactatatttattcttgccgcagagacagtgaaacatttcatgagtgttatgggcagcatcataaaagcctttagactttgtttttcatctggggtgattaaggtaattctgaaggaaggttgagctcaaggagagctgagatatcaaggaatggggtatcatctgttttattactccatattttactcccagtgaagtggtaaacaattaaaattcaaacacatcagtgcatataattcagttactcccagaacaccataaaaatgtttccctgatcaataattgcttattatgacatgcatttgttgtgctagctgtcaaggtgcttagctatttgctttctaaaagtatgaaaagcacgcccggctcatcagcctatgtggtaacaaagagcaatccagctgtggatgtcacagagccactcttgacctgttgtgcatagactccctccccacaaatccaaacccactaagactctccaggctctgttaacacacaccagcctggttcagcttggatgccctcctcacaccatgtgggttctgattttccatgccaggcagtccatcttaaatggatgcatcctcaccgtgtttgggcttcaacttcctattctggacctcctcggctactccctaccccaaggcatggagggctgccttgttctgatgcaccttatgattttagcaccaaattgtacaggaagggagagaagggaaaggagaaagaagatgtgaaaggaaagagagggtagggaagaggaaaaagaagatgaggaacacgtattattttctaatcctcacaataggtcctcaaaatgagcaacatttccccctatttcatacttgaggaagctgtgactcagagagactaaggcacttgcccaaggtctcttagtacattaaggagccagcgtctgcacccagttccttctgactctagagcctggattctgctggctgcaccacactgtctttaaagagaacactctcaaaacgcgcttggtctttggattgtctcaaatgtgttagaatagtgttttaagaaaaggaatgcagatctcctgggaagcaataggtcgagttcatttcatgagaatcatttttctagccattggcctacttccccatttttctcctgtctgcatctaggtgcaacaggaacttggctttatttgactccattgccagggtggggtaatgaagctgggactctcttgtagccagcggcagtgagccagcagtctcactgcctacccagtgatggttccttctgtggccagcacttctggaatgagtcatctttacatgtttgccaacccttgtcctctcctccccagccaggttcacccttgctgctgtcaaggagctttgagactttctgagatttttaaatggggaagtagatgttaaacctagtatgaggaagagagggaaagtttgctctggtttcaaacacacagtcatagaagatgctagtcttaatgctttccatagcaaaaaccctgaaggcttagagtgtacacattgtgaactgaacttttaacattattgtgtaactcatttgttaatgcctatttgtcattgactgtggggtccatgtgaaaaactcccacaaacactctaacaaaatggaagacagaaaagaaagcaagcatcatttgtgtacaatagccaaagaacaatagccaaataaatttgatggtctcaaaagttaagcatcttttgaagagaaaatttgattttagggccaggtggggtagctcatgcctgtaatcgcagcactttgggaggcagaggcgggtggatcacctgaggtcaggagttcgagaccagcctggccaacacggcaaaaccccgtctctactaaaaatacaaaaattagctgggtacggtggcgcatgcctgtgatcccagctacttaagaggctgagacaggagaattgcttcaactcgggaggcggaggttgcagtgagccaagatcatgccgctgtactccagcctgggtgaaggagccagactctgtctccaaaaacaaaaacaaacagaaaaaagaattgattttgattttttcagatacagtgcatgaactttttatcataaaatattaaagctggggaaaatatcttagaattcacctcatgttcatgctttaccctgtgaagaaacagaggcacagagagaaataacttgaggataatggaaacaagcacacatctgtaagtgtgtgtgtgtgtgtgtgtgtgtgtgtgtgtgtgtcagagagagagagagagatgttcctttgtaagtaaacactcttggaaatagccgcattttattataacacaaaaagtaatgctaaagctgatatagttctggttgctaagcttcacacacaaaaggtctttaggtagctgcttcctaatttttatttctgtggcccaaaagtctccttgtaaaccttcgtgtcatgtcatactaaacctttgacatcaataccctttaaaatgtacaagtccttaaaaaaaaaaaaaaggcaaagggcaaatactaatgtgggaaatttgaattttaattaactgtttgtttcaatgttaggataaattaatgttagataaattctttggtaatttttccccctaaaattggatttttcaagaaacatcactggttcagtatattgttatttggggtagcataattttaggcgataacttaatatttgcatatatttgtcactactttgagttggtttttgtcccctgacccccagccaggatgttagatcacacagatttttttttctttgagcccttagggagagtccaaaacagtcacttcatgtactaggaaagtttacccagtcagcacacacagatatgttgttgcctacatttatatttgtgagagtgactgttaagaaactagcaggtttataaaatccgtgtgagaatttctctcaaataactgttaatggacaatccagcaatcctcccatctcaggctcccaagtagctgagactacaggcaggtggcaccatactcggctaattttttgtgttttttgtagagatgcggtttcaccatgtcacccaggctggtctcaaactcctgggctcaagtggtgctcccgccttggcctcccagagtgctgggattacaggtgtgagccactgcacccagcctgtacattttccttgaaatcgtttttggatgtttagtcttatttccttattcagagttcacctgtttattttttttttcatttccccaatttagcctgcgtttcacccagccctagcaatataggtttgggtcagagaaattcaagcggccaggggatgctgaagatggcccattatggccgggcgcggtggcacacatctgtaatcccagcactttgggaggccgaggcaggcagatcacaaggtcaggagatcgagaccatcctggctaacacagtgaaaccccgtctctactaaaaatacaaaaaaattagctggctgtggtggtgggcgcctgtagtccaagctactcaggagactgaggcaggagaatggtgtgaacccgggaggcagagcttgcagtgagcagagatcgtgccactgcactccagcctgggcgacagtgagactccgtctcaaaaaaaaaaaaaaaagatggcccattgtggtaagccttgacttgaattagtcaccaagctagtcttatctcttttctaggctaattcttgttttttgtttggctcaaaacaaattgtttgtcttcagaacacaataaaatccagggagagtgtcctgttcttcctacagacgtcactgggacatcttattctttaattaattcagtcaactaaaattggtcaaatacctgctctctgtgccagagttataaactttgtatttgtataattgctagtagctctcttacatttcttactttatctatctggcatttgatctacctaataccttccaatatcacctcatgtccctttaccagcttggtggtttttctatagttcaggaaatcaaacaaaatggtgtgtgacctggaggtactagaaaaacaatagcaaaccaactccaaagccagcagaagaaaacaaataaccaaaatcagagctgaaaaaaattaaaacgtgaaaatccatacaaaagatcaatgaaaccaaaagtttgtgattcaaaaaaaaaacaaggttgatagatcactaactagattaataaagaaaacaagagagaagatcgatccaaataagcacaatcagaaatgacaaaaatgacactacaactgatgcctcagaaatataaaaaatcctcagagactgttataaatacccctatgcacacaaactagaaaacgtagaagaaatggatagattcctggaaacacacaagccccctaaaattgaagcaggaagaaattgaaatcttgaacagaccaatagtgagttctgaaattgaatcagtaatacaaaacccaccccaaaaagcccttaatcagatggattcacagccaaattataccagatatacaaagaagagctagtaccaatcctactgaaattatttcaaaaattcaaggaggaaggactcctctctaactcattctgcaaagccagcatcattctgataccaaaacctgggagagacacagcagaaaagaaaacttcaggccaatatccctgatgaacatcgacacaaaaatcctcaacaaaatactacaaaccaaatccagcagcacattgaaaagttaattcatcacaatcaagtaggctttattcctgggatgcgaggttggttcaccatacacaaatcaataaatgagactcatcacatagacagaattaaaaacaaaaaccacaggataatctcaatagacacagaaaaggcttttaacaaaattcaacatcccttcatgttaaaaaccctcaacaaattaggcattgaaagaacatacctcaaaataataagagccatctattattcaactatccacagccaacatcatactgagtgggcaaaagctggaagcgttcctcttgagaactggaacaaaacaaggatgcctactctcaccacttatatcaacatggtactggaagtgctagccagagaaatcaggcaagaaaaagaaataaaagacatcccaacaggaagagaggaagtcaaactagctctgtcacagtgcaggcaatataattctgtacccagaaaacactgcagaccctgctaaaaggctcctagaactgataaacaacttcagtaaagtttcaggatacaaaatcaatgtacaaaagtcaataacatttccacacaccaataatgtctaagttgagggccaaatcaagaatgcaattccatttattttatccttttgaataaaatacctaggaatacagctaatcaaggaggtgaaagatctctacaatgagaattatgaaacacactgaaagagatcagaggtgatacaaacaaatggacaaatattccatgctcgtggataggaagaatcaatattattaaaacagccatagtgcccaaagagatttttagattcactgctattcctatcttaattagcaacatcattttttcacagaatttaaaaaaaaaaacctattccaaaattcatgtggaaccaaaaaacctgaatagccaaagcaatcttaagcaaaaagaacaaagccggtggcatcacactgtgtgacttcatactacactacaaggctacagtgaccaatacagcacagtccaggtacaaaaacagacacgtagaccaatagaacaagataaagaaccagaaataaagctgcacgcctacagccatctgatctttgacgaagttgacaataacaagccatgaggaaaggtctccctattcaataaatggtgctggagcaactggctagtcatatacagaatattgaaattggacccctccttttaatcatatacaaacattaactcaagatggattaaggacttaaatgtaagacctaagattacaaaaaccctagagaaaaaaactgggaaatactattctggccattggccttggtaaagaatttatgaataagtccccaaaagcaatggtaacaaaaacaaaaattgacaagtgggacttaattaaactaaagagcttctgcacagcagaagaaactatcaacagagtaaactgataaccaactgaataggagaaaatatttgcaaaccgtaaatctgaagaatgtctgatatccagaatctataaggaacttagataattcaacatgcaaaaaaccaccccatttaaaaatgggcaaaggacatgaacagatacttctcaaaagaagacatacatgtggccaaaaaatatatgaaaaaatgcttaacatcactaatcattagataaatacaaatcaaaaccacagtgtgataccaactcacaacagtcagaatgcctgttattgaaaagtcataaaatagactgggcatgtggcttatgcttgtaatcccagcattttgggaggctgaggcaggaggattatttgaagccaggaggttgagaccagcctgtgcaatgtagcaagactgtgtctctacaaaacatcaaaataaatggaaaaaaaaaaagaaaaagaaaaagaaaattaactgggtatggtggcgtgtacctatactctcacctactgggaggctgaggtgggaagattgcttgagcctaggaattcaaggctgcagtgagctataatcacaccactgcactccatcctgggtagcagaacgagaccctgtctcaagaaaaaaaaaaaggcaaaaattaacatgttggaaattagttcagtcactatggaatgcagtgtgaagatttctgaaagaacttaaaacagaactaccattcaacccagcaatcccactactgggtctatacccaaaggaaaataaattgttctacaaaaacgacacatgcactcgtatgttcctcacagcacaattcacaatagcaaagacatggaatcaacctagatgcccatcgacagtggactagataaagaaaatttggtacatatacaccatgaaataccacacagccataacaaagaacaaaatcatgggggtttttttgcagcaacatggatgcagctggaggccattatcctaaacaaattaacacaggaacagaaaaccaaataccacatgttcttatttataagcaggagctaaacatcgggtaaacatgggcataaagataacacggtagacaccagggattactaaagaagggaggatggaagcaggtgtgggttgaaaaactgcctattgagtaccatggtcactatgtgggtgacgtcagtatcatgcatacatcaaacctaagtgacatgcaatttacccatgtaatgaatttgcacatgtatcccttgaacctaaaataaaagttggaaaaaaataaaagataagatatcccgtatcctcaataaaaataaaagtggcgtgtttgtgcacttgactttgtaacatgttttccaaagatgtctttgagtcataaaaatgggaaatacacatgttggtttctctagtcatcacttgacaacttacatgttttacctttcttatgatggtctgtctcatttcttcagtgacagggctagacattctgttttaaactcttcccacagctgtatattattcaacacaactttaacagagttcatagagtggagattgaggatgtttgcaaagttaaatcatttatttttattttttcttaaccatgtcccgcctgctttattcattattaagaacattgatgtgaagattaaatggttttctctatttttatcttcaaacgatctctatttgtggcttctgcacattgctagatttattccagccacttacactagggtcatagtttagcttcagctcggagccaaatgccccacagctgaaatgaccgcacctctgaagtggcattttcccaggccatgcctccctttaataatgagccagccagggggtaaatttgtatctcattacaacagagccttgtattaggcctggagaataattaaatgtgaggaattataattggttccctctttgaaagctctctcagcaccatgtctacacttaagccattacttttatttttaatctaatggtttgccgctctctctccctctttctctctccaaattaaatatcaaccataaaagaaaccaaggaagtccagaaatctgtggctttaaaaagactggatctcgaaaagattttcacaagacgcttccgaaacagacgtttgagtcggaaaccttggagtgcagtgaacccgctgctcaggtatttcctgtcaacaaacatggttaccaggttactgggctcttctgcccagggcatgctgtcagttttacaaactagaataaacgatagacgcatagaaagtttgagtaggaggaactttaccatctgagtcagtgattttttttttcaaacttatttgtagctgtagaaattggtgttcaaatgaaaacccagaaacccaatgattaaaatagaaaaaagtggaaaagctctaactgggggacagagacaccttgggcccatccctacgacagttcctgcagagactcttggtgcccctaaggcaaactacagagtaatgaaaagctctatgctgaggccagaatacctgcattctcctagtgattctaccatgtactaactctctaacttcaagcaggataattaaacttattgggcttcagtttcctcccctgggaaacaaggatggtaatactaactcatgaggttatttgagtattaaatgagttaatatccataaagaattagaataatgccaagtacacttagtgcctagtcaatgctggtcactgttattgttattgtcattattctttttcttttttttttttgttgagacagagtctcgctctgtcgcccaggctggactgcagtggcacgatcttggctcactgcaagctccgcctcccgggttcacgccattctgctgcctcagcctcccaggtagctgggactacaggctcccgccaccacgcccagctaatttctttttgtatttttagtagagacggggtttcaccgtgttagtcaggatggtcctgatctcctgaccttgtgatccgcccgcctcggcctcccaaagtgctgggattacaggcatgagccaccacgcctggccagttgtcattattcttataaagtaattacagtttaaaattcaagttaaagtgtacatattgtgaaatgagcttttaacactattctgtaactaattttttaaatgcctggggtcatttgaagaactccagcaaacactctaacaaatagaagacagaaagaaagcaagccttcatttgcataaaacggccaaagaacaatagccaaataaattccatgtttccaaaagttaagctctatacacctatgctcacagcagcattattcacagcagccaaaaagtagaagcagcccaagtatccatccataatgaatggataaacaaaatgtggtcgccaggggctgggggagggaggagtaggaagttattgtttaatgggtagagtttcggcatcccaagatgaacagcattatggagatggatgctggtgatggttatactgcagtgtgaatgtgtttaacactactgagctgtccaacctgcccattttatagatgagaaaaataaaattgagaagaaaaaatttgttcaagtttgcacagaacttcttgtaaactaatatagttttcagcttccatgtgtcttcataatacaggaatctcaccatgctggaaatgattcgaggtttttaaataatactaatttttcagacaaggtggtccccctaaagcaaagcccactacttacttggagcttcacagtagaatcagccatcatttccagcgctaaatatgacaggcttactgagggatagaatacctggatgctctgctctatgggagatttaaggaatttttcatcagtaattttgactgaattccattttcaccctacatgctgaccaattaaattgttcctcttaatgttagtcagatagaagccacggtaggtatttcagcagaagaaatttaacacagggaattgattaaaccggttttggaggtctgagagaaccaaaagggaaaaatggaggctatcctaaaatcgtcattatgggaaacagcacaccagcctggggctggggtatacggcagtggttctccacttcagcttcatcagaatctcccagagggtttgttcaaatataggttgctgggccctgtctgctggaatttctgattcagtaggtctggagggtgaacctcatactttttaattagcatttcctaagtgatgctgatgctgctggtcccaggaccacaatttgaggactgcaggtctaggggaagatcttggagttgtcagaacgtagaagctcagaagaggagcctgagagcaaggactgaaatccctgagaaggtactgcccagctggtggtgttgtctcaagatctcagagggaaaaacctcatgaagcctggactcacgcctcacaggaggagaaattgcccggctggtgctggtaccttcaaggaggtaagataagggtgattctggaagtaccaaaagaacctgaaggctagaaccagctgtcactacgaaggtgagaggaatagcaagaggaaggagccaggccctttgacctccttgaaccatccggtaaccctgtagtgctccctattgacagaacctaaagggagcagcagacacagcggaaatatgatttgctgacctagcatcaaagaacaaggcataaaagggtgaatttggagcccagaaacaataggtgaagaccagcgtacacacaaagcacacgctttcctgcagcatactagcagagaactcaagtcactgtgttgtgtgtggttttttttgttttttttttttttttttttttttttttttttttttttgagatggagttttgctcttattgccaggctggagtgcaatggcatgatctcggctcactacaacctccgcctcccaagttcaagcgattcttctgcctcagcctcccgagtagctgggattacagacatgcgccaccacgcctggccaattgtgtatttttagtagagacagggtttctccatgttggtcaggctgatctcgaactcctgacctcaggtgatccacccaccttggcctcccaaagtgctgggattacaggtgtgagccaccgcacccggcccactgtctgtgtttaagagccaacttgatcatatgatccagcagtctcactactagatatatgtccagaggaaaggatatcagtatatcaaagagacatctgcactcccatgtttattgcagcactattcacagtaaccaagacgtggactcaacctaagtatccatcagcagaagaatggataaagaaaatgtggtatgtatacacgatagaatactattcagccataaaaaaatgaagtcctgtcatttgcatcaacatggatgagtctagaggataagtgaaataagccaagcacagtaagactaatactgcatgatctcacttatatgtggaagataaataagttgatctcatagaagtagagggtagaagtggtaactagatgctgggaaggatggatggagaagggaatagagaggttggttaacggttacaaaattatagctagataggaggaataagttctagtatttgatagtactgtaaggtgactagaattaataataatttattctgtgtttccaaatagctagaagaaaggattttgaatgttcccaacacaaagaaatgataattgaggcaatgggtacactaattaccctgatttgatcattacacattgtacacaggtattgagatattacactgtattccataaataggtacaactattatgtgtctattaaatttttttaaagagccaaattgtacaaaagttgtttgttttgaaatattggaataatactcatcatggagagaatctcagactgcgagatgacagcaatgttttcaattccactctcattcttgtgcaccttcttattgagtagaatggtgaggccacatagctagatttataaaatttaaacaagtatatgataagattccttggtacacgtagattttataaaaattagattatattatgcataatattgcaaaacttcctttttcatattagcaatatactgtgattatctttctcttccaattaatacgtgttctttcttttttagagacagagtcttgctctgtcgcctaggctggagtgcagtggcacgatcttggctcactgcaacccctgcctcccaggttcaagtgattctcctcccttagcctcccgagtagctgggactacaggcatgtgccacgacacccggctaattttttgtatttttagtagagacggggtttcaccatgttagccaggatggtcttgatctcctgacctcatgatcccccggccttggcctcccaaagtgctgagattacaggcatgagccaccgcacctggccaggttctttcttttaatggctacataacattctattttatgaaagttccaaaatctcttaacacttcctttttgggggcatttagtttacttctattgttttgctatcacgaacagtgtttcagagatgcccttgccctcacattcttgcacacttgccagttataccctacggataaattcttagaagtgaaatttctagattaagggatgagtaatgttagatttttttacttatatgtatcttgatatccttttaaataaatttgggaaattaaagtcattttccttaaactcttataaattttaagaaaaacaaaagtattaataatcgaagtgttaatattgattatttctagcacattcagtttggggaaaatttatgatctagtagagtagtacttttgtgaggtagatgtcacaaaaaatgtgtagtatggagaaattgtccagtagtatgtccatttagtagaattttgagaataacattttgccataaattttatagatatttaccattaatccatttgtagtcctacaacatatagttgattacagttatacattttttgctgagtctttggttcaaagcatgcagttcccaattacaaagacattcctaatggaataaaacatccactttgtgactgatttaaggttgttttcttaaagcacaccgcagccaaaagtggacacagcttgaatagcaaattttttcctttttgttgttgttgcttcatccaataactgttaccaaattcccgtagaaaagtgttgcccactcccacatcgacctttggaagcataacattcagctttggtgtctatacacaatttaatttggaaggctcctcacaaatcatcttattttccagtttcaaaaaccaagttctgagtggagattaagacagggtctctttatttcccagtgcagtctcctatctatttatttgtgaatgaatgaattagttaattaatgagccagggtttcactttgtcacccaggctggattgcagaagaagtcatcgtggccaagcgtggtggctcatgcctgtaatcccagcactttgggaggccaagacaggtggatcacttgaggtcaggagttcaagaccagcctggccaacatggtgaaaccctgtctctactaaaaatacaaaattagccaggcgtggtggcgcgtgcctgtaatcccagctactcaggaggctgaggcaaaagaatcacttgaacctgggaggcagaggcagcagtgagctgagattgcgccattgcactccagcctggccaaaaaatgtgaaactccgtctaaaaaaaaaaaaaatccaatctttcctattggctttattaaatacactttaactttagaagcttagaagcacaataattagaactggcctaactttaaaaaaaattttcacaaagaaattagtaacttgtagggtcatttgtaatctttttctctgttgatttttacagttttaaaaagttaatacaataatttatttacttattttttgagacggagtctcgctcttgttgcccaggctggagtacagtggcaccatctcgggtcattacaacctccacctcccgggttcaagcgattctcctgcctcagcctcccaagtagctgagattataggcactggccaccatgcccagctaattgttttgtatttttagtagcgatggggtttcaccatattggccagtctgatcttgaactcctgacctcaggtgatccgcccacctcggcctcccaaagtgctgggattacaggcatgagcccaatattttaaaaatagtacattattacagaagctagatgtgcactttaaattattatcagaaaattagtatgacagacaaattctatgattgtcccatcatctgggcctgtgacattcacacctttgtgatgttcatccccgactgtgggtgggacctgggacttgcttctgtcaaaacaatatggcaaagcatgagaggatgtcacttgtgatcatattagatagcagccaaaatggattaaagacttaaatggggccgggcgcagtggctcacccctgtaatcctagcactttgggaggttgatggcggcggatcacctaaggtcaggagtttcagaccagcctggacaatatggtgaaaccctatctctactaaaaatacaaaaataaccagatgtagtggcggacgcctgtagtcccatctgctagggaggccgacgcaggagaattgcttgaacctgggaggcggaggttgcagtgagctgagatggcgccattgcactcaagcctaggtgtcgcagcaagactcggtctttaaaaaaaaaaaaaaggtaatcatacctcactgcagccttgaactcctgggcggggttcaagcagtcttcctacctaaacctcccaagtagctaagactgtaggtgcacgccaccatgcctggctaagttttgcttttttttttttttttaagagactgagtctcattgtgttgcccaggctagtcttgaactcccggcctcaagcagtcctcccaccttgtctacccaaggactgggattaaaggcataaaccactgcacctggcccagtctcctttttgttacaacttcctccagctctgttttgctctggtgtgagacatgagcatggttcattaagaggcttggcccccccagccccaggaaagaacaagccaacaaccgataggaatgtagtactgtttttagtcctttcctcaggactggtttgtctgcataagatgagtaactacctgcttccaggtgagaagaagacatttaattttagagtagtccagccaggaagctgagatgtcattcttatcaaatccgcagtttcttcagaagacttgaggcctggctgagattctgtagtcccaaattggagcagtcttgagacatccaagattcttcggttctcattttagacttgccgtctctctcacaaagacccactgttttctctcacaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgaggtgggtgccactgtttccatactggagaatctcagtgaagactctgagagtcatgtggacaattgtgttgttcattattactatatagcagcccatggtgtcagggctcacttgtatgatttctggggcctcgtttttcactcaggcaagcctgtgtgtcatagcagagccattattgattatcacacagatgggattctgataataataacaactggaattttcatagcactttacaaaatatgttcactaagagcatctcatttaatccccaaatgtttcaagggtctacatgtagtaatcacacccagcaagtcaaaccatcctattatttgaggggatgtgtggtcactaatccattgagacatacattacttaaactttgatgttctttagtgctttgttactttctttttaatggtctctatgagcaaccagagagacctgctttgaaaacatttcaggctaggataatcacagcccatgctcccaatgtatagaactttgggatcttgattgtttacttcttcatttattggagctgactgacaacaataggataatgtagactttgcctgtggtcactgcctgaggcactttggatgaaatgagaggtgacgattattcaagccttttgtctgtttgaactccttatactgtataggaggctctcagttttcccctctgcgtgaggttatctacacttctgggtcttgccagaacagattactgctatatctctgctgtccaaatggtattgaaagttcagttggaagaaacaggatttgaggaaactgcataaaagatattctatccatccatgcctctaaatatttgaaattcgatccttggattaagtgagacaatcagagagcctgatacccccacccttctggattgtgtttgctaacctgcccttcagtgagctcacgactggtcagcaaggaggacaataaaggaaacagcagtcatgagataggatatcacgtccacatggaaatactattgttgacattgacctactcaccatctagcaccttcctctttgatgatctaaagggcaattagccttcacatcttccgagaaagaagaagcacgcttctgctgagataatacaaacacttagagattgtgctcattttgtaactaactctcttaagttctttacttagagcaaacttctgtccaccttcaccaaatgtggcaacttaatgattggggtcctgaatttactccagctttcttttcttttcttatcctgattttctaagcaccttggtttcctcatctatttttattttatttgcagtttttgtcagcagcctcaaatggtcttctgaatgaggcagaatataaaaataaattatctcacttatatatagaatctaaaaaagtggatctcatagaaacagagtagaaaggtggttatagcaggggctgtggggagagggagaaggtgttggtcaaaggccacaaagtctcaggcgggaggaatacgttttagtgacctatcgcactgcacagtgaccagagttaataataatgtgttacatatttcaaaactgctttaaaaaaggatttttaatgttctcatcacacacacacaaaaggtaagttggtgaggtgatagatatgttaattagcttgatttaatctttctacaatgtatgcatagatcaaaacattacttgatttaatctttatacgatgtatacatagatcaaaacatgacactgtaccccatagatgttcacaattactacttgtcaattaaaaaataaattaataaagtatgaataatgtgagcaatatcatcatctcctttcctcagattaaaaagcaacaattaggctaaagagctttttcaagattcaacagataaattaaattacaaaatggggccctaacccgctaactacaaagttcgtgttcccttgtttatgtatctacatacatatgactacctggtatgttgggacacataactgaaatccaaatatgatatttttaaatatcatgtaactttttagtttccatccacgacattaagactttttaccagatttgtcaaaacatattaaatcagactgatttggcctttactttccttcctcttcctctcagttctgtgatggagatgccaacatgtaatagagggacccaaagtggatgccagaagagagagaacaattaaaggatgcagagaatatgtccagtgagacgtttgcttgtcagtgtctccctggtggtattagaggggagaatgttccatctgaacagattaaaataatgaaacgtagcctggttttagaggaactttgttttatgatctttgaaacaatgcagacgctccattgggactgaatgttataatctgggagcaggcctaatggggcctgcttttattgagtagagagaagtgcttcgtaattagtgttgcagttatttgtaaactggcgtgtctaaaatgcttgagggcctctataccagccctttaatattttgaagctgttgtcacagaaattgcatttgtatttataatttgtgctttctccaaagaaagttctatggaagaaaggtaaatttctgcctactctgacatgattacaaatgctggttttttcgatgacacaatcagatttttaaatatatcattacttgatttccctgtaaggaaagttagaagagaggtaaactagtatatccaagttatggctgagtctacaggagaagcaaaagttggacttaaccaccaagcttctataaggcaagttctttccctaattcattctgagtctacaaaaggcggttattctacaaaaggcattctatgtcaatccctaagaaagattccactgatactccaaattatagaaaagtttgctgaggctgttggttacaagtgacagaacccaactaaaaccaattcagaaaaaaaggctaggggagtacttcttggctcacctaagaaaatcacaggtaggcaaatgtggagttgacctctggatccattgggagagtaaatgaaagaatatcatctctctcatactgtctctttctctctcattatctctttcattccgttcatttatatatatttttaggatgatgaaaacaagaggtatccattaatgtttcacatttccactttctgtttgcttgggaattagttgccatttcagttagctataaagcctgaggaaattcatatagcttagaagagactgaggaaatatatcacccaaatgtcatatgtggaccttgtttggatcttgatttaacaaaataacagtaaaaacaaattgagacagtcagggaaatttgaaactgacaaaaattatttagtggcaataagaaattattaatttttaggcataatggtattgctgtatgtttttaaaagtctttatcttttaaagatatgtactgaaatatttatatatgtatatggtctctgggaagttgcttctatgtaatccagtattgagcgagaaaggtggtaagtgggtaaatagatgaaaccagaatgcccctgaattgaacttgttgaagctagatgatgggtgaatggttcttcattgcattgctctctcaacttttgtgtatgtttaaaattttcccaatgaaaatcttttttaaaaggatttcaaaaattagaatctagaccaaaggcagtcccagaaatccatgagtgtctctaccttcaggttgttttccagttagggagatcttccctttagatatgtctgttccaatgatcctaaaaggtccagattgccctgagcgagtaggcatcaaaacaatgtctcctctgaaataaactcagccattccacccagcaacatggccaaccgccgtaaccacaaggaatggggaccacagggagaggttggagtaatgatgagcttaccacattgatcattccatcaaagtgggtacatatttaccaggaaggtgactttactgctatttgcaagaatgttaagcttgctgtggggtattcactggaaagctcccaggaaaagacagtgagatgtgaccctgttctttggacccttgcgatgggcagagcactcaccagtgtttggaaagcatactgcaagagtgggaattactgttttcaaggatttgcactacttatttttgcatacatgaatataattaacatagaatgatagttcagatacagatgttaaggttacaataggggcttgatatttctctttaagtgtttagtttctgtgcggtaaaataaacaggtagagctcttaatttgtcattactaaatttcatatacctagcactttaggaagctctaactgcataagcctgtctagaacttgtcaattcaaccccaagtctctatcatctgtttaagaaaacagtgaactgagaaagtgactctgtattataggatcaatggtttacagccttaagtgaaccattctgactcagatttcaaatctgaaactcacatacttactagtaaagcccttgacaggagaaatattgcaaatgtgtaattagagtgggcaaaaaacacacaaaaacatcaacaataggtataagattttgcaatgccatctggtggatgttactaagccatatccatgttcacatttccttccttcctgcttcagtctctttgtcttgaatgcttgggtttctaaaaggagaaactgttttgctgcaaatgctggctttgaggttgggggttggaagagaaactttcttataaaaggcagagtgttagaaaaaaagcaaatctaagttaacttgagccgtggagggtagccttcccttccctgggttaactctaattggagctccccacagaattcactaatgatttccttacgatgtgattaaaaataggaggatgctgtggaaatacgtccagtaccagaatgtcccaaggaacacctgggcaacagaatattggtcaagttgctgaccttgaagtaagtatcaacaaacacactgccaccgctttgagatttatcttgccttttacatacaaatgttgtgtttattatcagagcttgaatcaaagcggagctcccaaaatacgtctaacagtgggcagctgtggagtagtagaaagggcacgtttgagtccattcctggattttttttctaccaacttcttgatggtcattcttctacaatagagaaggcaaacacacgtgtctactaaagttaggcaggtaaggtcattgagtgaaatgacctacattaagaaaaatagcgcttaagtcagtggtgtgctggagtcgactgtactaactcgtgagatctgacagtgcatatctcttcctgggttcggtgaagtcacattggtaactttaaattggccatggcgaaagtatttacaatgtagaaatcagccaatgctacacgtttgcaccaccctcagcacccggagattatttgtaaaacatttaccagtatgccactgttgaaacacaatgataaatgcaactgaaactcagtgccaggggacaatagggagtggtgaggactgtagtaaactatgttaagggggcactcactgctagcaacagactcttgccatccaaataaacaggcccatttttgtcaactgtcttttctattttttcaagagaagctgaaaacccagatttttctgcataatataccgactccctaaatatgttctcattccctttataaacaccatataattaaaacacgactacagtctggtttcatcttgtgggccaattatttgccacatctacttcaaagtagttgcatccaaacgtttcaattgtatactatgatagcaaaaaaaaaaaatcctctatagacatgtattaattttgtactttcatattaaaatattatctacattataaaacataatagaaattttaaagatgaactagataaatctatataaattctagtattttcttcttccactgcaatagattgtcttgtgtaccctcggagtgcctccatacctctcttcgtctctgcagactgctattttcaagaattagttctccttcaaatccacagatgaaaactttaaagttgtacatattttacctaagcaaaactacagaagcgtaacatttatttatatactattagatgggtcatccatctctcaaagtcacttcataggtcccttcagcggcccctggtttgcagtgagaaggcatctggattctggatgtaaggctgggtttcaacccctgggaacttccctgggattttgagttcttccctataaatgaagttgatagaccttatggtctcaaaattcctacctaccacaaacttctatgattctaacgcatagcctctgccaacttcttctgcctcagaaaacaagccagcaagtctgctcacacagctatgggtggtctcttgatattatagtctcctcccgctggccagttctaccagagggtcttcagggccttttgtacggagaaatgagcagcccataaaccagctgagtgtcaagtaatgggcacagaaaagcaagctcttgcccttgcaaaccaacctggcagtgggagcttcctcatctgtctggttggcgggaggactgagtggaagtggctcttcccctctgcattgtttaggaagccttcgctattgtctgagggacacacctgccccgacaggatgcatcatcaggctacttttagatgcagcgactatgtcatttgagatggcagaaattctcctctatggtgctcatagccaagctttctagacctctccagtgaatgagaggcagctgttctcacaggtgggaaaacatggtcactaagagagatatgtgttattttaaaaaaatgttaatggaggccaagtgtggtgactcacacctgtaatcccaacactttgggaggccaaagtgggaggatcgcttgaggccaggagtttgaggccggcctgggcaatatagtgagaccccctctctaccaaaaactaacagatgtgttaatttttagccctagctacattgggaggctgaggtggaaggatcgcttgaggccaggagttcaaggctgcagtgagctatgatcatgccactgtattccagcctgagtgacagagtgagaccctgtctctaaaattaaaaaaagaggagtcacttgaatatctcttaatgaaaattgtaaagtgcagtttctagtgatgtccccgcaactgccaaagcagaaattaagtcgaattgacatatttgccaggtgcacttggcctgctcatgtgttttaaatagtatctatactaacctataactgcaagagaagagatagaccaaaaagacagccctccgagtaactacttagagtaaactagatgaaagaaagaaacaaattcttataggtaagcctagaatgtgacagtatgaatagtaaaaatataagggtaatattaatggcaaatgttttcccatttacattgatatgtaggattctattcataatactacatgttttagcccctgaggaatttgtttaaagttgtagacatctgtaactgtctctgtattgcttttcagaaatatagaaaccctcaaagatacagagagaattagggtcctgccaattctgcaaatgtttgtaacagaaaaaaaaaaaaagaatgacaacaaagtatttttctgttttgtgttttaaatggagaaatattttaagatttaataccatcttatgaaaagtaatctcagctcttaggagtcttcttgatggtgaaactttaatgtgcagaaaatttgcccaggcagtttcttttaaatgcagattttggaggaccttccataacaatctccctcaagagattctggttgagtaggtctcaggtgggatcaagaaacctgcatgctggctaacttcttttgcttcaaaatgctagattctggggactacacttaaagaacaaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaaccggaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgaccagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgaccagagatggctgggctcaaaacctgaccgaacactcacggaaaaagcccaggttctgtgaccagagatggctgggctcaaaacctgaccgaacactcacggaaaaagcccaggttctgtgaccagagatggctgggctcaaaacctgaccgaacactcacggaaaaagcccaggttctgtgatcagagatggctgggctcaaaacctgaccgaacactcacggaaaaagcccaggttctgtgaccagagatggctgggctcaaaacctgaccgaacactcacggaaaaagcccaggttctgtgaccagagatggctgggctcaaaacctgaccgaacactcacggaaaaagcccaggttctgtgaccagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgaccagagatggctgggctcaaaacctgaccgaacactcacggaaaaagcccaggttctgtgaccagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgaccagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgaccagagatggctgggctcaaaacctgaccgaacactcacggaaaaagcccaggttctgtgaccagagatggctgggctcaaaacctgaccgaacactcacggaaaaagcccaggttctgtgaccagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgtgccagtccctaactgtgtagactttggcaagttccttattccctgggaaccttgctttcctggtgtgttaaatgcagataatatctgcattacgctgtagttgtgtaaagagactgatgtgtggaaagcacttattataacacaattttaagtctttaataaatgtcaattctctttttctttctcggaaccacagaggacttactactcagtaccaacctaagtatatcacagcaatattcaggccctttgtgtagtagggagtaaacaattaaatatagattgagcatgccaggcagcagctggtgagcctaggcccaggaaagcctccaattggcctggtgcagtggctcacacctgtaatcccagtactttgggaggctgaggcaggtgagtcacctgagctcaggagtttgagaccagcctggacaacatggtaagaccccatctctactaaatatacaaaaattagctgggtgtggtggcacatgcctgtagtcacagctgctagggaggctgaggccgaagaatcgcttgaacctgggtggcggaggttgcagtgagccgaggttgcaccattgcactccaccctgggtgacaagagcaaaactccatctcaaaaaaaaaaaaaaagaaagcccccaattaatgtgcaattacctaataatagaaagaataatcatagaaatcctcaacactgggcttttcggtggtaaaatgtatgtaacataaaatctaccatctttttttttttttttttttttttgagacagagtctcactctattgtccaggctggagtgcagtggcatgatctcggctcactgcaacttctgcctcccaggttcaagtgattctcctgcctcagcctcccgagtagctgggattacaggcacttgccaccacgctcggccagtttttgtggtttagtagagacagggtttcaccgtgttggccaggctggtcttgaactcctgacctcatgatccgcttgcctcggcctcccaaagtgctgggattacaggcatgagccactgcgcctggccaaaatctaccatcttaaccatttttaaggtacagttcagtggtgagtacattcacattgttctgcaaccatcaccaccatccatctccaggaatttttctcttcccaaactgaaactctgtacccgttaaacaataactccttattctccctactccccagcccctggcaactcccattctactttctgcctctatgaattttactactctaggtgcctcatgtaaggggaatcatgaagtaactgtctttttgtgactggcttcttttactcataatgtcctcaggttcatctatattgtagtatgtatcagaatctccctccttttatggctaaataatattccattgtatatatgtagcatattttgttatggcctcatatatgtatctgttcatggacaagtgggttacttccaccttttggctattgtgaatagtgctgctacttggcattgtttttaagatacattcacacacatcattatacgtgatcctcacaacaaccaggaaaatggaaaggcaagcatccttaccttattttgcagataaataaatggaattcagaaaggcgagtaacctgattagggtcgcagaattagcagatggtggaggaggaacagagtccaggtctctgcctgggtgccctgggagtctgccatgattccaaattgcctcatttccaaaggcgccatttgagcaaataaccctttttgtctgtgctcatattctgtccaaatattcttctaaaaagtcctcttttgagacaaagctatccattgatgaggacatcctctcacacatacctggagacaaaacatgactttattgacatgatgtctgaggtaatggtggactggggcccttttcctggtgctctctgcaggtaacatccaaagccatgggacatcaagctgagaaacttggaagaccttcaccagtgttccatgtgcacctgtaatgtccaccaagatactaaaggcaaataatgcaccaggattatgctttgggattcaccgtttcgaggggaattggcaattagggccaatatgagggctcatctttctagctctcatggggcccaggcacctcagtgtttatctgctgtgctcaagcccctccctgacctcaactcagcaactccccagtaatggagttaggaagggccagacattcatccccatcaaaacccagccttcttctgactgtcccactacaaatctaaggaaaagcaattgaacttttcttttgttgccatctgaaaagccccattccttagaattgaataatacagattctatcctttaaatttttttatttcaatggctttagggtaagtggtttttggttacatggatgaattgtatagtagtaaagtttgagattttagtgcacccgtcacccaagcagtgtacattgtacccagtatgtagtttttttatccctcatccccctctactctcctgcttctgagtctccaaggtccattataccactctgtttgcctttgtgtactcatagcttagctcccactaacatacagcatttggtttccattcctgagttacttcactcagaataacaacccccggctccatccaagttcctgcaaaagacattaattatttccttctattttatggataagcagtattccatagtgtatagataccacattttctttatctactcattggttggtgggcaattaggttggttgttggttccatatctttgcagttgtgaaacagatactatctagcaataaaatgtgaaatgtgaacaagtccattacctcagacagaaagtctaccctctgaaaacacagtagttacaataagaaggtgaatcacactaaaggtccattcagcccactctctcttgcagtgagtgagtgaatgagtgagatattccaaaaatatccaccatgcttttgtaatgtccaccatgatctcaaatgattaggaatttttcacaaacctcctatatttctctattaatatcccagtgcgattctcatatacttggagttttccaaatatttcgggaaactgctcatatttttaaccagtttatctatctaggtgttttcagaaaattcaaaattatctaactcaaagccacatagattttcctctctttctatggtaggttcgagattgaaattgagcccctgtttgccagcattgccctctacgatgttaaagaaaggaaaaaggtaagaaagcaaagaaaaatccatccctaaggcacatatattgttcatgattctttgcatgtatgtttttaaatttctttgcagcaagaacctatcagatttgaaagcaaatgatctttgatgagtccagttctgttgcctttgcaatttttcaagcagtggtctgagaatgtaatttatgatctttgaagaattttagagggagaggctactggaggtgctggcctggttggaatagagaaagaatgaaatagcgcatggggttatgtataaaacaaacccatttaaatacatttttaacaagcttggatgcgcatgtaaagcttcctcagtttgagagttctttgcactgtgaaataggctcatgactgaagggcatcttacatggtagaggtctcaatttgtcacagagttcagaccttaccaactgtaatgtgcttttaatgaaaacagtgaccaagacctctcgtgtgtttttaatgtttagtcattttgtgactcctagaagaggacagcaatagcaaatccagagtaggatggacacttctgcccttctttacccataatcattctgtatttaaggaaacaagcatctcctgcataaatattaataatcactgagatttgtaggataggttaactgctaaaacaagcagaacccaatctcagtggtttaaagcagtagttctcaaacttgagcatgcatcacaatctcctggaggacttgttaaaacacagattgctggacctcacccacagagtttctgattcagcaagtccaggtggggcctgagaatttgcatttctaacagtcccctgctgatgctgaagctactggtcaggggaccacattttgaaaaccgctggcctataagcaagaagttgctgtctttgtttctttaaccatccagggtgggaggagggacccctctgttccacgcagccactcagaaatacaggctggcagtggctcctccatcttcagtatgttctctccccaaattactcttgtcactgccattgctgcccctgaagaagagaaaagaaggatggaggaggcctggaagtttgatacattgcttctgctaacaattcactggagagaattgagtcacatgatcacccctcattgcaaaggaggctggtaaatgtagtctctgcctgggcagccactcaccactaaaattctcatggtgatgaaggagagaacccaaccatacagtggctcttaagtaatacgacactaagagagccaggagcactgttcacatcatgctcttgctcagaatcttcactaagattcattccctacaaccaggctttcttcatgatggcattcctctaccttctttccatccatagtctatgcagagtcaagctagaccgctgactaagcttcccccagccgttcaagcctctgagatatttattcatactctaatctctccctggcacatcatcaccttccacccctgcctatcagaatcttctaaggcccatccatctccagtgctgcttccatgaaaagttgtccttgtcacccaactgcaaatggcctgtcactctggaacttccacagtgcttctttgtatgcatgtggtgacttgtattttgcttttactgtagttagttacatgtttaccttttccctcacctttttttttttttttttttgagtcagggtctcactctgttgcccaggctggcatgcagtggggcgatcttggcttactgcaccctctgcctcccgggttcaagtgatccatcctcccacctcagcgtcccaagtcgctggaaccacaggcacatgccaccatgctggctagtttttgtattttttgtagaggcagggtttcaccatgttgcccaggctggtttcaaactcgtgagctcaagcaatgtgcccgccttggcctcccaaagtgctgggattacgagtgtgaaccaccacacccagtccttccctcattcttgattgtgaattaattgagagcagaggtcctcctcttctgtagtgaagtaactgatactcaggaaataccggtgggttaataaacatttaaatgtttcaaggaacatctctcaaatggctccagaatacctagacattgtgacaaaacatttgtcagatttatccaggagccactttcctaaaccacatctgtgattattacacttactccttcagcaaaatttctctgtggtgtttttactcctttttaacatgtttaaaccatgaatgcaacaggtctaacttatatttcactttgctgctcatttacagatctcagaaaattttcactgtgacctgaactctgaccagttcaaaggatttctgcgagctcacacgccttcagtggccgcatcaagtcaggcgagatctgcagtcttctcagtcacctacccgtcctcagacatctacctggtagtcaaggtaattcagtacgatctgatttgcccaatctgatgttttcattgctgtgttgttcccagcacatgtttggggtgcacgcaatctcagaatgtgtccacatatcctctgagattcactttgtttccttctcagtttaccccttttccgttctaagtaaactgtttcagatactagaaagactaggttttggagacacacagacctaggtttgagtcctggctttacaacctagtaattaaatggcattggcagtttcctggtctttctgagactgagtttcctcatctgtgaagtggagataatcacactgacctcagtggatagtcatgactacagaataaagcttggcacatcttgggcacccttctcctaattaaggagagttccctcagtgacctggtgcaaagaagctgctgtggagaaaggaacaaaatctctgggctagagtttcctaacgatgttcatgttgctctagagatgcatagttacgtgttcccaagtccagcctcttacaagctgaagcgtgggctgtggttttcaagtttcatcctccttttttttttttcttcttaccatgtcacagactgtctctaatgagagttgaaatctatggggcaattgtaagtagaagagcctttcattctaggctatactctttgctgttgtaagaaaaccagatcctttctctgtacaccaaaatgactggttagaaattaacaaacatcaggtattttacctaccttaggccagataattggtcttattgattcttttttttttttttttttttttttttgagaggagttttgctcttgtcacccaggctggagtgcagtgtcaccatgtcggctcactgcaacctccacctcccgggttcaaacgattctcctgcctcagcctcccgagtagctgggattataggagcccaccaccccaaaccaggctaatttttgtatttttagtagggacaggatttcaccatgttggccaggctgatctcaaactcctgatctcaggtgattcacctgtatttggttcccaaagtgttgggattacaggcgtgagccactgtgcccggccgtaaaatcattgtaaaaacaaaacaacaaattcaggtgtctgatttcatgtgcccccagcctcttaggtttggaacattatctagttagtacagtgttttatgtctgtagtctcagtgatcgccccatgatctcatggattccaaataattcaggtagctttgaggtcacttaacagatggcaaatgtcttttcactctagcttctttaacaccatataacaaagattatgagaggttactgtagcttgaggggaacttatttaagcttatagaagtatagttaaaattatattgctgaaaagacacttctattgttgtcaaacttcaatgtgtctccttttcgttgcaatattacttagacatacaggaaaattaaagcccactatgatagccctgtaggtaagttcacaattctctgtcagcctaggaaactgaagaagccaacactagttctatagagccaaattttatctcaaactctacttcccagtggatgactttctcttgattaatccgtcatattctgccaagtaacagtggttacccattggttcctatcacttactaaatatgttccaaaattttcaaatgtataaatgtgttcatttggcataacaaacatactaaagtgtttggataggtttaagaaattgaaatctactcagcaagacagcccctggttggctttctgtttgcttttctttatcgtaatgccatcattgttgcttctttccctttaaatatatagtaaatggtgttaaactatttagcacatccaggcagacattatttggtaagaggggcttctttcttttttgtttatattcccaggccgaacatcagggtctttactgtattttaggtagcatcatctagttcaggtgttgcatataatacggctttaagggattatttccgcttaaaagtttaattcaagattttgtgaaatttttttttaaaaagaatttgttttacaatcaaggaaagaagagtgaaaatgggattgaattggaaacttttcaaaaattgtttaaaaattggtatgccgtgcccaatttaaatatttcataagttgcgatgggcctatccttatgtaagggccacatagtttgagaaaacacaaagcagagagcctagcactttagaagtcttgcagatgttaaatttcccatcttaaagagtttacaatccagttaaaaaaacaacttggcattcaaagaaatgggttcaaattcctattttgctacatttgctgtgtatggtagcaagtttagtctgtcagtctaattggacaatgatccctgtgcctgagtggttttgaagaaaattgaaataatgtatgtaaaaacacctaccctgtacctgacataccataattaggtaaacaataaatggccatgaaatatgaaaaaaataggtatgccaagtgttaatcctaccccttctgaatagagcagaaagtagtctgttcccttaagaaaagttttaggttaatctgataggcttatttgccctactttccatggttatgaggagtcatgcatttcattacacacttttgcataaatcatgagggaacaaacaataggttctcatgtcggtctgcagctccttctcatgaagtacctggagttctccttgcccactgcagccagggcatagtatctgctggtctggtcaaatctgacttctcctgcttcctgtatgttccatgatacacactactagtgcatgaagccgtggcattccccttccttgcttcagggtcctaattaagaagttcttcatctctgttcagaatttattctaaagaccacatttttaatccattcacttcatggaaaaattagcttccttccaatttgttctacaagctcctgactatgagcttcaggagaatgggggcagtgtttatcgccaccttatctcccagctgctaccatatagaaggtactcaacaataagtaaacgattgctgattagcaggaatactggtcagtttctagctcaagtgttacgtgcttatgttttcagtgtggtgcatctctcagtgggattcgccttctcttcatgctgtggcaatgggagggggttttgaacttctttgatgagaagagagacttcctgcttggagtcctccctgaagcagatattcattgagtagcctcatgctgcttcctttgaaaccccataaatgcccctttatcatgggtattgttaaatactttgtgcctaactcacagcacctattaagtatgtgtcccttttgtactgtgttgacccaaattctttcttcaaggatcatctcaactgatgggactaaatccactggttttactcttcaacatctaagttaaattttttttgagcagagagttaggaaatttcaaatttctccttgtctttcttttaaatatggtgcccaaatttatgacaactggccagccagtcactttacctgaagcaagacagaagacacttcattcattcttattaccagcattcattcctatcaacagccagttagcaaagcaagaagctgcacatcccaatgcttttgagtttctttccaagtctgttaaatccagagaattagccctgataggaattacaagggagacaattacagataatttattcggttcagtcattcattttgtggaaggttttagtccctaacccaactttcacagagaccatatctcttttttacattgtaagcaataataaagaaaatgagttttccacttcctacgtatgtctcctgggttttgttttataaaataacttttattgctgtttttattatatacataatacatgtttattgtttaaaatagaaaatacacataagcaatgggaagaaaataaaaatcacacataatcccaccatagaaagttaactactattaacacttgctgcatttgctgagtatctactgtcacccttttaatatgcctttatgatttgttaaataaaattgtatgctattctttatataaattttttaataaaaaaatatgtatcacagatagcttcctatgtcatcaaatattgtcataaaatgtaattttgatggttgcatagattcctttttatggatgtaatttatgtgccttattttaatattctttttattggtagattgaaaaagtcctgcagcagggagagattggagactgtgcagagccctacacggttatcaaagaaagtgatggtggaaaggtatggtaatttgagtgttgttaaatggagacatcttagaagaagcaggtattttcagaagtgttacacaaatagttaatgggctttagtccctaatgtgtccctatataagacactactacattttaattaaataaaagaggaaaagaaaactggtcaccgatgatgactttttttttttttttttttttttttttgaggcagtgtcttactttatctcccaggctggagtgctggagtgcaatcacggccccctacaaccttgaactcctgggcttgaatgatcctcccccttcagcctcttgagcagctggtactacaggcacatgccaccatgcttggctagttttttatttttttttagagatggggtctcactgtgttgcccaggctgctctcataattctggcctcaagtgattctcctgcctcagcctcccaaagtgttgggattacaggcatgagtcaccatgcccagcctgatgatgattttttagagaaataaatccttgaattttctaatgttgacatacagcaaggtctgactgcataacttgattggggcaaggccaccccctgttgtcttcattctgaggctctgactcagctggttgggaggtccgtggagaccccaaaactaaacagtgccagagctctcctggccttcctcaacagcatgggccgctgccctttcaggtatgcaaataactgggaattggctgccactaccatgcattatatatattcattagcacagcataggtgttgagcctatgaaaaggatatcttttctcaacagcaatttgcaaagattcccagtgtgatttttaaaacatggccttggccgggcgtggtggctcacacctgtaatcccagcactttgggaggccaaggcgggcagatcatgaggtcagaagattgagaccatcctggccaacacggtgaaaccccgtctctgctaaaaatacaaaaaattagccgggcatggtggcacgtgcctgtattcccagcttctcaggaggctgaggcaggagaatagcttgaacctgggaggcggaggttgcagtgagccgagatcgtgccactgcactccagcctgggtgacagagtgagactctgtctcaaaaaaaaaaaaaaatagcctttctggaataagacttaccttattagtattgtactctacagactcataaatgtcaagtaagatttattgaactcaaggcattttttttttaaaatctgtcttttattctgaactcagaaagaacaccttggaagtattgtaaacttcctaaggagttgttaggaagctttttagaattttttggagttttccaaggtgacttttggagaaacaggttcacttgggagcttggtagatgatatactaaacttgatttcaagattcttttatgcaaatccaagtcacatagctagccaccaaaagaattgataatctgatgtaatgagtctctttttgttttcgttagctaaaaatgtattttactaattaaatgtagcctttttgtaaactcctcgttttttaatctttatttccttatcagctagacccaagtgcatcatttttctgcctattcactgtttttattttttagtgggaagatatgtttttactctttttaatcagtagggtttggattttggagatggctgtcatattcaggtcagaggcagttgacttggtgctgatgcttgtttcagcttgtttctttccattttcctccagagtaaagaaaagattgaaaaactaaaactccaagctgaatccttctgccagcgtttggggaaataccggatgccctttgcctgggcacccataagcttatcaagcttcttcaatgtctccacccttgagagggaggtaactgatgtggactctgtggttggtaagattttcacctgcagtgggaaagggagggctccccagtgtgcgctgcccaggtccacagcttactagcggggactgggggcacagtgaggtgtgggaagtggggaggcagaaggagataaatagaatgaaacactgttatgactggattacgtagatttggacggtgatctccaaaagaaattatcacgaacattggtgaagattaagtatactcttatagtaagattttctagatggtatgacactttaaaaagctgatttttgctagccacccgctctcaaaagtaaaactttaacaagaaaatgtagtaaccatctgtagtgtgttaagcagagacaccatggtcgactcctaaacctaaaaaaaaaagcctctgttacaaaggcttcaaaaagcaaaactcaacaggaacagggcgtggtggctcacgcttgtaatcccaccactttgggaggccgaggtaggcggatcgcttgaagccaggagttcgagaccagcctggccaacatggtaaaaccctgtctctactaaaaatacaaaaaatttgctgggtgtggtggtacacgtctgtaatctcagctactcgggaggcagaggcaggagaatcgcttgaaccagggaggcgaggttacagtgagccgagatcaggcctctgcactccagcctgggcaacagagcatgactttgtctcaaaaaaaaagaaaaaagagaaaaactcaagtttcccagcaaaatttccagttcgttaaagtttactttgccaagtgcaatgaaaaaatgggcatccaaagaatatttactgttttagtttatttagcatatttctttttcgtcatctcacccgtgatctgaatcattcattcctacactgcttggtgtagaaattttcaaaagggttgcaaattttcaagtagacctgcccatatcacctgtggtggggtttctctttccctaaatgcttttgtatccaccaaatatagaagtccatgttcacatcttttcatgcattccttaagctaaggcttaagccacttctgaaatactaccttgagcagggaagtggaggaaagggcattttgtgattgctgctgctattttggagttactggtacataatcaccagtcagaactcctgggttatttctggttcgtcaataacaaacctcactttaccacatcctgatcttcctgccacagctttctttaatgccgtctatgtagacccaagtaacttattgataagagttatgtatagagcttagagggcacacaagctaggtaattcaggatagggcatgctgaggcctcaatcatctctaggtcaaggataacctgacaacagagactgattcttaaggagcaaccagaagatgcaaagatgtcatgtattatactgaggcagaatggcaagtttaggtgggtagaggtagcaagaaattctaattcaacatcatggtaagaattaaggataagaagatactcaaagacgggttggaactgctctagttctaagcaatttgattatttacaagagaacccatgagtttttgcaatataaaagcaacaagatctccacccaaatcccaaaaggggataagaaacaactgggcaaactatcagggtcccagcccaagtctgagtgtgatttggggttctaattcccattgggcagatcacccaaggcagaaactcagtcttgctgcctggtccacataatgagagcagaggaatgctgggattcagagtgtacacaggctgaccccagcatgtttgggtcacaatcacaaatgccttcaggggcatttgagtacatgcctctcccagtggaatgcaaatatagaaataaaagaaaagcaaacactgtgctgactaaataaagcttatcaggagaccctgttctggctatagctctggactcttgccgggtggcatttgggctaccctaatttccatgtgggaggggcccatggctgctcctggcctctctcctctggtcggaggaggattaaggacaccaacaggaggactaagaaaggtaggggccaatggaaggacattttcattcaaaacaaggatggccatattcagtgttcctgatcagtgactttaatcatacatattgtgaagttaataactgctgtgtgtttgaacagaaaggcatactttggagtgacaattgtttttcttaaagggagaagctcagtgggtgaacggaggacattggcccaatctagaaggctttctgaaagagccctctccttggaggaaaatggggttggatccaacttcaaaacctccactctgagcgttagcagctttttcaagcaggtatctcttcacattacagtgtgtctggatttttccccatactggcatgggcactggaacccacaggaggaggatacgtagtgattaagagagcaaattagttaagctcactctcttagttcattttctgctgcttataatagagtatctgaaactgggtaatttaaaaagaaaagggatttgtttctttcagttttgaaggctgaaaaatccaaagttgagggcccacccttggtgagggctttcttgctggcggggcctctctgtagagtcctgaggtggagcacggtgagcagctgagcatgctagctcaggtctctcttcctgttcttataaagccaccagttcccctcccatgatgcagattaatccattaatctgtgaatggattaatccagtcatgagggcagagtcctcatgattcaatcacgtcttaaaggctccacttcccaacactgccaccatggggaccaagcttcaccatgagttttgaaggggacattcaaaccacagcattcacaaagcctcaatttcattagccagaaaacgggaacaatagtacttaacttcatgtggctagcaggaaggtcaggtgacatgagacctgtcaagctcttcttagagtgcctggaatacagtaagtgctcaatgaatgttagctattttaactgagagaagggttaggttttgttccttgtgataccaactatcctatttgaactatcttggccaatccattcattatgctatgacaacagtctggctgggccatctccttcccggtggatctcagggtttcttggcctggctattcatgtgcaagtttccactttcactactgcttgatgtgcaagtttccagggctccctgcttgctcagagagggtgaccattccagatggtactctttgttagctcagtaaacatcaagactatttaaaaaaataaaaaacttcctagacttgtcaacggtatagagacagaaagtagaatgacggttgccagggtctagggatagaggggtggggagtcactggttaaagggtacagagtttcagattttttttgcaagacaaaagcattctggaggttggttgcacaacaaagagaatgtgcttaacactactgaattgtgcacttagaaacaggtaagatgggccgggcgcagtggctcatgcctgtaatcccagcactgggaggccgaggcaggtggattatgtgaggtcaggagttcaagaccagcctggccaacatggtgaacccccgtctctactaaaaatacaaaagttagccgggtgtggtggtgcacacctgtaatcccagctacttgggaggctgaggctggagaattgtttgaacctgggaggtggaggttgcagtgagccgagattgccccactgcactccagcctgggtgacagagtgaggctccatctcagaaaagaaaaaaaaaaagaggtaatatggtaattttatgttagttatattttgccacacttaaaataaactcgcttggtctgactctgttttggaaagttttccatagctacgcagtcttcgtggagcatttaaaggggttacattaacaaactgaaatgcaaaagggatgctgagggcgcctgtgcaccgtgccacatcatagaaatagtaaaggtctgaaaaggtttctattcagcatacatgtacccttcccaatcttatgaccttggaggacaaggtacttaactaagtctggatggtctcactgggaataagacatatctacccacttaccttactgggttgttgtaaggattggagatcatgcatgtgtgctcctgacccatcttgggcatatgtgggggtggacagcatttatacttaaccttgttcgagacaaatgtgaagaaaatgagatggaaagatgctttctccaccttcgaacatttgaagaagaaagtaaacttattctgtattgttccggggggtaatactggcatcagagggtgagagttatcggggggaagcttttggcctggttttctaatggtcagacgggcttccttagaatgcagcagatgccccatccccagaaggactgataagaggccgaggcacagtgagtcacagtgattgagaaggatttaacaagaagtggagctcagtgatttcagagctgtctataatcctaatttctatgaaagacttgtgagaataaaacttaaaggtaaaaatcttcccagaaatcgtttgtccccaacccaagagtcaaaggtgcatctacattaactctgacttttctcttggcaggaaggagatcgccttagcgatgaagacttattcaagtttttagctgactacaaaagatcatcatccttacagagacgagtcaagtcaattccaggtgtgaatgacttatctttatcctctttagctgtgccaaaactgcttatcgttagacacagtctttgtctaatgccagaatttataaaatcatgtttgccaagtgaaatgtgagattttgtgttaggggttaagaatctgaattgttctatgtctttggcaaacctattaatgtttttttaattttcttaaaggattgatttagtaaacaaaccttgtgctttagatctggtttctcagataatgagataattgtttaaacagaggagcccctttaatcaaataaaatattatacttagtattaaaaaagtaaatgtgagatgctttggtagaaggcaaaggcatcttccttatcctcactcggcagccctggaggtacttctgtagcatcctcaggtccagggaagccagtttgtgtttgtttttgtttttttgagatggagtcttgctctgtcaccaggctggagtgcagtggcacaatctcagctcactgcaacctctgccttccaggttcaagtgattctcctgcctcaacctcccgagtagctgggactacaggtgcctgccaccacgcccagcttattttttgtatttttagtagagacagggtttcaccatgttggccaggattgtctcgatctcttgacctcgtgatccacctgcctcggcctcccagagtgctgagatgacaggcgtgagccaccacatccggctggaagccaattttaaaactcccaatttttactgctagcaatgcagggaagttacttaacaatgtaaaattatactgtggtaattcaggaaagaactttaaaaatcctctaatccattccttctcattttacaatttcttgctttatattttattttatagaggctaaatctcgaaagttatcatgacacacttttctcaagctgtaggaaattagctccaaaacttttttacagtactatagtttgttcttattttcatgaaagaaacacagtgcaacaatctttcttgattccctcataacatgacagtttctttactagaacattcctattttctctctttaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacaggtaagaaacacaggctcgggctgggcgtggtggcttacaccataatcccataactttgggaggccgaggcaggaggattgcttgagctcaggagtttgagaccagccttggcaacatggcaaaaccgtgtctctacaacatatacaaaatttagctgggcatggtggtgcatgcttgtaatcccagcaacttggcaggctgaggcaggagaatcgcttgaacccaggaggcagaggttgcagtgagccaagattgcactactgcactccagcctgggagacagaaccagactctgtctcaaaaaaaaaagaaaaaaagaaaagcaggttcttggaaaaccgttgagctcacattctgagttttatttgaataacgttttctcatccttcaacctgtcttcctacttcctaagtttcagggaaatgaaatgtgatatttatgtaaccgtaggtgattgccaaatctctttctaaacatagtttacctaattctctttaacaagaaagggttacttcagatgtaattgtagtttaggattatagtggacatatgttttccagagattaaaaaaaaaatctgctagccattacctttgttctcctctgtgcagagggacatattagaaaaagagcaatgtgaccaaaatgtgctagttgtcaaaaggacaggttttcagctaaagattagctctttccaacagaatttacagcaataacataataatagcacacattccaatagcatttacagcaataacagaaagttctgtatgtgtgccagcagtacaatagccactaatcacatgtagctgttcagcatttgaaatgtggccagtgcaatggaggaactgaaaaattgattttaattaattttaatttaaagtcaagtaactgtatgtgtctactatattggagagtatggagctagacactgaaggcctaacaggttgggctgccttggtttctgaatcgcttatggtggcacctgacctattccatggggtctggaaggagtgcttgtcaacacatatctgccaaaggcattaatgctcatgcacttctttattttgagactatttcctttaatgcagaaaaggatgccttctataaaaatcatctcttccccaccatccagaaatgacattgttgttttctgtgtttttatataaaagaaatacagtggtactgattcagttgaagtcttcttttatccccagtctccagtcacagacttttacctcacctcctagacttttatcatcatgaaattatgtatttcctattttttctccttttacacacacttacacacacatctgtgaacgctcaatggcattatcttcatattcatttaaaatgtacgcaaatgacttcacactctaggtcaggggtccccaacccccgggccatagaccattactggtccttggcctgttaggaaccaggctgcatggcaggaggtgagcatcgggtgagtgaagcttcatttacagccactccccattgctggcattaccacctgagctcctcctcctgtcagatcagcagtgacattagattctcatgggagcatgaatcctattgtgaactgcatatatgaggcatctaggttgtgcgctccttatgagaatctaatgcctgatattctgtcgctgtctgccatcactttcagatgggaccctctaattgcaggaaaacaagctcagggctcctactgattctatattattgtgagttatataattatttcattatatattgcaatgtaataataatagaaataaagtgcacgataaatggaatgtgcttgagtcatcccaaaaccatcccctgccccccgctgccaccccagtccatggaaaaattgtcttccatgaaaccagtccctggtgccaaaaaggttgaggattgctgctctaggtgttatattacactttgtttttgtcactcaaaagattgatttgtttttcttttttctttttttttttttttttgtttgagtattactatggagtcgtgagtcatttttctttctacttacccagatttccacaagttttaccaatgggaactttttaatggcttgcatttttggaaatatcagtattgattcatgtaaaggtttgtgggtttttttggggtttttttcgtttttttgtttttttttgagatggagtctcactctgtcacccaggctggagtgcagtgacatgatctcggttcactgcaacctccgcctcacaggttcaaacgattctcctgactcagctgcccgagtagctgggactacaggtgcctgccaccacacccagttaatttttgtatttttggtagagacagggtttcaccatcttggccaggctggtcttgaactcctgacctcgtgatccacctgcctcggcctcccaaagtgctgggattacaggtgtgagccaccatgcccatcctgttattccttttaactgctgtttagtattcctttgtgaagaggccatattttattcatttccttgttgatacgcatttaagtctttttcaagttttcagctcttacaaacactatgaagtaagattttttgtctttgcccctctgtacacgtttgtgaaagtttctttaatatatctaaaagtgaaattaccagatcacaagtaatacacatttcagtcttaagttttctaaaattttacatttgcagtcctaacagcagtgtgagagaattcccattttccagttcctcacccatactttccagtatgacgtatgtgggactaaaatgcaaagaacttcagagctcacctgatccaagcattcccacccccacatttccagatgcacaaaattaagacccggaaaggataagtgaatggttccttgaggtcaaaaattacagcgaggtggccagacacagtggctcacactgtaaccccgctgctttgggaggctggaggactgcttgagtctaggagtttaagatcagcccgggcaacatagtgagacccccatctctacaaaacattttaaaaattgcccaggtgtggtattgtgcatccctgtagttctagctacccagaaggctgaggcagaggattcttgagcccagaaattcgaggttagccttgtgccactgctctccaaatcaagcaacagagtgagaccctatctctaaaaaaaaaaaaataatttagaaaataaaattatactgagaaatacaaacagctattcacacaggaatggagagttcttctttacagtattcaggaggtatacacttatttccccatttaatccttcctggagcagctcttcattttcaatcctcattccttacatctaaacttagtccccacgtctccctcctagaggagataagcattctcaggatgcagtagtttcgattctctattccttagaggaagatgaaggcatgaaaatgtttgcttatggatgctttgtatctttttagaaactttatcctataatcgggaaacaatgcttgtggcattggaagagacttgcatccaatgaattctgtagttattcaacttcccctcagcatttaatcacccacaggtggcatttacaatgttctctactcgttcctgcaaacattatcccttaattacatcacagtgggacttagagtgcattagtgcactgaatgatccagaaatgtaggagggcaaaggaggacaagtctggacggattacaatggacccaacttgtcatcatgagaaacagacccacaaatacagagttaatcttcttgagctgtactggccactgtagaagtgccaaggacaccccgttagaaatgccaaggccaccctgttagaaaccaggtcttggggaatgacagaagagatttctctccagtttggttgtggccccttctcttggctcacagttcttctctgtggctctcaggccaccatattttatagtctatttaaggaaagagagagataatgaacttggtttggaatcttacttcatgaaaatttcacagaatttaggaagcatcttgtctaaatatcttgttctaaatttttagtgttcttctccagtccttgtgtgctttagggtggttttgattagattgggcttgacagttacccagtcccagatgagtgtcccctttcctgcacctccccccattcacgacatggaaatggaaagaatcgagtgaggtctgaaccccaggtaaaattggcaagctgactaagttcgccttgggtgacctcaccttttcatttctgtccattttcctctctttttgttccttgccatctccccatatctcaaaaaacctggaccttgtagcttttctatactggcccccaaaataaaagtctcttttcaagcaacgatctctaaactcatttgctatggtattgataacaggtatggattagtcttatcactcccaagagtattatcattttgggccaggtgtggtggctcacacctataatcctagcgctttcggaggccaaggcaggtgaatcacctgagtgaggtcaagagttcgagaccagcctggccaacacggtgaccccttgtctctactaaaaatacaaaaagtaactgggcgtggtggtgggtgcctgtaatcccagctactcaggaggctgaggcgggagaatcgcttgaacccaggaggcagaggttgcagtgagctgagatcctgccattgcactccagcctgggcaacagagcaaaaaaactctgtctcaaaaaaaaggtattatcttggcagggacagcagttcctatttcttaattgaagaaatccagatttcttctcattccaagagtctgtcaggtaactttcactgttgatgttgctatttccatgccaatcaataatcctgatcatacctgtatcccttaaggaaatcaaataactgaaaatgaagatctgtggggcagataaattcaggaatatttcttcgtttatagaggattcacctcatgaatttgaaatatggcttggcttataaaaagttgatctgcctggagcttgtagctaacacctctgtcgggccaaacaataaatgcttacactgagaaagccaggtttgggatttcaaattaatgtgcccttaacataaactgcagagcccccctgggtggagggaactattacctggttctaatagcagatgttttctggccttgagtgccagtggtaaccagagtcacacattttaggattttggtattgatgagggtttcagctgaatattacttgagttgaactccagttatctttacctgtcttaaaggagcagctgccatagtgcctcaggtaaagttggcttgggataggctggcattgccttccagtccccagcctcaccttcctcccacctcttcactgcctcttttctttgccctgccccttcaggtgtcctgcgtggggcaccattcgagttgcattctagtgtattaggttggtgcaaaagtaattgcggtaatgtgtgtgtgctgccccgtgtctctaccttattcaagtttctttaaggaacagctgtagatgagttctggtagaactgggtagtgctcccagaagtatccccgtgggtccgtgagggttgggcattcataaaataaatccttgctctaacgatagagaccaacttctagagccagaagtgctcatcccaggaatgaccaggggctcccaaaccagcggctcgggccctctgcagtgccatgtgcagcctctgtgggttagaggcatggagctagagcagggtcctctgaaccagagccaggcaggacactctgagaaatcacaagcagaaggacagcaattctgaaagcagagcagaacagctggaaaaactgagctgatgaaaaggattatccgaatccaagcttggcgttccttgctctgtgtccagattaagaaaatgctagtggtttgcctaggaacacatttgcaccaactcctggcttattttccatgtgacccaacagctggtactagagacaccagctgctttctggtgggggcagaatgaaaacagcatgggctgaggccaaggcccagcaaggtcttcaagggcatcctatcctgcggccgccagaggggtatgtgcggagatcacaggcaatgaggttgtaatgagctgttaagctccctgccgtccctttaatgggtgattacagtaaaaagagccacataaagtacgttttcatctctcacttcagcccccgagagcctctgaggtcttgtttatccaattatcagacttgctgtggaggacggtgcttgctgagaacaagcatatcagttggaacatgatttctctgatggataattagctgttttcaggactcctcctattcagctgaatgttctcagaccagaagtctgatctggcctaacggggatgtgctcccatatcgcagtggagtcttaaggagtactacccaccttctcttctgcgggggaaaaggaatggcgtagcatgcatgcaggacctgaccggaaggaatgtctgcgagttatgatttagtgactagaacttctaaggaaagaaatgaaccagaaataactgcaaacgaagtggttaggaagaggggcaggacatggggagtatccttgaaagggacttaatttcatccaaggaaataggttcccagtttaagcccagttagctctgtattcagagtggatcttctcagtgctaggtgaaggaagggtggttgtgcatcagagtaagtgtccagccccaccctgaagactcccattcaggtggtctgggatggggcactggtggtctgacactctcttttgttcaaaatcaaagcgtccccctccttctcatggaagggaagcttccaccaacccttaatgagttcctgtaccatatggagttgtcaaatgctccataccgggcacagcggctcacacctgcaatcccagcactttgggaggccgaggcgggaggatccattgagcccaggagttcaagaccagcctaggcaacatagcaagaccctgtctctacaacaacaacaaaaaaattagccaggggtgggggtccacacctgcagtcccagttacttgtgaggctgaggtgggaggatcgcttgagccaggaaggtcgaggctacagtgagccgtgatcatgccactgccctccagcctgggcaacagagtgagactctttcaaaaaacaaaaacaaaaaactctgtcctaagtatcagatgatgcggaagcccagtacttggttttactaggcttagcaagcagtcgcttatggaacagaagcttttataaacaaaccatgtagttaggaagggcagtggcagcccaggcaaaatctagtcatttgaattagccaaggaacggagacaaagacaaagtgaatttctggtgctagttgcaacttggtctcgataataaatcaggaacacaatccccacattcctaatgccttgctccaaaactcagcaatcctcctatttgtaagaatgaaaaaattcaggagggaaccaattgcctaaggttatgacagcaaagctaccgttccagtataatattcagccactagaggacacaattcactcactttctagattcagacacacgactacctttttcgttacaaaacatatgaagtcgtgatttatgaaagtaggacacatattgtattttttgcccttgaagtgcaagaccaggaaaaactgaaaagtattgcagcatcctccgagatcactgttgtcattttttcgcaaaggattttattctagcctgtcagtttctgcctcctttcattagtaagtcctgaccttagacatctggcatttttttggaaggtgtagtggggagggggaccaagagatgcatcccttaatgtagctaaagatcgaaatcttctcattttggggagagttgcttactatacatatttacacattcaccaattttgtctcatatgtaaaccacagaatgtgccgaattttcctagaatcatggttgaggcaggtaggagtaaggaggtgctgtgtacattagtgtcactgattccaccgttcacaactccataccactctccttattttatactcttgagtccacagtgctttggtgttacagcccatatagaacggtcctacctaaaagtcctgcggtcggtttaacagtgacgagtgtcatttttccactgtcctttacatagaattcagcaggaagcttcatgaggcaccctgtttctacatgagttgccctggttggtggaggcagaagcaatggagaagtggtgatgaaattaagtcaaagttaggcttgcatttgactctgatcttgaatagtttgtctagattagagggagcacctaaaatccaaaaagccttttgtctttgatttctatacttttgttagttttacaaattattatttaaaatcagtcctttgaagtggcttcttctcttctgacgggacagctttgggaaactgtttagtcttatttcttttgctattgggaagttgtgggggacgctattttgcagctttttcatcctcagttctgacctcctcatgtgctttacagatgcccccaaaggtcagcattcatccacctttcactgagagtgtttggccatctctaaagcagaggtattttaacagctctccttaatggatgtcctgtggtttcaggcctcagacaggctgcccttgggccctcagcagaagtcgggaatcgtcttatacttccagatcgtcttttactcaggcaaaatatgagatgctgtgtcagggtttcccaagggaagaaactgagtgggaggtgcaggtaaaccccacagtacaaaataaaacagagctgtgagtagttgaaaggactgtgttttgacagcgtaataaggtaattgtttaaaaccatggctaattcatcagatgtcatgtgtcttttatagttaaaagatgaaatttctttacccactggtgtcaacaacagaaagattctaaaactttcaaaaaatgtgccagtcctggctgctttgtttcatgttctttgacaactttcaaaatgtaaattgagattcatgcaactattaatggaaatataaatatcatggcttcataaggataaaattagaggagctcaacataacggctcattttaatgatttctaaggggtttccatgcccaggctaataactgtacatttagcaataagcaaatctcaaagcctatttcttatctttccctagaattacagcttttaagcccaagctggtcgttccttttataccactccactcacttgataggggtgacatgggctgagctttctctcctatcagggctcaaagacaagtttagcagcgtttctaaacttctgtcaatcagctcacaggacacagaccagtttcgttatcccattaacagatttacatttctgttctctggaagtgtcagttaatgtccttaaaggtaatatacacaaatgtacacaatagtctctgaatttttctcagaagacacactcagaaaccttagaattctgattcattctctttggctcagacttggatgaatttgcttctcagagtagggacatgaaaattattcttaatttatacttcatgtaatctgtttcttctttctccctccgccgccctccaatagctcttctgagcttgtttgttcttcccctaactcccattgttgaaaacatggcctcccctcattctcacctttccaggaatctccttgtgctcctcaagttcggctcatcgcaaacttggagttctgttttctcatgcccttctttcattttcttcttttaagagacaggatcttgctctgtctccaagattggagtgcagtggtacgattctagctcactgcagcctcaaactgctgggcttaagtgatcctcccaactcagcctcccaagaagctaggaccactgctgtgtgtcaccacaccagctaattattttatcttttctagagacaaggtctcactctgttgcccaggctggtcttgaactcctagcctcaagcaatcttcctacctcagcttcccaaagcactgggaggtgccactcttcttgtgttttttacctttgcatttatttcctggttacaatacttttaacttaatggctgctgaactagattctgccaatgtacgtgccgtccaggacacgttcatgccactttaattttcttagaacatcaatgagatagtcttactagggagagataaagggcaggggtttggttttctggcaggttttctttcattttaataacgagccaacccacggaggaaggaattgattgatggctgcttcctcttttgtaaagaacaaacatcaaattagtggtttgtcctcactttgcggataagcagaataataacacctgtgcctctccctgcattattttgaaactaatataattttgtttggacagaacgtagatagcaaccttaatggggaggaatgtggaagaggaattactgaagggggaccagtcagcctgtcaggcagcaactctggtgccaaagaatggacataggatcagagctgtggacccccgtcctgtttgtaaacttcctgagggtggcagagattcataccctttctcccatcaggacaaaaatcagtgtgttggagctcactcaggaaatgctctttgggattggcatgggaaggggatgaggccgattgacaattagcctagttcactgggattttgttgtaggagctgggtggtggcaccatatggccaacaggggatgccagcgacatccctaatttctctggcttcctgataggtcctggtagggtcggggttccaccgggatttgcctagtatggtctacctctgactgaaattaaactctaagtaggtaactggggaacgcctttctccagagagaaggttttgatgtgatctcatcatcggggactggattggacctggagaaatcagtttttctatagtcttgtttctagagtggcaccctggtcttgggcaggtcagaaggacagatagttggtcaccatcttcaacacaaatcatggctggaaaagggccccagtagggagtgcctttctcactcaccaatcaccaaggctagaagatagtctgcagattctttcagatgccacaaagctgtgattacagctgcccattggcaaatcaggtactagtttttgttaatcacattgcagtcttccttcactgtttcttcccctggtcccggaattaaggctgggctccatttgacaagttatcttctgtgcaggtagagcagcaggctgtgttagctcacagcatctactcagtaggcatggaaatatccactgaatgggactgagaaagtggaatgggaggggaacgtgtgaagaacaggaagtttgcctctttatgtccaaagtctgtctacttagagcaacaggatggtgatgatgctttctggttaaagatgtcatggcaacagtcttccctagacagctctctagcaatagccagtggcatgtaaaccctgcatttttgcactgtatccagtgtttgcaactcccttgtagaactttccctgaagtcagcaagaaccctgtgagaatcaggatttgtctagaaatttagcatttacctaatcaatgattctctagacatgtcagtacctccaagtgattcatatgcatgtttggtgggcgtcgagcatgtggcagtttggagaaggaagtggagaatgcagcagcagcaggagaaatgtttgatgttgctaaacatcaaccccacagcaagcctagaactcggggaatgggaggcatggtgcgggtagctgctgacacacagctctagagatagctgcctgcaaagctggatgggactccaggcaataggcttcagggcctaactgctctttcaaggtcactgattgttacaggagccatggtctgcagcattgagcatggaattattattactattaagcatgatcctcaccgtgatgctcttggggtggaacaaaagagcccagagagaatatgcttattttatgcaacctctaacgtttcctcccagagttgtgatgaaactgaaccaaactctagcatgagaatcggcatcccaggccagcagccaaaacaagtggtgacacttggccaggcacggtggctcatgcctgtaatccctgcactttgggaggccgaggcgggtggatcacaaggtcaggagtttgaaaccagcctggccaacatagtgaaaccccatctctactaaaaatacaaaaaattagctgggcgtggtggcgggcacctgtaatcccagctacttgggaggctggggcaggagaatcgcttgaacttggaggtggaggttgcagtgagccaagatcgcgccactgcactccagtccagtgacagtgtgagactctgtctcaaaaaaaaagtgccgatactttatatatcttctgaaagaaatgaagtctgtaagaaggactgttaaccctcagaatggtctggggatgctacatccccttgtggacttgtcacactggtatgagtgtagggagtgggaacacttcttctcagctccttcctcaccatgtgtcattcagggacaaagggagcaggatatcttccctttgaaaaatctcatatgcctggcaatactcgtcaccctgtgaataatgttgatgcattcacctaaccagtattataagcccctgctgtgtgtcagacactatgcttggtgctgaaatagacaaggaggggactgcctgtcttggaaggcaaatcccagtctcctaagagacactagaaccacaggcaaccatgctgatctatgcaatgacatgtaatgcaactttgtcctgcaaccaccttgagatctttgaaagttctcctacctccaaaactcagacaagtcctctctcttgccaagtgcctaaagcaaggatatgtttatagaggcagctgggggcatctggccaatttatttcccagcagacctgctgcttcccctgattccaatactttcttccccaacccaaaccaaggcgtctggcaatgttaaaaacatcaagaatgataaaacaagcattttaatgaagattattgatgtattcattggctgtttctttaaatgggtagagaactaataaaggatctaccccaaataaccaaaaatatcagcctcagcaccagcagaaattggaagcgttctggtatttatatgtgtttttctcagctggcagatttgttttaggaaactatttgcaaagcctgggaaaaatgtgctttctctgtctgttaaaggaacatgcaggttggttggtgctggttctccatctgacagttctgtctggtggcctcaaaaaaaaagaaaaatacagcatagtccagatttggactatgcaaatggtgtcttgaaacttaacttttaggtcttgagcaaagccaagtattattgaaatgtttattttgtttttatctgcaggaggttttcattcaaaatgtggtgctttgggggaaaaggaagggtgtttgtactaggtactttttagcattcttcttattatctgacctatcacagcctcttcaggagacattaattaatttagttcatataatcaacactggaaccaaggaaaaattatttatacttttagaaattctcatgttcttatacttctttggagattgaattgactccaaagagactattttgtgattaagaatatttttgtggccgggcacggtggctcacgcctgtaatcccagcactttgggaggccaaggcaggtggatcacctgaggccaggagttcaagactagtctggacaacttggcaaaaccctgtctttactaaaaatactaaacttagccagccgtggtgacgggcgcctgtagtcccagctactcgggaggctgaggcaggagaatcacttgaacccgagaggtggaggttgcagtgggccgagatcacagcattccactccagcctgggaagaatatttttgtgtggggagtcgttatattatgtccttagaccaggaggtccaattgaggcagaaatttttgaagtaaaaccattttttttgaaggaaacacatatttaaatatcaaagaacactggacgtatacttttaaaaatttacatacttgtgttagttatctattgctgtataacaaaacctttgcagctcaaaacaacagtcattatctcacaagtttatgtaggttacgcaggtgcagctgacctgcttggtctgagctttcgaaaagtgcagtgaggatgtcagcctaggctgccgtcacctcaagggtcccctgggggtggatccacttccaagctcactcatgtggctgttggcaggatgcagttgctcacgggttgttaggctgagggcgtcggttcctcactaagccagaggcttccttaagttccttaacatgttttctcatggggggcagctcacagtgtagcaattggcttcgtcaaaacaagcaagcgggagggtaagagacagaaagcaagacagaggccagggtctttcacagcctaatctcaagagcagtacctcatcacttttgtcctattttgacaaacgtcgtattgacttttgtcactacatcagaagcgagtcactaggtctagcccacactcaaagggagaggatttcacagagcaagaatatcaggaagcagaatcattggttatttcattagaagctgctggcacagttcttaatgaagctacaaaacattgaactgggaggaatatgggggtaggagggtgacagggagggcaggttaattttgtggatgctgaggacaacgtgcctcatgaaaagtgttcccatcagactggtgtatttctgtttcttttcttttttttttttttttttttttttttttttgagacagagtctcgctctgtcaccaggctggagtgcagtggcacaatctcagctcactgcaacctccgccttcctggtacaagcgattcccctgccttagcctcctgaatagctgggattacaggcatgtgccaccacgcccagcttattttttgtattttagtagagactgggtttcaccttgttggccaggatggtctcagtctcctgaccctgtgatctacccaccttggcctcccaaagtgctgggattacaggcatgagccaccgtgcccagcccagaatggtgtatttctaggacatctgcaatgcatcactctctaataaaagaaaaaaaaatagccactccttgacagatactcaaaggtgtggagtcccttactaaaccacactccaaagaaataagcctgcaaaatagggaaaagttgttttttacctagaaagcagattctctgcattttcttattttcaaatagtggggagaaaccctaagctgtacatatgaaggaatggattcatttctcctcttgcacagcaccccagcaccttgtacaccctattcctccctaactcccaaccgcacactcacctcccaagcatctgcagatctacatacatattatcaaatgtacagagtactgagtgaaatggtcactgtagctatggaaaggtgagatttgcaggctgtctgaaatgtttcttgctaaagtagttccaatccttcccccatttagaaaaaaatacattcttagtaaatgactttcaggcagaaaaagaaaaccacactggaaataggattctaataaaccaacatggggctctagctggtgaacatatttctgagccatccctatacagaaaccacaagacaaataagaaaaagtaaatccagatcacttagacccttcaaaccacatcctgggttccaaggacagtggctgcgagttaggaaagatacatttatccagtggaccttttgactgtcttgtcaatcttaagaaaaaaatgtagagtaaaaaattttggctgggcgtggtggctcacgcctgtaatcccagcactttgggagaccgaggcgggcggatcacgaggtcaggagattgagaccatcctggctaacacagtgaaaccccgtctctactaaaaatacaaaaaaaactagccaggcgtggtagcaggcgcctgtaatcccagctactccggaggctgaggcaggagaatagcgtgaacccaggaggcagagcttgcagcgaggcgagattgcaccactgcactccagcctgggctacagagcgagactctgtctcaaaaaaaaaaaaaaaagaaaaaatttggtttgggtcccttcccaccttcccttgcttcatcactttccttaagcctctaagcatccagatcttccccaaagcagtgcttcctagtcagtgattaccctatcctctttttattccttttcttcatgcacaccttcagtccataaatccaagctttttgtaaggagggagggtgagtaaaccaattcatactaaggtgagagtgaattatatataaacctcttaatatattaaatctaccaagcagtgtttcagaaggaaatctgctaacatgggcatcttacttgaaaaaaatttcagttggttcaacaaagtatggtttagaaatcattttcaatcaggatcggggagagaatttttttttttcttaaagcagttaggtttccccagcagatttcgaatgcttggatatttgtgattcttttctatgggaatctgatctggataagacctaagaccataaacactctagctttccctttgggtctttgctattgaaaactagttggacttaaacaagtgaagtgggttttaaggatggctcctttcacccatttctaaaagatagcattcttgagggtctgctttatttagcagaaggaatgctggttttccaatctctcactcaaaaggaacttttacttatctcatagaaaagaatgggatggagattaatgtaatagaaaaggtattctacaaatatcatagcagctatatttaatcaattcatgttcaaagatcaattagtagtaataagagttgtgctgtataaaatcaccatatctcatattcaaattgcagatcatcagttgaaaaagcatggattgttttctcactgaaagaaatctttaaaagtggtaccataagagacattaagactggctattgttttatttctctctctctctctttctctttctctctttctgtcatttgatttctgactttcagtggatttttttaacattacaaaatcatagagaaagaatattggaccatttattgtagagtttttaaacaatttgataccattttttttttctggcgtcttaactgcatttgctgtttgtgaggggtgtagaggtccctgatgttcagagtacagtaccagcgtttatgtgaaatattgcagcctggcctgtggaggacaggggttactaaggggcaagctgctgcttgcgataacacccccagtgcctccttctaatcttgcgccatttcccagggcagacagccttgtggggctctgactggtgccctggaacatgttttaccttccatttttcttgctctgatttctgaagacagaatgttctcttcaacctacacatcaggagttttccttctgttttcctttttcactggttcctttgtgaatttgcacttttatctaacctaaaacattggaaacaggaataaacacaaataatggcatgaggccgtggccacagaatgacaagacaggacacagcaaatgttttgggtttttttcacatttatgaaccttctcattctatttatttatttatttacttacttatttcttgagacagggtctcattctgtcacccaggctggagtgcagtggcatgatcatagctcactgcagccttgaactcctggactcaagtgatcttccagcctcagccttctgagtagctgggattacaggcatacaccaccatgcctggctaataaaaaaaaaattctgttgtacagatggggtctcactatgttccccaggctaggctagtctcgaactcctggcctcaaacagtcctcctgccttgacctcccaaagtgctgggattataggcctgagccactgtgctcaactgcttcccattctaaaaagtgtctaaggcagttatagaggttatataacaaggtataaaatttctgagtgaaaggaaaataaggagagagaaataaatctaagtgtgtgtaaggttaatatgtacacagaatgtttattaaggcctttgacagttcctttaaaaattacctgcaggccaggtgcggtggctcatgcctgtaatcccaacagtttgggaggccgaggtgggcggatcacttgaggtcaggagttcaagacaaacctggccaacatggtgaaaccctgtctctactaaaaatacaaaaattagccaggtgtggtggcatgtgcctgtagtcccagctacttgggaggctgaggcaggagaatcgcttgagcccagaaagtggaggttgcagtgaactgagatcacgccattgcactccagcctgggtgacagagggagactccatctcaaagagaaacaaacaacaacaacaacaaaacctgcaaatttgagctgcctagcagccaagcaataaagggaatcacaatgaacgataagattcatatatctgccaatttaaaaacaaaccagttctcttgggtcagtgcttctcaaacttgaatgtacatttgagacacctggtgcattgttaaaatgtaggttctcatctagcaggtccatggtgcatttctaactggctcccaggcaatgctatgctgatgctgatgctgacgctgacgttgatgctgctactcattggactgccctttgagtagtaaaattttagctcactcagaaaaacctcatagtttatttggagtaacatccctttagcccttgtagatattataagactacattacaataaagttctggtgagtctaattgttgaccagagagattgtttacttcagagcacctggatttgaattgcagtgtgccacctgctgctgtgttacctggtacaagttaatgcattctcttcacacctcagttttatcatcttctgaatgaggctaatagtagtacctgtcatagatgcttgtaacagtgcctgcatagagtaagaatgaaataatgttagctattttttattgttacatttaaaatagattttgctggtagtgaaatatgaatgataaaatcatctcctcagctgttttccttgcataagtaccttaaaataatgtatttgcaatttccttctgaatccttgaataaaagacaccagataatcagaagatgttactgacattagtaggcatttgaagttcactctgatgggatcagtctatttacaacaaattgctatagagagtaaaaagcgccaaccttttcctgtagtttttgaatgacagcatctttgttcatgcagttggctttgctgcatttccacttcatcaattttttggctctgtctttgcaaaaaaaaaaaaaaaaaaaaattacagagggagaattttaaaacacaaatgaagaaaaagaaattactttgaaattgccaaaattgtttggctgaaagagcttatttagaaaaacagagctttttatgtataaacctgtttcattggtgttgtatcagaattgcatgttgctagtagtttactatcaaaacaacacttgtgtttcaagctgttaaaaaatgaataaaataggccaagtatggtggctcacacctgtaatcccaacattttgggaggccgaggcgggcggatcacttgaggtcaggagttcgacaccagcctggccaacatggtgaaaccccatctctactaaaaatacaaaaattagccgggcctggtagcatgctcctgtagtcccagctactcaggaggccgaggcaggagaattgcttgatcttgggcagtggaggttgcagttagctgagatcatgccactgcactccagcctgggcaacagagcaagactccatctcaaaatttaaaaaaaaaaaaaaagaataaaatagaaacactgatttttctggtattttatacccttccccgaatatccatacccaaggcatttttaagatttccctaagctggaagcaccagaccacatgttatttaaaacatattaagatgtacctactgtattatgtatactttgtatatcattttataacagtctgcaaagtagcaggaaaaaatttttgccttcaggttaaactcagaagagttgccattggctaactgaaaaattttgcatttggtaagcatttaattaaaaatttattgatttcggttttgaggttttacttttcatatttttagagccaataacttctggaatctcagacatttttgtggaatcttaagttgttcatagatcctaggtgctgtgtttgtcatcctgagagcttaaatggccctgtccaaacctcagcctcagctcagagtaggaaattgtcaagcacttggtaactggtaagcaaatggattttagtcactaaatggagcgggaggaatggagtgctccctcaaaaagagcatttcagctggtcacagtggcttgggcttgtaatcctagcactttaggaggcccaggcatgaggaccacttgagcccaggagttcgagaccagcctgggtaacacaggaagatttcacctctacaaaaagtaaaactaaaaaattagccaggcattgtggtgccttgaatctgtagtcctagaaacttaggaggctgaagcagaggatcgcttgagcccagaaagttgaggctgcagtaagctgtgatcacgccacagcactccagcccaagcaacagagcatagactccatctccaaaaaaagaggctgtgacagaggaaggcagggggatgttaatcagagagacatagagactgggagagtctgaaagagaggcagagagacttacacaaattaaagacacagactgagagaaatggaaaaatgaagagaggatcccagacagattgattgacttcccaggtaacatataatatcttacaatcctgcagaatgtttaaagttgcattttaaaaggcactccgtttgttcacacaatcctggtaagaagatcatcttaattagtatcatactttgcagctttcaagcagttcttaggcatcattgcgtttaagacctggctccagccgttttattacagatgaggagattgacttgttcaccttacatttgtagagcattttgcaatttttttgaaggacatttccacccattatctaatcacaagtctccataaatcccatctcccctggtataaaagcagcttaaattacaggtgctactaagatgcaaaatgcagcccacaaaatcagcaaatattttttctttgtttcctccttttttaaaaaaggcgtagatttcatattactactttgtttcaggccgtatattgaagtaacaaaaataaaaccaaaattgacaccaattttatttcgaaataaaatctacttttttcactttcccacatcattttctagctgctaaccttcatgcatattcaatttttgcatatttacagccctgtcaaagataaaattttattttctgcattttcactcaacattatacactgagtattggccatttcactcatctcagtgccactttcaaagagatacccaggaaaagcagcagcaagggttgttcgaccttgaacaactacagataatactttggctctctttgagatttttaaggccctgtaagtaaaatattttcagattacagaaggcttgggattctgtctttatcacatgactgattggtcctccatgttctccttggcagatgtgggtatcagtgacacaatgttttttactcaaaacatggtttagcttaccagtaccaggaatggccgatgcatacgcattctcattgtgaaggtttatttgcacctccactcttcttaaccaggctattttcacagaagaaataaccccaacttcatgaaccctattcccatgacctatttgccaatctgttaaaataatggccaactcaaatgatcagtaatgattgactcaccatgacatcatccatcacctttgtcactggaagcccacttgccttaaagggtgcagcatcttccaactttgctccagcaacttcagctcctcattaaatccctccctgtaggtcatccctgcaaccagttgacactggagctcagcagccagctgataggggccttcactcctcttgtcgagctgctcctctctcctctcaaagccctctttccttctctcctgctggctgacctagaagctcagctaaagaggtgttcaaagggtccagtcgcttaaacaggtggccagtgtgctttctgctataactccttgctccttgagctcagctccaagctgtagaaggccatggaagagcacattgatgtcatcttgggaataattaacagggtccggtttttctgttcgtttccttgcaccagatgaagagtaggataaacttgggagaagccaaagtgatgtttttgtattgtggctttgaatgatttcaaggtcccttggttaacctattctcagcaaaagaaatagaagatggtcccaagatggtaagagcagagtgtttggttgataatttgatctaaaagtgaccagactccacaagttaacccccagagctgctcaattacagcagtttaaaaataagttgaggattcgttgctaaatcagtggaaagaatttggagtttccaaaatagtttgtaatcaagaaaagccatctgaggaggccctggagggaaaatcgctgatgattatcaaatgtccagttctcaatgcggtggtatatgtgactgaaaaaaaccacttttgtccacatttggggaaagataagattatactaaatgcctggcacatacactggaccttcagttacctagaaaactttcaaaataactttgccataacaagtggcaaattattaaggtcatgggctgtcttctcaaaattacttagataacatgattctctggccagtatgagacccttaatttatcacgtatgaagcatatgagcctgtttatccgttcgttaatcattatttttatctggcttgggctctgggttactggccatgcaggcagatcttcccttccaaaaggaaacgttattattctcttgtattcgtttctttaaaaacatgcagatttaacaaaacatattacttagcactcttactgatttagaaatatgatgacccttaggaaatgcatctccttaaaagaaattccaggcaaactcatttaacctttctggatgttagtttcctgaccttcaaaaaatgggatgttggaccaaattatcttgaagtttccttccagctgtgtgctcggtggggagtgctggcagtgtggggcaggacactgaatatctgtggtggtgatgtttggatacaggggtgagcaacccctttggaagcaacatgcaaaattgctgagcagtggtgggggtgcatgggaatgggtggcggtgcccctgtattggagtgtaagagacaagtgtggtgagagcagtctggcagggctactactgttatgatttacacagtccctttcatccagctacttcaaagcaccttcacaaactctggctcattattccttcaaacacagcattcaagaaagattgataggcgccttttaattaattcaaagatgatgaagctgagcattacagaatataaggggattcttccaaaagtatctgcactgcagaggggcatgatatataaagtgttcatcacaggtttctaactgaaacaaggaaatgacctgaacgcttatttttagaggagaccagtatatattatggcatattcagaatatgcaataccatgcacccattaaaatcatgtttattaagaatagtcacattagggaaatggtcataactgaacaacgtttagtggcataaaaaaagataaagctttgtacatacagtatgatgaaaatgtttaatgtggctgggcatagtgacttgtgcctgtaattccagcactgtgggaggccaaggcaggagtatcactgaaggccaggagttcaagaccagcctgggcaccatggtgagaccctgtctctacaaaaaatttaaaaattagccaggtggtcatgatgcatgcctactattctagctactagggaggctgaggctggaggatcactggagcccaggaggtcaaggctgcagtatgccatgatcataccactgtactccagcctgggcaacagagtgagatcctgtctcaaaaattgaaaaaaaaaaaaaaaaaaggtttaatgtgtagaagggaaaaggctaaatggaaatgtgttaaagtcttaacggtgatcttccttggagcaatgatatagtgggtggttgctattcttttctttatacttttatgtacttttatgttatgcaaggttgaaaaaatgggcacatattgctttcatagtcatttctgttaagataatcatatgattatgaaagagggagtgtgtgtgtgaaagtggaatggaccaatcaaatagaacagtaggaagacctcagaagatatgacacatgagctcaaccccaaagatgagaagaaccagccatttagtgaatggggaagccctctggggaacagaaggcacgaaggaaggaataagtttggaatgttctaggttttgaaaaaaggccagcatgggagaatgatgaaagataaggtcagagccattgccaagggcaaggtcatgtaggacccatgacgaaaagtttgggaaacccttgtaggggactgacataatttattttacatttttgaaaaatccttctgaccaatatatgaggaacattgtaagaggcaagtgtagaagtcaagatctattgagaaggcgttgcaggggtccaggtgagaatgaggatggttcagagtggagagacagggacaaggtaagttggagtgtgggtctgacttgttagccatgtggaggaaataattatcataataactatcatgtatgtttttagggggctctataacttcagtatgttttcagtgttcacatttgtaggtttacagagtttgtacttgataaggtacagaagtaagtcacttctcaaaaatcatgcctttagaagcatatatcatgcttctattatagtaatgataataatagaagtctactgctagtcataaaacttatctgttcagagaaggctttttttttttttcagagaagtcttccaggtttcagctgttgctcattaatgctcaccacagccctttgaggtcgatgcaattatgctttggaaaagctaagtaacttgccaaaggccatgcagctaaaagaagcaaaagctggattcaaatctcagctctctgcctccagagagaacaccctcaatcccgcttaacagacattagctctgcttatttgattggtggcagtggagatgaacagaagtgaacagtgagcagagaggggtctgtaccccacacacatccctgcaccccaactgtcaactgtcttccatcatcatttactatatccacgtccactcctgacagcatcagtggctcagtcttaccgacctgcatcagggttttgggctctgcctctgtttagacagagcacgatttgggaagtgctgctaagtcagccagtggctgagtagaaacagccctgcagtgggcctctgcctgctctgtggctcgtttatcatgtgtctcatctttaaaagttggggctcagtctaggtgcctcctggcctgagcaccccagaattctatgctgatcccttcattgtgacatggcctgtcatctactcttctgggaagaccatctgcacctcactgatacttgaagctcattgagtattgtcacatatcagcccagaaagtcacagggtacagcaactcatacttgctcccagcaccaggccagccccattctgcctccagggagtcacccaaaatagagagatgagggtaaaataagacctaggaatactatttatttgcctccatggcctttgaacttgcacatccaacgtaacggctcctgtgtgttcttgattgttccaattatcatttttcctctcgaatacctgagagcattcattattttgcaagagatttgagaatccctgtgccctaacttttctttccttgatgtgggatgttcttctgtgactaggtaagtttatctcaatgtgtccccaaataatttctcagaatgttaaattcataaaagctaccatgaaaggataaataaatgaaaggagttctgaggtcaaaacatttggggaaagaagagtctttctccttctgaggcattctcagtgcacagtaacctgtttatctcgctttgccttgctctttcccaagcacatttttgctcaacgccccctaccttccccatacacttgttaacactttgcagagcactagggctctgtgggacaggctgggaaatgcaggttgacatgccactgttaatacctagaaaattaaggcaaacttgtccctgagagatgtcaggatagcacagtatggaaaggccatgcttatcagggctcttatctgagagaatacagtggttatgagcatgactctggaactagacagtctgggttgaattccccgctctgccatttagttatatgatatggggtgtattacctaacatctctgtatctcatttgttcctcacttgtgacatggggatgatgacaatgataatagtaccaacctataggatagctatgagaattaaacaaattagtaaatatgaagtatttggaacattggcctgactcaggataagtcctgtttaaatgttagtatcattattattgtttcttcaagccaggaatatacttcatcaattatgtgtacactcattccttcattcaacaaacacttacttaatactcctgtgtcctaggcactgttctagtgctggagatacatcagtgaatcaaaaacatgagagaaaaatccctgtccttgtggaacttacactgtagtggaatctactactaataatgcaaatagaaagaaaaatatatgcaagttacccaggcactgggtagcctagtacctgtcctatagttgtcaaatggatggatatattattcttattgttgttgtcgtttacagtaattgagcttggaggtttgagctgccatcttagataagaacagaaagctaagccaatacgagtgccatgccagtaagaaaaggaaactattacataaagattaggaagaaaaaagagaagaatgacaagtaggccattatctatggccatgagttttatttaaaatgagctggaccttttttgccttctttatctgtgtatcagatagacaattacctctaggcagatttccacattccaagacatgaagactttctaagctgcagcagacacatctttacttgtagcaaaacagagagcgatgggggttattttcagatgactgtagctgaagaggaagaatcaagtaattcactccccccaataataattcacttctgagaggaaaaacttctttggaaaaagcaccccatgaatggaagtctcagcatttgctgaagaacttagttaaaataaactctagacctttttcattgattctttatctcttcttttccagaaaccttctctatgtctacccacagaggctgaactttgtaaacaaactagcatcagcccggaacattacaataaagatccagtttatgtgtggagaagatgctagcaatgcgatgccggtaaggagggaaacgaacatttgcctcaaatcagggtgggctgctcacccctgtcacttcacacaagtccgggactcatcagtgtacaaagtccgtctattccaggccaatactgctcagcatgtgcaagggcttctgtgcccaggatatcagtggggaaacagggtcagtcttacttgacgatctctttctcggcttattctgtagtgagcttggaacatacagatcattttagaggattaaaaaaagtcataaagtctttccatactgcccataggaccaccccactctaaaggcatacaaagtaaagagatggctcaacacgtgcgccatgtttgctgagtgtcttccatgcacaaactgtacacactgtgttatacacacacagtgttacacacttactcaagcctcggaccacagtgctgatgaatacaaagtaccgcctagtaattataaacacacaccacctccacaccttctaggagtggatctttgttctgaggcaaaatataaatcaaattattcatatatatatatatatataaaatgcagtgtgctccaaggaactcaaaatgccagaatttatactttttaaaccatctcctactaaatgagatggtggttagctattactatttcccataagtcatagaattcagttaatataactttctttctttttttcttttttttttttttttttgagacagagtttcactctttttgcccaggctggagtacaatggccgcaacctccacctcccaagttcaagtgattctcctgcctcagccttccaagtagctgggattacaggcgcgtgccaccacgcccagctaattttgtatttttagtagagatggggtttcaccatgttggccagggtggtctcaaactcctgacctcagctgatccacccgccttggcctcctaaagtgctgggactaaaggcgtgagccactgcacgcagttaatatacctttctaaaaagaaaaagaaaaaaatcctttctcttaatgtcccacccaaagaaaaaaagaaaaaaaaaaacctttctcctaacgtcccacctgtcttcccaatgcaaggtgtcttaagacagcggtggggtcctcttagtcctctctgctcaggcccctggcatgccactgccaggagtgccagatatgcttgtgcagatcctgtggcaaccaagatgcccagccaagagtgactgtgggctaaagtccagtctgttcttcattcactgagccatgggttctggtgttgggattactgcatctagaggaaagagctttttttctctgcacaaaggtgagtgcacttgttcataatgcatcctaaatgctgcttcaggcccaaggaggtatctttttctaaatggcacaaatgtggataaggcagtggagattcaaatcacctaagtgagtaggtctgtatgtttgagagagaagaacctggaactggggatttctcactcaagacaaaagtatgtaactttggcctgttggatagacctctaggcagtgaggcagagtggagagagtactggttttctaatctcacaaacatgtggcctttggtcactaatatagccccttggaacctcatttcacccttcatagccagttcctttgcactggtgtgcttgggccagttgtagtcccagcacttttttttttctttttgagacaggatctcactcttgcccaggctggggtgcaatggtgcaatctcgactcactgcaacctctgcttcctaggctcaagcgatcctcttgcctccgccccctgagtagcagggactatacgcatgtgccaccacgcctggctaatttttgtatttttttgtagagatgaggtttcgccatgttgcccaggctggtctccaactcctgggctcaagccattctcccacgccgacctcccagagtgctgagattacaggtgtgagccactgctcctggccaacccagcactcttaattgtacaaaatgcagctctatgagaccagaacatcctgttggcctgatgatagtcaatttgatgtacccaaatgttactgataatttgatcctttctctactggtgaacaggtcatctttggaaaatccagcgggcctgaatttctgcaggaagtgtacacagctgttacataccataataagtaagtctatttcagcattctaaatatatgccaagatggtttcatcatctcctggtttttccaagtcccgtgggtggttcctcctaactatttttataattcagggactgaggggcaaaggaaatccatgccagttccgtgactctgtgttgaagatgtataactttgccattaaccaagactgagagaagaacgtgtcttcaagaatccaatatagttttgacttttccagaagcttctattctagtatgatgcaaagaggttgtattacgttaattaaggaaacacatttcctaacttgctttgagaccctggaggggaccagaagcacagtccggctccccttgccctgtgtgtccctgtccgctccacttgacacctgccccactgtctgcctaggctgaccaaaggagaaatggaacactcattattccaccggcaaatggagtcatgggataatgcccaccctattattcatgttccacagggaagggagagacacctgcacagtgttggacggaattgggtttgatccgggcctgataacctgggcctaattaagtccttcatttaagcacattctgggattgggatgaggattaagtgaggtaatgtacattacatacctacattactttacaatgtacgtaatgtacttcgtaattaatgaagaacctagggcttcataatgcagttaaattggttcctttttcctcctgcctcattcatttgcttctactctttgatgagtgcagctaggtgctaggcttggttccttgggtagaaatggaaaaaggaggtcacagcaggagtccaaacctcatcctttcttcaaattaagttgttggagttttccattgtgtgggggagttgttttttgttttttgttttttgttttttgtttttcctgacaaagcctttagttcatgaacagttttatgtaagggaagtgcatctaataacataagcttggtctcagggacttccagcttcagagcagagtaatgtaaaatgaaaagcaaaacaccaggcaaattctgaggagcaaaggggctgtggcgttttacaatcagagaagtcatcattcttgctaaaagttatttgtgtataatgtgcttttgaaacaggtctcctgacttttatgaagaagtgaaaattaagctccccgctaagctcacagtaaatcaccacctcctgttcaccttctaccatatcagctgtcagcagaagcaaggagcctccgtggaaactctcctgggatattcagtgagttgtttccagcctgctgactcacactgcagttgttggtgcatctgaggtccctgcagagataaacaaccaaattctattcacttgattttttccagtcagaagtagcaaaacatgctaagccacattatagcaagaggcagaaatgatttgccttagcaaatgtcaaatttcaggaatggaaagctagcgggtgatagatgttggaagaatactcatctgttttttaaaaagcattgcagtgttcactatttccaaatttaatatccatgcttcacgtatagaactagctttgtcccccaagaagaaaccattttttctttaaaagatataaaaggtgaaataaacattgatgttgttcagacacacacaaacattggctacagagaaaaatgctactgctttagctccaaaagcaataaatcatcaatattaccatttcaggaggtctcggagatttaaaatgcaaagaactggacagaaattactgccaaaaagagtactggtcaatatctactcactgtttagttgcatttgattattgcgagctagataaattatcagaattatatgctgtaataaataccactttattatttacatcatctgtttcagtggctgccaattctcttaaatgaacgtcttcaaactggatcctactgtctcccagttgccttggaaaaattgccacccaactactccatgcattctgctgaggtaattggcaagctggccatcagctgtttcttgtccagctgtagtcttggaccaccttcccagactcactttccattcccatgtggccatggatgttcatcatgttctcagagagcacattgttctgataggatgggaggaataactgactgtgaaacctcattcttttaaatgccaccaaatcagaatgttcagtagacgcaacctacacccaaggcagcataaccttgcattatctaccacagagggattcccagaataatgtattatagaagaggaggcaaactaaggccattcatagtaaacaactgttcccatcaaggatccttataaaagattcccaggccagattcatccgtttctttcttgggtcagttgtcacagccctccggtagataccaaggtatttattctcctaccaatcccaatgccaatagcctttcccacttcctgtttctggcactttctcttgctcatccactctgctgcagtgcacccatttaaagagaagcccaggtggatcaactgaggtcaggatttcaagaccagcctggccaaggtggcaaaaccccatctctactaaaaatacaaaaattagctgggcctgctgttgggtgcctgtaatcccagcactttgggaggccgaggcaggcagatcacttgaggtgagaagttcaagaccagcctggccaacatggtgaaactccatctctactaaaaatacaaaaaaattagccgggcgtggtggcgggtgcctgtaatcccagctactcgggaggctgaggcaggagaatcgctttaacctgggaagtggaggttgcagtgagctgagatcacaccactgcactgcagcctgggtgacagagtgagactccatctcaaaataaataaataaaaaataaataaagggagcccaggggactgtccaccctgactgcaccagctgtcacactgctagcccacttctcagttccttgcataggtttacatcaataagtattattttgaagtaaatctcggacatcatatttcattttagtctgcatcttaaaagataagggatttgtttttaaccatcacaataccattgtcatactttaaaattttaactgtaatttcttagtatcatcaaatattcagtcactgatcaaatttttaattatcccactaatgctatatttttgacgcttgctttttaaaattggtattcagataaggtccacacactgatattgattgttacatctctggagacgcttttaatctacagatcctccatctcttttgctttccttgcaattttaagttgaagaatttctcagaaatttgaatttaatttcaaccgttccagtcaactttcttctctgttctttcgccatctaccgtctcacttccggctgttttcctcttattttcttttttccttaaagagagaaccaacttttgccctggaccacaggcatgtgtctggtaaaccaaaacttctctcatcaaagccatctaaggggcaatccgagtatgtccacagacatttccctgattggtctttatgatttggacatcaacacctttcagtatccctcaaaaccaccttcttatcatcaagttgcacactctaatttcttagaaccccctattatctttttaagctataggaaagacctgagtgttggagagagacaaatctgtgtccaaagtctagattctgccactccctagctgtgtgaatgttggtgagttgcttaccctctctgagtctcgaagatgaaactgagcccatatctgcatatctgcctataaggttgctgtaagcattaaatgagataatgcttgccaaacaacaaactcaattcctaagtaaacattaattcctttttcttacttgcgctatgctgtgtttatagatatacccttagcctctcttagtatcctttaaacctgcactgtctgataagatagccactagctgtatgtggctattgaggaaaatatggctagttcaaactgagatatgtgctataagtaaaatatgcaacagatttcaaaaacttcatggggaaaaatgtgaaatattgtattaataattttttacattgattacatattgaaacagtctttaggctgtattgagttaaatgaaatattactttcacatggtccttttgtgtttttttttttttttttttttttttagagacagggtcttgctctgtcactcaggctggagtgcagtggcgtgatcacagctcactgtaatcttgaactcataggctcaagcagtcgtctcacctcggcctccttagtagctgggactataggcatgcaccaccacgcccagctaattttttttttttttttcattagaaacagtgtcttgctatgctgctcaggctggtctcaaactcctggcctcatgtgatcctcccactttggactcccaaagtcctgggattataggtgtgagccaccatgcccggcccctttttacttttttaatgtggccactagatgattttaaattacatatatagctcacgttatatttccactggacagtgctattttagatcacagatggcaaactcaagtgcccacaggatccagatgagtaacataaatgaatgccttgttctggtggcatctgttcactctggagattgtctcttccccatctgaaggtcacagctgttctcttcactctgcagattggtgacatgctgggatataaggccaattttttcatttcttccagtactcaaatgaagttagaaaagcagtcttttataggaaattttcaggctttcaaatattggtaattaattttttaaagttcctaatacttcaaacagaacgtgtgtgtaggctagagcccactttgggccccagcttttgactgcttcagatagctttaaaggtctccatcccctgtacacatctacctttcattatgatgaaagacatacaaacctaggcgaggccctcactcaacactgcaggacatctctaaaggaatgcaatttcaatgggaatttaaggcaagaaactgtctgtaagacctacgaaggtaatgatatataaacgtataaaagagtcactttgagtaattaaagcaggagccgacctggcctagaaacatgtgggaaacacttggaaaaactgtggtgaaagggaaagtaatatcgggtactcaaaagtattaaaatttcatgtcttgtaaagatattctatactttgtcctgacaattctgattaatggggaaattgctgggatcttaatttattttaattcctagaatccagaatcatcaatgctggtttggaacttagagacagattacaccgttcagccctcttctcacagcatgagaacagaacactaaggcccagaaagtttagttgagtcgtctaagtaaaaataactagtttgaagcggggcacagtggctcacacctgtaatcccaacattttgggaggctgaagtgggcagatcacttgagcccagaagtttgagaccagcttgggcaacatggtgaaaccacatttctacaaaaaatagaaaaattagttgggtgtggtggtgtgtgcctgtagtccccgctactccagagactgagacgggaggatcatttgagcccaggaggtcgaggctgcagtgaaccgtgattgcaccactgcacttcagcctggcgacagagtgggaccctgtctcaaaaggaatgaataaatacataaatattaactagtttggtgtagaattgaagttgaatccagggctcctgactccaagaacagttagattagttttcaagagagttctgtatttgtataaccctgacatttccagtcaagttggtctgcattgcttgttagtaatcagaaaagggaattggattgctaatcttttttttttctctttaacacagaaagtcccattacagaatcctcccattaagtgggctgaaggacataagggagtatttaatattgaagtgcaagctgtttcttctgtacacacccaggtaaggaatgtcaaggttaatcatgaaggtaaaggtgcagcggaggagcctttgaaggacaggccaataaaagatcagtgaaaatccttgtctacagataaataaaaaataaccctttagttctttgtggggacatgcaaacctctttaggtttcatttgtcattggaatagaaagaccttacaaaaccgccgagcacctaaaggaaagaacctagtatctgcactgttggtggagaaactttgcagggggacttgatttgaaactctcatctgctgttacttcttttccctctgtaactctgccactttgccagcttttaaaaagaaattccgtactctctcctttacctgccactgtctgagttctgcatctgctgagacctctctcttggcagtatgcttacctggtacgctgacctctgcttacagaacatgtcagagccaaaattatttcttctttagctaataattattgaaacgttcaacttcatgcaccacattctacaaagaagttcatagcctcggtctgaaacatcatgtcttagaccttctggtctgaaacgctggataagaggttctacccataaagagctattcgattgtgtttgtgaatccactggtgaacattgatggtataaaaccccatgaggcctgccttctcccttcgcaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacaggtatgaacctgcagggctgggctgggaggaggcaggagcaagcaagcattgccttctttaatgaaaaatgactttccagaaatccagagacaatgtgatcttcctttccactgatgatgtgtgctcaagggaggccaagtcttatgctattttttttttgagactctctgcatgttggaaagaaaaagaaacattaaaatagggttcttaatattatagctttttgtaaactttattaaatgattataggcagtctttaaaattccatttctggtaattgatgaatttattttaccttgaagatatttttgttttcttgactaacaggaaatggaacattttaaggtaagacaacctgtgttaaatggagggaaggaactctctacattgaaatgcaatgcaatcaatttttaaagttaaaacataaactcactattttaaagtgtatagttcattggtttttagtatagtcacaaggttgtgcaatgatcgctacaatctagttttataacattttcatcacctccaaataaaaccccatcactccctattcatccctccccctagaactcatccgttctctcttacagtctattttaaatgcttacttttaacaagttaacactaaatacaatgtgtacattttcccttagaaataatctcaaaagcttatcctggaggcatgaccagagtccagtggttctcctaactcttccagggtagactggctggtatagggcatctttatttgccaccattttcagctgtgcctatatagctctttgctttccagtccagcagacgtcttttgggtaccatccatatgcccagtactgtactaaaagttgtaggctttgtgacaataaccaagagcatctcagacctcagaggacttataatatggcaaagagtcagcagcacaggacaagactcctcaaagggacacagctaaattttgcagtggttgtggggagggtggtatcaaaggagagagtgagaaaacatccatctgggaggatgcaggaggtccacataaagagatggccttgaagaagggatagagtgaaaaccgacagaataggggcaatgagatgagtgcagcactgcagagaaccagaaaagtgtgggagtgtcaggaagaaagtcagtagcacagttggtggtggaacagaagcacgtgtggaagtgggctgggacaatgaagtgagacggcttttagagccagggaggggcatgtccccttaatctctcactctgctttgcaccctgatatgcatcttctgtggttccacagatcaaacgtcctgtgttggaggctaacttttcatccatgtagcagttgcctctccagctagattcttgcagagctctgccctccttcgattactttctgtgcccccgcatatgtggcacactgctttgtatgttccagctagttaatacagacttgttcaccagacaaaaatatttatatgttttgagcagcttctccatagcaagttgccaccttgtggtgtgaggaccacagggtgttggcataggcagaataagtggaggtggctagtctacaagcatttattcagaacctattctgtgtctctgcaatggaaagcacagtgggggcacaaaagatgtgagaaatgcacttcgcatgggaaggattccagctttcacagacagacagtttaccaccagacatggctggagaatcatgtaactcagtttcacttgagccctgtactgtgtggagtcagacggcttcatggaggaggtgggacttgtgctgagattcacagggtcggtatgattttgtggatgggagtgaggagggcttcctaggcgaggacaacagcatgagcaaagtctcagaggtaagagagcaggcatgatgggacaatacaatgactgcctcattttaagggatgtcgaactgagccaaaaagggtacaaggttagataagtatattggagccaaactatagaggcttagggcaccagaacaagaggttctatgcagtaaatcaaatgtgtatgggcccactgtgggaatgacttgatatgcagacatttttaggttaatctgtacaagaatcagggttgtgcagcacatctcaaatcatagtgtccacaacagtcacgtgagcatcttgtaaagatgcagaacctgattaatacactctctggggtggggcctgagattctgcatttcttagtagcaagcaggtgatagtggtcgtgtgtgtccgcagcccccactgagtagcatcagtttacaacctggcttagagaaggaggacgtctggacagtcttatgtctttgtcattaaaaaccatcaatgctattcagtggcaggaggaggaagttcaaaagagggaatgtggaggcatctgtggtactcagagccagcatgccagagctcaccaaaaccatctacccttcccaggcctagttaaattggtcagcggtcaggactcattgtcactgtcctggagaaacttccacctcaggctccttaaggaccagctgtgggactacccatttttctcttggttcctcagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggtagagttgccctgagtgtgggactctggtgggcggggcaacaccacctccaccccactgcagtgtaatccaaaataaaacatcctatgctgggtgcaggggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcacttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagccagaagttggagaccagcccagggaacataatgagactctgtctctacaaaaaatataaaaattagcagagcatggtggcacatacctttagtcccagctactcaggaagaagctgaggcaggaggatcatttaagcccaggagttggaggctgcagtgagctatgattgcaccactgcactccagcctgggaaacagagcgagatcccatctcttaaaacaaacaaacaaacaaacaaacaccctaaaattccattttcgttttcaggacaatacaaaacttacatgaatgctgaaattatgtgtttctttatagatctttcttcctccctccttgcctctttttatgctctaaacacttattttgtctgcccatttgataatccctcactggtctttacccacttgctaatttatgattcagctgagaatctcttttttaagatggagaagtggtgactgatgcctacgattctagtataataaaggaaataatatatatccaatggcagtggttcttaaactttttgttattaaaaaaaatcccttttcacatttccctcaaactgaactattgaaataatagtaatgcatttccccaactcttcttaattatttacataagtaataatcaagtagaacttcttgtcagcatgatataaaaattagtgtcagtgagttcacaaaattgcaggcccaaataaacatgacacttttgttggtctgtgcagcctcatttctagtaaatctgaaaatttgattgagtttttaaaaatactagtgatgtggctgggtgcggtggttcatgcctgtaatcaatcctagcactttgggaggccaaggtgagcagatcacttgagctcaggagttcaagaccagcctaggcaacgtgacaaaagcccatttctataaaaattacaaaaattagccagtcgtggtggcgggtgcctgtagtcccagctactcgggaagctgaggcaagaggattgcttgaacctgggaggcggaggttgcagtgagctgagatcatgccactgcactccagcctggaggacaaagtgagaccctgtcttaaaaaaaaaaaaaattaaatagtaatatctcatagatttccataaccgcttgtgaaaacatgtcaacatttaaagatgaaaaacagtgctgtatacatcatataccgtaatcctcacaaggttcagatgactctatggatttttgaatctgagaaaacctcactgcatgaattgtaaagttgtcatttaaatattgacaaattaaaaatatccacatttttagcttctcatgagaaatcagaagctctagcaaccctggggtccatttcccgatggcagtaatagactggagccagtagtaccccctgcctttgtaagaggcatgtgttggctgtttaccatgatctccaccactccctggtgccttatgccccatctacttctctccaaaagattgcctcctaccccaaccaggatttgttaagaagtctctaattccaaggcctaatccggtggcttttcatccaccctatccctcttcaattccttcttaaactcagtaagtaactctgttcccctgtctgttgacatgtctctgcctggtggggtgcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaaggtaggaaagatgtcaaaccgtggaaggggacacaggcttttttattttttaactaaaacttggagaagtaacacagaagcaaccactactgctgcccaccatgctggtcggatgctttaatgctcagctttggagtgattaacgttctttagaacagattaagaccattctgacagatgcagcagcaagaccagcatctgaggatttgctgagaactacttagcttgggtagcaaagttttaaagcatcaggggtttagccacatggagtcatgtggctaaaccatgcattttattttcaaggaaaaaaaatagctttaacttttgatacctggaaaggttgcctttaatttagttttgtttctttaatacctacctcttacgttcattaacatccacagattgattatctcacaaaaaagtccaaaggaacagccgggcatggtggctcatgcctgtaatcctagcactttgggaggccgaggcgggcggattacttgaggccaagagttcaagaccagcctggccaacatggtgaaaccctgtctctactaaaaataaaaacattggccaagcacggtggctcacacctgtaatctcagcactttgggaggccgaggtgggtggatcacaaggtcaggagttcgagaccagcctggctgacatggtgaaaccccgtctctactaaaaatacaaaattagccaggcgtggtggcacatgcctgtaatcccagctattcaggaagctgaggcaggagaatcgcttcaacccaggaggcagaggttgcagtgagccaagattgtgccatttcactctagcctgggcaacaagagcaaaactctgtctcaaaaaaagatacaaaacattagttgggcatggtggcgggtccctgtaattctagctactcaggaggctgaggcaggagaatcacgtgaacacgggaggtggaggttgcagtgagccgagattgcaccactgcactccagcttgagctacaagagtgagactccgtctcaaaaaaaaaaaaaaaaaaaaaaaaatcccaaggagcaatgccaaattttacaagcatataaaaactgacatcctgagagggttgatggcttgccctatgttgtttttccctctatgaattctttatttttttcatggtaaagctttactttcagaacagttttagagttacggaattatatactctatacccagtctctcctttattaacattttacattcaaatggtacttttggcacaattagtgaaccaatattcatggaatattattcattaagttcatctttattcacaccttctcagtttttctctaatgtcctttttctgtcccaggatcccattctgaatgccatattacattttgcagtcttgcctccataggctcctcttgctggaaacaatttcttagactttctttgttcttcatgaccttgacagttttgaggagtaatggtcaagtattttgtagattgtctctcattaggaattttttaaagattatgatattattcacataccataaaattcacccttttttaaaagatggagtatacgatccaacagtctttaatctactcacaaagctaccacgatgaattcttagcctgaattttttctccaatgatctgtggcctcagggtggccgagctattagagtaatatcatttcccctgataaagagaaatcaaaatctctaggtttagacacagacacagtttcacccttacaaattccagccacttgacactgtgtggtgtgaggaaggaaatctgcaggccagggtttggggctgggcgccaatactgccccgctgtgtggccatgggaaagtcatgtaactgtgctgggcctcatgtcctcatctctgcagaggtcctggtccctgaatgaacttaagaaccatctaccctgggtcttttaaaaacactggatttggccgggcaccgtggctcatgccagtaatcccagcactttcggaggctgaggcgggcagatcacgaggtcaggagatcgagaccatcctggctaacacggtgaaaccccgtctctactaaaaatacaaaaaattagccgggcgtggtggcgggcgcctgtaatcccagctactcaggaggctgaggcaggagaatggcgtgaacccgggaggcggagcttgcagtaagccaagatcgtgccaccgcactccagcctgggcagcagagcgagactacgtctaaaaaaataaaaataaataaaaaataaatgaaaaaaccactggattcaccccctgagatgctgatgatctgtagtttgagccatcaggaattattcgtattctatcctttttgacttacaaaaatcagttcagggatgtgctggagtgagctcatacctgttcccaaaagctgattgcttagttttccagaattttttgagccagttttgaaacagacattgttaaaattaaatcgtataaacttaaaattaaataagttatattaaaaacaaaggtaatctgaatgcaatgtggtatgctagattgtatcctggaacagaaataggacatgagtgcaaaaactggtgaaatccgagtcgttcgtgtttagttaatagtaacatatcaatgttagtttcttagttttgacaaatgtaccttactataaaagatattaagagaaatgcaatgaaagtcatataagaaatactacctttgtaacttctctgtaaatctaataataactatacaacttatacttcaaaattaaaagttcactttaaaaaggtaaacctagtcccttcctaataatttcactatatgctacaatatctaagttcttccttctttacgtttactgtgtctgtgtgatggaaatattatataatggtttgctaccacactgcatttctatgacatcgtgttggtagattgaaatcagttatgatgaaagtatttgtggcacaaaaattggcaaatgctacaaattacccctacccccctgacaactggttgttaaacatttgccagcacaacacaactcagcctcatattgaaagcccctttcagtaataccactttctgatcacccaggaaagaagtggtctgcagctattactgacagccttgatctttctatttttctttaataaaatgaaaatattaaatttttatgtggacagggttagcaattttcgaattattttgttgcatggggagaaaatgtctgatagagcatgagcactccacttcccttcagaggtagtttttgacaatgtattggtgtttaggagacagcgtggtgcagtaccgtactaaaccacagagagacactgttcccacacattttttcctggcgtcccctgaagtcacagactcctagaagggactactcagcagcccagattcttaaatagtttttaactgtaggttgctacacacaaactattaacgggtgttgtctcaagagcaagtaaaattaggtataacttcactgtctttgctttgttttatatttacttatggcaattgttttacctttgtaaccaggaaaaaaaatatgtataaaaaaatgaattctgaggttgtgatttccagatgtctggcttacctttccatggttggttgactgttaagccatggtttgtgtattttagatcgccgatcgcaactgcagccgaatgtcttactattgctctggcagtagtgatgctccaagttcacctgcagccccaaggccagccagcaaaaaggtactgaagagagcaatgtgaggttcatcccaggataagaacagaaggatttcctcatgccctcacactgtgcttgggaatagtcaaagtgctcccctgcctgtccctgatgtgctaacacacacacaccccacacacacttttgcagccctgtcctttacgccacatttgaccacctaattgcccattaactcagtgtttctcccactttctcatgcatcagaattacctggaagccttgttaaaactcatcgctggaccctacctcctgagtttctgattcaatagatctgagctggaggctcaagaatttgcatttctaacaagttcccagctgatgctggtccagggaccacattttgagaaccactgcattggcctccttttagtagagggaaagctgggcacaagtcatccttgacaaaagtgaatggcaataattaggtatcatttgtttcaataccatataaactaatatgaaatgcttcctcataattcttcacaatcagccttacctatgagttcagaaactttaaaagctgttaaactgcttaccaggatttttaaagcaacaaaattccccaatcatagtcccagcctatgtggtctgagggatggagggaaaaaaaactgtctgccctaatttcctctcttctaggcactcaagaatctcaccattatagtagctacttaagtttttaatgtctttgaagacctgtattaaaatgtaaatatggcagggcacagtggttcatacctgtattcccagcactttcggaggccgaggtgggtggatcacctgaggtcaggagttcaagataagcctggccaacatggtgaaaccccctcctactaaagatacaaaaactagccgggcatgatggcaggcacctgtaatctcagctactcaggaggctgaggcaggagaatcacttgaacacgggaggcagaggctgcagtgagctgagatcgtgccactgcactccagcctgggcgacagaatgagactccatttcaaaaaaaaaaaaaaagaaaaaaagggtaaatatgcttattgcaaaggataacacaggaagccatttgcaagagctgacatcacagggaaatgtttattaaacaggcaaggagggaatgagcctccccaagtctccctttggactggatgagggaaagaccaagtgtgggagggccggggcctggtgctgtgcactttgcagtattccaggcaccatatgtctagtgagaggtaccaggatttaactataaaaggaaaagtgaaaaaagatatggttaggctaaaaacaaattagtccacttgctctaaaatttaatattaggctatcacaggccctatgcagtgactggttataggtattataccattttcctttcttaaaaaccattatttgcctacagcctgacttctttaacccatgtcctgtttggtttcgcagttgccatgttttgacttgaaatgaccagaatagagacattttatttcaaagggaagtttggccaatatgtttccttaataccttagcagacagagttttgctgcttggctattttatataacctccagagcaaggtgttcttgtaataatgctgcccagaaagcagcatgaattactttaagaagcagcttatccttgtctaatctcttcttgccataagaccctggcagacaaactgacctattttctagaggcgacctttgaagctgggggagcatgtctttcctacaatgagaagatcaaggtgtagtccagttataatatgtgcacagttagaccacctgctagactaaaactcaaccccacgcctctctcaagtgagacagcttcacttcagactcacaacagcaaacaaatgtgttaacgcatattaaaattattaaggtttgactaacctcacaaaacgaagtgaaaccagtcgataagctgaaacacctaagcattctccattcctcaccactaacccgcctgggatctaattggttaaaatacccaagcatgtatacagagattttccttttgtcatcttttagtttagctaagtagctctcaaattttaatgtacgcaagaattagtacattgggttgcatgcgtactggactctgtgggtaatttttttttttttttgaaacagagtctcacttactctgtcacccaggctggagtgccgtggtgcaatcttggctcactgcaacctctgcctcccaggtttaagtgattctcctgcctcagcctccagagtagctgggattacaaccgtgaaccaccacatctggctaatttttgtatttttagtatagatggggtttcaccatgttgaccaggctcgtctcaaactcctgacctcaagtaatctgcctcctcggcctcccaaagtgctaggattacaggcatgagtcaacacacctagccctctgtggataatttaaacgactgtcaagagcaatgtttgctgtaatcagtttttgctttaggtgttgactttaaaacttaatttgcaaataaggatatgatattagggtgttcaaatagctttagctttcttacctactttcttaccagaaaaaaaaaatgagtttatctacgtttattccaggttttgtgggcataagatgaaagaaaaccacagaaaattcccagacatcatttttggcattaattagggtgaccaactgttctcatttgcccaggactgagggagtccccaagatgtaaggttttctattttaggaccaggacattatcaggcacactgtaatggattgattgccctacctttagtcttgaacttcttcctcatcaaaatgattgtcaggaatatgaacacatagccagatatgctgtagaatggaaaaggtataagtcaccctgtgcactatttgctactgagcagtaggtgacttgaagggaagtgaagacgcaaagtggagctgggggactttccaagcatctggccctgggacatagacatttagatgttgtaagttaaggctgatactactatgcctttcagagcccaagatcctctcataaaccccaccgatcctgcttcccacaatgccatatgggcattataaaaacaaaaattgtccagtctcctagagagtttagacaccatctagacagtggtccctaaagtgtaaccctggaccagcagcagcagcagcagcagcagcagcacccaggaacttgttagaaatgcaaattcccaggctattgaatcagaatatctgggggtggggccccccagtctgtgtttcatcaggccctgcaggagattctgatacacagaggccgggcgtagtggctcacacccgtaatcccagcactttgggaggccaaggcgggtggattgcttgagctcaggagtttgagactaagtgggcagcatggcgaaaccccatctctaccaaaaaaaaagaaaaaagaaaaaactagctgggcttggtggtgcacgcctttagtcccagctacttgggactaaagtaggtgggaggattgcttgagccagggaagttgcagtgagcgagattacgccaccgcattccagcctgggcgacagagtgcagccctatctcaaaaaaaaaaaaagtttgagaactgctgccaccaaccaactgattttatggatgagaaaactgagggtgaagagaggaatggcttgcacatggtcacacagagagttttcagcaggacccaagaggaaagtaagacagtaccagttttaatggctacccagaatgtttcccccgtagaatagagtttcactcccaggctgagtccactccctcagatgtgtctgtcctgtgcagcactgaccccagccttctatgcaccgaaatgtcctccagtctcaggtgatctcagcactgactttgccatccaccacttactgcctagaacatctaagacacatgcttcaggaacgaacaagctattaaattggggggaataaaagaaaagaaaaaaagtgttggtgaataataatagcctttgtttcacagcctaatttttgtggttcttatttagcatttccatgaggagcttgcccttcagatggtggtcagcaccggaatggtgagagaaacagtcttcaagtatgcctggttcttctttgagcttctggtgagattcttgcgcgtttgtatctgtgctcaataggccaagagaagcacacagcagaaaggaattgacattttgttcactgagttgcccctgctgaaaacctggggtggtttcttgaaatctaataatctctcacccctcccatccttcttccactaaattgtgttgcttctaccatgaaaatctatcgccgtcctgtgagttctcatcaccttcaccactctccacctggccacacaccatcatctctcatgtgcctctcgcagtgacatcctctttttcctgcctgtatccatttttgctcttggcccacccattctgcacatggcagccaatactaaacagagaatgtcacgctccttttaaaaaccgatcgatgattttcactgcactgagaagaaagcacaaatttttatcatgacctaaaaagcccttgtatgattctgttgttttcctccctctctaacctcatctcacgccacattcccccatcattcagccacatggtcctcttttggtgctttgaagatgccaaggccattttggcctcacagccttttccagattctcttcctgctccctaactttcacctccgcacccccaacacacacagtttctattcttctctgtagatttcagcttcagtggaaccatccccaagaggccttttctgaccacctaatactgtaatatatcttcctctattatcctccttctgagcaccctatttatttctttcctagtggttatcacaatttctaattgttttttctgtctcagcggttagattttcaggatttgggtctctcttgtgtattatcccatctctagcctcagcacactgcttggtaccatgcaaggcccaattaatatctgttggaaaacagaatgaaatttgtatatctgtttatcctaaaacttctaccattactcgagcagaaaagcaaaaggtatagccataataccttaattttaaaataaggggaataatagtgataactatttttttgtttaattattaatggaagcaaaaggattttcccatagaggcactaaaaataaacattttctcaatgttgataaacagagatgcataatgagatgatgttgaatgaaagaggtctaaagacatagacaccaactatataaaaatatatatgcaaacagttcagaggatttggagtaggttgagatttagtgataatgttagctttatattcattgggttctttcccctgtcccattaagtgaatctttttttttttttttttttttttaaagagagtctaggctgggtgtggtggctcacacttgtaatcctagcactttgggaggctgaggcaggcaggtcacttgaagtcaagagttcgagaccagcctggccaacgtgacaaaacccatccctactaaaaatacaaaaattagccgggtgtggtggcgggtgcctgtaatcccatctactcaggaggctgaggcaggagaattgcttgaacctgggaggcagaggcagcagtgagctgagattgcgccattgcactgcagcctgggcaaaaagagcaaaactccatctaaaaaaaaaaaaaaaagagagagggactaaagagatgggaggggttccacctaagctctagtttttgtatgtaagttgaagcccaagaaaaagggagaaatgctgaacaataggacacagagaacaaagggcaaaggaaacaaatgaaccatccactggggaggaaataggaagcaatgtggaatagagttcagaagaagtcaggttcatgccacagaaacacacccaggattcaaatcccatgaagttttgcaaagtcccaacctctgttttgagaagggtcccaaagcatggtcccaaatccttgccacagaaccacctggaggtgcttagtaaaaataaagcagagattctttctcaaagcactaaaattaggaggctggaggccagcattgtgcatttacctgtcttctcaggtgacttctaagcctgttaatgatccactggtctacaccacctctgttctgtgaatcctatacagagctacaggtcttttggaatttgtactcagacaacaccagaatttttttttcattccaaaagccgagctaattaaggtggtggctgcagctcacaagtcttggggcaagagcattaacaatgagacatgagctccatgctctggcaggaaagggactgggccataagacccattcccctcttgtttcttgaggcatgagaagtatcaaaaccgtcaccccatgccctttatatcctgcttctatttacacatcccacccaccatcatgtctctccataaagaagattcactcagcctagctctgcaaaaatgaaaaaattacctgggtgtggtaacatgtgcttgtagtctcagttactcagcaggctgaggcaggagcgtcactggagcctaggagttcaaggctgcagtgagccttgatcatgccattgcactccagcctgggcaacagattgagaccctgtctcaaaaaaaaaaaaaaaaaaaaaaaaaaaaagaagaagaagaagaagattcacttgagtcataatccagctatggataattcatacaaataattcattcccaatgcggaattcagcattgcttattctgagtggttccatgtggcatcttagagctctctttccaaaggaagtttgcattctctgcaggtgtaatgatgtctctgttcttcacagaatcccaataatagttggcataccaatagttggcataccaatgggagaaagaataatcacatcaaaactactgagcatcttactatatatgtgccaggcagtgttttaagcattttaaagcatcatctaatgtaatcattatgcaatcttgaggcaggaggaacttttattatcccaaatttacagatggggttggaggaagggtggtggccataaagagagtctccaagtcagccaaatgcttcagcagtaccacttcactgcccctaactgcttttggccttgcacatttatttactagggcttcgttggcccaggagagaaagcataagctaaagcacatggcccatcttacctctaggaagtcccttatggtaaacagatgaagttttttgggaagaaagcccctgctgatctaagcatattgcaggggtttgtcaacatgcagatcacccaagacaccagttctaccagcagcctaaaacctaagtctgtcaggttctggcaggacagagtttccgttgcccaaaagggttaactgaaaagcattgatcaaaaggactctgctcagcatgtatgggaggttcaggggccaatgaggattggtgagagcccccagggtacagcagctggcagaagcctttctctatgctagctctaaagaatcaagagtatagcagagtaactggggcctagaaaaatctggaggcagatgagacaatcttagaaaaggagcctggggccttagaaaaatgttgccactaccaggacctcactgcagcagggatgagggcagtggaagtgagtaactacctgggcctctctgttctcccacgtaatgatccccttgtttgtgctcctgttggccaactccaactggaagccaaaggttaagggggcctgagtgatgtggtccctcgagacccccttcccagcattcagagacagacagagaaggacaagaaatccatcagggagctggggtaggggcaaatggaaactatcatcccccagccagaactttgcaaggaaattgatctcagactcagacaaggtgcccaattcttcatacattgtttatgcatttgcctgaccaatgcccaggaagttatttgaaaaccaaaacagttttgttttgtttttttccaagaagcttgagaaagacaacagcttccttggccttagccaacaacctgggcaatttaacaccctctagttgtgtcagtgcccaagcgctaatgaacaaccactttggcattagagctgttaaacacaatgcttgggcgactttcacacttgctaatgaataaaatccctgtgcttctagaaactgctgagccagaccttggagaaatagagataaatgggtgacctagtttactcactcaggacatgaagttccacattaaggggttctttagaggtacccttactttaaatgggccacaaaggcccatatagggggaaagatttctgtgcctcgccccactcaacagggccaggcctccactagtgtttctactggatgttcttctctggagatctggaggacacagtagctggcaagctgctgacagtctggaaagaggccattggttggaagtatggtattgtgagaattatgtatttggttgtaggatggccaaactcagcagacaggagccaaatacagcagtgagttctgaaagccttagtgctgggatggttagcctgcccagaatcaggattggcattgcccaaaacaaagaggccttatcttcttaagtcctttgttaggagcatagtgagagagaggcttttttcggacaaaaatgggtccagttcccacccttcattcgggtcttctcaccaggtgcatgcggccttgtgggatatgaagccatctctgtgtcccaaaccaaagaggatgccgccatgaggagaaaccatggtttctctactgagctttagggtttgatgtccttaggtcttccctgagctggccatggcgttgtctgaaaacatgaaacacataaagcctgtgtctctggttttttcttattttgccttccctttgttttttctgtttgtttccatgctaacaaaaattgccagtgctgcatgcatccttagaaactgaattctgctgttagtgtattaacgttctctcatgtagctcctgggagtggaagtcccctcttcttccagtctcaacacagagggcaaatgtgggtggttcaacttccagtgccattagtagtagtagtagtagtagtagtagtagtagtattgcagtggctgtctgactaatctagacgcatacatgaaaacgttttcagagtgtagggacccaaccacaagaccttctagtcttccccatgttcctaatagtgtaagcaacttccaacaaggataagactcaccctcagatggtgacaagggggcccatattgacctgtgaatctcctggccccaagaagatgtccaaaaaataagcatgatcttgatttaaaattgtggtaggcattgagatagtattattctagtcataatgcagacagtcaccaattgacacaaggatatctatatatagatacgatatgtatatgtatgtatatccatatagatatatctgtatataaatatctttctgtcagttgacgaattgtttgcattatatatgtaaccacagtatacaccagtttgtgtcaattggtgacttgtattgacacaaagatatctatatagagatactagatatagatagataatctgtatatagatatttttgtgtcatttggtgactgtctgcattatgtaactaaaaattagacttatggaactcaaaatttcccctagaggtaatgttttccctggaggcaatgttctaaatagtggttctgtttccagctggccaacatttcctgctcaatatataatatagctaaaatttataggagcagaagataactgctggaaactatagaactgtttctggaaaaactgtgctccctcgagaaacactgaaactcaagataggaggaacatttctcccacgttctccttactgtagtttcaggaacagaaaagactttagttcgcatcaagaaccttgtgataaactgttcctttctgagtcatgtgttctgtcctatgatagaggacacctagctggttacaggagcccagctcaggtctgccttccaggatgtaggcagttgagaacactgtagctaaagaattaagctcctggctttgtcagcagcaagaagggagcctctgacttggggtcaaaaagaggacacccttcccacctcccgccaccatggtaaccattggtgtgtctgcagcattttagtccagagcttgctcgggcaccaccagcacagataaagtgtcagaaaatccattgttagagagcatttctgtgagtctttcccccttttctgcattgtacaagcaggtcaccaatctccatgttgacatttcctccatccccctccgcaggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggtaactgtattttactctttattttctaaattgtttacctggaacatatattactttcataatcagagaaaaataagcatcattttaaaacaataattaaaatataactgtaatgacagttaaacgcagtatgttatactggactggaccctgatgtggggctggaaaattgttataaacaaattacacacatgaggccaggggttcgagacctgcctggccaacatggtgacatggtgagaccctgtctctactaaaaatataaaaattagctgagcatggttgtgcatatctgtaatcccagcaactgggaggcagaagcaagagaactgcttgaacctgggagacagaggttgcagtgagccgagatggtgccacagcactccagcctgggtgacagagtgagactctgtctcaaaaaaaaaaaaaaaaagaaattgcaatatggactgtggtttaaatgatcatatcaggctgggtgcagtggctcacacctgtaatcccagcactttgggaggcaagggtggtcagatcacttgaggtcaggcattcgagaccagcctggccaacatgttgaaaccccgtctctactaaaaatatggaaaattagccgggtgtagtggcacgtacctgtaatcccagcttctcgggaggctgaggtggaagaatcgcttgagcccaggaggcggaggttgcagtgagccgagatggtaccacagcactccagcctgggtgacagagtgagactccatctaaaagaaaaatgtagatatgaaagataatatttttgctcttaggaaatacaccttgaagtgttatggggtaaatgggcatgatatttgcaacccattctcaaatggttcagaaaaaaatgtttttatgttcatagaatgataaaacaaatgtagcaaaatgtcaagtattgataagcttcgttaaagggtatacagtagttctttgtactattcttgcaccttttctgtaagtttaaaattgtttcagaataaaagctaaaacatatataaaatggaataaatcaaatgtttaaaaggcagctacaaaaatcttaggaagcaatgtttattattaatcgctttgtcgttattgagaatgtgcatagtaccaagtgctcaggagattttcattcggttattcctcatggcaaactttgttggaacagcatggtatctccacattggcaggtgtgagaataaggcacagtgaggttgataaattttccaaaagtcacacacagccagcagtaaagccaagactggagattttagacccagatactgagtcacgtaaggcacccaggaggagtggccatgtggagaatgcggagagagttcgaggacctctcagcggcacggtagcaacctctttatcaggtccccatccatcccagtgacttgactggtcagcatggcctgaatttgcaaattgcatgttaacaaaagcaaaatagtttcaaaccatatttttaatagtgtcaaaggaaattgatttgtcattctgagaataaaggacataaacatgaaaaactgaatcccagattgctctgaagcactgtaaaatccctcataaacaggagcactgagaaataatacaaattaaaaattttaaaaataggcgtagcttattaattgggattcatggaggaatttaccctacggagtgaatacaccctgcggagtatgactctgacctctcttaggctggaaatgctgcctaattgaggaataaatttcttaggtaaaaactaattcttttatcctgattggattttctgtaataatccttaaaaattaagaaactgtctcattgaaaacagtaagtatttttcaagtcagtttgccaaaaaaaaagaaaatagttacaaaaaaaaaagttaccaggatataaaaaaaagtaggatccaacatagtatatagagaatgaggttaattatacacatataaatatgcatgtagaaaaaaaagtgactggaaggaaatgcacctaaatattaacagtgcacgaataattacttgattcaacctcacagtcatggctttagttaaaggagactcaactacttcgcccagtgccacccagaaggacagtggctgaaataataggacctgtctctcccaatgttcccaccagtgacctggaagttcaaatccagagtgtcccacaaaatgatttgggtgtttgtttgtttttaaggaaaatgaacaggcggaaaagatgaacatcagcctggctttcttcttgtatgaccttctctccctcatggatcggggctttgtgtttaacctcatcagacattattgcagccaggtgagtgtcccccccacccccacccccgagcgagccacttggttccttctcatataatgtgatgttcgttgccatggcacgctgtcttcttcattactgagttggcatgaatcctacacatcctgtgttttgcagcacgtccctcatgtctgtgccatggacattcctcagacatgctggtttaccttgattcctggagcatttaccgacagtgtagaagggtcaacagattcatctgtgggaattaaaatttgtgatatgatctgaatcttcaatttgacattcaacagaaaattaacatggctatacagtgctttcagtctttgacaagtccttgcgctcccagtctgaggtctcttttcacatattagggtaattaattaaattgctgttgtgatgctccgacttgaaagaacctttttaaagtgttcttaaataaaatcattcaaagagatttaatttcactgagcacatagcaaatatttcataaaccaagtgcatctatcagtgccatccccccagatttttaaatggaattattcatgtgctgtctccctcaaactaccttaacaatagtaatataaatagcagttattgttgctgctcctctccttccatatccctaatctagccactagtaccatcattactgctactactaccaccagccaccaccattctcattagtcccatgcccactatcaccaccttctccaccatcaccacctcccaccacctccaccacctccaccatcaccaccacctccaccatcaccaccaccacctccaccatcaccacctccttcaccatcaccatcaccaccacctccaccatcaccaccaccacctccaccaccaccagcatcttcaccatcaccaccacctccaccatcaccaccaccaccacctccaccatcaccacctccttcaccatcaccatcaccaccacctccactatcaccaccacctccaccatcaccaccacctccaccatcaccaccacctccaccatcaccaccacttccttcaccaccaccaccatcttcaccgtcaccaccacctccaccaccaccacctcctccaccaccaccacctcctccaccatcaccacctccttcaccatcaccatcaccaccacctccaccatcaccaccaccacctccaccatcaccaccacctccaccaccaccagcatcttcaccatcaccaccacccacctccttcaccatcaccaccacctccaccatcaccaccaccacctccaccatcaccaccacctccaccaccaccagcatcttcaccatcaccaccaccacctccaccatcaccaccacctccaccatcaccaccaccacctccaccaccatcaccaccacctccaccatcaccaccacctccaccaccaccagcatcttcaccatcaccaccacctccaccaccaccaccacctccaccatcaccaccaccacctccaccaccaccagcatcttcaccatcaccaccacctccaccaccaccaccacctccaccatcaccaccacctccaccatcaccaccacctccaccatcaccatcaccaccacctccaccatcaccacctcctccaccatcaccaccacctccaccaccaccacctcccccactaccaacagctccttcaccatcaccacaacatccaccaccaccatcaccaccaccaccaccacctcctccaccatcaccacctcctccaccaccaccaccattagctccaccatgaccacctccttcacctccaccatcacttcttccaccatcatcattgtcaccatcatcaccaccaccacctccaccaccatcaccacctctcccatcaccaccacgttctctgtggttagtcacttagtgactttagataagtttttccaattttatgggtcttaatttcctcagttttaaaataagaagggggggttgagagatttgagggctgatcaacgaaaaggataggaccataaaaagcagtgacatacaagcttcattgagcagcacttggacagggttacataagagcggaagcccctcccagcatgagaacagccataggcctgcagtgaggaggggaccatccagaggagcaggggaactcccaggggagaggaggattagggcagaagcttatagatctgggtgaggctgctccacagcacagtagggagtctctgggtcagagagctccaagggctgtagcagcttagggccctgtatctgcaaggctctatcttatcattaggaaacagctgtccatcgagattttatggggtctgcaaaggaggcaggcactaaatggatgaaaatctgcttatatgagctatttttgttaatgactgggcatggtaaaatttgagttaggtatgagccaagggatcagcaccagtcgacagtgaagaaataaacaaccgaggggccaatacacagaaacaatctttgacttgtttacataacacctctcctccaaaaaaagaaaaagacatgacttttctaaaggaagtcctgtctacagccataccaccctgaacgcacgcagtctcatctaagggaagtcctgataaggaagcagaataataaaaaagaatcctaaggaaacatcagaagtccccaagcatccccatcccatgcaccctgacccctgccctgcagcggatcttctgtcccaggacccaccagaatagaatggcagagggacacttcactcctccttgccctccctcttcagtatttaggattccaggttagtctgttttcaaaactttaagttgagtgtatgaaagataccctagatcaccactgcagacccaggcttagctactcacatgcaggctatcttcattcccgacagggaaataaggcaacccaaggtagatatctgccttccctgcaaaactcatgtttttattttctctttctctttcctttcttttctcttgctcactatctttctccttaaattcttcccttttcttttagttaccatttctttttttgtttctctccttgactcaaatgccaaagatccctagaccaggagtcaagaagcctgcatgctgattcctgggacaccattaattacttctgtgattgggagcatcagcctttgaggcattcatttcctcatctgcaaaaaaactaggctggattagatttatccactgattctgtggtctgtgtctgccagtgacatccacggatgttacttagcaccattagtggcactcaggcctcagaaggtcactgacccccattcgtggtgatttaattcattgatcccagctctctagatacaggatgaacttcataccttaagcaagttgtattcttacaaagtcgtctgactttatcattttgcataacctattatgttttctgccatctaaagattttgtggcaatggatataaccttagtcttttttaatagtcactaaaaatagacaaatccatttcctcaattactgtctgtcacttacaatgtgccactaagcaaacacccatcccttgggtaggggcattgtgggtcttgacctttgggaaggaagtttttggaatgcaccttactcctcttttcaaaacatcactcaaattgtttttgaaatgtctattttttttcttttgagatggagtcttactctgttgcccaggccagagtgcagtggcacaattttggctcactgcaaactccgcctcacaggttcaagcgattctccttcctcaccctcccgagtagctgggattacaggtgtgtggcaccactccccgctaatttttgcatttttagtagagacagggtttcaccatgttggccagactggtcttgaactctggcctcaagtgatctgcctgcctctgcctcccgaagtgctgggattacaggtgtgagccaccacacccagcctgaaatgtctgtcttgaatgatgtctcaagggacctatgaaagatacccatagtggggccttcttttaagtgccaatgtgttgtgggttcaagttccgatagccggcttgacccgacacctgttaatgagtaacctaagtgacaggcacatgaccaagttctaatcccttcaatgtgctggtggctccactggtccaaagtcagccaggagtgcacatcgaaaggttatgggatctggtaactgtgcttacatagaagtcatatgttttggttttaaaataatatataatggcatttacttattttaagtggatgtctaactatgaattaattctgtaggcaatatgtcccacaacacattggcttcttgtaaaatggctgaaaatatgtgttcatttaaattatattgtttagtctgtaatcccagcactttgggaggccaaggcgggaggatcacctgaggccaggagttcgagaccagcttggccaatatggttaaaccccatctctactaaaaatacaaaaaattagctgggcatgttgatgtgcacctgtaatcccagctactcgggaggctgaggcaagagaatcgcttgaacctgggagatgaaggttgcagtgagccgagatcatgccactgcactccagttcaacagagcaagactctgtatctctctctctctctctctctctctctctctctctatatatatatatatatatatatacatatatatatatgtgtatatatatatgtgtatatatatatatgtatatatatatatatgtgtatatatatatatgtgtatatatatatatatatagtttaaaaaacaaactactcttgaagtgagtgaagaggaggcatgtctatcacaaggatgatgcttcatatttctgtgctggggtggggggtgataatgatgaaatattgaggagctcaaggtgcatcagcgccccttccttcccctattttgcctttagaggagctgcctctgagtctgggtctttcagttgttcagcttgcctgggggaagcaaggggtctcttccagacagtcacctttttctgcttttcattgcttgcttcatggtttattttttaaaggaagatttttcctaaaaactcttctagctttctttctctttcttctccatttcctcctctctcagtctgggacaagctccttgagttttttgcaggtactatgtactttgctaaacagtttgatgcctttctctagggaactggttctacaactttccaatggggcctttaattagaaactacgagagaacacttgtagtataaaagtcatctagtcatattctattagtttcatacaggctcatatgaggtcaactcctttcatttagtttctcgaacatagtagagtttttgtaaaattaattatgttacggtgaagatgtacctcaagattttcagcacaggcttcccatggtattaaagatttgataaagtggaaatcgggataagaatcctcattctggacagctactaggctagaatcactaaggggaacagtaatgaatgaaaatttattagacctctctgtaatgcagaatttaccatctgttgcactatcccattagtttttattaaattgattgccttaacctggagagaaaggatatttttgtgtctgccaacctcaactccacttaccttgtaataaatgtttcattcctcttttcatttttcttcccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccaggtaataaaagaattatttaactaaaagaattattcaagctatttcatttaactagctcagtttaatcatgtatttcctataaaggttagtcttattaatttgacaaaaaatcaaacaattcaaaccagatcaagtatgctaccctgaagttacaccactagctaagaattaacaatctaagtaattggtttctccccaggctcaaggctccctgatcaggttaagtaaagccaagaatccaataagccctatgaaatttagaaactcatagaaaagtctcaaatcttcctttgtctgacattagccaattgttatattatgcaaatagaggattccaaagtaaataagttttggaaaccatgtattcaccaggtttctttgcagcaggccctctaagaggttttaacttgttcatgtcaattgcaaatgcacgagaagcagaagaggaaatgggaggaggtgtgcatgataagcagtgattccccaaatgatttaacatggaaaccccaccccacctcatacattttttgaaatgttactctggaataactttaagaacatgctgtttgatagtcacattccatttatagggaacacatcagtagctcagagcatcaggcaaaatttctcattattaggttatatttctgttgcatattccttgatactagtacaaaagtgaaggcttgtcttactaattgaaaaaaaaatcttagccatatatgccatatggcatgatccagatattagctacatgaccatcttactgtgaacagggaaagatctgactcacaagcagcaattcaaaatgtataaactttttgctccatcctgcccagcagcttaagtcctaaaacttccctggactaagcttaccctaggttctttcccaccttccccttctgactgccccagggagtggccaaacccaggggccaggctcacaaaaccatgaaggatttctaaagacactttagatgctcttaatgaaatataaagtgtgctcccaggatacaaatacaggacaggaattactgaggaccggtaaatctaatacttccctccctgacatcacttgtagttccaggccagcaaaagtctgacaatgtgcttaagccaaattcagaagtgtagctgaggccgggcacggtggctcacatttgtaatcccagcatcttcggaggccaaagggagtggaatacttgaggcaggagttaccagcctgaccaacatgatgaaaactcatatctactaaaaatacaaaaatgcatcaggtgtggtagtgtgactgtaatcccagctacttgggacgctgaggcatgagaattgcttgaacccgggagagggaggttgcagtgagctgagaccatgccactgcaatccagcctgggtaacagagtgacactctgtctttcaaaaaaaaaaaaaaaaaaaaaagaaggtacctgagtaagcagggccttaaacaaagggggcatttggttacagaggaattgcctgttcccagccccaggactgggtgaggttcttatttctctgtccaacttttatgctaggatttttatcttcagcttttgatttcaggtgggaaagggagcgtcattcatttttcaacagacccggggtgctttattttcatctttcccgctgggcagtcttctctctgtgggtatgggaaagtgcagtaaccactctgtgcctcagtttccttgtccgccttatctggcaccagagtacctacctcactggggagggctcacgaagcctggctggggcgaggactcagtaaacactggccatcgctattttcattccagttcttgtggctcataaaatggctccttacgtttctgtagaactcaagctcctgctccagcttccaggaccagaagatcgccagcatgttcgatctgacttccgagtaccgccagcagcacttcctcaccgggctcctcttcacagaactggctgctgccctggatgccgaaggggaagggtatgtttctggcatttaaaatggaagatgaagccaaaaaaacagatgttctttaataaaatttgcagtctagcttctcacacttggtaaaaaactctactgtagttgaccagttctgaggagtagaaacatctgtcttgagaatatggtacccataagcacaaggcacaagaaaggcctttcttgtgtagaaaggcaccagggatgggtaagaactacaaaatgacttttcttggtcaactatttcagtggaatttaccagttctgctatagcaggtttcccaaggatgctttgattagtgaactccctaggagcaaagccatttttaacaaaggggatagcatgcagaggcaaccacaagatgtcacttggttcaaagctgatgaaggaaataatggctgctgagaaggcagctgtcccatgcccagattaggtttcttgcagacagtgcttctcaggccaagagacaccacacatccagggcttctgaatccttttacctcttatctatctgattactcagggacatgtggcagtatctagcctagaagtcaacagacagagaggtagaccacccccttctttccttctctccctatgctccgtgagctcatggagtcagaaacccacagcctatctgattggactgaaaaagataatgccttctaaaatattattcattccgttcaacaattattgaatgccttccatgggacagacacagttaggtgttagagtacatcagagatatatcagtgcacaaaacagacaaaattcgctgcccctcaagagctcaccatccagggactcagattcaaagatgattaggattgcaaagtagttgagattcaacacttctggtgtttagattaggcatacagaattgcaggaacttgcccactattccataacagagaacgaaatctaaagccatggtcttcccagtcccttcccaggacccactctcctataccaaaccatctccctgcacagggaacctgttcccatgactcctatgctaaagaggtttccagaataatgtttgctaattaatggtagcattgctgtatgttatggatggatttttatctaaatggaatttctcaagttctctcaaagtgcttacaatttagtgaaggaaacaggaggttcctgcatgaaacaaatacaggagcacatcgagttcgtgcaactgcaacagtcacatgtgtcccaagctatgtacccaggctgacaccgctgaagtgactctatgtctgcgtctcctggcaggatagtgtggggaatctcatgcttttagctctcaattctgcctccttccagataaactggcctgagtatatcctttgagaacttcactttccatggcttcaattctatcttctcttctcaactctaactaaatttctcccaattatctcagtagaatgttctaccctacaactaacataaatttccacagcaacaaaaagtgcaccgaacacttatgctaataagtaagatactgagaagaaagtttgaacacaaagaaaattgccttcatgcacaaacatgtacatacattttcttagttgtcctttaatagcagtactttaagtgatttctagaaacatctttagtatttacaatagcgtagtttctattttctattttcattctagctggaaacagccatgacattctgttctggattccttgtaaaattgttgctgttatattactagcaacaaggtagagtatattcagagataatcatgtaattatgtttaatcaggtagatacattcttcaaacacacacacacacacacacacacacgcacacacgcgcgtgcacatgcacacacacagtaccctttctcccccaaaagagtaattaacagtgtaactcctttggcaacacagtaatccctgattgctgggttgtcagttactctcctggaaagtcattagatacactgtcacaacttcatcatgtaagctaaaacctcagaaaaatgtcatgcttcaacaatacttcctattgatcagcacttcctttttttttttcttttgcttccaagacagttggtagacttgccaacacctgtacatccatggggcaagggccagaaggacgcatctcagtacctgaacccctagggagctacagctccagtttccactgggtttcccttggatctctgacacctgggtatatccacaagtgtctatgcatcgttaaatccacagtgtttttcaagcatttagaaattgtctatcatctttgtgttaagccagcaaattgcaatgcctaattcaaaacacaacccattgccgggaccacagactaagaacaagaaaaacttttgaaatgcaatttacaattatcttactttagccacagtgcaagagtctgagtcatttaaaattttggttaatattttctatataacgttgaattctgatgtagccttattttgtttgaaagaaaaaaatgtatatatatgtatatattttttaaatctggattctttttttattattatcatactttaagttctagggtacatgtatacaacatgcaggtttgttacatatgtatatatgcgccatgttggtgtgctgcacccattaactcgtcatttacattaggtatatctcctaatgctgtccctccccactccccccaccccatgacagtccccggtgtgtgatgttcccacctatgagtgagaacatgcggtgtttggttttctgtccttgcgatagtttgctgagaatgacggttttcagcttcatccatgtccctacaaaggacatgaactcatccttttttatggctgcatagtattccatggtgtatatgtgccacattttcttaatccagtctaccattgatggacatttgggttggttccaagtctttgctattgtgaatagtgccgcaataaaaggattataaatcatgctgctataaagacatatgcacacatatgtttattgcggcaagatgtatatttttaaaattgaacatctatgactaggttccagatactccactatatattttatttactttttattatagtataatttatataaagaacctgaatcctaagtgtaaagtgcgattaatatttcctgtgaatatatttgagtaaccaccagtcagataaaaaatataatattccattatcctctctcagttacaggcccccctcaagtaaccactattctgactcttattattagaaattaatactgcctgttgttgaatttcatagtcttttgctgaatgttgtgactgtgacatcctttagtgtggtcgcatgtgtcagtattcattttttttcaactgtatgtcatattcctttgtctactataatttctcttctgtaaattgacatttgggctgctttctatttgtgggtattgggtattatgaaaacagctgccgtgaacatgcctgtgcatggttttgggtggacgttagaactcatttctttggggctataaatacagcctattttttattttaatatactgctcttgaatagtttaataaatatgtgtacatggtcttaacaaaatgtcaaaagaatatactctgagctaggaaaagaagagcaaacaagtcaaagcaggaagatggcagggaataacaaaggtgatagccaaaataaatgaaataaagaatagaaaaacaatcacggaaatccgcaagatgaaaagcttgttatttgaaaagagcaacaaaattcaccaatctttagctgagctgaccaagaaaaaaggaagaagactcaattactaaaatcataattgaaagattcaacacaatcatatcacaagagaccttacagaaataaaaaggattataaaagaatacgatgaacaattgaaagccatcaaattgataacctagattaaatggataaattccttaaaaggtacaaagtactaaaattgactccaagaagatatagaaaatccaaatagacctacagaagtaaaaagattgagttagtaatcaaacttcccacatacacctactatgtacccacacaaattaaaaatttaggctgggcgcagtggctcatacctgtaatcccagcactttgggtggccaaggcgagtggatcacctgaggtcaagagttcaagaccagcctggccaaggtgatgaaaccccgtctctactaaaaatacaaaaattagctgggtgtggtggcgggaacctgtaatcccatctactcgggaggctgaggcagaagaatcatttgagactggaaggcagaggttgcagtgagccaagatcatgccaatgcactccagcctgggcaacaagagcaaaactccatcacaaataataataataataataatatattttaaaatttaaaacttcctacaataaaagctcaaacctggggggctttactgatgaattctaccaaatatttttaaaagaattaattctaattttttaccaacttccagtcttctcttccaacgaatggaagaggtggaatacttccccacttgttctatgaagctagcattaccctatactaaaccagacaaagacatcatgagaaaactacaggccagtatctgatgaatatagatgtaagaccctcaacaaacactagcaaactgaatccaacagcatataaaaaggattatacaccatggctaagtaggatttatctcaggaatgcaagataggctgcatacctgaaaatcaattgttgtaccatattaataaaataaaggacaaaacccatacaatcatcttagtagatgcaaagaaaagcatttaataaaatctaataacgcttcctgataaaaacactcaacaaaccttttaggaaataagagaacttcctcaacttgacttaagggcctctatgaaaaatccacagctaatgtgacacttattagtgaaaaacagtgctttatccctaagattaggaacaagacaaaaatgtctacccttgccacttctattcaacatattaggagttctatctagggcaattaggcaaaaaaataaaacaaaagacatctaggccaggcgtggtggctcacgcctgtaatcccagcactttgggaggccaaagtggacagatcgctttgagcccaggagactgagaacaccctgagcaacatggcaaaacgccatctctacaagaaatacaaaaattagctgggcattggtggcttgtgtttgtagtcccagctacttgggaggttgaggctggagaattgcttgatcccagaaagcggaggttgtagtgagctgagatcacgctactgcactccagcctgggccacagagtaagaccctgtctcaaaaaaaaaaaaaaaaagaaaaagaagaaaagaaaagaaagcatttaaattggaaaagaagtaaaactatctctattcataggtggcataatcttgtttatagaaaaccataaggaatccacaaaaaactccattacaactaataaatgaattcagcagtgttgcatggtataagatcaacatacaagaatcaattgtgtttctatacacttacgatgagcaatctgaaaatgaaattaagaaaacaatttcatataaaatagcatcacaaagaaaaaatatttaggaataaatgtaacaaaagaaacacaagagttatacactaaaaatgacaaaacactgttgaaagaaagatataaataaatggaggatatcatatgttcatgaatcagaagacttattattaaaatagcaatactccccaaattgatccatagattaaatgcagttcttctcagaattctagcttgcttttttttttttttggcagaaattagcaaactgatcctaaaattcgtgtggaaattcaagggacccagtatagccaaaacaaccttgaaaaacaagaacaaaattggaggactcacacttcccaatttcaaaacttactacaaagcaaaagtagtcaagactatggggttctgacatatgatagacatatagatcaatgaaattgggttaagagtccaaaaataaatcttcatatttatagtcaattgatttttgacaagagtgccaaaacaattcaatgggggaaaatagaattttcaataaatggtgttgggacaactgggtatccacactcaaaagaatgaagttggaccctatattacactgtatacaaaaactaactcaaatagatcaaagacctaaatgtaagagctaaaactataaaattgttacataaaattatagaggtaatcatcatagacttagaaaaggcagtggtttcttagatatgacacactcgaaagtatgagtaacaagaaaaaaatagataactggacttcagtaaaattaaaacttttgtgatttataggacaccatcaaaaaaatgaaaaggcaacacacaaaatgggagaaaatatttgcaaatcaaaaacctaataggggacttgtatctggaatatatattttaaaatcttacaactcagtaataaaaagacaaataactcagttttttaaaaggcaaaagatcagaatagacatttctccaaagaagatacagccataagaccatgaagatgttcagcatcattagccgtcagggagatgcatattaaaatcacaattaaataccacttgatacccacgaagatggatataataaaaaagacaggtaataaagtgttggcaagaataaaatggagtcttcagacactgctggtgggaatgtaaaattgtgcagccaccgttgaaaacaacttgctgattcctctaaaagttaaacagaggctgggcgctcggcggctcacgcctataatctcagcactttgggaggctgaggtgggcagatcatttgaggccaggagttcgagaccagcctggccaagatggtgaaaccctgtctctactaaaaatacaaaaattagccaggtgtggtggcaggtgcctgtagtccccgctacttgggaggctgagtcagaagaattgcttgaacccaggaggtggaggttgcagtgagccgagatcgtgtcattgcactccagcctgaacaactccatgtcaaaaaaaaaaaaaagttaaacagacagttaccatacaagccagcaaatgtactctgaggtatgtacccaagaaaagtaaaacttaaaacttgtatacacatactcatagcagcgttggtaagtcacaatagctcaaaagcagaaacaatccaaatgtttatcagttgatgaatggataaaattcaccaatggaatattatttagcaataaaaaggaatgaagtactgatgctacaatatgataaacttaaaaacatcatgctaaacagcagacccagggttagaacacaggcagtctgtttctggattctatgtagttctatcctatattgcttggttttccagggttagaacacaggcagtctgtttctggattctatatagttctatcctgtattgcttggttttccagggttagaacacaggcagtctgtttctggattctatgtagttctatcctgtattgcttggttttccagggttagaacacaggcagtctgtttctggattctatgtagttctatcctatattgcttggttttcacagtcacctcattgcttaggagcgttttcatcactcttgactgtttaagagctctttagtcaatttcctttcaccataacctcttgattcctgtgttgtgccaacagaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacaggtaatggcccttctgttttctttcttggattgttgggggcccctgccaaatgccccatccgaatgagatctctgtcattcgttccagtgctgatatgttcatatgagcaattcttcacaaaaatggtctccaaacctctttaacactggccccaatcagttaaaaaaacaaaaaaagtcacatagccccatatgtgttttttgtttagaaattatttacttgtttcttcattcattcatttattcattcattgatctgctagtatggaatgaactttataaaccatacaccacaaaggatgaaataataacaagattactgcctttggagatcgtgctctaacaccttgaaataaaggtgttccttcccttttcttttatgaatatgtaagcaaaaaagcggtctcaaatgaacccaactaattgctccatgcaaaaaaaaaatcatggcatatgtcaatattagaaaattctatcatagcagagaaatattgcccttggcactaagtgactaattttgaggttaatatgtctagattagcaacaagatgaaaggataagttgtcttaaaggggttttgtgaaaccccagaatctatttacaaattacattgtggattaaggaatgtagagggaaaaaaatcctcccaaatagaagaacttcttatgttgacctgagaaaggcagtccattggcctaccctctccacagcgtacgtgtgtgtgcacgtgtgtgcgcgcgtgcacacacacacacacacaattcctatcccatcagagtagttcttgcttttcctccagctcaagggaagttttggaaatgtccatgctgctctcttggcagctgaagggtgctgggatctgggcaatgcttccctgagccagcctctttatagtcagtcatccttgaaatcttggaaccatccaggttttcccacctcctccaaatggaaagtgtcatgtgtgactaaattgtttataatactattacggtgacaagtatttagttcatgaaaatgggaccaaacgcctatagtctttaattcatacaaatcataaaatgaaaagcaagtattcctgtggaagtaattctctcctttcttgaaaaaaatcctctagcaaactgctaatggagtaactcagaagagaaaggttgagacaggggttagggtttgtagagttctgttggggccagagtgcaaggaaatgatagaaacaagctcagcacacagggctgagcaagctgcaccatgaggtcagcagcttcctctagcagcgcctgattgcgcggaattgaaaatggagttgtttttaacatttacagacataatgcagagcatggcatgtgacttgtagcccattttgagaatccttgatggcaagtttctaaaaagttccatttcaagagcttgcttgttcccaaagccaggaaccactttagcacacattatccgaagttttcttgtcaattagaatattccgtatcagtgactcggaatcagaacttttcaacatttggtctccaagccttttaaacctcaaagacttctttgtatatgcgttgaactttatgatcatgatgtagctgatgagagaaaaaaacagtgaaaagtattttattgttataggttacacagtacatctattaaatatggaatctttaggttgataaactcataagaatacagtctttcaaaaagatgcatctgaattcagattccagccccatttattaatataagtgacctttgaaaggctcaacctttccgtgccttcctttcctctgtaaactataaaaatgtgataacgatgtctaccttttaggtttacgataaaggtgaaactagagaacttctataaaagcattttgcacagcacatgtttgtatctttcccgatttttcttgtaactataaccctatggcaattaaggggaaataagaatgtgtctctatgttagttgtgataatgttatcaggtcttgcataatttccatgtgctgtttatttaaccatttgtttaaaatcccaatggccttaataagtatttctaaaaattgggttttggctcggtgtggtggctcacccctgtaatcccagcactttgggaggccaaggtggacagatcacttgaggccaggggttcaagaccagcctggccaacatggcgaaaccctgtctccactaaaaatacaaaagttagccaggcgtggtggcgcacctgtaatcccagctactcgggaggctgaggtaggaggatggaggggcagagattgcagtgagcggagatggcgccactgcactccagcctggatgatagtgtgagactttgtctaaaaataaataaataaataaataataagaactgggttttgttttcacaactttagtagaagaaatgttatttacactcaaatttttctaaataattgaaggcccagatggctgtaatgtcaacaggtctagaaaaacatgaatttttaggaaaacatgagtgaatcaatcagttgtgaatgttttaccacacttttcccagaactgcttgaaatattaatagtttttgattgtatactggtagcattcttaaaaaccagacttttaaacggtttatcgtttttttgcttgcatacatctagacctatctataaatatgggtatgtctatattacatagatacaataaattgacattcattttaaacatttgaaatatgacaaattattgctgaacttgtgataatagcttattattctatataaggtagttgcttaattctgtaattgtaggtgtcttctatttggtcattatttaaaataatgccaattattagaatagagaatgaagtttaaaaaattatgttacaggaaacaattatggaaggtttgaaaactttttgttcacacaatttgaaaaattaatttctagcctaatcttgtgctagacattgtctcttagcctgctgtgttttcctataggtgatagcagatacataatgctaaacatcaggtttgaaattactgtgctgactttagtgactgagaagtatcagtctcttattgggtaggggacatggggaaatgtcatgtttgacttgacatcacaaacgatgttttcattgcagttgcagatactcgcagataccgcaccagtggctcggatgaagaacaagaaggagccggtgccattaaccagaatgtggctctggccatagcagggaataatttcaatttgaaaacaagtggaatagtgctgtcttccttggtatgttggtgcacatgtgtctggttgatttttcatttcatgtcttctgtcttctgttttgttttgtttgtttgtttgttttgagacagagtctcactctgttgcacaggctggagtgcagtggcgcaatctcagttcactgcaacctccgcctcccgggttcttcatgcctcagcctcctgattagctgggattacaggcgtgcaccaccacacctggctaattttttttgtatcttttagtagagacggggtttcgccatgttggccaggctggtctcaaactcccaacctcagatggtacacccacctcagcctcccaaagtgctgggattacaggcgtgagccactgtgcccagcctcttctgtcatcttctgatgggagaactcagcttagagcaggcattgattatttccgcctcattttgctggaaagaatcattgtgaggctggcagctgaggtgcacacaagtcagaaagggttctggcaacagcaagagatgtgcagatcaaattcaggcagtcccagtggtgctgagttcaagttcaagaaaccggaaaagaggaaaacttgggaaatctgaaatccttgcaaaggagatcaaaccaaggctctctgagggtggaggcttaggctgtgttcagtctatgtgtgtgtaattcatacagtgtaatgcctccaaaaaaaaagactgaaggaggctggtagcttagcgtaagggcttcttaaacaagactgcagcttttctaggaccccagggagcctaaggagggttgtttggctctgtccttttgcatggactctgtgggctcaaagaggggctcctctgggaatgtatcctctgattcagttgaggtgggattcatctctgttcattgatgagctctgactatcccttgtgaagacagcactgcatcctccaatgtcatttactttcacatttcaatgtagggtatagatgtgcagagaatttaactttcttctcccgtgagaaagcagcatcctgacctaactcttcttgctggatgactttcttgtcttccttcctgcacttagcaagctccatcaccatgaggattggggggacagtgaggcaggaagatgagacagagaaaagacatttgagatttgacatcaccgatcttactgttggagaaatattgtgtgacctcctccacctttctaatatccgtcttaccaaagttagctgcttgaggtggtatatgccttttacattatttgcctctaagggaaaaactcaaaagcccaaagttcacctgttagaacatagtccttgtgaggttgtatctcaagatttcctttattcttgtcaacaaactcagaataactaaagttaaagttgctttataacctctattatttccatccaaaactaacatttccctcccatacccacaaattcctcattgcaatttcaccagtacattccactggatattagctacgctgcatgaaccaagggtgcagcctcattgttgttgtttgtgttgatgagatgagtaacagagagtgcgctcagcactttaaaatgaatacttgtggccaaaatattaaagcaaatagcctgaacccccacaccccagccccaggcaaacataaattatggttaaacttccattacagagaactccacaaacatggatttgattaatttgctgagcagttcatgacccttatgttatactttgcactatgtaacaaagaagctaaatcttgaacagcaagcttattcatggcacccagccagtttccttctcccctgtaagtctaaccctctgctgcccagcacgaaggagaaatacttggagatcttagcagcatgaaagcctctttgtatcactgggattgcagcacgcatgatcaaggcccaggggtgatcaccaggccacactgctcctaagacagaggtactcagatacgtggctgaaagcctagctcaaatactgccccaggtgagcctctttgctgagtagcgctactcaaagaacacagcttcccctgcctagggaaggcagggctactggcaatagatctccagcctagcagtgatgtacagtcatggtattttaagagaacactttgaatttttctgttgcttgactgttaagcctcaaatttttctgttgcttgacttcttccctggcctccatcccccaatctgcctcccttcagccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataaggtaagtctggagtggcacaactttataccagctcttatctctcaattgcaattctgtcttcttactcatcccctttgtttgggccatggaggcatcattaatttttctcatttctgtattcaaatccataacccatttgtaggtatagatatgatcatttcacagggaaaggatctctgccttctgcagagagaaccccatttctgttgacagagttttggcccataggatgctccagagcagcatctcagtgaagcacatgtcaaacttagctggcatcactgtggagtgtactgttttggtaactctccccatcaacggagatctcaccaaaggacatgtcctcctacctctgtcttgtccagggaaaacagagttctgacaaagtcagtacccaagtcctgcagaagtcaagggatgtcaaggcccggctggaagaggctttgctccgtggggaaggggccagaggggagatgatgcgccgccgggctccaggtgtgttggactggcccttccctgctctctgtcaagcagtttttcactgtttgtggggaggaatgtcctcccaacatgattagacaccattactttcttgagatatttacggtagtgtcagagacagcggattctgggagtctgtgtgtgacatttgtgttagccctgtgcctgtgagggaaagcgctgttctacaattgtaggaaccctgaaaacagcaccaaatgacatcttttaattaaaactcgttgatggtaaaaggtcacctctaagaatgtcagtcatggatgaggtggaaggtgtttccctcaaggctgaggcctttctatgtgacctttggctagtctatccggagcatggtcaagaaactgaacagttctggccccaagatcatcttctcgatcattcagggcactattagaatggaaccagttccctgaaatggcttcagagtgtcccagtcattcaaggattccaccacaggaggaatgatctcaaaaaggctgagcttgaatagaatgaaatccccaggtaccctcagtcttattcaccatgctcaaagtaaaacagagtgacagcttattgtattcgaagggacacagtggcagggaacttggagggagctcatagttttcagtggtggtcaggcaccctcatttgacacccatactttcatacccaataattcagtaagcccccagagtttcacaggaatcctctgctcatgagaaatgtctctctgacactcagaaaggcagaggttcttcttatattctagtctatcaatcaaagagcgggccaacttggacataggtgtggcgactttgtctcctaccagcaacctgcatggactctaattagcccgagaaatggtgctgaggcttctcagttgagcttgttatgaacttctggttatcttggagggtttcatgctaatcaaattcctatcatgcatttcttaactcctagggaacgaccgatttccaggcctaaatgaaaatttgagatggaagaaagagcagacacattggcggcaagctaatgagaagctagataagtgagtcactcggcaactttctgctacttttacctaaagtccaaaactatttttcccaggctgcttgtattactgaaacaactgcatccttccaagggttagaaaatgaaacatcattatctgtgtaaatacaattcatccagggacccaggataatcaaaggtatagggagttgtggtttccagctcttaaaaatttgtcacattgataagcatgtaaagaaaactaatatttctttagcaacctcagatggcttaataaaagcagctgattttgcagggagggtagcagggaaatagagaaagcaggacacggtgcctaggaccgtatactttcaaatcgatatttcctttctggaaatatgtacaagatatacattcagatatatttatgtcagtgctacttaaagttgttttttaaaattgaaaacattctaaatgctccagaatagaaaaatatatttaaaagttggattgccatcaaaatgttttaaaatcatcttaatgacatggggaaatgcttatgacataatgttaaatgaacaaaggcagggtagacacttggttttctagtagtgtgtggctcacgcctgtaatcccagcactttgggaggctgaggccggtggaacacctgaggtcagtagttcgagactagcctggccaacatggtgaaaccccgtctctacaaaaaatagaaaaattagctgggcatgatggcagatgcctgtaatcccagctactcaggaggctgaggaggaagagtcgcttgaacccgggaggcagaggttgcagtgagccaagatcgtgccattgcactccagcctgggtgacagagcaagactccatctcaaaaaaaaaaaaaaaaaaagaacctcaaatctctgatgacatatagtcaatgtattttttaaaggctagaaggaaatttaccaaaatattaattgcggttttctttgggtgctgggaatatcggtaattgatgttttctcttttatactttgctatgtttcctacagtagatgtgtattataatatatattgttaccagaaaaaaaattataaagaaatgaaagaataaaaaaacctgtttggatcaaaatctatgctatagatgaatagatatattgacgtgtattgctatatatgcaacaatttagacatatgaaagctaaaagtatatatgtttgactagatagcacatgtttccgataccgtttagccacaggtagcctaatgagtcccagggtttgctgagcaaaatgtcgtagagctaaaatcacccctcacacacagttgacaaggtaggataccccatgggtgatgaagcacccatcaaagggggtatggggcagacttgattagcagtgctgttttgtaaataaatgtgagttaatatctttattgttaccacaagaatgaatcattctggttaacttatgggactttggggagtcacatttattttaaaacattaaagaaataagtatatttttattatagatgtgacttggaaacccagttgttggtatcatgcctatttgctttgggtatgttattcttgcactaaattccctggactgatttataaaatacttggatcggagagtccatacattctacttcgggcaatgaacaacaactacaaaatatgcatgccgtgggtgctacagaattgcttaggtggtttagctcatctactctactagattaaaagaagacccctaagtaggcctgttttgcctgggctgtgtaaactggtgttttggaaaacctttcccttttgcttgcaggagcaacacaatattggtccttaccacgcatggcctaccggtttgctctaggttagttctcagccctgcgctacctggtgggctgctggttgtcagagctaatgattcacatctacaaattctcaggggctttgtgctttttttttttttttaaaagggaaaccatagtaaaattataactgttcaacctacctacctggaaaatttataattataataatggtgtctttcaccctctttctgatcatttttcgattattttggctctgtttcttttagagcaatgatcttcaacttaggctgcacattagaatcacctggggagctttaaaacctgtcagtgcccagctgcaccctagactacttcaattggaaactccagcaggacccagaaatcagtatttggtaaaacttcccaggtgattctattgccaccaaatccattgttttaaaggaatagatggtaagcttttcttttcttttttttttcttttctttttttgagacaaggtctcactctgtcacccaggctggaatacagtggcacaatcacagctcactgcagccttaccctcctggcctcaaacaatcctcccacctcagcctcccaagtagatgggactacaggtgtgtaccaccacaactgcttactttttgtattttttgtagagacagggtttcaccatgttgcccaggctggtctaaaactcctgggctcaagtgatccacctgttttaacctcccaaagtggtgggattacaggcatgagccactgcgcctggtcagatggtaaagcttttaaaaaaccagattagtgttagtgatggttgcacaatatgaatgtacttaacactactgaactgtatacttacaaatggttaagatggtaaatttttatgttaggtgtactttatcacaatacaaaaatttgggaaaaaacagattaggacactctagatttgtgctgtccaatacagtagccattagccacatgtgactatcaaatgcttgaaatatggctagttcaaattgagataataaatcaagataagtgaaaaatacgcaccagattttgaaggcttattgtgaataaaagaataaaatatttcactagtaatttttatattgcttacatggagacagtattttttatcttttaggataaacaaaatatattaaaaataatttcactttttctttacttttttaatgtggttaccacaatatataaaatgacatatgtggcccccattgtttctactagacagcattgctctaaatttaaaactaaactagcagtcaattaattaaaaaggatgataaggggccgggcacagtggctcacacctgtaatcccagcactttgggaggccgaggtaagtggatcacgaggtcaggagatcgagaccatcctggctaacgcggcgaaaccccgtctctactaaaaatacaaaaaagtagccgggcgcggtggcgggcgcctgtagtcccagctactcgggaggctgaagcaggagaatggcgtgaacccgggaagtggagcttgcggtgagccaagattgcgccactgcactctgcactccagcctgggcgacagagggagactccgtctcaaaaaaaaaaaaaaaaaaaaggatgatgaggttaaaatggtaaatttgatgttatgtgtactttatcacgatataaaaatttgatggctcatgcctgtggtcccagatactcaggaggctaaggcagagcatcacttgagcccaggagttcgaggcttcagtgagctatgatagtgccactgcactctagcctgggtgatagagcaagaccctgtctctaaggaaaaaaaaaaaaaaaaacttttagatttcatttattttacacatatattatcacttggaaaatgagaaaaagtgtcaagtggcttgggaccagagagcctatcctaaacatgaaaacaagtaaaacacacagaagtacttattttttgagtcctcagtggtatgtaagcagctgcagtgcccccattattaggttaatgggacgcaagaacaggtaagtggtaaccctggcccaggacatatgagctgatataatgataccccaaccccatggtaacatcttggctactgaggcatcttggtaaagtcaattcttcatacctccctttccttgcaactagatttggatgatgatacaaaatatccctttacagcttcacttagatttcataagaatggatgggctagcaaaaaaaaccattctgattccttaaagtgaaacctaatagaggagcgagcaccaggcaatttcccattccctagtgggcaatgaccagtaatgtccggcaggatattagatcacctgccctacaggaatacagtcttgtttcccaatggaaaaggacgaaagaccccacgcacttggctgagcaacctcaaggtgatctttgggaagttaagaggctgactctcccctgacttggctctgaagctccaccctttcctaacccagccgcatcactgccaagttcacatcacatccagtctcactctctctcgcatgttgcaggggcttccccttactcagatctagcaatggttttcatgcgtgaaatacagccatggccctgaggctttaggcaacaatctgagaggggagcttaattgctagtagcaactaataactgcttctctacccatagtgttatttttataattgtcctcatcattattaataatagtggggatgaggatgaccaggaaaccttacctagacagttgtttcgacaagacatgaatcacagaaggcacctgcactgtagttactcagggccagttgctctgttttcatttcaaggttgactattttggagatttctttacaccttggtgtatagattgccatcatgggaacctggccaggtttgacatgcgctttaatttgacctcttgttgtttcctagaacaaaggccgagttagatcaagaagccttgatcagtggcaatctggctacagaagcacatttaatcatcctggatatgcaggaaaacattatccaggtgaggaaaacaaacacccaatctgatttgttggccatgaatatgtttactagaataaggacttctttatgcaaaattgtgaaagacataaatgtgatcccatagtaccttttttaaaaaaatgaagttgagaagtttactatttacaacagtgtctaccttataaattccagagataccaaacattcttctggcttctttgacttagggcttacttggagagggttaggtgtttggccagctgaccctcttggttaaatctgtgtgagtatgtaccaagtttataatatggatgttgggtttatcgtttagtatctagaacagtagtggtaagtagaattttttctgatgggtcaactccagttgaatgatggtcactgtctgatatgggagctatgattatgactaggctaggtaaaaagagtgctaaatttgacaaatgatgtcttctttggacttaaatttgttaaggaaagtcatttgtaccatgaatttgccatccctgctgtagaaaaatatagctttgtgaactttgtaccatactaattttatcttctatgtgattatttccacaaattcccaagctgtctaggtaataatgagtttttaattaccctgaaaaatgagttcttacatgtttccattgagaagtcattcattagagtaggtccaggattgcttttagggctagaagaaatatcgttgaaacacagtgaaatcttaattctctaacttttgaattgtctaaaatcaaagtaatcatcatacaaaaataaacacaaaaagtatgtgatatttttgttgactttaatatctttgataacttaaatgcttggtatcacatttaccttatctttatatagcacaatattaggtgccaaatatctatactagcccccaaatatatttgcagttttcaaagaaagctgaaaccttttgttattatccttggtgttgttagtccttctgtaggtgataaacaagcttctatttagaaacattgctgccaccaagcagcccctgttgtactgggaagcccacaattgtgttttgcatcccataaggaaagctatgtcttgtatacaaagaaagaactttccaaaagatgtgacccaggatgagggagatgggccttataccttcatttaggaacccagaattaggtataaatcccaaactcattggaagcattgaaataaagccatttggaaataggtcttcagttcccatggttaatggatgatacccatggtggctcaccaaactcttaagactcaccactggacatggaacatcagcattactgagctaattgtcaggaacatccagttcattggcacagtgcagggattcaatgatgctgttcttccattcccccaggcgagctcggctctggactgtaaagacagcctgctgggaggtgttctgagggtgctggtgaattctctgaactgtgatcagagtaccacctacctgactcactgctttgcaacactccgtgctctcatcgccaaggtaaacttgggatgcttgttttcttcctcttaattaagagtaagattctcatctagcttcatacttctctcttcaggtggaccaaaagtcacagagcatattaagtggcatcacagtaaaggtcttaagtcttcctaggaagaaagcagatgccctgattctgtgggaagccaccatggagaggaaaagcagtggctcccatatttgaagtgtggacctaactctagaagtttaaaatggccattcgctgaaggtctatgacatgagaacagagatcaactgagtgacttagcaatttcactctttctctgtaatacctctgctgagtgagattaaatcctctatgtgacgcccattagtcttacaaaatgtcatgccataaaatgccaggaaggtcagaaatgaatttctcacggcctgaggaatgaggattatcctggggtaacatgcagattatttttccctttatttatttatttatttatttttgagactgagtctcgctctatcgcccaggctggagtgcagtggtaccatctcagctcactgcagcctctgcgccctgggctcaagcgattctcatgcctcagcctcctgagtattgggattataggcgtgtgccaccgcacccagctaatttttgtattattagtagagacagggtttcaccatgttggccaggctggtcttgaactcctgacctcaagtgatccacctgcctcagcctcccaaagcactgggattacaggcgtgagcccccgttcctggcctatttttccctttattgaagatctcaattggtgccttctacatggggtcttttaaatttaaaaagtaaaattcttctgctcatccttctcaggaccattttctctttcttcatcaccagtaatttcccaggaacccaagaaactcaggtttccttccatcatagttgtgatttcaccagtgaatgcgacctggctcacagtgcagttgataacacagctctgacccttttagctggacagttcattattaaatctcaagtctactccattgcttaaatccatcttctgattcacatagctcattatctttatggaataatgcattaactcttctaggctttttgcttgtccaaatggacatttgcatatttcaacggtccagaaagtgtatcaaactgccaagtgatgcctaatggccctttatgtctctcctagtttggagacttactctttgaagaggaggtggaacagtgtttcgacctatgtcaccaagtcctgcaccactgcagcagcagcatggatgtcacccggagccaagcctgtgccaccctttacctcctcatgaggttcagttttggagccaccagtgtaagagttcaaaccagctgagtgacctggaatcagtagagaaaaattgatgtaaagcatcagctgcgaaaaaaaataaggaaattttgcagtattgcagtttacttctgtcctgtgagaaagaaacaattgagtatgtagatagatagcagcttccattttaatttgcatctaaaagtgaattcatcagataaatgcagtggtctctatcagtgtgtttctaaaatagacagccaggggccaggaacgatggctttcacctataatcccagcactttgggaggccgaggtgagtggatcatttgaagtcaggagttcaagactagcctggccagcatggtgaaatcctgtctctactataaatacaaaaatagccagatgtgttggcgcatgcctgtaatccaagctacttgggaggctgaggcaggagaattgcttgaacctgggaggcagatattgcagtgagccgagattgccccatttcactccagcctggacaacagagtgagacttcatttcaaaaaataataataataaaataaaataaccaggtgcagtggctcatgtctgtaatcctagcacttcgggaggccaaggcaggcagatcagatgaggccaggagtccaagactagcctggccaacatggtgaaacccccgtctctacaatacaaaaaattagccgggtgtggtggcacacacgcccgtaatcttagctactggggaggctgaggcacgagaatcgcttgaacccaggaggcagaggttgtagtgagccaagattgtgccactgtattccagcctgagaccctgtctcaaaaaaaaaaaaagaaagaaagaaatggaagagtattttagattaaaagttatcatctgtgggggaaaaaatacaatagacaggttagaattcagaagagtgtttcctgtttctaaattctgactagctagtgccagaatgacctgtggaagaggattttaaatgatcggtgtcatctaacctgagttttattttaatattttatttatttatttattgagacagtgtcttgctctgtcacccaggctggagtgtagtggcactatcagagctcactgcagccttcaactcctgggctcaaatgatcctcctacttcagcctcccatgtagtaactgggattacaggcacgagccaccttacccagctaattttttttgcatttttgttgagacagggtcttgctgcatgcccaggctggtctagaacacctgagctcaagtgatcttccctcctcagccccccaaagtactgagattataggcatgagccatcctgcctagccaagacttgagttttattcaaagctacgaagactttggagttcagctttattatagaacagtcaagtttgctttagtttgtctagattttgataccttctttggaatttccatttgtggccatgttaataagtatgctcaagtgatatataaagataaattggcccatggaaaaaagtcagcctcctccaaatgtattagggatgattatttaaaagacattcctcaggggaccttgaggtagccatgtttttccatgggcctgtaaagaaagaagaaacaaaaccttgttgcttacccggagttcaaaatctcagaaatgctggccacagaagtcccctgatttatttatttagagacagggtctcgctctgtcaccgtggctggagtgcagtggcgagatcttggcccactgcaacctctgcctaccaggtttaagcaattctcctgcctcagcctctcgagtagctggaattacaggtgtccaccaccatgcccagctaatttttgtatttttagtagaggcggggttttgctgtgttgcccaggctgatcttgaactcctgagctcaagtgatccaccctccttggcctcccaaagtgctgggaggctgagccagaagtccctttcttttaataaagtttaaataaagtcccaagaagaaactcttggcacaaaaggatatactgtattcttggacccaactttataagaatcttccagcttgcagcacaaaggcagcccagtcctcaatgaaaatttaaagggagcctgacagatttatgtgagagcaatgtccatttaaaccatttaaacaacaatatgaatgttgtgcaaagtgtagctcccatttcattgagagaagaggaaataattaagacggggcaaaggaaacactgaggagttgtttgtgtctggccatgctgctttcagttatctactgctaagtgtgtcttatttacttcatcttttttttttttttcactgatgcagaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtacaccgaagcacataccttgtctcatgcatgagtttgggatctgccaactattgtgtatgtatgtatgtacatatatacacaatttatatataaatatataacatttgcaagtatttattgtccaatatgcatgtgctctcagcactctgagaggttttaaaaagaaatacatccatcactgtccccagtctcaatatgctaacagtctatttggagtgctcagtctcaaaacaattaggaggcagtacaagacaagtgatacataagtgcaaactgtgtggtaaggagctaaatgctatggaaggttagaggaagagaggtcgtgatcaataaacaatctggtggccaggaaagcctgcagggagggatgacactaaaggctggggtaggattccgctaggcaggggaaaagtgagggggaaattgtgagtagttgaaacaatgaattgtttgtatctgtagggatggtaaagggaccagcttgtctggtgaggggtaaggaagggccgagtttgagagagcttgtaaacaaggttgtcctaaggaaatgtgtaaggacagtcatctcttccatgtccattacgatgaccgtggaactctagcctgtcccatttgtcttttaactccagctcctagcctgctctatggtagggtcttaattaagtgagaatgaatgaatgaatgttttcttttattcccttagtctgagaaccctatttccggagtctgttttgccctctcgggcaatgttgcatcctcattctcagaatctttttcctctcctctacatcaaatcgttcctctctcatttcatcttgaccatactcctttagttccatcatttatatagaggtattcaccaacaagaccaatcaaactatgggcagtttaataaaggtcttcagtgccttcacccaatgaaatgactctagtggtagaaattttaggagccctggcaagctggcagaggggaacggggataagacaacattctgtggctgagttacctgccagggtctctagatcaagccatagtctctccctgtttttgtactgcaggctcccctggacctccactgttggttttataattaagaataaatgattacaagaggttctaaaatctctgaagccctgggaagatccaggaggcttctgagacatggaactcaagctgaggtcctaagctgcttcctacttggtataaaaatccctgatattccagagtagagtttagaacttttcaggttacaaataactgaaactggttcaaactaatttaaacaaaaatgttggagatagagatagtatgaggattcaggcagatttctggatctcaagggccaacacacatccaggtctcataaactcctgggctggcgaagatgaaaactacagagtcaggtctagatgactccgccatccctagtctctgctgccctctgatccaacccttcccatggcttccccttgcatttcaatgtaatcctaactcttcacctgggactacaaagctaagattattttgaggcttacactttttgcaggtggaggaacttctctgtaatctgaatagcatcttatatgacacagtgaaaatgagggaatttcaggaagatcctgagatgcttatggatctcatgtacaggtaagctttcctgacacactcaagggacaccatttgggggtcgaggatttgtcactgtggagttcttactaatgtaatgatcacagctaacatggatatagtgatttggatgatagccaaataatatatagaaattaaacattcagagtaggttaattcatatgtaagttttcagaaggatctccctaatttaaagtgaggcataataatgttattaaatataataacattattaaatataataacactatcttctacttaccacagaatcagagaaagaataattaactgttataggaattattttccatatgcttttgttccaattatattcagacatacatatatagttttactttagaaatcattttttacgcgtagtttaaaagttggtcttccagtccttgttcaggagaaattacttacagaggcaaaattgttctgatgcaacatcatacaaagggcagtacttttgtcttctgttttattttgagagaaaggaaagaaaaggcagaaatttgcctgagagccattaaaatagacatcatgttatcaggtattttttccccataaggcttttactaagtactatttcttggaggtcagcacagcttaaacatggaataaaaatagttggactaataaatgttttcttctgtctcgttttctggaaatatagggcaaaatctcaggtggaggggtacagggaactcttggggagaaaaaaagaaaaggtcacacaaagtagaagaacagtgtcattaacccactgtcctcaaaactacttctcactcaatctgtcttcagaattgccaagagttaccaggcatctcctgatctgcggctgacctggctccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccaggtagggtgtgtgcagcttttcccttagagcagtggttctcaactggggcgattttgtcccccagccccagggacatttggcaatgtctagatacatttttggttatcacaactgggatgggtgagtaggtgctactggcatctgactggtagaagccaggatgctgtgaaacattctgcaataggagagctcccctgacaaagaattgtctggccccaaatgtctgtagtgctaaggttgaaaaattccaagttcatacattacatttgcttcttctaattgctttcccatcgtcgttgggttttttttaaattactgtttacaataatggcacctagccattattaatagcactttaggagacatttgcaaacactttcacatgcatggcttcatttgaacctccccgtaaagctgtgaggcaggtaggtagggaaggcggttattattcccacttcgcggatgagagaactgagagagcaagttttctaaggtcacttaaactctttttcaaagacttgtagttgacacagtatactgacattgtgaaagtttggaaaacattggataaatgattttcctcctggcccattcatttgattccactcttcaactttataggggcccactctccaatccaaaaatcaagaaagaatcaaattgacctgagaagggagacaaaaggctgaatcagtaccttcttaggataagctgaaaattacccacatttggcaaagggaaattgtctgccagacctaaaagctggctcggatggggatgctcagtggccacttaaagtgttcttactgaatagtttaatagtctttagagagagagaaaataaaaaagcacaatgttgggtactttttttgtaagagacatagtttgtagagatgaccatccctgaaaccatgaacaatatagctacagtaatagagtgtttttcaagccagactcacgaagtcatttacaagggtttgtattattcttgtttgaatttacatggctgattttatgaaaagctttgttcttgttattgttcttcaacacaattttgtgatgttgtatgaaccagaaagaaagaacaattcaaagtagcttccccaggcttagagaataagtcactgaaactatgctggtgcagccaagagcttctggttttccagaacacagcaaagctgggtattgcctcctatgaataactcctcctttcttatggtcctcaagaacaaaaatagtcattctgtgatttcatgcttggcaaatgaattttcttcttaattcagaaatgtttgttataaaagctgataattaaatctcatccaaaagcataaaaataacacctgatttcaaatcacatagaagtgtacaagaaagttataaaagttattttagatgtatttgcttcttttctcaaatttattttgaccatgtgatactatcaaaaataaatattatagtactactctttcaattcccaggaaattgtaaggtttagcacttcatattgtttcatttactaaattattttatacttcttttattccttttcccatgactatattttattttatatttatcacttaaatatcaattgcatttcattattgacttttatatttagtaagccttactgttctaattttacctagaattcagttgatttgctaataatgacatgccaaagtgaatcattattacacaatcaacagaaatattccacattattccgacatgggggcatacagctctatctgttcacatatatttatccattgattccttcttttagagaatatttattgaatacttattctgtcctcatgaacgttacattctaaccagagagacgtaatataactaattattccaatctttgttcagttataattatgagaaatactgttataaagaggcacaagatattgtgagcatttatggtccaggccctgtgggtcagggaagggtgaagaaggtgaaaaggaaggcagaagaaactgaagtgtgagggcttcttgatgtagaggaggcaatgagttaggtgttgtcagctacagaagagaagccaaattatattaatgtgtatgagtgaattcttacttctctcaaatgggacataccaaatcaatttggaaatgtagctggcaagtgaaaggacacccaacccagactgacagaaggtaaaaatggaatttatcagcccgtctgaggaatgtgagcctggagtagcacctgccatactggacctaggggcccaaacaatgtcagcagagctcactgtcatcaccacttcccatctctgccatctgttgtgtcagcttcattcttcacaggcttcccacaccacagtttaggtttacatctctaggttcaagtctaggagagaagagagatgcctcctttctagcagttgcagagaaagcctcagtgcatcttactgatcctgtctgaacatctgatcctgtgctcatccctgaaccagccatactggccagagaaatggagtgctctgatttactgaccccgggtcatgggtccacacctggaattatgggtgatttcttcccctaaatcaggatgccttactttatagaaggaggaaagaattctagacagcattaacaacagatgtccagtgttgattttgcaaatgctctgtgctttaattttcaaccttgttctgctccaatgaaatagagcttttggaaaagatttataaactagagataaataaatatgtgcaaggaaaataactttgaggtcactgaattccaggaaactgagatcactgaaattctgtgtcccagagtgcaatatttatttcacaactgtagatacggacacattcttagatactgctgttacttgtacctccctgatcctgaagccaagaaagtctgcagaatccttttcctctgactacagctaatgaggctacatagcttcaaatctgttcctctaatgtggaaaattgcatacattctaatagtattagtatcttgggttattaaatgctttcaactgaatttcttggatcttctgttgtcacagaaacatcataatacatagggcaggtttggaagaaagactggccacaaaggctttgagagcctcctcctatattcctaaaactacgttacagtattgcatgtgaagagatagggctatctatgacaactatgtcctgactgattgctaaggttgattcacatgatcttgctaaccaggccagaaggcagacagcttttagttcacaagccaactctgatcagttagtagtggctgactggagaactatgcttaagaatttcgagactatgtccaagctctggggaaaaagtgctacagttgattagttatgcctgccatgattacagcaataggaaggagtggcatgtgtgccacctgtttgtaatccctaaactgggaaggtttcccatttcttctgtttttcatatgcatttcttccatagctgtgagctaggaagaaaatgattcttgacctgtcacatattcactgccagggccagtgctagggtgaagaggcactcaccctcagggtcgagcgggtacaagatcagtacttccatggccctaaaagcgagtacctctctaaattttgtcttgggtttctcatttggttcaccccaaccatggtctctgcatgctctgctagaggctctaaacgcaatagtttatgtaaaggaaacaaatgcatggaaacaaaatgttcaggaagaacaaaaacacacacacagtaactgctgcaatgccatgaaaacttccttaatgaagacagcctcgcttgctgttgtcgtatgtcatggctgtttatctgagtcaactccagagtagcaacatacttcagaaaaacaccactgtaagtcagaggtccactcggtgaaacagggagcctagttaatgttaattgggtctttgccttttgaaaaccaggacaccagccctatgtcccttagggttgtttcactaaagtaactcagctgttgtgacattgaggtaagtgtcctttatacaaaatctcctaatggttaaaaagaaaaacgtgaggtttgaagaccagttgctcagtgcgcctcttctaaatgaatggcagacagatactctcggggtagaattacagacctagtttagtcacggtcttggtaaggatctgcacaccagcttcctcgtttccccattcggggttcctgtggtctcttactagtctggtcgccctgttctccaggcttatactgtggtctctttcagaatatttcttccaatgtgctggaggagtctgtggtctctgaggacaccctgtcacctgacgaggatggggtgtgcgcaggccagtacttcaccgagagtggcctggtaggcctcctggagcaggccgcggagctcttcagcacggtcagtgcccagagggcatcccggggcctggcctcccatactccagctggacttggggtgctgggaacacctggtcttaatggcccagtcagccccacttcccgaggacacgtgccagggtgtgcggggcaggggatgggcccggggaggactttgatgtatgcaaattgcatgagcttcccaagggagctgagataacctttcatcacagtgccgatctgagcttcactgtatgctcattggttgggcagcagtttcacagtattatttctatttaataggggtggaactaagccacagagaggtgaaatggcctgcccagggttacacaataaatgatgaggcatgttttcactccctcgtttttcctctcagagagaaaaaaattagggaggaaccactgggaggagagaggaggaatacacagacagtgtcttccctcctagccactgtgcagtctgaaggaccatcacagaccaggaccagcttacagaaatgtgggcacagaaaccactgagactcctctggttaacgtaatctggatctaaacactcctagtatatatactagaaaaatatatagagagatgaagtcattgagattcagggcaaagaggaaacactcttgtctattttcttttctttttttgagacagagtctagctctgtcgcccaggctggaatgcagtggtgcaatcatggctcactgcagcctctacctccagggttcaagcaactctcctgcctcagcctcatgagtagctgggattacaggtgtgcaccaccacactcggccaattttttgtatttttagaggagacaggatttcaccctgttggccaggctggtctcaaactcctggcctcaagtgatctgcccatcttggcctcccaaagtgctggaactacaggtgtgagccaccacgcccaacttgttttcattttaataatctccctcctcctttacattttaagccaagaaagtattcagtactttactatatttagctgacccaattttgttttcatctatactatactcatccttattttccagtttttatttccaagtttcctctctacaattttatttattttaattattgttttaactgtcttctctctattcttgctttccttttcaagattcagaaaatgtctaatatactctcatttttcctcaaactcaacaaaatgaattagaatcctactaactctttggaggcatacatttagcatctggctagaggaggacctctgatgaaatttaaatatactaaaactgcctttctgaattgctgttagtccctgctaccaaacttctctcctgttttttcttttcgttttgttttgtttttgtttttgtttttgaggcagcgtcttgccttgtcacccaggctggagtgcagtgatgcagccttggctcactacagccttgacctcctgggctcagcctcccacctcaaccgcccaagtagctgaggctacaggagcatgctaccacacctggctgattttttaatttttttgcagagatggggtctccctatggtgtctaggatgatctgaacttctgggttcaagtgatcctcctgcctcagcctcccaaagtgctgggattacaggcatgagccactgcactcagccagtatttttttttcccccgaaagctcttctccttacttatcgccatacaggactacttagcgaggtgtctagttcagtttgaaggctaccactgtcccaaaagtgctcagataccccttcttgccctgtgaaatactgtgatacaacaataaattcactctccagcacattgtttggacaatgacctctggttgctcttcttaagtttccagtggattaaattctctctgatgctcttctcctctttccaagggaggcttatatgagacagttaatgaggtctacaagctggtcatccccatcctagaagcgcatcgagaattccggaagctgacactcactcacagcaagctgcagagagccttcgacagcatcgttaacaaggtagccggggagcctggctggcaggtcttgttacctggtggcaggcgaccctgtcctacagatgcttagccatccttcctctccagggagtgatttatctttagcacattgcttttgctctcacctgtcaaacagaaaagggctgaaattcttctaacagaggaccaaaattccatatgtgaaaacatacagcttaaattactttataaccaggaaatgtgagaaatttttaagtgtaattaaaagaagtcccagaaatctttcatgggattccttttgttgttatttctgaagtttattccataagcattaaatttttttaaggagtaatttctgtttacatcagccataggagtaaaatgctttgttaacacaatgagagacccctgccctttgcaactcagtggctcctcaggatgacataactaaggagagctttttatattttgttcctcaggatcataagagaatgtttggaacctacttccgagttggtttctttggatccaaatttggggatttggatgaacaggagtttgtctacaaagagcctgcaattaccaagcttcctgagatctcacatagactagaggtaagaaaagtgattctgtgcgcctgacctggtacactttacaaaaacaagttagagtgggtcatcaccaaaaataaacaaataaagagttatggattcatcattgatctctacataaagttttcccctttgcatttataaaaggcaaagtagaaaggtattaggtgagatcatgaggtgatgtaatattttgatagtttttccctaatactctgtgtatgcttttcacagtttggaattttatatggtgaatatttattttgaagtctgtgcaaaattcaatcaaggtcatgtgctttcttatcaccctttccaaatattagtagtttatactagtagatagagagtagtagagtttttcaacatgaagtttagcatcttgactttgaagtaatctagccaaatgactgaatcacccctagataatggtgaggccatcctttaggtatcactggatggcacctggggtccttctgatgtggagctactcagctgtggccagcccggctccaacctgccagtgagtgacatttggtccataatacaacagaaaagtgtagcatgttgttagaagcaaagctgaaagcatggagaaaaagagaaacagcctagagaaaggtcaggacaaaagaaacacaggttataagggccaaacactaagaactcagtcaaaggtgcctccccgatgggatttggatgaacaggaatttgtttacaaagagcctgcaattaccaagcaggactggggtcctttgaactgctcacaattaaccaaagattcactccttaggctttcattgctttgaatttgtgccctcctatgagtgtaaaacttaaaacatttgtgttgcctaatggcttcgtacactctccatccatgccaaaaaagacaagagggtttatccttacttgactcaaagaagccattgcccagggtggctgggtgagttgccccaaaattgtttagcacatgagaaaaagagctagcaattgaccccagtccacttggttccctatattgtttcccctacttagaattagaggtatatattttatcttcttgtgcactgtgatttgccacaatatgggaaggctggtgacttccaagttcccagggtacagaaggcgagaagtaaagagtgtgataccccaggagatacctcagcaaatataatgatgttagctgaattagaggccaagcatacatcttatagggaagcatataccagttgacagtgctatttttatttttgtcttaggaaatgctgaactttgctcattagctcagaggaactctcaataatcagtgaacatcattctaccttgcacttgctccaaacttatttcacttccaagaagacaaagagttgcattatgttaaaataacctttataaactgttggttcttcttacctaggcattttatggtcaatgttttggtgcagaatttgtggaagtgattaaagactccactcctgtggacaaaaccaagttggatcctaacaaggtatacaaaaatttacaaaaactaaccatcaagctctaaatcccttcgttctctacccaagaatacctaatgatctcatctatctggactctccaagtcacttaaatgcagtcaaaccttttcgtctagagttcaactactaattggtcagatcttaaagaaaatatagtcaaaggcaggaatcataataggagctaccacttattaagcaccaactgtgtacctggaactgcattaggccctctacatacatcattttatttcatcctgcaacgacccctggaagtagattttgtcattcctattttagagatgagaaaactgagacatggaagagtcaagcaagtttcaaggtcatgcaagcagcagagccagtactcagacttgaggtctgttgcttctgaacccctactcttcagcactgctctttactgcctttttataaaacctttaaactctccatttcaaactcgacaacacttagtggcttccttctttaggctgcaagtattccttccatccaagtccgggatcactgtgctgttgggggaatggtaaaaacggcttgggtttgggtttcctcactttcacaagagggtatgttccatttcaccccaaaatgggtgtacagttctgatgctaacacgtggaggtggtatcagctcccacagggtaaaggctcagtcctcctcaagactgccctgacttcagatgccagcttcaagagggacccccaggccagccacgcttctgatcagccagctacaaatttgggagtttctataacctgttagcttgaaaataggagaaaacaaagcaaataataataataataataataataataatttgggagtttctatgatacctgttagattaaataattcactacaatgactcacagaattccaaaaagtactctggttactatcagagtattatgataaagggtgaacatctttttgtgcctttatttatggcttcctggctcatcagtgtgttctccaaccaggaagctccgccaagtctcagtgtccagagattttgttggggtttcattatgtaggcaaattgaatacagtctccagcccctctcctgtctccagaggtcatccagttcctaccctgtaatcacagaattggtctttttggtggccacttggcatcctgaagctatccaggggcccagcatgagtcacctcattagcatcacaaagacacccatcactgaggaaattctaagtgtttctaaagctctgtgctaggaaatggagacaaagaccagacatattctttattataccacaagctgatgctgcccactcagcccaactcacatgtccatgaatgagctttctaagttactggaaatagtgcaagtgcaaggtatcattaagggccctgggacagaggaccattcaccatctagcaaacctataaaatgaaaggtccaaactcccagttccatcttccaggatatgaagaagataatggaagaggggaagaattggccaaattgaagagtttgtttttctacatttttcagaatgctttctcacttaagacacattccctagcctcggcttgaaagcagtggctgtggtaagagtttaactaatcttcagacacacatgtctgggagatggagttggccgtgtgcccacagtgatctgtacatagcacaagctgtgtaaaatgtgacctccctcagccaaggtgcccttttcccctcttttaaaattcccagggtaggttgtgagagtttggaatgagagtctgaacccagagttacaaccagatttcattatactaagtcgtgatttacagtctgaggtcagtgaccccactcatccctttcagtgggtgagtgtcccagcatctgaactcatggtcactttttttcctaagagattgtcgtctttaatgagtacttattcgctctgtgtttgagggtggaggtgatgtgagtgtgtgtttaaatgaggcctaggcagtaaaattcagttttggtgtttagttctatgagttttgacaaacacatgtgactaccttcataaccaagatatagaacagatccaccactccaaaatacttcccgtgcccattggtagtccatgttgcaatagttccttcctttccgttgctgagtagtattctgttgtgtgactacctcaccatttgcttgttaattccccactggagtgacatttgggttgtttctagtctttgttatgaataaagttgctggagacatttgtgtacaggtttttgtatggacataagctttcatttctctcctgtacacacataggagtggggttgctgggtccaatggtagtgcagtttaactgcataagagaccgccagcttcttctgcaaagtagctgtgcattttgcattcccaccctctgtgtatgacagctctagctgatctccatccttgccagcacttgatattgttagttttctttagttcggccattcatgcttcctcataactgtgaggtagtcattgtcattctgtaaaggaaagtttgtctctttggaatagcagtttgcaaactctcataccaaggcttccactgtggatcagtttgctctgctaggaaggtgcggccggtggccctcactctccccacaggcacattcccctctccctccttgcagccccttctgtccttgggggtggagaggaggaacttctgctggccacattctcccctgcatctgtagcttttctgcactgggcagggcggtgccggcacgccgtgttcctgcatgcccctccattgcgtcagggatggccgtttgcagaatagctcatcttctccctccgtgccttttcccccttaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggaggtaatgcacccaagggattggccaccactggatgagtgggctgggtggcctcccaggaggacccacaaacctctttcacagtggattggactgaaaacaaggagggatgcacttgaaatatgattatatggttgtcctttcactctcatagtgccagaaaatcccatttaggcagctacatattttatagcactattgtatattaaatatttaatattttaaagttatatctttagtataagtgtgtttatgtatttaattataatatttaatatatatttcaattataaacttgtacaacagatatatttaccttttaaatattttatataaaatttttctatatttcaaagcttagaggtgattcaagcatagtcgtgctgttaattattggagacgggacctgcacgtgggcagccccagtgaggcggtggtgtgctgtgggaaagggccgtgtaaggtagacaagttcactgactagcttctagtcctagcttcctcctgtgattttaaacaagctacgtaccttcagtttcttcatctatgcattagcaggaaagacctctaagtacagtacaagattatactcattttattaataaaaggactggtcaagaaggtctctcaaaccacagaattgttcaaaattctacacaccataaacaacttattattctttaaaacacatatatatacacttatttgtcgtcctttttatgcagggccacagacttctctgtgactgtgggtttgctgatcacaattcagcattttcttttataaaccacacccgtagtgctttgtccatgattttcagttttgctttgtgtaagcagagtgagagcttaaagatccttgttaaacaatttgagagcagaagccttctggatgtttatgatgtttttctccccgagactttgacagcagtcttgtgcacacctaatatgacaggaatttttatagcaactcactttcataatatcttgtccaaccatttggcttggttttcatagaaagaaatctttttctttccacacccatggttcatcagtttctccattatctaattagattgggtcattaaaataacaagtataacaggcataatcaagttggtgaacaaacacagatgaattgtggtgaatatatacctcatcaggcagaagcagaaatagctgagctaactggagagtcatccagcaggtagtgttcagctgggtaaccacatcagggtgtggctttcacagaagctgaagaaagcctgaagcagtgactcagtcgggaggaggtgggtttagaagccatctgctgtacttcctatacttcttggtttggacttttgaacactgagacattctaggcataacacagatataaactcatggtgcccaaaagcatttcaaaaccttttcttttcttcattcctgccttcctttcctttccttcctttcctttcgttcttcctttttttctgtgtctctgtctctctttctctctttttcatttttgagacaggatcttcctctgttgccctagagtgcagtggcatgaacatggctcactgcagcctcgacctcctgggctcgagcaattttcctacctcagcctcctgtgtagctgggactacaggcttgtgccaccatgcccagctaattaaaaatacagagagatatatattttgtaagagacaggggtcttactttgttgcccagtctggtctcaaactgttggcctcaaacgatcctcctacctcagcctcccaaggtgctgggattacaagtgtgagccactgcaccagcctgaagttttcttggccttccttcgttccccaacaacctcaacaacagttctcagctgtttgctagggctgtagaacaaagttccatagactgggtggcttaaacaactgaaatttactgtctgcacaattctagaggctagaagtttgaaatcaaggtgccagcactgttggtgccttctgagggctgtgaggaaagggtctgttccaggcctctctccctgacctgtggacagccctcttctccctgtgtctcttcacatcatcttccctctgtgttcgtgtccagatttcctcttctcgtaaggacaccagtcatattggactagggcttaccctgctggcctcattttaacttgattgcctctgtaaagaccctatctccaaagaaggtcacattctgaggtactgaaggttaggacttcgacatatacattttgggggaacacaattcaacctataaaattcagaaaagactctaccccaaaccagcagaacttagcaaatagattgattgacccttaaaagaattccatttactggaaattcaccctcagttggagaaggcacaggtgatatcaaaagcctgtgttatgatgggggagaaaatcttgagtgctgtgcttctactacagctttctgcattgtaagttgagtaacatgaggctgtgtgcggtggctcttgcctgtaatcccagcactttgggaggccgaggcagggggattgcctaaggttgggagtttgagaccagcctggccaacatagagaaaccgcatctctactaaaaatacaaaattatctgggtgtggtggtgcatgcctgtaatcccagctacttgggaggctgaggcaggagaattgcttgaacccgggaggcggagattgcagtgagccaagatcatgccattgcactccagcctagacaacaagagcaaaactccatctcaaataaataaataaataaataagtaagttgagtaacttgctcagtaataggaaaaggcacctgacagggtagaaaaaacatggactttgaagatagacatacttgtgatcgaattatgacctcctcccttactacctgtggcattctgtggaacttaaccttacaaatccccctttgactgtaaaatggagagtataaagaggttgttgagaggaataaatgctaaatgtatgtaaagttcctggaacataaggaatcaagaaatgttaggcccatctttctttttaacctgttaagagtattttaaattactctgaaagtctttccctagctgcctcttcaaattcaggtggcctctctgtcatagctccaggcttgtccatagcttatgagaccagacagtgacttccctatgtttacgtctcatgttcagtttgttttgacaccgattgaagttgccattgaagacatgaagaagaagaccctgcagttagcagttgccattaaccaggagccgcctgatgcaaagatgcttcagatggtgctgcaaggctctgtgggagctactgtaaatcaggtaagcaaaaccagaggtggcagctcctctggttcttattatttaggttgtcattatacgtctgcacccttcttccttggggttgatgaggactttgatccatagacaaacacagaaatgttcctacacttaacctgaacacctgtaaggtttagaagacttttaggaaacctcttccctttcatgtaacaaccccaggtaaaaaagaaatcctagagatgagtggaccaggctttaaggagtaccactttctcagaggagtctccacttcggggccagacctgacaatatgatgcaaatctggagtcatgttgaagaatgcttagtcatgaccaattcacgcagagtaattgcagggcttgagactcacctacaaatgcctataggagagaaggaaaaggatctagaacatccaactcttggctcagtcagcagatgaacccagcatgccaaggaccttgacaaccaggaatgacctgggacctgacttcttaggctacttcagacaagactagatcttcctatcagacttcttagaacgctgactcccaagttcagcatggtgctcaagcagtctcagatgaagggaggtaccagcctaatacctctgtccagtgggcctccttaattcaaatctagatctgttcttgtccacacttccacggcagttattcagtgagcatcatgagtcttttctcattcagcgtaattggatttccccacaaaagttctgagtgtacttgacatcaagggagcagaaacagagaagagaaatgcctattacattcccaagatcaggaaaaaaaaatgaggaaacgtttgcctttgtaagtgccaatcctttgataaaatggaagactttccaagcccacaaccatggtctatctgtacacgatggatatctctgactcaatccagcagttatgcaaaatgatgtttgccatgaaggcaactagataagtgaacaaaaatgaatagatcaaggcaatcctgatttttagaaaagcaactcaaagcacataccatttgatgtagttgtattacacttatatatgaatgaaaatctattattagtagtatttgattgataaaataatattcggcgccaggctcagtggctcatgcctataatcccagcactgtgggaggccgaggtgggtgaatcacttgaggtcaggagtttcagaccagcctggccaacatggtgaaaccccatctctgctaaaaatacaaaaattagccagtgtggtggcaggcgcttgtagtcccagtacttgggaggctgaggcaggagaatcccttgaacccgggaggtggaggttgtagtgagctgagattatgccactgcgctccagcctgagtgacagagtaagactctgtctcaaaaacaacaataaaaaagaaaataaatttgggctgtgtatggtgcgcacgcctgtaatcccagcaatttgggaggctgaggtgggtggatcccttgaggccaggagttcaagaccagcctgggcaatgtggcaaaatcccatcactacaaaaaaatacaaaaatagccaggtatagtggcacacacctgtagtctcagctacttgggaggctgacatgggaggatcacttgagcctgggaagtggaggctgcagtgagcagagatcatgccactgctctctagcctgggtgatagagcgagaccctgtctaaaaaacaaaaacaaaacacacacacacagggaaaatacatttatacttctgagtgttcctctaaaacttcagattcctcctaagaaatcaaaatttcctgagatgtccaagaccttccttatttttttttgtttatttcaaaccaactacaaaattaaatgttcaaactaagaagtcactccaatattttctcccaagcaatttaatttccttcatatatgtatgaatatattcatatatatgtgtgtgtatatatatatacatatatatgcatatacatatacatatgcatatacatatatatgtatgtgtatatatatatgtgtgtgtgtgtatatatatatatatatatatatttttttttttttttttttttttttcccaccagggaccactggaagtagcccaagtgtttttggctgaaattcctgctgatccaaaactctatcgacatcacaacaagttgaggttatgctttaaggaattcatcatgaggtaagaaggaaaatggctgggaatttcagtagagcagtggttctcaaagtgcaatcttagaccagcagcttcagcatcacctgagaacttgctagaaagacaaagtctcaggcaccctccagacctgctgaattggaatctctggaggtgtggctcagcaatgtgcagtttaacccgccctccaggtgatcctgatgcacactgaagtttgaggaccactgcagcagagcaacactacttgaactactaatgagtaactaacacgtcaactatgaaacgcttttgtggctagcatcccgtgtgcctcacaatcacttgttgtaaaacaagtatcatcatcttcctcattttacaaaagaggaatcagaggttcagagagaggagataattttacttaaggtcacacagacagttggcagcagagatgagctcaaaccaggtcttctgaatccaaatagtccacatgtccatcaatgtgctgatattccactgatgcactagagtcccagaggttctttgcattggcagtcattgtaatgttacaaatcttataatatcttatttttagaaacttaaaaacatacactgcctcaaattgagagaggcaagttctaaaaccaggcttttcaaaggtattatcctgtgacagttccccatgtcagacaagtctcatctctgttccttaattctgcagtggagctggcttcaagagcagtcagttaggaactgggtctttggtcaaagccttgtaatttattgcaatacagacagatatattgggtctcctatggtcctaaaaatatgagtatgaaggatgtgatggcatttcacctataagagaaaaggacttcagaaaaatgtgtagcaatatttctttctattcaaaaccttagagaagaatattaagtataagaatatcttcacttggcagatggggataaaggagactaaaagtttgctaaattcagtgaaaactcatcaaaatgctagcatttgtgaggttagagatatctcctccttcacaggcttttgcgagaggtccgcaattttgctgcatatacaggagacacactgtgccctgcagtgaatcacagccgcttggtaataggatgtttgtgtggctttgcgtgtttgtatttgtgcatgtgtgtgaacatactcacagattatcttgattaatgttttgatatttgaattgtttcctgtatttgacaacaattctgacagaaaaactagttgttgttgttgttttttcagtacataatacgtatcttttaaaaggctagaaaaatatttggggaattattttattattttattttattttgagacaaggtctcactctgttgcccaggctggagtacagtggcataatctcagctcactgcaacctccacttcccaggctcaagagattctcctccctgagcctcccaagtagctgggactacagacgtgtgccaccacatctggctaatttttgtatttttggtagaaatggggtttcaccatgttggccaggctgatcttgaactcctgacctcaaatgatccacctgccttggtctcccaaagtgctgggattacaggcatataccaccgtgcccggccctattttttattttttgtggagacagggtctcactatgccgtctaggctggtcttgaattcctgggctcagagattgggggcttaaaaaaattttttttcatatatttttatttaaaattcattatggttgaatgcttccaaagttgactatgccccaggacctctaaaaggacctatgaaatgtttgaagagcactcactatattccaggcatgatattagttatgggactacagagatctggcttgttcctctgttcttaatgacaggacatagccctgcatggctgaataatagaatgcagcatatgcacagaactttaagaatgactaactacaggactataaagatcagaaaagagaaatcagtttcaggctggagcatttgtgggaggcgttatggaaaaacaccacttaaatcttgtcttgactatatacgtggaagaaaggcgctagtggggaagagggagccaggacagtggccctgcctgatccaaggtatcactttcagctgctttagttacccatggtttgaaagtattacttacaatatgatattcagagagagagagagagaccacattcacataacttttatttcagtatattgctgtaattgttgttaatctcttactctatctaatttgtaaattaagctttatcataggtatgtatgtataggaaaaaaacataatatatgtagggttcggtaccatccgcagtttcaggcatcccctgggggtcttggaacctatccccgagaatgaggaggactgagtaccactgagtggaccagcaggaccacgagactctgtcaggaatgcctgtgatgcaccgggttcctctaagtccagctggagcagcgtgttctcatgagcatgctaggacaaggaggaaagattggaaatatgataatatcagtaaatgaggctctgaatacaatttaaatgtttaagaaaacttgtcaggagagtgattttcatttacttcagtttgcctcaattttttctactagttataaatcttgcaatccagtatctcacgggtatgatcctttccatgacaccacctaggtaaaatgtacttacaaaatccctactaaacatgcgtttctcattagctcccagccccaggaaaagttactccaaaaagaaccagtgcccagtaaaactagtcccaggcaagagatacaagaggaaatggactttcctaggggtcgctcctttaacaaagtcattagagtttcaataatgaggctatcattctccccagatggcctacagaaatgttggattttcaaaatcaaattcaccattttaaagttgttctcctacccttttaatggtgattccacatgggaaccagtcccacctttctccccactggctgggctgctgcattgttctaggaggccaggagactgtccatgcttcccagacttcactgttcttacacgtcacctgaggatttgtcaaaatgcagattttggcctgatgcagtggctccgcctctaatcccagcactttgggaggctgaggtggaaggactgcttgagcccaggagttcaggaccagcctgggcaacatggcgaaactctgtctctttaaaaaaatacaaaaaaatacaaaaatttagccaagcgtggtagtggtgtgtgcctgtagtcccagctactcgagaggctgaggtgcgaggatagcttgagcccgaggaggtcaaggctgcaatgagccatgatcgtgccactgcactccagcctgggtgacagagaaagaccctgtctcaaaaaaagaaaaagaaaaatgcagattctgattcagtaggtctggggttggtcctgaagcactgcatttctaacaggcccccaggtgatgctgctgctgctacactggaccaaactttgagtggagagcctgcaaagattgcttaatttcctccctttcacatttctccctattacctctccctccttccctgagggcttaatctcttaggccatccttatcatcatttaccacttttgccgtctgcttcctcccaaaaaataaataaataaataaataataaaataaaattttaatggcaaaaaaagaagttgtaaatctcaataaaattatgtgagaacaaaaaaaaaagcaaacatgctcaaactgctgcaccttgaaccaactatagacgtcagttcatccattcattcagcagttattgagctcctactttgtgccaggcactgtgctacatatgtggaaggatgaagtcccaatatcagtaggacaaggctacagacaaaacagtactgctgctcattattcatctctatgtgcaaacacaacagatggcctgccctccacttcattctacagagatcagaagtcgtgggtgagagtgtgctgatggtgcacaactgtgtaaattactaaaactcatcaaactctaaacataaaatgggtgaatgttacggtatgtaaatcataccctgaatacagatagtagatgaggttcctctgttgcttaattgcttctcaagtccaatctggaagttacagcttttaatgaatagagtaactattttttcacgttgtttgtgctgtgtattttctcctccactctgctaacagacagcagaggtgacgcagaagtggaaaatatttggggcttgaacagctctcaggtttcccctttagtaagctccagcttctcagcagacttgggctgtagatcgataagcccagatttccaaggtgaccataaatgagtctctgttgctgagagctaatagcggaaacatttgcttgccaggtccactgcgtctagtgccaccacggggcagcgacctttctgactcagctgtagtggaagcagaaacagccataaagaatcctggcagcctgatttgctgcagccagtactcatccagccagtcctgcaactcttcaaactgttaccaagctgggacctcaatcagcttctgtcttttcctgcaataataaaaaacatctcgggttcagaagccaagacaagaagatagagagatacaatcttctatcttcctcttctgctcccccaaacaccccgaccatttagatttttaaattttcttctttatacttatctggactttctcattcttataaagactaagtgatgttaaatttgtttttaatttaaataaaagatagtagtactcactggcaccagttacagcttgcctttaagagaagtagtttcagatacaccctgaaagggttctgcagcatatatgtggtcataggctcagaaaacaggctgttgagtggtggcgtttttaaactggagttggggtctatgaagaggaaggagaaggaatttgtccgagtagccaaaggacaaccaaatgtgtagagtgtaggtggaaaaagaagcagtagttttaacttgagaccaaggccatatgcctggcttatagctggaaatggggaaatggctttcctaggcagtatatgtggcgttggggttgggaatatgggcactcaagccagattgcctgagttcagatcccattctgcctcaactagatgtgtgaccctgagaagttacctaccctcggtttccccagatgtaaaatcggaataataattgtacctctcccttgcagttagtgacagaataaaatgagttaatacatggaacttagaataagacttcatacatactaagggatcagtaagtgtaacattgttcagtggggcaaataggggactgatggatttgagtgggaaatagagaattaatctgacttaaatacggagattgtctatccatgatttgtctgtctctataaagtttgaatcataagacacagtgatgctgatgagacattggcctgggagcagcaggattctgggtttatatccagctgtgctgtcccacaggtatgtgactggacagggcacttcacctctttgcatgttagtttcatcaactatgaaataaagagactagaatacagcatctctaatagtttatcattctcatattgtacaaatagttcatttacttagcctgggtctgtcaggcataataacgctaccatgtgctctggcttcagctgtgtgcagggactcttctgaacatttgatatgtttcaactaatttaatctttacattaatttatgaggtaggctcttatcacccacacatcacagatgaagaaactatgacatgaagaggttaagtagcttgtttaaggttgcaaagccagtaagcagcaaagcgggattcagagttgagcactctggctccagagtccatcctcttaattgccatgctgagctgttccctctagtgactatattcagttgctagtaacagaaggaagagtagcttaaataagaaatttatttttctctcacattaaataagattggaggtagtcgatgtagagctgtgtagtggcctcataaagtcatcagagaccctggttcttttccaatcctttgccatgccatcctggttctagtgtacccattctcgtggtcatgatatggttgctagggctccagccatcatgaccacatctaggcaagtcaggagtagaaatgaggaaacagcaaaaagatgtgcccatttcccagtgccttcacctatattatcagcgatccctacctgcatgggaggctaggaagtgtaagttttcaggtggtcacactgcctggagttctgccagtagggaagaaagaatggatattgagaaaacaactaacgaatgtttgtctgccacactgaggaacccatgtatgggctgtgctgaaaaaggggggccaaggctgggtacagtggctacgcctgtaatcccagtactttgggaggctgaggtgggcggatcacttgagctcacaagttcgagaccagcctgggcaacatggcaaaacctcgtctttacaaaaaatacaaaaaaaattaaccgggtgtagtggcgtgcctgtagttccaactgctcgggaagctgaggtgggaggatcacttgagcccaggaggcagaggttgcagtgagctgagatcatgccactgccttccaccctgcatgacagaatgagatcctctctctaaaaatagagggggtaccaagagatgcagggggggtgagggcagcatgactactctctctgtaggagaccttaactctataaatggaggccccaaaatgttactgccatcaaaagccaggaatccttttctggaggcgtaacttcctgccctttctaatccctatcaatctggtttctgtagaactgtgactgctagaaaaccccaggcatatttgttctaagaaaatacttgtgttcggtgaatttaccaacaaagggagcatcagaggatgtgagggaagtctggaatggttgtatcactaagtgagagcagcacagatgtttgtggacctattgagaatgttacagataagaccatttttgaaaagttgtttgcagtgtcattttatgatcttgtgtacattttccaagcgatgtggctattctctaggagggatagtagaaattatttcaattttaatcaaataacctagagaatataacccaaatgactgaaaggaagaaatgtagaaaaagtatataaaataattttttgcattataaaagtttaaagacataaagtaatattactacataaaatctaagttttttactccagctattaatatgtttttctttataaaacatcacatttattaattgctgtgtaacaaactacctcacaatttagtggcttaaaagaaaatttaattattatgcatgtggtacataataatttttgctttcctcatttctactcctgatacttgcctatgatgtggtcatgatggctggggccctagcgaggtgtattgtggccatgagaatggttttgctgcaacttggggttggctgggctcagctaagcagtttttgcctggagtctctcagttgcactgagacagtgactaggacttgaattacctgaatgcttcctcactcatgtctggtgtctgggctgagaatactcaaacagcaggggctcctcctctctctaactctccttctctccacatggtctctcctgcatgacagctttagggtaactagacttgtcacaggatggttcagaactcttatagtacagaacgagagagagacagaggccatattaccttttattagccagtcacacagtaccacctccaccacatcctattcagtgtggctgtcacaaagaaccatccacctcttgatgggggcatgggcaaggttctaggagagcacattcttgtggccattttcagaaatacaatctgctacactccagaagcatctgtttgccttattatcatagcttctgatttaattctcccagcaaccctaggagattatatgagcttattatccccattttccagagaaaattgaagatttttatggttaagtcatcctgctaatgagtagcagcttgtttcaaccgcagttgtctgcatataacacatttaactcagtcaagggcacatggtgagcaatcagaaggtgttagctagctgctgctacttctgcaaacaaagactaaggagagtttagctgattttaccaaagttgtccgagtagacttccccaaattagctgttagctttggcaggactcatcccacctcctgtagcctgccaatgttataaacttgggccttgaagtcatcctgaaactgatcttattttacacatggtggtaattgtaactgttagttaagaagcaataaaaaaataataaggggtgatatagatttctcaggattcaaaggccatatgccttcccttctatttcttccctaaaaccgttaattcataaccttagctatcctataatttgcttcaattaatgacaaacataaaagataggtgaaaatccagttaagggagttctttcagattctgtgtgagttaaatcaagtccttcttctatagcaggctaattccatgatgaagctgtggtgctaagtttatttttgcctaggcaggtagctcttccttgccacatgctatcctcttcctctttgactgtcatcctgaaaatgtgttcagtgttaagaggatttgataacaatgtctgggtatctccataacttagtccaaatctggtaccactgttaggaaaataatgtaagccatattgatcacccacgtcttattcatttgaaggataatatagttattactaattattgcgtgttaggtaacatacagccattattctgtccctttaaggtttattgatttgtaagttcccttgggtagaagagtacaaaacaaaaggcaaaacttcatcatgtttaaataacgtgattttcttctttggtgtgtaccgtaccgtgcaggagacagggaaaacaccaggtttaacggtccacaagccagataaccatgatgagttctaaagattttctctgtctttaatgttcttcagttttgtcatgagaagactggatatagctctgttgttgttcattagaggatttatatctctcttcaactctagaaaattaccagctgttatctctttaaatattgtctccctctcattttccattcccttggagattctattagatgtgggttggatcttccttatatctctatgtttcttaaccaattttttcatatttttttattttttaaatctcattggtgatttccttggatctgtcatacatttacttctccaattatgtctagtctattatttaacctttaacctttccattgagttttttgtcttttagcaactgcatttttttttttttttttttttttttttttggtgagacaaggtctggttctgtcacccaggctggagtgcagtggcatgatcttggctcactgcaacctccacctcccaggctcaagccatcttcccacctcagcttcccaaatagctgggactgcagtcacctgccaccatacccagctaatttttatattttttgtagagatggggttttgccatgttgcccagtctagtctttaacttgtgagctcaggcaatccacccaccttagcttcccaaagtgctgggattacaggcatgaggcaccacacccagcctagtgactgcatttttcttttttctagaagttctgtttggtccttttctgaacttttcctggtctcttttttcattttccctgtttatttgtttttatcatggattttataccttttatttattttctttttttttttctagttacatgattacttaggattttatacattttattacctctctatattaactttggttttttacattgttttattatctctaattcttattggactaattcttttgtttgatgcatctgttagttttccctcgtggtggttggtttcttcatatggtttgtaattttttattgtgagctcatctttggcgagagtggctcatatgccctgattgagaatgtgttcctccagaacaactttatgttggtttggctgaatcctagcaatttcagtaatcttggactggcttttaagttattttctcaccttgaagcacatacagtcaaggaatgtacatttgtaacttatactatgtgtggtgcaagcctagaatttccatttctcaatatgactttcttttccataaatggccctaagctgatagcaagttttcattctgcctctctggacatcttgcagcatttttctaaaccctctttcatagatgggatagcttttcaaggctctggacgatatgcaggtggcatatccagaatctccctttgccctggccaaggccacatcactaatcttgtgtgagctttgaagccccttcccctcagcccatagacctatacacagtcctaaaatcttaatgggcagtcctactgacagctgccttgtcaccagctcctgtgatcattctagctttgatttttctctttctttctggcacctggtgttcccctttctctttcaacaagtttttgctgtgctttcctagcacttccatatgtacgtagcaggaggaggctgaatgccatctgctctgtctgccatgttgctgtaaatcacagtgagttttttgtaagtgtaacagcttccattctgcagtgtgttttgagtctgactcttagatccatcacttcctcacagtgttatcttgggcaagcatcctaacatttctgagtttcagaaacaaaatagagataaatgctgactttttagggttgttgggaaaattaaacagataatgcatgtaaaacttcttgaaacttcttctggcacatagcaagtcagaggttctcaattctggctaggttggcttcagtatcccctgggcaactttttaacattagacatttctgggccagaagcaatggcccacacttgtagtcccagctacccaggaggctgaggtaggaggatcactggggcccaggaggtcgaagtttgccatgagctgtgatcatgccactgcactccagcctgggtgatagagtgagccccgtctcaaaaaataataaaataaggtaaaaaaaaaaaacaaacacagagatttctgggtgctacccctcagcagttatgattcattaagtctgagatagatcccagaaatctgcattttgaaaagctccacaggtgatcccgatatgccacccagtttgaaaacgttcttaaagttattcgaaaaatcgtaagtaatttcattgttctcagatttctaagcacttcaaagtcatttatttctcccacactgatattttcatctcagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagaggtaagaacagggcagaggaggcctcttcctgtgggataaagagcagcgcatggggcctagcaccttggggcatgctctgctgcacttggggagctgcagaacctcgaaagggtggaagagggtcccacagtcagagaggctaccagagtgtgattcattctgcctctgtcctccccatccctgctccttgacctctcccagacaccttggtgttggtcttgtgccagggtattcccagggctgaatgatggcctgtgttggtttttttgtttgtttggttggtttgtatgtttgttttggcacagtgtgaaggggtcgcagacctttcacttattatttgctgagttgtccatgactgatgtccatttctactgggtgatccacccccaaccctttctaaaaggctaactgatcttttcttgcttctgtacgctctctttccctctcctccctctcttttcttaatttcagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccagaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaatgtt

SEQ ID NO: 1688 - DNA, 192212 bp, Homo sapiens
cattttgtctcctgtaacaatttacgcgccgtgtaactgtgaatctttcaaaggtatgttttactggagtgatttctggttatttcagaaggataatttgtgtgttgcgtcattaatgaaatagtagtacgaaaaacctatagcatcttttactgcaggaggtaactttccatgccattttttcagaaaatctacttatgacttcagtggcttgctagactggcctttttatttgtacttttcctgtgtttcagaattgcagagtataataaaggcatgtcaagtgcatattgtgtccattttcaggtatattagataagctttacaccaagataaattagatatgcttattggtttaatttgtgctaatatatatttaattgaaaaatcaaaaaaatttttttaaattgactgaagttgtattccaaaacatgcaaaatttagtttaaaatagattggatacacttttaaattttaaacaaggtagagggtttagtgctttgcttttttaaaaagtaaatgaaggctgcagctttctgcagtagttgtcttgggaagtagtgtggacatcactcctaagagacgttaaggaagtttagctaacaggctttaaccctttctctccataccagcttttactcttttttttttttttttgagatggagtttagctcttgtcacgcaggctggagtgcaatggcaccatctcggctcatcgcaacctctgcctcctagttcaagcaattctcctgtagttcaagcaattctcctgcctcagcctcccgagtagctgggattacaggcatgcaccatcacatctggctaattttgtattttgagtagagacggggtttctccatgttggtagggctggtctctaactcctgacctcaggtgatccgcccgcctaggcctcccaaagtgctgggattacgagcatgagccaccatgcccggccaccagcttttactttaatgccacagccttaaattttctttcaggagaaattattttatgtaaagttacaaaggaaaataatgcttaatatctgtaagcattcgtttggtaagtttgctgcctcctcagtaagttttgatgaaagtgaattttgatgaattactaccttagccgggtagtgacgttaacatgtggcttagctgtccattttctaagatatcaagaaaccagcaacaataagtaaaattgttaaattatgcaagaatcacatgttcctacctgtcatcatttagtcttggttctatttgcatgtgaatatcctttagaatatattactcccagttattccgctttacttttctgaatctcttttcccatctcttgacttcaacttcagtatatggctcttgttccttctacctggagaacggaggcatgtggaagcccagaggattgaattcttttttttttcttttctttcttttctttttttttttttagatgaatagtctgcttaggaaatccatctccataatgtttacctggtatcgtgttgtaatgtcagaatgaagtggctgttcttccccttgagtcatcgtcccgaatgaaggttccccaaaagaaatcatcaacttatgtggtgatttccttttacctttaaaaaaaaatttcttttcatggaaagataatggaacatgtcggtaagattcatttctaggaaggcaaaggagtagtttatcatctaaagactctcaacctaaagctgttttagaaaactttccttaaaatgagaagccgtaggttttcgttgcattattttggctaattgaaaaataagaccaagtgcgttctgaccttcgtttctcttacctttatttttacaaccaccatttcaatggcccacttgctgatacaaatgattgtttaattttaaaaagcatttaattgaagtcaagttatttagaacctaatcatttacacgtctttgttgttgctgctgttttgcaagagtgaagagcttggagtcaggtgaatctgggatgaggtacagttgtcatttattagtcatgtaatttgtgacaagccacttaatctctctgaagacttcagtttcttcatttgtaaaattggcataataatgctgtccctagtagggaatatagaattatataatgggtcctttgtatatattggctagtattgctctcttacgatttggcactatggagacactgtgggagattaaaagaagatgatgaataaaaggtgacttcagctctgaagggctttatgatccatttgggagaacaggtaatgtagaatatactggcttcaaaagtggcaggtgtttagaagagaaaaggatacatgatgtgataggaggcaaaggcttgattgagaaggctgagaagacttagagtaagggttctcagccctgactggacattaaaattatctagggacaattcaatcagaattcctgggggtggggaccaagcatcagtattttaaagttccctggggactttaacttgaagcccaggttgagaatcatttaaacagctctgttatttatttatttaaaattttaatgtattttttgagatggagtctcgctctgtcacccaggctggagtgcagtggcgcaatcttggctcactgcaactcctgcctcccaggtccaagctattctcctgcctcagcctccccagtagctaggaatacaggcgtgcaccaccacaactggctaatttttgtacttttagtagagacagggtttcaccatgttggccaggctggtcacaaactcctgacctcaagtgatccacccacctcggcctcccaaagtgctgggattacaggcatgagccactgggcccggcctagttttactttttttttttgtaatggaatttccctctgtcacccaggctggagtgcagtgatgtgatttctgctctctgcaacctctgcctcctgcgttcaagtgattctcctgacttagcatcctgagtagctgggattacaggcagctgccgccatgtctggctaatttttgtatttttagtaaagacggggtttcgccatgttggccaggctggtcttgaacttctgacctcaggtgatccgcccgcctcggcctcccaaagtgctgggattacaggcttgagccactgcgctcggcccatttaaaaaaactttaaaggtagacgtattccaaatggggggaatatataaagaaaggtaacacttattttgccctgtgtgctttgaatttcagaaggtgtagtaagcaaagaccacttactaaccctacagatatatccttagaaaatacagtggtttctgtcataaatctgataaatcagatgagaggaagggtgtatgtttgatgttgatttttctttttgttttattggggtttttaaaaactataaatatcaggtctgatgactatgtgtataaacattttctaagtagataaaatattttcaaattttgcattttttagtatgaaggggatccatcatttgaagttggttttctagatgtgatgataaacttgtcccaggtctatttgacactcctaccaaaatcctttgtgaccagggctagaaggcagctgtggctagtaaataaccctgtgtgtagactcacttattggctttggcattctctattgccacagctgtgtgaatagattaaccagagaccctctggtgccagccacctattcaggcaaacaagtctataatcagtacctctgttaaaatgaaactgtaatatactattgtcttttcatttatttatttatttatttagagacagggccttgctctgtcgcccaggctggagtgcagtggtacaatcttggctcactacaacctccgcctcccaggctcaagcgattctcctgcctcagcctcccaagtaactgggaccacaggcgcaccattgcgcctggctaatttttgtattttttttgtagagacggagtttctccatgttgtccaggctggtcttgaactcctgagcttcagtgatctgcctgccttggcctcccaaagtgctgggattacaggtatgagtcattacacccggcctattttctgattgttcaaagtagaagccaggcacaatggctcatggctgtatgtaatcccaacaatttgggaggcagaggcaggaggatagcttgaagccaagagttcgaggccagcctaggcaacatagtgagaactcatctctacaacaaagttaaaaagaaaaattagccaggcatggtggcacatgcctttagtcccagctacttgcgaggctgaggcagaaggatcacttgaactcaggagttggaggctgcagtgagccatgattgagccacagtactctagcctgggcaacagagtgagaccctgtctcagaaaagaaaagagaagagaggagaagagaaagagagaagagaagagaagagaagagaagagaagacatacaaaagaagagtaacatacaagagaagagttaggagaccctgtctcagaggaaaggaggggaggggaggcgagaggacaagagaagaaagagttaggatctatgccctaaggaagtaaggaggatttgagactgtgtaggtggttaataaccttaagctacatattttatggagggaaaaatcctatttttaaaagtgagaatagaacaattttgaagtgaaatggaatgaattagctggaccataacggctctgactgaagaaaaggatgtaaaaagccacatcctggatatgtaccaaacaccatggttacatggcatgtttgtatatgtaacatttatttaaaaaaaaagtctcatagcttagaaggcatttatttttgttatgtgtataggcttctgtgcaataaagcagccttttttattttacagctcatgatgacttaaatggttaattgcctgataaatatggtcctcttttattcttctgattctgttgttcttttgcacttcatctttcaaggggttgggctattcttaggtttcactgattgcactggaagggacatgacggaaaatgaagatctcaagataattttcttgcaaattcacaatggaagataaaaggaaagagtggcaggcattctgcacacagagcagacgtttctttattgtcattgttcagcagaggaatcaactcagccttggtgaaactagagtgatgcccatggtggcatgtcagcatctccctcttagtggcatcagtgctagattgttgttgttggaagcaggagagtgtttagtccataaagtacagaacttcgatatcacagaagctagaagaactttactgccttcagcttcgtttaaagatagtagagagcttactcattcgttttagaaatatgtattgggtctctatgtcaggaactgctggcacagcagtgagattgaagatacaacagtgaatacaatagagggcctatcctcatagagtttgcctttcagaatgagggacagacgcagacaaatagaaaatgtcgattgtgtcagggagtattgagggctttgaagaatgaaatcgtgacccagaagagatgcttttagattggatcatccgtgaaggcctctatctagaaaggagacacttgggcagaattctgaatgaacttgacggacatctgaaggaaaaatattccagtcagaaggaacagtacgtgcaaagtccccaaaacttcaataagtgacgtgctccagaagcagcaaggaagcagaatgaggcctgaacagagtgggcagtaggaaatgcagtcatagagaaagcagggctgggtcacaggcctcagagactgtagaacattggctcctactctaagacaggaagctgctgtgagcattgaggttgggcgtggaaccatttgactttttatgaggatcactctggctgcagtgtggaaaatagactggacgagggagggcagttaggaagatgtcacggtaactcaggaaagcaataccggtgctttggacgagggtggtggcagaagagaaagtgagaagtattctggatatatttcagaagaaagtggataggattttctgatgggtgatatgtagagtgtaggagaaagagaagaagcaagattgactttaatgttttccacctgggcaattggtggactggaattgccacttgcagaagtgtggaggtatggaaggtatgggaagagcagattgccaggaaagttgagttagttttgaactcattgtgtttgagaggtctgttaaattatcaagtagtgatgttgaggtgtaattggaaaagtcaacctggaatttatggcagaagttgaggctgcagatataaacttgtaattttaaaaatgtatatttaaagccatgggagtgaatgagttcatttgagattgaatgcagattgagaagagatttagaattgaactccagggcactgcatagcaggaggaaaacctagtaaaagtggtatctgtaaaatagaggaacgaactgtcacaatttgcctggtactgaggattttctcagtacatgagactttaagagactgggacaccctgagacaattggttgccttccatgggaagaaagtatgtcaagagggagagagtgaacaactgtgtccaataaaccaggactgagcaaaaaccattgaatttggcatcatgaagtcttaggtgactttgacaaggcttgtctgttgtgaacagccaagtaaatgtgaggaccactctccaaaaggtaaagaaacatgcatgaggatacaggtgcgccagctggagacatcatgcctcttccccgtccccaccaggagtggcgtgaagcctccccagtgctgtaacgaggcagccaggtcctgtgtgactgcacatgtgacttggggcaagtcatttaacctctctgttttcactatcctatttgtgaaatattgtttagatttgtggtttgagtcagctatctgtatactacactgtgttaggagctatgtagattaattttcaacagatatggttctggggttgtaggaattttcaatttgagaacaaattgaatcttaccctttgtcaggagaaatagcctttgacatgtgttaggggcaagggaaatctcaaacttgcttaattttaaaaatgaatatttggttgtggataatttaagctttggtgatatttctaattattttttgtgtgtttctagtctactgaccagaagtctgaaaaaaacaactaaaaagaaagactgcataagccttcactagagaagtattgaaaattgcttgagggaagtgacggtttctttagcctagtgtctgtaggaccccagtgtagtgtttgttgaatgaatgaaaggaggcgtatcagtcaggttcactcagagaaacagaagctgtaggaaatccatatggatgtgtgtgaaggtattggcttgcctactgctggtgtgtggctaagcgagcttaaaagtccgcagggcagatagtcaggaaggaaatattcccaacagactgagctcccttgggcacaagctgaagcctggagtctgaactgccagagagcctctaccttcttagaaaaggcttcccactggctaagtcaggcccacccaggggaatctctcctttgattaacttaaagtcacctgtttagggactttaattacattggcaatagtcccttcacagaagcacctaaatgactgatgatgtaactgaaaaaatgtgtgtgtatgctacaaaatggctgcagtctcccttctgtcctccagctcttgcaggagaactctcttgtagctcaccctgtctgaaaacatactggaaaggaattcaaggaaatgtagttcagcctagccacgttgacacatcatgaagccgtcacaaaaggtaaagcctggtttaggagcatttgcatttgcagtcttaagtatttttgtcttatttttcaaaaggggttgggcacggtggctcacgcctgtaatcccaatactttgggaggccgaggtgagtagatcacttgaggccaggagtttgagaccagccaggccaacgtagtggaaccccgtctccactaaaatgacaacaattagccaggcgtggtggcgcatgcctgtaatcccagctattcaggaggctgaggcacaagaatttcttgaacccaggaggtggaggttgcagtgagccgagatcccgccactgcagtccagcaacggagtgagactctgtctcaaaaaaaaaaaaagtagttttggtttttaatttttgattttttcttatgttattacatataacgaatgatatgcatactctgaaaaatcatgacataaaggtgaccttgaaattactttgatgttcatttaaactagtctttggtctccactggctaggagaccacatatagcagaacagcagagaaagcaaaacagttaattttcatgtttggcttttgagcttccagggacccaagtcttgccttgaaccgatcttaggaaattcctcattccctacccgaccctgtttctaaactgcatccctgctgaaatgcaatgccactgtaactctctccaatatttgttttcttctttggcttaccactagatgtatgtatatatgtttgtgtgcctgtgtgtgtgtgtgtgtgtgtgtgttgactgcctcatagtaaagcctactcttgagattaagactcctgatagtttagagaacagaaatcttttttagttcctggttattacttgaatttgcaagaggaacaactgctaggaggcctagttaacagtagttagggtctccacccacttgccaagggcaagactagtttacaccacatttggaatgaccagtttcctcccactttagtttcagtgtagaaagagtaggggagacgaactattcaatgtcagcttgggtgtagtgccagaaccgtactcagtaatgctgtcattgctgttggtgcttaccagctcttcagtactggaatagcttcagacctcgagagtttatgactttatcatcaactgggtgtgttgcccttggcacattgccacacagtgcttaatgatgatatatgttctttatcaaattccccccaccaaataatggcattatttacgtgtgagaaagttgcacatttcaccacctcatggtttattagagtgcaattccgtgagaacaactgcctgtgatcctctgtatccccagtggccaactcaggagctcagtatgccctacccagtagatgctcagaacatcattgctgagtgaggaagtcagccatcattttctccctggatagtctctcctgtagataacaggggccgttatcagccaggtttttcatcatttgtggctttgaatttcagggacatgacaagtttgctttttgtttcgttttgttttttttttttttttggttttctagagacagggtcttcctgtcactcaggctggagtgcagtgatgtgatcacagctcactgcagcctcgaactcctgggctcagtgtttctcccatctcagcctttggagtagccagcagtataggtggtgtaccaccacacccatctaactttaaaaaaaaaaaaattgtaaagacagagtctcacttttttgcccaggctggtctcatactcctggctcaagcaatcctcctgcgttggcctcccgaagtgctgggactgcaggtgtgagccaccttgcctatccaacatgacaagtattattctctggcaggaagtgaaattttttctcactgatgattgcacacaaatgtcatatctccatgaggcttctactcactagttttacggctcatgtcaccttgcttcaaactatgcttcagtataattttgaagtgtatatttccattgcctctccttgagtaattgatattcttcacaataagtttacatttattatcacttttatttacttactattattactctgagcagccaatcttatgagaagctcagagtggaacgtgtgggtcctggtaaatatattatttgactcacttccaaacacacttaatattgcctggtgttttgattatttcaaaatatacagatttcttgaaaggcctgcaaaaggaaacaatcaaaattatagcggttaagaatgtgagtctgccttggtttgaattccagatgggccagtccctagctgtgtaatcatgggaaaattattaaatctctagcctcgctttcttcatctgtaaaatgagcatacaggctgagcatccctagtccgaaaatgcaaaattcaaaatgctccaaaatctgaaactttttttgtgcctccatgacgccacaagtggaaaattccacacctgacctcacgtgataggtcacagtcaaaacattgtttcatacacacaatacttttttttatttgtataagtttaagtggtacaagtgcagttttgctacatgaatatactgcatagtggtaaagtctggacttttagtgtctccatcacccaaatagcatccattgtattcattcaggaatctagcatccctcaccccctcccatcttcccacctctccaagcctttcatgtctagcattctgtgtccatgtgtacacattatttagctcccacttctaaatgaaaacatgtgatatctgtctttctgtttctgagttttttcacttaagataatggcctccagttccatccacgttgctgcaagagacatgatttcattctttgttatgactgaatagaattattcaggcacaaaattattaaaaatattgtttaaaattaccttcaggctatgtgtataaggtgtatatgaaacataaatgaatttaatgtttacatttgggttccatcccgtggatgtctcattttgtatatgtaaatatgacatgatatgaaaaattcaaaactctgaaacaccaattgaactcaatttgcagtaagaatgcatacctcacagggttatagtgaggattgaatgagacaatcctagtccaatttctttgcacatagtaatgctcaataattattacttaaatgggtataaactttatagtaatgaggttggggctggaaaaaatgcagtttcataatttcctatagaagtcattcaatcctgactctaaactctgtattccatgtggtggttgggtggcgtgggagagtcctctttatcctgtggggttggtcctatggaggtgtctgtggcagattggcagatgcatttgtcttgtgcatagatggtgtctgttgtttcctctggcagagttcaccagtgtcctaatgcaaacttagtcctcatctggctcctgcacaggctgatctctggctcctttagcccctcatggttcctgttgtttcattttcagagggacccttgtaaggactatagtcctctcttcagctgaccttcaggtccccagtcagaaccaagggaaccgactctgtcccttctcatagcacctgaaaaccccgggaaacgaggggaatgctttgctctcagctactgaggttgtcctgtcaccttctcttctgccctcctttgccatggcataggataatgtaagtcagcaatctcattactcggtatatagccagaggaatataaatcattctaccataaagacacacgcgtgtgaatgtttattgcaacactattcacaatagcaaagacatggaatcaacttaaatgcccatcaatgacagattggatgcagaaaatgtggtacatatacaccatggaatactatgcagccataaaaataatgagatcatgccttttgtgggaacatggatggaactggaggctattatcctttgcaaactaacgcagaaatagaaaaccaaatgctgcatgttctcacttataagtgggagctaaatgatgagaacttaccaacacaaagaaaagaacaacagacactgtggcctacttgtgggtgaagggtggtaagagggagaggagcagaaaagataactatgtggtcctgggcttaatacctgggtgataaaataattgtacaacaaacccccatgacatgactttagctatgtaacaaaccttcacatgtacccccaaacctaaaagttaaaaaaaaaatcccagacaggaagtagggcatattttgcctaatttgcagcttcatcctcactccctaacttacgccactcatgtctcctccatcatcagggacagcaagagtggggaggggacgaggcctgccacatctccattctctgatcttatttcctcttgcctcttcaacagcgctttgtctctcctctccagcttgaagcccttactctggtatgtgatttcaaagcgatgaaaaactggtttcgttagtacttcccttggatctgcccttgtctcccatcaaggcagtgcaagtaaagaatccaagatatttgttttgttggtccactggagggtagagatagagaaaaacagtaacttccccaccacccccaacctcccttgggctgatgactccaaagactgccataaatgaacacttcatagagctgctattaatatgacacaaatctacttgatctaagggattcttttactttcttagggtggtcattcctaagtctttggatttcacagaaaagaaaatatattttaattgaggactgacaaaggttgccaactttttatcaattataagaattgtttttataattaccatcaatttctattatttcttttactccccctctttccaactgtggaaggtaaaattgaagagcaaagaacacttatttcaaagtgagtaaatttagctatatgaaaactcagcagattgccctgagtttccttgcgtagctgcagtccagtggaaatttcttccagaccagcaccagtcgccccagtgacatttagaaatcactgccctggattgtttcagccaccgaaacactcggtgttcactgtcagctatgattatatatgaagtgctttcgagaaccaatgtatagcataacttaggccaaaagaaacactgtgcctaaacactcagccaaggagtgttgagtttgcctggatttctggaaaattgtctccgttccctagttcactgtatttgggtaaacaaaacatggcctcggagagcctttgcgggagaaattataaaaattcagcaaagctttgtgatctcattttggatctcctcaggattcctcatcaagttgcaattaaggagagaaaaattccgccttggggtgggattttaattactcatcatgttatgacttgactttctgtgctgcatttttttccatatcactacttctgtgtttgacagctcctccaaagagtcgctccgttttatgccaggagcgaagtacttactaagtcaaaggaaagcaaggcaaacatctactattgcctttgtgcttttaccagaaaactgggtgagaacctccttttccttttccctgcccctccagcctcagttttatgaccctgtggagccagtggactttgaaggacttctgatgacacacctgaacagcctggatgtgcagcttgcccaggagctcggggacttcactgatgacgacttggacgtggtgttcacgccaaaggaatgtaggactttgcagccctctttgccggaggaagggtaaatagttttctaaaatgtagatgtgattgggattgtcatgattgttttcaataagtgggtaggggagatgccttcaatctgaacttaaaaataaaataaaattactcaatccattcaaatgtgtgggacagctatatgatatcatcatgtaagtatagatagtttttaaattagtttggccagagattttgaaaagctatgtgaagactaagccagtgcaagggatgcaggaggaccaaatgaaatgctcaagaggaggttaaaagtgcaggctctggagccagaccacctggctgccagctcagtgaccttggctgtcacatgacctcccaaatcctcggtttctccatttgtaaaaatgtcaagatttttaataataattactgaaatgccaccatccagaagcattttaattgcttacagttatgagactggatcaagttagaaacataaggtaaacccacatttattgagcatctactatgttctgggtactgagataaaaagatgaataagtcaaagtccctcctttaaagaaagtgtcatgcagtgctaaaacagtggggagagctctgtagaataaatatgtgaatagctaattagggcttgagtttctatagttggctcttctatatgtttataggcttgggcattagtttttggcatcaaactaactgtggaattgtagctaaatgaaacgcctgttgcttctaaaatgtaaaaaaaaatgtctctttggaggtttaggataaacttttatttacatttattttaaaagccaaattaagattcatatcctcctggacaggttccatcttctcatcttccccagaaggtcccagaaagaagatcctgacacacagcccctgccctctttactctgagatattctagttctattttggattttatttcatcacagtttaaggaggttggatgataatgggctggtattattgtgaaccgttgctctcttgttcagacagtcctcactcacataggagaactgaccatatgtgtagctctgatgttttaaaaatacacacttcccaggaaagaaaaacattgtcatttttgggaaacatactcccccattttcagtccatttattcaggtatgactttagtataagttaacacctactatttcatctttagtgaagaatcatttaatttattcctttatgtaaaatttatggatgtttccaaatatggtcagaatcttggaaaaagctgtttaaaatgcttacagtagccagtcaccgcagcttgttcctgtggtcccagctacttgggaggctgaggcaagaggatcacttgagcccaggaatttgagttcagcctgggtaaaatagtgagaccctgtttcttacaaaacaaaaacaaaaaacagtacaatgaatttagaggaaggaggaggtttttttttttttgaaatttgataaggaagataatttctttacttagcatcagttttttagtatactgttgccttgtcaaaagaatttataggtaacatacctgtctgatgtctttaagacagcctctactatttcagttgttgccaaaaagtcttctgtataattaaggcaggggaaggtatcatcatcacaccagagtaaacaatagctgactcctgttgaacaacctgtgcctagcccagaactttatgttgagctgtgatggcgtggtagtgaaaaacatgaacgctacaggtgagctgcctggattcaggtccctgctccaccacttgctgtgtgacttggaacaagatccttaccatctcatttttctgcaaagtgagaataatagtaatgcctgccctatggtgctgattgagaattaactgaattaatacatataaagtgattgcctcagtgcataatgcacagtaaatgctacctaagtgtaaactattaatatcatatatgcgtcttattgtgtgccaggcagtcttctaagcactttgcacactaaccgatttaatcttcatcaaagctgtctactaaaaggggcactcttactactctaacagctttaaggagaggaaactgaggcacagaagggttgagtgactggcttatggtcacatagctataagcgatgaagctgggatttgggcaattagggcccagagactgcatgtgtaacctttacaatattttatctaatactaacagcatgtctctgttcttacctccttatcacagatgagaaaattaaggcttgtagcatttaagcctgtttatttctggtactaatgcatttgcaacaatagcaaaaagctttgctacaattgttatttttgatttcaagactctgaagcacttgaagagtattgctcatggtgcattccttaagtagacatgacaggaaccaactgaattaatgatcaccaacaaaagccagtgtttgcaatttcatcaaagcataagacaactgttctttttcctggctttcaaaaaggagaacacgcgtgtcctaacaaggttacacatgcataaaaaatatgtccaaattaccctgtcagagataggtatttatacttattttccttgttttgtattcgaatacagctagttctacctgtcttgtgtctgaatgccttcggggatagttataatttaacatgattctgtataataaagaaaacccacaaagcaaaaaaatgccaacatgtttgtctcatcaaagtaaaaatgtttattgccccaggaatacttcagacatttggaatgattgggcaagaacatcctaagcattctcactgataaggatttaaattcgtgtcatgttccttgctcatgattaggggttgttttgttgttttacccagtaataacgtgtttatttcattttctacctcattagggttgaactggaccctcatgtcagggactgtgttcagacctacatccgtgagtggctaatcgtgaaccggaagtaagttactttttttccactttttgtatataaatattaattttatattgctagtttttaaatatttcttaatactttgaacagttctaggtttacagaaaaattgcatggcaaatagagttctcatgtatgccttccttatccccactccatatcacacacacagttccccctattatgaacatctcactttagtgtggtacatttgttacagtagctgagccaatatggatatgttgttattaactaaagaccatagtttacattaatgtttactttttgtgttgtatattctatgggttttgacaaatgtgtaatgacatgtatatgcctttacagtatcatacagaattgtttcactgccctaaaaatcctctgtgttccacctgttcatcctccctccctggcaaccactttccttttttactgtctccataattccaccttgttcttcaatgtctttttgtggcttgatagctcattttttttattgctgaataatctttcattgcatggctgtaccattgtttatttatccattaacttactgagaaagaaagttctattttaaacataaagaatagactgcaagcttgcccaacccctagcccgtgggcaacatggagcccaggatggctttgaatgtggcccaacacaaattcataaactttcttaaaacattatgaggtttttttttttgcgatttttttaaagctcattagctattgttagtgttagtgtatttgatatttggcctgagataattcttcttccagtatggcccagggaagccaaaagtttgggcacctggaatagagcctttttgttgtcttctaattctgatgaattcccagggggaaaaattaagtgaattgaaacctggcctcagcttcagaggtggcattcgagtttatgaccaagaaataaattacttgctggccttccagtaagggatctttctctcctggattaatcaaaccttctgtgacattgttctgagctttttctctccatgccatggacctggacagcactctctcatgagaaacatctatgcacattgaaattctcagcctgcatgggtgtacctgttggggagtgagatgtggactctctacagattagggcacaccccactagagacacgtcacagaacctttgacaagacattagtagtttaaaattctgatagcctcactcctcctatacctcagtaagaattactattctatggggtaaatgatgaaagactttgaggattgggttttatctagctcctggaagggtgccattgagtttgtgctgaggttttctggagtaatgtcaatatgcacacattttcagcagcagaaaaagagaaagcattcattattaaaagttattaagagaaagttagatgccaatccatcatctgttctaaaatgaatggaaaacaaagtttgctgggcagtcagataaaattatggtttgctgataataaataaaagatttcagaacaagttgttctcaagtttttaaatgctatcattagaggtactttctggacattaaagatctaaaaaaaatctgagaaggaacaaatagaaagatccattttgatacatttggttttcagatttattttctatttcgggcttgtccactttttcatttctcatggcaatgcacgcttcttggagtagtgatttttcttgatcttgcacaaatgtaagagaaaaaaatgactctttttggaatactcgttgaaattttagaaataattatgaaacacaaatcactcagtttcactctagacagataatcatcatgaacatttgatgtctgtcctttgaatagtgttgggtttttttggtatatatttgcgtgaaaactaaataagattataatatcatttttgtaacatgcattttcagttttcacagtaaagagtgattctcttcctttgctattaaatatgcttcctcaatacaatgattgatgattgcataatatatttataccaaaatttatttaaccaattttaatatttaggtgattccttccttttcagtgttgtgcttaaaatgcaaaaacatccttctcaggaaaaatttgtacatatttatgatttttttctttggaattaattcctacaagaggaatttctatgtcaaaggatatgcacaaatttaaagatttggaatactagatcaaacattatgccgggcgcagtggctcacatttataatcttactcagcactttgggaggttgaggtaggaggatcccttgaacccaggagttcaagaccagcctaggcaatatacagagaccccacctctaaaaaaattttttaaaaaattaactggatatgatgacatgcacctgtagtcctagctactcgggaggctgaggcaggaggatcacttgagcccaggaggtcaaggctgtagtgagtgacgattgcaccactgcacaccagcccaggcaacagaggaagaccctatctcaaaaaaaaaaaaaaaaaaaaagccaggcacggtgctcatgcctgtaatcccagcactttgggaggccaagacgggtggatcacctgaggttgggagtttgagaccagcctgaccaacatggagaaacccagtctctactaaaaatacaaaattaaccgggcatggtggtgcatgtctgtaatcccagctacttgggaggctgaggcaggagaatcacttgatcctctaaaaatagctaaactgggaggcagaggttgtggtgagccaagatcgcgccattgcactccagcctgggcaacaagagtgaaactccgtctcaaaaaaaaaaaaaaaaaaaaaaaaaagattattgacactacatgcatgaatcctcaagaatattagatgttataatttatcaacatttccaattttatttgataaaaggttgtcttttttttcattttcttttactattagattaggcatctttcttctatatatttcttggccattttttatttttcctggtgctctgcttattcgtgaaatttgtgcatccctattaatgtatttgtctagtctgatttatttttataagcacttttttggtaaagatattaagccttgtctaccatgtattaaaaatgtcttccccagtatgccttttgtcttttaaagttgtttttaattttcaacattcagaattatttatgtcattaaatctatattaatatttttccttatgtttaattttggcatcatgcttaaaatttgattcacaaacttattattattttctaagagtatgggattaaagcattaatccagatcattagccacttgactgttgcttctgttcccttatgtgtctccatttgtttttatcttttctacagaagcaatggttacccatatatttattatatgcaagtttttgcatcttgttcccctaaaaaagaaaggaatatgtgttttaattttatgtttggcaacattctagggatgggattaccattggcccagttctctgcacccctgtgtaatggagcagttcccttcttaacggtcacctagtggacagggagaagtgtacaacttcagaactcattgtcagtttctggcaagctttcttgtagaaaagttgcatctctttctatccctctgcctcattctcttgcactctgaatctaacactctgcccatgaaaactaaaattcctagcacacactcctcccagggatcattctgtctctatatgcacctgtcgtattttatctgtggggagaatccagtacactattgccagatgtccttcatctcccaacctcacacagtacatttttagcttattgttttctgtgagttgtatctgtattgttttagaatgatggtagaaggagaaggacaaggagaaggtggtgattcatataaatgaaaccagctggaagctgtgatgctttcatagataagccactattatgaagaaggagacttcagatttctgtatagacactgaccagggactcgtgggcaggaaggtgtgcaacaccttcttatctttattcagtgagttcccctttggggagacaaagtttggtacatccttctctttccagctccatctgatccacagaggttctgtccagattcaggcattaagttatctcttcatttggatgagtttccagtttttctgtgtcttcataagtggtttactagaaagtcggaggaggatgcaataggggttgctggccatttgttaattagtgattaattatttagctctcctttaattggttatgtgccaaatcatgtatgattgttttgaaagaaatcaagtaatatggaggtgcattaaggaaaaggcaaatctcatgcctcactacttaccagtgtcctacccttcccttaactcactcttcactgcgtaaagcccagctgtgtagcttccagatcttttcataccctcacaaaaaatatttgtctatttatatttttcacataaagatatatgtattaatgtatgtacttatatattacaaacatttctttaaaataactgtccatgtcagagctatatcccattctactgaaatgctgcctagtattcaaagggtgaaggaatgtgtcctaagttactgaaactaaatgaccattttggttgtcaccatttttcataattgcaaataatactgaaacaaacatatctgcacatttgccccatacatgtgtgtgaatatttctgagggtagaaatgaagccagtgtacatggtatgctctgataggtactgccaaattcttctccagaaaagtcgtgctgtttcattccattaccaactgggcattaaactggcgtgttcccatattcttgccagtgctggatattatttattaaaataaaatttcagttcctccagtcttcttttagttattattttaatctggaagctattacacctactttctgaatacagtttcctatcaccaagtttcctttccttatgtgttctaaaatcccagttaaatatgcacttaaccatacaaccgtaagtcccactcttgagtatttacataaaacctatgtgcaaatacagcagtttagcagttttatttgtaattgccaagactgcatagcagttttatttgtaattgccaaaaactggaagaaaacccagattgtactcagttgggtagtagataaacaaactctggtaaatccatacaatggaatactactcagcagtgaaatggaacaaacaattgatatatacaacaacatggatgaatctcagatacagtatgctaagtgaaagaagccagacaaaggccgggcatggtggctcatgcctgtaatcccagcactttgggaggctgaggcaggtggatcacttgaggtcaggagttccagaccagcctgaccaacatggtgaaaccccgtctctactaaaactacaaaaattagctgggcgtggtggcacgtgcctgtagtcccagttactcaggaggctgaggcaggagaatcgcttgaacctgggaggcggaggttgcagtgagctgagatcatgccattgtactccagcctgggcaacaaagtgagattctgtcttaaaaaaaaaaaaagaagaagaacccagacaaaaaagataactgcatgattccatgtatctgacattctggaaaagatgaagctacagggatggaaaacaggtccatggttcccagggtctgggagtggggaagagggctgactacaaaaggacacgggagtgccctttgcgtggtgctgggactgtagtgcccatgatgtaaaatctgccttggaccattacattagaagaaatcaattccagttatcccaatattccctccaagtgaaatactttggtagcatatataataataattcaataagtattagctattatatttattaagtagtacctatcagaaaacatacttatattagcatgtcaaaggaatgaacacaaaattctctcccatatattgaacgcaccatggaggggggacctgccttcctctggaggaccatacttagtgaagccactttgccttataaggacatgcctttgttatccagaaccaagcagtcaaacactgatttagttagctcctttatttctcagttatctcctgctgatattacatttctccataatatctagagataggcttttatgtccttgctagctgtggtaatggttttgaatcccacttagggggcagaggagtagagtaatggccacttgtgttccctcccaccctcatcattctacagggcatttgccactcaagtactgtaattgagacatttaaatcatacaaataatgctgcccatgaaggatagaggaaatttttagatttccttttaaacctaacagagaaagattaagttacataaaaatgtaaaatacatgatctccagtacattgaaggaaatgtattttcttacttgaaatgtttgtgttacttagactggaagatttattaaatgatttccattctatcactcatgtttacagcaccaaatttggtgtccttgttctaaaaacaatagtacttttctccccatgacttttgaaaatgattactggtttactgattagcatggcgccatgtttgcttgtttgtccaaccttttatctgcatattttgataatgttgtgtggattaatatttgatgacatcctttgggtgatattaacgattttaagctttatttcttctgtcattttctctaaatgaaccaaagagggataaacttcagaatgtttttgatgcctggtggagagctgaactcttaagaaattaaacttgtttacatactatatttattcttgccgcagagacagtgaaacatttcatgagtgttatgggcagcatcataaaagcctttagactttgtttttcatctggggtgattaaggtaattctgaaggaaggttgagctcaaggagagctgagatatcaaggaatggggtatcatctgttttattactccatattttactcccagtgaagtggtaaacaattaaaattcaaacacatcagtgcatataattcagttactcccagaacaccataaaaatgtttccctgatcaataattgcttattatgacatgcatttgttgtgctagctgtcaaggtgcttagctatttgctttctaaaagtatgaaaagcacgcccggctcatcagcctatgtggtaacaaagagcaatccagctgtggatgtcacagagccactcttgacctgttgtgcatagactccctccccacaaatccaaacccactaagactctccaggctctgttaacacacaccagcctggttcagcttggatgccctcctcacaccatgtgggttctgattttccatgccaggcagtccatcttaaatggatgcatcctcaccgtgtttgggcttcaacttcctattctggacctcctcggctactccctaccccaaggcatggagggctgccttgttctgatgcaccttatgattttagcaccaaattgtacaggaagggagagaagggaaaggagaaagaagatgtgaaaggaaagagagggtagggaagaggaaaaagaagatgaggaacacgtattattttctaatcctcacaataggtcctcaaaatgagcaacatttccccctatttcatacttgaggaagctgtgactcagagagactaaggcacttgcccaaggtctcttagtacattaaggagccagcgtctgcacccagttccttctgactctagagcctggattctgctggctgcaccacactgtctttaaagagaacactctcaaaacgcgcttggtctttggattgtctcaaatgtgttagaatagtgttttaagaaaaggaatgcagatctcctgggaagcaataggtcgagttcatttcatgagaatcatttttctagccattggcctacttccccatttttctcctgtctgcatctaggtgcaacaggaacttggctttatttgactccattgccagggtggggtaatgaagctgggactctcttgtagccagcggcagtgagccagcagtctcactgcctacccagtgatggttccttctgtggccagcacttctggaatgagtcatctttacatgtttgccaacccttgtcctctcctccccagccaggttcacccttgctgctgtcaaggagctttgagactttctgagatttttaaatggggaagtagatgttaaacctagtatgaggaagagagggaaagtttgctctggtttcaaacacacagtcatagaagatgctagtcttaatgctttccatagcaaaaaccctgaaggcttagagtgtacacattgtgaactgaacttttaacattattgtgtaactcatttgttaatgcctatttgtcattgactgtggggtccatgtgaaaaactcccacaaacactctaacaaaatggaagacagaaaagaaagcaagcatcatttgtgtacaatagccaaagaacaatagccaaataaatttgatggtctcaaaagttaagcatcttttgaagagaaaatttgattttagggccaggtggggtagctcatgcctgtaatcgcagcactttgggaggcagaggcgggtggatcacctgaggtcaggagttcgagaccagcctggccaacacggcaaaaccccgtctctactaaaaatacaaaaattagctgggtacggtggcgcatgcctgtgatcccagctacttaagaggctgagacaggagaattgcttcaactcgggaggcggaggttgcagtgagccaagatcatgccgctgtactccagcctgggtgaaggagccagactctgtctccaaaaacaaaaacaaacagaaaaaagaattgattttgattttttcagatacagtgcatgaactttttatcataaaatattaaagctggggaaaatatcttagaattcacctcatgttcatgctttaccctgtgaagaaacagaggcacagagagaaataacttgaggataatggaaacaagcacacatctgtaagtgtgtgtgtgtgtgtgtgtgtgtgtgtgtgtgtgtcagagagagagagagagatgttcctttgtaagtaaacactcttggaaatagccgcattttattataacacaaaaagtaatgctaaagctgatatagttctggttgctaagcttcacacacaaaaggtctttaggtagctgcttcctaatttttatttctgtggcccaaaagtctccttgtaaaccttcgtgtcatgtcatactaaacctttgacatcaataccctttaaaatgtacaagtccttaaaaaaaaaaaaaaggcaaagggcaaatactaatgtgggaaatttgaattttaattaactgtttgtttcaatgttaggataaattaatgttagataaattctttggtaatttttccccctaaaattggatttttcaagaaacatcactggttcagtatattgttatttggggtagcataattttaggcgataacttaatatttgcatatatttgtcactactttgagttggtttttgtcccctgacccccagccaggatgttagatcacacagatttttttttctttgagcccttagggagagtccaaaacagtcacttcatgtactaggaaagtttacccagtcagcacacacagatatgttgttgcctacatttatatttgtgagagtgactgttaagaaactagcaggtttataaaatccgtgtgagaatttctctcaaataactgttaatggacaatccagcaatcctcccatctcaggctcccaagtagctgagactacaggcaggtggcaccatactcggctaattttttgtgttttttgtagagatgcggtttcaccatgtcacccaggctggtctcaaactcctgggctcaagtggtgctcccgccttggcctcccagagtgctgggattacaggtgtgagccactgcacccagcctgtacattttccttgaaatcgtttttggatgtttagtcttatttccttattcagagttcacctgtttattttttttttcatttccccaatttagcctgcgtttcacccagccctagcaatataggtttgggtcagagaaattcaagcggccaggggatgctgaagatggcccattatggccgggcgcggtggcacacatctgtaatcccagcactttgggaggccgaggcaggcagatcacaaggtcaggagatcgagaccatcctggctaacacagtgaaaccccgtctctactaaaaatacaaaaaaattagctggctgtggtggtgggcgcctgtagtccaagctactcaggagactgaggcaggagaatggtgtgaacccgggaggcagagcttgcagtgagcagagatcgtgccactgcactccagcctgggcgacagtgagactccgtctcaaaaaaaaaaaaaaaagatggcccattgtggtaagccttgacttgaattagtcaccaagctagtcttatctcttttctaggctaattcttgttttttgtttggctcaaaacaaattgtttgtcttcagaacacaataaaatccagggagagtgtcctgttcttcctacagacgtcactgggacatcttattctttaattaattcagtcaactaaaattggtcaaatacctgctctctgtgccagagttataaactttgtatttgtataattgctagtagctctcttacatttcttactttatctatctggcatttgatctacctaataccttccaatatcacctcatgtccctttaccagcttggtggtttttctatagttcaggaaatcaaacaaaatggtgtgtgacctggaggtactagaaaaacaatagcaaaccaactccaaagccagcagaagaaaacaaataaccaaaatcagagctgaaaaaaattaaaacgtgaaaatccatacaaaagatcaatgaaaccaaaagtttgtgattcaaaaaaaaaacaaggttgatagatcactaactagattaataaagaaaacaagagagaagatcgatccaaataagcacaatcagaaatgacaaaaatgacactacaactgatgcctcagaaatataaaaaatcctcagagactgttataaatacccctatgcacacaaactagaaaacgtagaagaaatggatagattcctggaaacacacaagccccctaaaattgaagcaggaagaaattgaaatcttgaacagaccaatagtgagttctgaaattgaatcagtaatacaaaacccaccccaaaaagcccttaatcagatggattcacagccaaattataccagatatacaaagaagagctagtaccaatcctactgaaattatttcaaaaattcaaggaggaaggactcctctctaactcattctgcaaagccagcatcattctgataccaaaacctgggagagacacagcagaaaagaaaacttcaggccaatatccctgatgaacatcgacacaaaaatcctcaacaaaatactacaaaccaaatccagcagcacattgaaaagttaattcatcacaatcaagtaggctttattcctgggatgcgaggttggttcaccatacacaaatcaataaatgagactcatcacatagacagaattaaaaacaaaaaccacaggataatctcaatagacacagaaaaggcttttaacaaaattcaacatcccttcatgttaaaaaccctcaacaaattaggcattgaaagaacatacctcaaaataataagagccatctattattcaactatccacagccaacatcatactgagtgggcaaaagctggaagcgttcctcttgagaactggaacaaaacaaggatgcctactctcaccacttatatcaacatggtactggaagtgctagccagagaaatcaggcaagaaaaagaaataaaagacatcccaacaggaagagaggaagtcaaactagctctgtcacagtgcaggcaatataattctgtacccagaaaacactgcagaccctgctaaaaggctcctagaactgataaacaacttcagtaaagtttcaggatacaaaatcaatgtacaaaagtcaataacatttccacacaccaataatgtctaagttgagggccaaatcaagaatgcaattccatttattttatccttttgaataaaatacctaggaatacagctaatcaaggaggtgaaagatctctacaatgagaattatgaaacacactgaaagagatcagaggtgatacaaacaaatggacaaatattccatgctcgtggataggaagaatcaatattattaaaacagccatagtgcccaaagagatttttagattcactgctattcctatcttaattagcaacatcattttttcacagaatttaaaaaaaaaaacctattccaaaattcatgtggaaccaaaaaacctgaatagccaaagcaatcttaagcaaaaagaacaaagccggtggcatcacactgtgtgacttcatactacactacaaggctacagtgaccaatacagcacagtccaggtacaaaaacagacacgtagaccaatagaacaagataaagaaccagaaataaagctgcacgcctacagccatctgatctttgacgaagttgacaataacaagccatgaggaaaggtctccctattcaataaatggtgctggagcaactggctagtcatatacagaatattgaaattggacccctccttttaatcatatacaaacattaactcaagatggattaaggacttaaatgtaagacctaagattacaaaaaccctagagaaaaaaactgggaaatactattctggccattggccttggtaaagaatttatgaataagtccccaaaagcaatggtaacaaaaacaaaaattgacaagtgggacttaattaaactaaagagcttctgcacagcagaagaaactatcaacagagtaaactgataaccaactgaataggagaaaatatttgcaaaccgtaaatctgaagaatgtctgatatccagaatctataaggaacttagataattcaacatgcaaaaaaccaccccatttaaaaatgggcaaaggacatgaacagatacttctcaaaagaagacatacatgtggccaaaaaatatatgaaaaaatgcttaacatcactaatcattagataaatacaaatcaaaaccacagtgtgataccaactcacaacagtcagaatgcctgttattgaaaagtcataaaatagactgggcatgtggcttatgcttgtaatcccagcattttgggaggctgaggcaggaggattatttgaagccaggaggttgagaccagcctgtgcaatgtagcaagactgtgtctctacaaaacatcaaaataaatggaaaaaaaaaaagaaaaagaaaaagaaaattaactgggtatggtggcgtgtacctatactctcacctactgggaggctgaggtgggaagattgcttgagcctaggaattcaaggctgcagtgagctataatcacaccactgcactccatcctgggtagcagaacgagaccctgtctcaagaaaaaaaaaaaggcaaaaattaacatgttggaaattagttcagtcactatggaatgcagtgtgaagatttctgaaagaacttaaaacagaactaccattcaacccagcaatcccactactgggtctatacccaaaggaaaataaattgttctacaaaaacgacacatgcactcgtatgttcctcacagcacaattcacaatagcaaagacatggaatcaacctagatgcccatcgacagtggactagataaagaaaatttggtacatatacaccatgaaataccacacagccataacaaagaacaaaatcatgggggtttttttgcagcaacatggatgcagctggaggccattatcctaaacaaattaacacaggaacagaaaaccaaataccacatgttcttatttataagcaggagctaaacatcgggtaaacatgggcataaagataacacggtagacaccagggattactaaagaagggaggatggaagcaggtgtgggttgaaaaactgcctattgagtaccatggtcactatgtgggtgacgtcagtatcatgcatacatcaaacctaagtgacatgcaatttacccatgtaatgaatttgcacatgtatcccttgaacctaaaataaaagttggaaaaaaataaaagataagatatcccgtatcctcaataaaaataaaagtggcgtgtttgtgcacttgactttgtaacatgttttccaaagatgtctttgagtcataaaaatgggaaatacacatgttggtttctctagtcatcacttgacaacttacatgttttacctttcttatgatggtctgtctcatttcttcagtgacagggctagacattctgttttaaactcttcccacagctgtatattattcaacacaactttaacagagttcatagagtggagattgaggatgtttgcaaagttaaatcatttatttttattttttcttaaccatgtcccgcctgctttattcattattaagaacattgatgtgaagattaaatggttttctctatttttatcttcaaacgatctctatttgtggcttctgcacattgctagatttattccagccacttacactagggtcatagtttagcttcagctcggagccaaatgccccacagctgaaatgaccgcacctctgaagtggcattttcccaggccatgcctccctttaataatgagccagccagggggtaaatttgtatctcattacaacagagccttgtattaggcctggagaataattaaatgtgaggaattataattggttccctctttgaaagctctctcagcaccatgtctacacttaagccattacttttatttttaatctaatggtttgccgctctctctccctctttctctctccaaattaaatatcaaccataaaagaaaccaaggaagtccagaaatctgtggctttaaaaagactggatctcgaaaagattttcacaagacgcttccgaaacagacgtttgagtcggaaaccttggagtgcagtgaacccgctgctcaggtatttcctgtcaacaaacatggttaccaggttactgggctcttctgcccagggcatgctgtcagttttacaaactagaataaacgatagacgcatagaaagtttgagtaggaggaactttaccatctgagtcagtgattttttttttcaaacttatttgtagctgtagaaattggtgttcaaatgaaaacccagaaacccaatgattaaaatagaaaaaagtggaaaagctctaactgggggacagagacaccttgggcccatccctacgacagttcctgcagagactcttggtgcccctaaggcaaactacagagtaatgaaaagctctatgctgaggccagaatacctgcattctcctagtgattctaccatgtactaactctctaacttcaagcaggataattaaacttattgggcttcagtttcctcccctgggaaacaaggatggtaatactaactcatgaggttatttgagtattaaatgagttaatatccataaagaattagaataatgccaagtacacttagtgcctagtcaatgctggtcactgttattgttattgtcattattctttttcttttttttttttgttgagacagagtctcgctctgtcgcccaggctggactgcagtggcacgatcttggctcactgcaagctccgcctcccgggttcacgccattctgctgcctcagcctcccaggtagctgggactacaggctcccgccaccacgcccagctaatttctttttgtatttttagtagagacggggtttcaccgtgttagtcaggatggtcctgatctcctgaccttgtgatccgcccgcctcggcctcccaaagtgctgggattacaggcatgagccaccacgcctggccagttgtcattattcttataaagtaattacagtttaaaattcaagttaaagtgtacatattgtgaaatgagcttttaacactattctgtaactaattttttaaatgcctggggtcatttgaagaactccagcaaacactctaacaaatagaagacagaaagaaagcaagccttcatttgcataaaacggccaaagaacaatagccaaataaattccatgtttccaaaagttaagctctatacacctatgctcacagcagcattattcacagcagccaaaaagtagaagcagcccaagtatccatccataatgaatggataaacaaaatgtggtcgccaggggctgggggagggaggagtaggaagttattgtttaatgggtagagtttcggcatcccaagatgaacagcattatggagatggatgctggtgatggttatactgcagtgtgaatgtgtttaacactactgagctgtccaacctgcccattttatagatgagaaaaataaaattgagaagaaaaaatttgttcaagtttgcacagaacttcttgtaaactaatatagttttcagcttccatgtgtcttcataatacaggaatctcaccatgctggaaatgattcgaggtttttaaataatactaatttttcagacaaggtggtccccctaaagcaaagcccactacttacttggagcttcacagtagaatcagccatcatttccagcgctaaatatgacaggcttactgagggatagaatacctggatgctctgctctatgggagatttaaggaatttttcatcagtaattttgactgaattccattttcaccctacatgctgaccaattaaattgttcctcttaatgttagtcagatagaagccacggtaggtatttcagcagaagaaatttaacacagggaattgattaaaccggttttggaggtctgagagaaccaaaagggaaaaatggaggctatcctaaaatcgtcattatgggaaacagcacaccagcctggggctggggtatacggcagtggttctccacttcagcttcatcagaatctcccagagggtttgttcaaatataggttgctgggccctgtctgctggaatttctgattcagtaggtctggagggtgaacctcatactttttaattagcatttcctaagtgatgctgatgctgctggtcccaggaccacaatttgaggactgcaggtctaggggaagatcttggagttgtcagaacgtagaagctcagaagaggagcctgagagcaaggactgaaatccctgagaaggtactgcccagctggtggtgttgtctcaagatctcagagggaaaaacctcatgaagcctggactcacgcctcacaggaggagaaattgcccggctggtgctggtaccttcaaggaggtaagataagggtgattctggaagtaccaaaagaacctgaaggctagaaccagctgtcactacgaaggtgagaggaatagcaagaggaaggagccaggccctttgacctccttgaaccatccggtaaccctgtagtgctccctattgacagaacctaaagggagcagcagacacagcggaaatatgatttgctgacctagcatcaaagaacaaggcataaaagggtgaatttggagcccagaaacaataggtgaagaccagcgtacacacaaagcacacgctttcctgcagcatactagcagagaactcaagtcactgtgttgtgtgtggttttttttgttttttttttttttttttttttttttttttttttttttgagatggagttttgctcttattgccaggctggagtgcaatggcatgatctcggctcactacaacctccgcctcccaagttcaagcgattcttctgcctcagcctcccgagtagctgggattacagacatgcgccaccacgcctggccaattgtgtatttttagtagagacagggtttctccatgttggtcaggctgatctcgaactcctgacctcaggtgatccacccaccttggcctcccaaagtgctgggattacaggtgtgagccaccgcacccggcccactgtctgtgtttaagagccaacttgatcatatgatccagcagtctcactactagatatatgtccagaggaaaggatatcagtatatcaaagagacatctgcactcccatgtttattgcagcactattcacagtaaccaagacgtggactcaacctaagtatccatcagcagaagaatggataaagaaaatgtggtatgtatacacgatagaatactattcagccataaaaaaatgaagtcctgtcatttgcatcaacatggatgagtctagaggataagtgaaataagccaagcacagtaagactaatactgcatgatctcacttatatgtggaagataaataagttgatctcatagaagtagagggtagaagtggtaactagatgctgggaaggatggatggagaagggaatagagaggttggttaacggttacaaaattatagctagataggaggaataagttctagtatttgatagtactgtaaggtgactagaattaataataatttattctgtgtttccaaatagctagaagaaaggattttgaatgttcccaacacaaagaaatgataattgaggcaatgggtacactaattaccctgatttgatcattacacattgtacacaggtattgagatattacactgtattccataaataggtacaactattatgtgtctattaaatttttttaaagagccaaattgtacaaaagttgtttgttttgaaatattggaataatactcatcatggagagaatctcagactgcgagatgacagcaatgttttcaattccactctcattcttgtgcaccttcttattgagtagaatggtgaggccacatagctagatttataaaatttaaacaagtatatgataagattccttggtacacgtagattttataaaaattagattatattatgcataatattgcaaaacttcctttttcatattagcaatatactgtgattatctttctcttccaattaatacgtgttctttcttttttagagacagagtcttgctctgtcgcctaggctggagtgcagtggcacgatcttggctcactgcaacccctgcctcccaggttcaagtgattctcctcccttagcctcccgagtagctgggactacaggcatgtgccacgacacccggctaattttttgtatttttagtagagacggggtttcaccatgttagccaggatggtcttgatctcctgacctcatgatcccccggccttggcctcccaaagtgctgagattacaggcatgagccaccgcacctggccaggttctttcttttaatggctacataacattctattttatgaaagttccaaaatctcttaacacttcctttttgggggcatttagtttacttctattgttttgctatcacgaacagtgtttcagagatgcccttgccctcacattcttgcacacttgccagttataccctacggataaattcttagaagtgaaatttctagattaagggatgagtaatgttagatttttttacttatatgtatcttgatatccttttaaataaatttgggaaattaaagtcattttccttaaactcttataaattttaagaaaaacaaaagtattaataatcgaagtgttaatattgattatttctagcacattcagtttggggaaaatttatgatctagtagagtagtacttttgtgaggtagatgtcacaaaaaatgtgtagtatggagaaattgtccagtagtatgtccatttagtagaattttgagaataacattttgccataaattttatagatatttaccattaatccatttgtagtcctacaacatatagttgattacagttatacattttttgctgagtctttggttcaaagcatgcagttcccaattacaaagacattcctaatggaataaaacatccactttgtgactgatttaaggttgttttcttaaagcacaccgcagccaaaagtggacacagcttgaatagcaaattttttcctttttgttgttgttgcttcatccaataactgttaccaaattcccgtagaaaagtgttgcccactcccacatcgacctttggaagcataacattcagctttggtgtctatacacaatttaatttggaaggctcctcacaaatcatcttattttccagtttcaaaaaccaagttctgagtggagattaagacagggtctctttatttcccagtgcagtctcctatctatttatttgtgaatgaatgaattagttaattaatgagccagggtttcactttgtcacccaggctggattgcagaagaagtcatcgtggccaagcgtggtggctcatgcctgtaatcccagcactttgggaggccaagacaggtggatcacttgaggtcaggagttcaagaccagcctggccaacatggtgaaaccctgtctctactaaaaatacaaaattagccaggcgtggtggcgcgtgcctgtaatcccagctactcaggaggctgaggcaaaagaatcacttgaacctgggaggcagaggcagcagtgagctgagattgcgccattgcactccagcctggccaaaaaatgtgaaactccgtctaaaaaaaaaaaaaatccaatctttcctattggctttattaaatacactttaactttagaagcttagaagcacaataattagaactggcctaactttaaaaaaaattttcacaaagaaattagtaacttgtagggtcatttgtaatctttttctctgttgatttttacagttttaaaaagttaatacaataatttatttacttattttttgagacggagtctcgctcttgttgcccaggctggagtacagtggcaccatctcgggtcattacaacctccacctcccgggttcaagcgattctcctgcctcagcctcccaagtagctgagattataggcactggccaccatgcccagctaattgttttgtatttttagtagcgatggggtttcaccatattggccagtctgatcttgaactcctgacctcaggtgatccgcccacctcggcctcccaaagtgctgggattacaggcatgagcccaatattttaaaaatagtacattattacagaagctagatgtgcactttaaattattatcagaaaattagtatgacagacaaattctatgattgtcccatcatctgggcctgtgacattcacacctttgtgatgttcatccccgactgtgggtgggacctgggacttgcttctgtcaaaacaatatggcaaagcatgagaggatgtcacttgtgatcatattagatagcagccaaaatggattaaagacttaaatggggccgggcgcagtggctcacccctgtaatcctagcactttgggaggttgatggcggcggatcacctaaggtcaggagtttcagaccagcctggacaatatggtgaaaccctatctctactaaaaatacaaaaataaccagatgtagtggcggacgcctgtagtcccatctgctagggaggccgacgcaggagaattgcttgaacctgggaggcggaggttgcagtgagctgagatggcgccattgcactcaagcctaggtgtcgcagcaagactcggtctttaaaaaaaaaaaaaaggtaatcatacctcactgcagccttgaactcctgggcggggttcaagcagtcttcctacctaaacctcccaagtagctaagactgtaggtgcacgccaccatgcctggctaagttttgcttttttttttttttttaagagactgagtctcattgtgttgcccaggctagtcttgaactcccggcctcaagcagtcctcccaccttgtctacccaaggactgggattaaaggcataaaccactgcacctggcccagtctcctttttgttacaacttcctccagctctgttttgctctggtgtgagacatgagcatggttcattaagaggcttggcccccccagccccaggaaagaacaagccaacaaccgataggaatgtagtactgtttttagtcctttcctcaggactggtttgtctgcataagatgagtaactacctgcttccaggtgagaagaagacatttaattttagagtagtccagccaggaagctgagatgtcattcttatcaaatccgcagtttcttcagaagacttgaggcctggctgagattctgtagtcccaaattggagcagtcttgagacatccaagattcttcggttctcattttagacttgccgtctctctcacaaagacccactgttttctctcacaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgaggtgggtgccactgtttccatactggagaatctcagtgaagactctgagagtcatgtggacaattgtgttgttcattattactatatagcagcccatggtgtcagggctcacttgtatgatttctggggcctcgtttttcactcaggcaagcctgtgtgtcatagcagagccattattgattatcacacagatgggattctgataataataacaactggaattttcatagcactttacaaaatatgttcactaagagcatctcatttaatccccaaatgtttcaagggtctacatgtagtaatcacacccagcaagtcaaaccatcctattatttgaggggatgtgtggtcactaatccattgagacatacattacttaaactttgatgttctttagtgctttgttactttctttttaatggtctctatgagcaaccagagagacctgctttgaaaacatttcaggctaggataatcacagcccatgctcccaatgtatagaactttgggatcttgattgtttacttcttcatttattggagctgactgacaacaataggataatgtagactttgcctgtggtcactgcctgaggcactttggatgaaatgagaggtgacgattattcaagccttttgtctgtttgaactccttatactgtataggaggctctcagttttcccctctgcgtgaggttatctacacttctgggtcttgccagaacagattactgctatatctctgctgtccaaatggtattgaaagttcagttggaagaaacaggatttgaggaaactgcataaaagatattctatccatccatgcctctaaatatttgaaattcgatccttggattaagtgagacaatcagagagcctgatacccccacccttctggattgtgtttgctaacctgcccttcagtgagctcacgactggtcagcaaggaggacaataaaggaaacagcagtcatgagataggatatcacgtccacatggaaatactattgttgacattgacctactcaccatctagcaccttcctctttgatgatctaaagggcaattagccttcacatcttccgagaaagaagaagcacgcttctgctgagataatacaaacacttagagattgtgctcattttgtaactaactctcttaagttctttacttagagcaaacttctgtccaccttcaccaaatgtggcaacttaatgattggggtcctgaatttactccagctttcttttcttttcttatcctgattttctaagcaccttggtttcctcatctatttttattttatttgcagtttttgtcagcagcctcaaatggtcttctgaatgaggcagaatataaaaataaattatctcacttatatatagaatctaaaaaagtggatctcatagaaacagagtagaaaggtggttatagcaggggctgtggggagagggagaaggtgttggtcaaaggccacaaagtctcaggcgggaggaatacgttttagtgacctatcgcactgcacagtgaccagagttaataataatgtgttacatatttcaaaactgctttaaaaaaggatttttaatgttctcatcacacacacacaaaaggtaagttggtgaggtgatagatatgttaattagcttgatttaatctttctacaatgtatgcatagatcaaaacattacttgatttaatctttatacgatgtatacatagatcaaaacatgacactgtaccccatagatgttcacaattactacttgtcaattaaaaaataaattaataaagtatgaataatgtgagcaatatcatcatctcctttcctcagattaaaaagcaacaattaggctaaagagctttttcaagattcaacagataaattaaattacaaaatggggccctaacccgctaactacaaagttcgtgttcccttgtttatgtatctacatacatatgactacctggtatgttgggacacataactgaaatccaaatatgatatttttaaatatcatgtaactttttagtttccatccacgacattaagactttttaccagatttgtcaaaacatattaaatcagactgatttggcctttactttccttcctcttcctctcagttctgtgatggagatgccaacatgtaatagagggacccaaagtggatgccagaagagagagaacaattaaaggatgcagagaatatgtccagtgagacgtttgcttgtcagtgtctccctggtggtattagaggggagaatgttccatctgaacagattaaaataatgaaacgtagcctggttttagaggaactttgttttatgatctttgaaacaatgcagacgctccattgggactgaatgttataatctgggagcaggcctaatggggcctgcttttattgagtagagagaagtgcttcgtaattagtgttgcagttatttgtaaactggcgtgtctaaaatgcttgagggcctctataccagccctttaatattttgaagctgttgtcacagaaattgcatttgtatttataatttgtgctttctccaaagaaagttctatggaagaaaggtaaatttctgcctactctgacatgattacaaatgctggttttttcgatgacacaatcagatttttaaatatatcattacttgatttccctgtaaggaaagttagaagagaggtaaactagtatatccaagttatggctgagtctacaggagaagcaaaagttggacttaaccaccaagcttctataaggcaagttctttccctaattcattctgagtctacaaaaggcggttattctacaaaaggcattctatgtcaatccctaagaaagattccactgatactccaaattatagaaaagtttgctgaggctgttggttacaagtgacagaacccaactaaaaccaattcagaaaaaaaggctaggggagtacttcttggctcacctaagaaaatcacaggtaggcaaatgtggagttgacctctggatccattgggagagtaaatgaaagaatatcatctctctcatactgtctctttctctctcattatctctttcattccgttcatttatatatatttttaggatgatgaaaacaagaggtatccattaatgtttcacatttccactttctgtttgcttgggaattagttgccatttcagttagctataaagcctgaggaaattcatatagcttagaagagactgaggaaatatatcacccaaatgtcatatgtggaccttgtttggatcttgatttaacaaaataacagtaaaaacaaattgagacagtcagggaaatttgaaactgacaaaaattatttagtggcaataagaaattattaatttttaggcataatggtattgctgtatgtttttaaaagtctttatcttttaaagatatgtactgaaatatttatatatgtatatggtctctgggaagttgcttctatgtaatccagtattgagcgagaaaggtggtaagtgggtaaatagatgaaaccagaatgcccctgaattgaacttgttgaagctagatgatgggtgaatggttcttcattgcattgctctctcaacttttgtgtatgtttaaaattttcccaatgaaaatcttttttaaaaggatttcaaaaattagaatctagaccaaaggcagtcccagaaatccatgagtgtctctaccttcaggttgttttccagttagggagatcttccctttagatatgtctgttccaatgatcctaaaaggtccagattgccctgagcgagtaggcatcaaaacaatgtctcctctgaaataaactcagccattccacccagcaacatggccaaccgccgtaaccacaaggaatggggaccacagggagaggttggagtaatgatgagcttaccacattgatcattccatcaaagtgggtacatatttaccaggaaggtgactttactgctatttgcaagaatgttaagcttgctgtggggtattcactggaaagctcccaggaaaagacagtgagatgtgaccctgttctttggacccttgcgatgggcagagcactcaccagtgtttggaaagcatactgcaagagtgggaattactgttttcaaggatttgcactacttatttttgcatacatgaatataattaacatagaatgatagttcagatacagatgttaaggttacaataggggcttgatatttctctttaagtgtttagtttctgtgcggtaaaataaacaggtagagctcttaatttgtcattactaaatttcatatacctagcactttaggaagctctaactgcataagcctgtctagaacttgtcaattcaaccccaagtctctatcatctgtttaagaaaacagtgaactgagaaagtgactctgtattataggatcaatggtttacagccttaagtgaaccattctgactcagatttcaaatctgaaactcacatacttactagtaaagcccttgacaggagaaatattgcaaatgtgtaattagagtgggcaaaaaacacacaaaaacatcaacaataggtataagattttgcaatgccatctggtggatgttactaagccatatccatgttcacatttccttccttcctgcttcagtctctttgtcttgaatgcttgggtttctaaaaggagaaactgttttgctgcaaatgctggctttgaggttgggggttggaagagaaactttcttataaaaggcagagtgttagaaaaaaagcaaatctaagttaacttgagccgtggagggtagccttcccttccctgggttaactctaattggagctccccacagaattcactaatgatttccttacgatgtgattaaaaataggaggatgctgtggaaatacgtccagtaccagaatgtcccaaggaacacctgggcaacagaatattggtcaagttgctgaccttgaagtaagtatcaacaaacacactgccaccgctttgagatttatcttgccttttacatacaaatgttgtgtttattatcagagcttgaatcaaagcggagctcccaaaatacgtctaacagtgggcagctgtggagtagtagaaagggcacgtttgagtccattcctggattttttttctaccaacttcttgatggtcattcttctacaatagagaaggcaaacacacgtgtctactaaagttaggcaggtaaggtcattgagtgaaatgacctacattaagaaaaatagcgcttaagtcagtggtgtgctggagtcgactgtactaactcgtgagatctgacagtgcatatctcttcctgggttcggtgaagtcacattggtaactttaaattggccatggcgaaagtatttacaatgtagaaatcagccaatgctacacgtttgcaccaccctcagcacccggagattatttgtaaaacatttaccagtatgccactgttgaaacacaatgataaatgcaactgaaactcagtgccaggggacaatagggagtggtgaggactgtagtaaactatgttaagggggcactcactgctagcaacagactcttgccatccaaataaacaggcccatttttgtcaactgtcttttctattttttcaagagaagctgaaaacccagatttttctgcataatataccgactccctaaatatgttctcattccctttataaacaccatataattaaaacacgactacagtctggtttcatcttgtgggccaattatttgccacatctacttcaaagtagttgcatccaaacgtttcaattgtatactatgatagcaaaaaaaaaaaatcctctatagacatgtattaattttgtactttcatattaaaatattatctacattataaaacataatagaaattttaaagatgaactagataaatctatataaattctagtattttcttcttccactgcaatagattgtcttgtgtaccctcggagtgcctccatacctctcttcgtctctgcagactgctattttcaagaattagttctccttcaaatccacagatgaaaactttaaagttgtacatattttacctaagcaaaactacagaagcgtaacatttatttatatactattagatgggtcatccatctctcaaagtcacttcataggtcccttcagcggcccctggtttgcagtgagaaggcatctggattctggatgtaaggctgggtttcaacccctgggaacttccctgggattttgagttcttccctataaatgaagttgatagaccttatggtctcaaaattcctacctaccacaaacttctatgattctaacgcatagcctctgccaacttcttctgcctcagaaaacaagccagcaagtctgctcacacagctatgggtggtctcttgatattatagtctcctcccgctggccagttctaccagagggtcttcagggccttttgtacggagaaatgagcagcccataaaccagctgagtgtcaagtaatgggcacagaaaagcaagctcttgcccttgcaaaccaacctggcagtgggagcttcctcatctgtctggttggcgggaggactgagtggaagtggctcttcccctctgcattgtttaggaagccttcgctattgtctgagggacacacctgccccgacaggatgcatcatcaggctacttttagatgcagcgactatgtcatttgagatggcagaaattctcctctatggtgctcatagccaagctttctagacctctccagtgaatgagaggcagctgttctcacaggtgggaaaacatggtcactaagagagatatgtgttattttaaaaaaatgttaatggaggccaagtgtggtgactcacacctgtaatcccaacactttgggaggccaaagtgggaggatcgcttgaggccaggagtttgaggccggcctgggcaatatagtgagaccccctctctaccaaaaactaacagatgtgttaatttttagccctagctacattgggaggctgaggtggaaggatcgcttgaggccaggagttcaaggctgcagtgagctatgatcatgccactgtattccagcctgagtgacagagtgagaccctgtctctaaaattaaaaaaagaggagtcacttgaatatctcttaatgaaaattgtaaagtgcagtttctagtgatgtccccgcaactgccaaagcagaaattaagtcgaattgacatatttgccaggtgcacttggcctgctcatgtgttttaaatagtatctatactaacctataactgcaagagaagagatagaccaaaaagacagccctccgagtaactacttagagtaaactagatgaaagaaagaaacaaattcttataggtaagcctagaatgtgacagtatgaatagtaaaaatataagggtaatattaatggcaaatgttttcccatttacattgatatgtaggattctattcataatactacatgttttagcccctgaggaatttgtttaaagttgtagacatctgtaactgtctctgtattgcttttcagaaatatagaaaccctcaaagatacagagagaattagggtcctgccaattctgcaaatgtttgtaacagaaaaaaaaaaaaagaatgacaacaaagtatttttctgttttgtgttttaaatggagaaatattttaagatttaataccatcttatgaaaagtaatctcagctcttaggagtcttcttgatggtgaaactttaatgtgcagaaaatttgcccaggcagtttcttttaaatgcagattttggaggaccttccataacaatctccctcaagagattctggttgagtaggtctcaggtgggatcaagaaacctgcatgctggctaacttcttttgcttcaaaatgctagattctggggactacacttaaagaacaaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaaccggaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgaccagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgaccagagatggctgggctcaaaacctgaccgaacactcacggaaaaagcccaggttctgtgaccagagatggctgggctcaaaacctgaccgaacactcacggaaaaagcccaggttctgtgaccagagatggctgggctcaaaacctgaccgaacactcacggaaaaagcccaggttctgtgatcagagatggctgggctcaaaacctgaccgaacactcacggaaaaagcccaggttctgtgaccagagatggctgggctcaaaacctgaccgaacactcacggaaaaagcccaggttctgtgaccagagatggctgggctcaaaacctgaccgaacactcacggaaaaagcccaggttctgtgaccagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgaccagagatggctgggctcaaaacctgaccgaacactcacggaaaaagcccaggttctgtgaccagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgaccagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgaccagagatggctgggctcaaaacctgaccgaacactcacggaaaaagcccaggttctgtgaccagagatggctgggctcaaaacctgaccgaacactcacggaaaaagcccaggttctgtgaccagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgtgccagtccctaactgtgtagactttggcaagttccttattccctgggaaccttgctttcctggtgtgttaaatgcagataatatctgcattacgctgtagttgtgtaaagagactgatgtgtggaaagcacttattataacacaattttaagtctttaataaatgtcaattctctttttctttctcggaaccacagaggacttactactcagtaccaacctaagtatatcacagcaatattcaggccctttgtgtagtagggagtaaacaattaaatatagattgagcatgccaggcagcagctggtgagcctaggcccaggaaagcctccaattggcctggtgcagtggctcacacctgtaatcccagtactttgggaggctgaggcaggtgagtcacctgagctcaggagtttgagaccagcctggacaacatggtaagaccccatctctactaaatatacaaaaattagctgggtgtggtggcacatgcctgtagtcacagctgctagggaggctgaggccgaagaatcgcttgaacctgggtggcggaggttgcagtgagccgaggttgcaccattgcactccaccctgggtgacaagagcaaaactccatctcaaaaaaaaaaaaaaagaaagcccccaattaatgtgcaattacctaataatagaaagaataatcatagaaatcctcaacactgggcttttcggtggtaaaatgtatgtaacataaaatctaccatctttttttttttttttttttttttgagacagagtctcactctattgtccaggctggagtgcagtggcatgatctcggctcactgcaacttctgcctcccaggttcaagtgattctcctgcctcagcctcccgagtagctgggattacaggcacttgccaccacgctcggccagtttttgtggtttagtagagacagggtttcaccgtgttggccaggctggtcttgaactcctgacctcatgatccgcttgcctcggcctcccaaagtgctgggattacaggcatgagccactgcgcctggccaaaatctaccatcttaaccatttttaaggtacagttcagtggtgagtacattcacattgttctgcaaccatcaccaccatccatctccaggaatttttctcttcccaaactgaaactctgtacccgttaaacaataactccttattctccctactccccagcccctggcaactcccattctactttctgcctctatgaattttactactctaggtgcctcatgtaaggggaatcatgaagtaactgtctttttgtgactggcttcttttactcataatgtcctcaggttcatctatattgtagtatgtatcagaatctccctccttttatggctaaataatattccattgtatatatgtagcatattttgttatggcctcatatatgtatctgttcatggacaagtgggttacttccaccttttggctattgtgaatagtgctgctacttggcattgtttttaagatacattcacacacatcattatacgtgatcctcacaacaaccaggaaaatggaaaggcaagcatccttaccttattttgcagataaataaatggaattcagaaaggcgagtaacctgattagggtcgcagaattagcagatggtggaggaggaacagagtccaggtctctgcctgggtgccctgggagtctgccatgattccaaattgcctcatttccaaaggcgccatttgagcaaataaccctttttgtctgtgctcatattctgtccaaatattcttctaaaaagtcctcttttgagacaaagctatccattgatgaggacatcctctcacacatacctggagacaaaacatgactttattgacatgatgtctgaggtaatggtggactggggcccttttcctggtgctctctgcaggtaacatccaaagccatgggacatcaagctgagaaacttggaagaccttcaccagtgttccatgtgcacctgtaatgtccaccaagatactaaaggcaaataatgcaccaggattatgctttgggattcaccgtttcgaggggaattggcaattagggccaatatgagggctcatctttctagctctcatggggcccaggcacctcagtgtttatctgctgtgctcaagcccctccctgacctcaactcagcaactccccagtaatggagttaggaagggccagacattcatccccatcaaaacccagccttcttctgactgtcccactacaaatctaaggaaaagcaattgaacttttcttttgttgccatctgaaaagccccattccttagaattgaataatacagattctatcctttaaatttttttatttcaatggctttagggtaagtggtttttggttacatggatgaattgtatagtagtaaagtttgagattttagtgcacccgtcacccaagcagtgtacattgtacccagtatgtagtttttttatccctcatccccctctactctcctgcttctgagtctccaaggtccattataccactctgtttgcctttgtgtactcatagcttagctcccactaacatacagcatttggtttccattcctgagttacttcactcagaataacaacccccggctccatccaagttcctgcaaaagacattaattatttccttctattttatggataagcagtattccatagtgtatagataccacattttctttatctactcattggttggtgggcaattaggttggttgttggttccatatctttgcagttgtgaaacagatactatctagcaataaaatgtgaaatgtgaacaagtccattacctcagacagaaagtctaccctctgaaaacacagtagttacaataagaaggtgaatcacactaaaggtccattcagcccactctctcttgcagtgagtgagtgaatgagtgagatattccaaaaatatccaccatgcttttgtaatgtccaccatgatctcaaatgattaggaatttttcacaaacctcctatatttctctattaatatcccagtgcgattctcatatacttggagttttccaaatatttcgggaaactgctcatatttttaaccagtttatctatctaggtgttttcagaaaattcaaaattatctaactcaaagccacatagattttcctctctttctatggtaggttcgagattgaaattgagcccctgtttgccagcattgccctctacgatgttaaagaaaggaaaaaggtaagaaagcaaagaaaaatccatccctaaggcacatatattgttcatgattctttgcatgtatgtttttaaatttctttgcagcaagaacctatcagatttgaaagcaaatgatctttgatgagtccagttctgttgcctttgcaatttttcaagcagtggtctgagaatgtaatttatgatctttgaagaattttagagggagaggctactggaggtgctggcctggttggaatagagaaagaatgaaatagcgcatggggttatgtataaaacaaacccatttaaatacatttttaacaagcttggatgcgcatgtaaagcttcctcagtttgagagttctttgcactgtgaaataggctcatgactgaagggcatcttacatggtagaggtctcaatttgtcacagagttcagaccttaccaactgtaatgtgcttttaatgaaaacagtgaccaagacctctcgtgtgtttttaatgtttagtcattttgtgactcctagaagaggacagcaatagcaaatccagagtaggatggacacttctgcccttctttacccataatcattctgtatttaaggaaacaagcatctcctgcataaatattaataatcactgagatttgtaggataggttaactgctaaaacaagcagaacccaatctcagtggtttaaagcagtagttctcaaacttgagcatgcatcacaatctcctggaggacttgttaaaacacagattgctggacctcacccacagagtttctgattcagcaagtccaggtggggcctgagaatttgcatttctaacagtcccctgctgatgctgaagctactggtcaggggaccacattttgaaaaccgctggcctataagcaagaagttgctgtctttgtttctttaaccatccagggtgggaggagggacccctctgttccacgcagccactcagaaatacaggctggcagtggctcctccatcttcagtatgttctctccccaaattactcttgtcactgccattgctgcccctgaagaagagaaaagaaggatggaggaggcctggaagtttgatacattgcttctgctaacaattcactggagagaattgagtcacatgatcacccctcattgcaaaggaggctggtaaatgtagtctctgcctgggcagccactcaccactaaaattctcatggtgatgaaggagagaacccaaccatacagtggctcttaagtaatacgacactaagagagccaggagcactgttcacatcatgctcttgctcagaatcttcactaagattcattccctacaaccaggctttcttcatgatggcattcctctaccttctttccatccatagtctatgcagagtcaagctagaccgctgactaagcttcccccagccgttcaagcctctgagatatttattcatactctaatctctccctggcacatcatcaccttccacccctgcctatcagaatcttctaaggcccatccatctccagtgctgcttccatgaaaagttgtccttgtcacccaactgcaaatggcctgtcactctggaacttccacagtgcttctttgtatgcatgtggtgacttgtattttgcttttactgtagttagttacatgtttaccttttccctcacctttttttttttttttttttgagtcagggtctcactctgttgcccaggctggcatgcagtggggcgatcttggcttactgcaccctctgcctcccgggttcaagtgatccatcctcccacctcagcgtcccaagtcgctggaaccacaggcacatgccaccatgctggctagtttttgtattttttgtagaggcagggtttcaccatgttgcccaggctggtttcaaactcgtgagctcaagcaatgtgcccgccttggcctcccaaagtgctgggattacgagtgtgaaccaccacacccagtccttccctcattcttgattgtgaattaattgagagcagaggtcctcctcttctgtagtgaagtaactgatactcaggaaataccggtgggttaataaacatttaaatgtttcaaggaacatctctcaaatggctccagaatacctagacattgtgacaaaacatttgtcagatttatccaggagccactttcctaaaccacatctgtgattattacacttactccttcagcaaaatttctctgtggtgtttttactcctttttaacatgtttaaaccatgaatgcaacaggtctaacttatatttcactttgctgctcatttacagatctcagaaaattttcactgtgacctgaactctgaccagttcaaaggatttctgcgagctcacacgccttcagtggccgcatcaagtcaggcgagatctgcagtcttctcagtcacctacccgtcctcagacatctacctggtagtcaaggtaattcagtacgatctgatttgcccaatctgatgttttcattgctgtgttgttcccagcacatgtttggggtgcacgcaatctcagaatgtgtccacatatcctctgagattcactttgtttccttctcagtttaccccttttccgttctaagtaaactgtttcagatactagaaagactaggttttggagacacacagacctaggtttgagtcctggctttacaacctagtaattaaatggcattggcagtttcctggtctttctgagactgagtttcctcatctgtgaagtggagataatcacactgacctcagtggatagtcatgactacagaataaagcttggcacatcttgggcacccttctcctaattaaggagagttccctcagtgacctggtgcaaagaagctgctgtggagaaaggaacaaaatctctgggctagagtttcctaacgatgttcatgttgctctagagatgcatagttacgtgttcccaagtccagcctcttacaagctgaagcgtgggctgtggttttcaagtttcatcctccttttttttttttcttcttaccatgtcacagactgtctctaatgagagttgaaatctatggggcaattgtaagtagaagagcctttcattctaggctatactctttgctgttgtaagaaaaccagatcctttctctgtacaccaaaatgactggttagaaattaacaaacatcaggtattttacctaccttaggccagataattggtcttattgattcttttttttttttttttttttttttttgagaggagttttgctcttgtcacccaggctggagtgcagtgtcaccatgtcggctcactgcaacctccacctcccgggttcaaacgattctcctgcctcagcctcccgagtagctgggattataggagcccaccaccccaaaccaggctaatttttgtatttttagtagggacaggatttcaccatgttggccaggctgatctcaaactcctgatctcaggtgattcacctgtatttggttcccaaagtgttgggattacaggcgtgagccactgtgcccggccgtaaaatcattgtaaaaacaaaacaacaaattcaggtgtctgatttcatgtgcccccagcctcttaggtttggaacattatctagttagtacagtgttttatgtctgtagtctcagtgatcgccccatgatctcatggattccaaataattcaggtagctttgaggtcacttaacagatggcaaatgtcttttcactctagcttctttaacaccatataacaaagattatgagaggttactgtagcttgaggggaacttatttaagcttatagaagtatagttaaaattatattgctgaaaagacacttctattgttgtcaaacttcaatgtgtctccttttcgttgcaatattacttagacatacaggaaaattaaagcccactatgatagccctgtaggtaagttcacaattctctgtcagcctaggaaactgaagaagccaacactagttctatagagccaaattttatctcaaactctacttcccagtggatgactttctcttgattaatccgtcatattctgccaagtaacagtggttacccattggttcctatcacttactaaatatgttccaaaattttcaaatgtataaatgtgttcatttggcataacaaacatactaaagtgtttggataggtttaagaaattgaaatctactcagcaagacagcccctggttggctttctgtttgcttttctttatcgtaatgccatcattgttgcttctttccctttaaatatatagtaaatggtgttaaactatttagcacatccaggcagacattatttggtaagaggggcttctttcttttttgtttatattcccaggccgaacatcagggtctttactgtattttaggtagcatcatctagttcaggtgttgcatataatacggctttaagggattatttccgcttaaaagtttaattcaagattttgtgaaatttttttttaaaaagaatttgttttacaatcaaggaaagaagagtgaaaatgggattgaattggaaacttttcaaaaattgtttaaaaattggtatgccgtgcccaatttaaatatttcataagttgcgatgggcctatccttatgtaagggccacatagtttgagaaaacacaaagcagagagcctagcactttagaagtcttgcagatgttaaatttcccatcttaaagagtttacaatccagttaaaaaaacaacttggcattcaaagaaatgggttcaaattcctattttgctacatttgctgtgtatggtagcaagtttagtctgtcagtctaattggacaatgatccctgtgcctgagtggttttgaagaaaattgaaataatgtatgtaaaaacacctaccctgtacctgacataccataattaggtaaacaataaatggccatgaaatatgaaaaaaataggtatgccaagtgttaatcctaccccttctgaatagagcagaaagtagtctgttcccttaagaaaagttttaggttaatctgataggcttatttgccctactttccatggttatgaggagtcatgcatttcattacacacttttgcataaatcatgagggaacaaacaataggttctcatgtcggtctgcagctccttctcatgaagtacctggagttctccttgcccactgcagccagggcatagtatctgctggtctggtcaaatctgacttctcctgcttcctgtatgttccatgatacacactactagtgcatgaagccgtggcattccccttccttgcttcagggtcctaattaagaagttcttcatctctgttcagaatttattctaaagaccacatttttaatccattcacttcatggaaaaattagcttccttccaatttgttctacaagctcctgactatgagcttcaggagaatgggggcagtgtttatcgccaccttatctcccagctgctaccatatagaaggtactcaacaataagtaaacgattgctgattagcaggaatactggtcagtttctagctcaagtgttacgtgcttatgttttcagtgtggtgcatctctcagtgggattcgccttctcttcatgctgtggcaatgggagggggttttgaacttctttgatgagaagagagacttcctgcttggagtcctccctgaagcagatattcattgagtagcctcatgctgcttcctttgaaaccccataaatgcccctttatcatgggtattgttaaatactttgtgcctaactcacagcacctattaagtatgtgtcccttttgtactgtgttgacccaaattctttcttcaaggatcatctcaactgatgggactaaatccactggttttactcttcaacatctaagttaaattttttttgagcagagagttaggaaatttcaaatttctccttgtctttcttttaaatatggtgcccaaatttatgacaactggccagccagtcactttacctgaagcaagacagaagacacttcattcattcttattaccagcattcattcctatcaacagccagttagcaaagcaagaagctgcacatcccaatgcttttgagtttctttccaagtctgttaaatccagagaattagccctgataggaattacaagggagacaattacagataatttattcggttcagtcattcattttgtggaaggttttagtccctaacccaactttcacagagaccatatctcttttttacattgtaagcaataataaagaaaatgagttttccacttcctacgtatgtctcctgggttttgttttataaaataacttttattgctgtttttattatatacataatacatgtttattgtttaaaatagaaaatacacataagcaatgggaagaaaataaaaatcacacataatcccaccatagaaagttaactactattaacacttgctgcatttgctgagtatctactgtcacccttttaatatgcctttatgatttgttaaataaaattgtatgctattctttatataaattttttaataaaaaaatatgtatcacagatagcttcctatgtcatcaaatattgtcataaaatgtaattttgatggttgcatagattcctttttatggatgtaatttatgtgccttattttaatattctttttattggtagattgaaaaagtcctgcagcagggagagattggagactgtgcagagccctacacggttatcaaagaaagtgatggtggaaaggtatggtaatttgagtgttgttaaatggagacatcttagaagaagcaggtattttcagaagtgttacacaaatagttaatgggctttagtccctaatgtgtccctatataagacactactacattttaattaaataaaagaggaaaagaaaactggtcaccgatgatgactttttttttttttttttttttttttttgaggcagtgtcttactttatctcccaggctggagtgctggagtgcaatcacggccccctacaaccttgaactcctgggcttgaatgatcctcccccttcagcctcttgagcagctggtactacaggcacatgccaccatgcttggctagttttttatttttttttagagatggggtctcactgtgttgcccaggctgctctcataattctggcctcaagtgattctcctgcctcagcctcccaaagtgttgggattacaggcatgagtcaccatgcccagcctgatgatgattttttagagaaataaatccttgaattttctaatgttgacatacagcaaggtctgactgcataacttgattggggcaaggccaccccctgttgtcttcattctgaggctctgactcagctggttgggaggtccgtggagaccccaaaactaaacagtgccagagctctcctggccttcctcaacagcatgggccgctgccctttcaggtatgcaaataactgggaattggctgccactaccatgcattatatatattcattagcacagcataggtgttgagcctatgaaaaggatatcttttctcaacagcaatttgcaaagattcccagtgtgatttttaaaacatggccttggccgggcgtggtggctcacacctgtaatcccagcactttgggaggccaaggcgggcagatcatgaggtcagaagattgagaccatcctggccaacacggtgaaaccccgtctctgctaaaaatacaaaaaattagccgggcatggtggcacgtgcctgtattcccagcttctcaggaggctgaggcaggagaatagcttgaacctgggaggcggaggttgcagtgagccgagatcgtgccactgcactccagcctgggtgacagagtgagactctgtctcaaaaaaaaaaaaaaatagcctttctggaataagacttaccttattagtattgtactctacagactcataaatgtcaagtaagatttattgaactcaaggcattttttttttaaaatctgtcttttattctgaactcagaaagaacaccttggaagtattgtaaacttcctaaggagttgttaggaagctttttagaattttttggagttttccaaggtgacttttggagaaacaggttcacttgggagcttggtagatgatatactaaacttgatttcaagattcttttatgcaaatccaagtcacatagctagccaccaaaagaattgataatctgatgtaatgagtctctttttgttttcgttagctaaaaatgtattttactaattaaatgtagcctttttgtaaactcctcgttttttaatctttatttccttatcagctagacccaagtgcatcatttttctgcctattcactgtttttattttttagtgggaagatatgtttttactctttttaatcagtagggtttggattttggagatggctgtcatattcaggtcagaggcagttgacttggtgctgatgcttgtttcagcttgtttctttccattttcctccagagtaaagaaaagattgaaaaactaaaactccaagctgaatccttctgccagcgtttggggaaataccggatgccctttgcctgggcacccataagcttatcaagcttcttcaatgtctccacccttgagagggaggtaactgatgtggactctgtggttggtaagattttcacctgcagtgggaaagggagggctccccagtgtgcgctgcccaggtccacagcttactagcggggactgggggcacagtgaggtgtgggaagtggggaggcagaaggagataaatagaatgaaacactgttatgactggattacgtagatttggacggtgatctccaaaagaaattatcacgaacattggtgaagattaagtatactcttatagtaagattttctagatggtatgacactttaaaaagctgatttttgctagccacccgctctcaaaagtaaaactttaacaagaaaatgtagtaaccatctgtagtgtgttaagcagagacaccatggtcgactcctaaacctaaaaaaaaaagcctctgttacaaaggcttcaaaaagcaaaactcaacaggaacagggcgtggtggctcacgcttgtaatcccaccactttgggaggccgaggtaggcggatcgcttgaagccaggagttcgagaccagcctggccaacatggtaaaaccctgtctctactaaaaatacaaaaaatttgctgggtgtggtggtacacgtctgtaatctcagctactcgggaggcagaggcaggagaatcgcttgaaccagggaggcgaggttacagtgagccgagatcaggcctctgcactccagcctgggcaacagagcatgactttgtctcaaaaaaaaagaaaaaagagaaaaactcaagtttcccagcaaaatttccagttcgttaaagtttactttgccaagtgcaatgaaaaaatgggcatccaaagaatatttactgttttagtttatttagcatatttctttttcgtcatctcacccgtgatctgaatcattcattcctacactgcttggtgtagaaattttcaaaagggttgcaaattttcaagtagacctgcccatatcacctgtggtggggtttctctttccctaaatgcttttgtatccaccaaatatagaagtccatgttcacatcttttcatgcattccttaagctaaggcttaagccacttctgaaatactaccttgagcagggaagtggaggaaagggcattttgtgattgctgctgctattttggagttactggtacataatcaccagtcagaactcctgggttatttctggttcgtcaataacaaacctcactttaccacatcctgatcttcctgccacagctttctttaatgccgtctatgtagacccaagtaacttattgataagagttatgtatagagcttagagggcacacaagctaggtaattcaggatagggcatgctgaggcctcaatcatctctaggtcaaggataacctgacaacagagactgattcttaaggagcaaccagaagatgcaaagatgtcatgtattatactgaggcagaatggcaagtttaggtgggtagaggtagcaagaaattctaattcaacatcatggtaagaattaaggataagaagatactcaaagacgggttggaactgctctagttctaagcaatttgattatttacaagagaacccatgagtttttgcaatataaaagcaacaagatctccacccaaatcccaaaaggggataagaaacaactgggcaaactatcagggtcccagcccaagtctgagtgtgatttggggttctaattcccattgggcagatcacccaaggcagaaactcagtcttgctgcctggtccacataatgagagcagaggaatgctgggattcagagtgtacacaggctgaccccagcatgtttgggtcacaatcacaaatgccttcaggggcatttgagtacatgcctctcccagtggaatgcaaatatagaaataaaagaaaagcaaacactgtgctgactaaataaagcttatcaggagaccctgttctggctatagctctggactcttgccgggtggcatttgggctaccctaatttccatgtgggaggggcccatggctgctcctggcctctctcctctggtcggaggaggattaaggacaccaacaggaggactaagaaaggtaggggccaatggaaggacattttcattcaaaacaaggatggccatattcagtgttcctgatcagtgactttaatcatacatattgtgaagttaataactgctgtgtgtttgaacagaaaggcatactttggagtgacaattgtttttcttaaagggagaagctcagtgggtgaacggaggacattggcccaatctagaaggctttctgaaagagccctctccttggaggaaaatggggttggatccaacttcaaaacctccactctgagcgttagcagctttttcaagcaggtatctcttcacattacagtgtgtctggatttttccccatactggcatgggcactggaacccacaggaggaggatacgtagtgattaagagagcaaattagttaagctcactctcttagttcattttctgctgcttataatagagtatctgaaactgggtaatttaaaaagaaaagggatttgtttctttcagttttgaaggctgaaaaatccaaagttgagggcccacccttggtgagggctttcttgctggcggggcctctctgtagagtcctgaggtggagcacggtgagcagctgagcatgctagctcaggtctctcttcctgttcttataaagccaccagttcccctcccatgatgcagattaatccattaatctgtgaatggattaatccagtcatgagggcagagtcctcatgattcaatcacgtcttaaaggctccacttcccaacactgccaccatggggaccaagcttcaccatgagttttgaaggggacattcaaaccacagcattcacaaagcctcaatttcattagccagaaaacgggaacaatagtacttaacttcatgtggctagcaggaaggtcaggtgacatgagacctgtcaagctcttcttagagtgcctggaatacagtaagtgctcaatgaatgttagctattttaactgagagaagggttaggttttgttccttgtgataccaactatcctatttgaactatcttggccaatccattcattatgctatgacaacagtctggctgggccatctccttcccggtggatctcagggtttcttggcctggctattcatgtgcaagtttccactttcactactgcttgatgtgcaagtttccagggctccctgcttgctcagagagggtgaccattccagatggtactctttgttagctcagtaaacatcaagactatttaaaaaaataaaaaacttcctagacttgtcaacggtatagagacagaaagtagaatgacggttgccagggtctagggatagaggggtggggagtcactggttaaagggtacagagtttcagattttttttgcaagacaaaagcattctggaggttggttgcacaacaaagagaatgtgcttaacactactgaattgtgcacttagaaacaggtaagatgggccgggcgcagtggctcatgcctgtaatcccagcactgggaggccgaggcaggtggattatgtgaggtcaggagttcaagaccagcctggccaacatggtgaacccccgtctctactaaaaatacaaaagttagccgggtgtggtggtgcacacctgtaatcccagctacttgggaggctgaggctggagaattgtttgaacctgggaggtggaggttgcagtgagccgagattgccccactgcactccagcctgggtgacagagtgaggctccatctcagaaaagaaaaaaaaaaagaggtaatatggtaattttatgttagttatattttgccacacttaaaataaactcgcttggtctgactctgttttggaaagttttccatagctacgcagtcttcgtggagcatttaaaggggttacattaacaaactgaaatgcaaaagggatgctgagggcgcctgtgcaccgtgccacatcatagaaatagtaaaggtctgaaaaggtttctattcagcatacatgtacccttcccaatcttatgaccttggaggacaaggtacttaactaagtctggatggtctcactgggaataagacatatctacccacttaccttactgggttgttgtaaggattggagatcatgcatgtgtgctcctgacccatcttgggcatatgtgggggtggacagcatttatacttaaccttgttcgagacaaatgtgaagaaaatgagatggaaagatgctttctccaccttcgaacatttgaagaagaaagtaaacttattctgtattgttccggggggtaatactggcatcagagggtgagagttatcggggggaagcttttggcctggttttctaatggtcagacgggcttccttagaatgcagcagatgccccatccccagaaggactgataagaggccgaggcacagtgagtcacagtgattgagaaggatttaacaagaagtggagctcagtgatttcagagctgtctataatcctaatttctatgaaagacttgtgagaataaaacttaaaggtaaaaatcttcccagaaatcgtttgtccccaacccaagagtcaaaggtgcatctacattaactctgacttttctcttggcaggaaggagatcgccttagcgatgaagacttattcaagtttttagctgactacaaaagatcatcatccttacagagacgagtcaagtcaattccaggtgtgaatgacttatctttatcctctttagctgtgccaaaactgcttatcgttagacacagtctttgtctaatgccagaatttataaaatcatgtttgccaagtgaaatgtgagattttgtgttaggggttaagaatctgaattgttctatgtctttggcaaacctattaatgtttttttaattttcttaaaggattgatttagtaaacaaaccttgtgctttagatctggtttctcagataatgagataattgtttaaacagaggagcccctttaatcaaataaaatattatacttagtattaaaaaagtaaatgtgagatgctttggtagaaggcaaaggcatcttccttatcctcactcggcagccctggaggtacttctgtagcatcctcaggtccagggaagccagtttgtgtttgtttttgtttttttgagatggagtcttgctctgtcaccaggctggagtgcagtggcacaatctcagctcactgcaacctctgccttccaggttcaagtgattctcctgcctcaacctcccgagtagctgggactacaggtgcctgccaccacgcccagcttattttttgtatttttagtagagacagggtttcaccatgttggccaggattgtctcgatctcttgacctcgtgatccacctgcctcggcctcccagagtgctgagatgacaggcgtgagccaccacatccggctggaagccaattttaaaactcccaatttttactgctagcaatgcagggaagttacttaacaatgtaaaattatactgtggtaattcaggaaagaactttaaaaatcctctaatccattccttctcattttacaatttcttgctttatattttattttatagaggctaaatctcgaaagttatcatgacacacttttctcaagctgtaggaaattagctccaaaacttttttacagtactatagtttgttcttattttcatgaaagaaacacagtgcaacaatctttcttgattccctcataacatgacagtttctttactagaacattcctattttctctctttaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacaggtaagaaacacaggctcgggctgggcgtggtggcttacaccataatcccataactttgggaggccgaggcaggaggattgcttgagctcaggagtttgagaccagccttggcaacatggcaaaaccgtgtctctacaacatatacaaaatttagctgggcatggtggtgcatgcttgtaatcccagcaacttggcaggctgaggcaggagaatcgcttgaacccaggaggcagaggttgcagtgagccaagattgcactactgcactccagcctgggagacagaaccagactctgtctcaaaaaaaaaagaaaaaaagaaaagcaggttcttggaaaaccgttgagctcacattctgagttttatttgaataacgttttctcatccttcaacctgtcttcctacttcctaagtttcagggaaatgaaatgtgatatttatgtaaccgtaggtgattgccaaatctctttctaaacatagtttacctaattctctttaacaagaaagggttacttcagatgtaattgtagtttaggattatagtggacatatgttttccagagattaaaaaaaaaatctgctagccattacctttgttctcctctgtgcagagggacatattagaaaaagagcaatgtgaccaaaatgtgctagttgtcaaaaggacaggttttcagctaaagattagctctttccaacagaatttacagcaataacataataatagcacacattccaatagcatttacagcaataacagaaagttctgtatgtgtgccagcagtacaatagccactaatcacatgtagctgttcagcatttgaaatgtggccagtgcaatggaggaactgaaaaattgattttaattaattttaatttaaagtcaagtaactgtatgtgtctactatattggagagtatggagctagacactgaaggcctaacaggttgggctgccttggtttctgaatcgcttatggtggcacctgacctattccatggggtctggaaggagtgcttgtcaacacatatctgccaaaggcattaatgctcatgcacttctttattttgagactatttcctttaatgcagaaaaggatgccttctataaaaatcatctcttccccaccatccagaaatgacattgttgttttctgtgtttttatataaaagaaatacagtggtactgattcagttgaagtcttcttttatccccagtctccagtcacagacttttacctcacctcctagacttttatcatcatgaaattatgtatttcctattttttctccttttacacacacttacacacacatctgtgaacgctcaatggcattatcttcatattcatttaaaatgtacgcaaatgacttcacactctaggtcaggggtccccaacccccgggccatagaccattactggtccttggcctgttaggaaccaggctgcatggcaggaggtgagcatcgggtgagtgaagcttcatttacagccactccccattgctggcattaccacctgagctcctcctcctgtcagatcagcagtgacattagattctcatgggagcatgaatcctattgtgaactgcatatatgaggcatctaggttgtgcgctccttatgagaatctaatgcctgatattctgtcgctgtctgccatcactttcagatgggaccctctaattgcaggaaaacaagctcagggctcctactgattctatattattgtgagttatataattatttcattatatattgcaatgtaataataatagaaataaagtgcacgataaatggaatgtgcttgagtcatcccaaaaccatcccctgccccccgctgccaccccagtccatggaaaaattgtcttccatgaaaccagtccctggtgccaaaaaggttgaggattgctgctctaggtgttatattacactttgtttttgtcactcaaaagattgatttgtttttcttttttctttttttttttttttttgtttgagtattactatggagtcgtgagtcatttttctttctacttacccagatttccacaagttttaccaatgggaactttttaatggcttgcatttttggaaatatcagtattgattcatgtaaaggtttgtgggtttttttggggtttttttcgtttttttgtttttttttgagatggagtctcactctgtcacccaggctggagtgcagtgacatgatctcggttcactgcaacctccgcctcacaggttcaaacgattctcctgactcagctgcccgagtagctgggactacaggtgcctgccaccacacccagttaatttttgtatttttggtagagacagggtttcaccatcttggccaggctggtcttgaactcctgacctcgtgatccacctgcctcggcctcccaaagtgctgggattacaggtgtgagccaccatgcccatcctgttattccttttaactgctgtttagtattcctttgtgaagaggccatattttattcatttccttgttgatacgcatttaagtctttttcaagttttcagctcttacaaacactatgaagtaagattttttgtctttgcccctctgtacacgtttgtgaaagtttctttaatatatctaaaagtgaaattaccagatcacaagtaatacacatttcagtcttaagttttctaaaattttacatttgcagtcctaacagcagtgtgagagaattcccattttccagttcctcacccatactttccagtatgacgtatgtgggactaaaatgcaaagaacttcagagctcacctgatccaagcattcccacccccacatttccagatgcacaaaattaagacccggaaaggataagtgaatggttccttgaggtcaaaaattacagcgaggtggccagacacagtggctcacactgtaaccccgctgctttgggaggctggaggactgcttgagtctaggagtttaagatcagcccgggcaacatagtgagacccccatctctacaaaacattttaaaaattgcccaggtgtggtattgtgcatccctgtagttctagctacccagaaggctgaggcagaggattcttgagcccagaaattcgaggttagccttgtgccactgctctccaaatcaagcaacagagtgagaccctatctctaaaaaaaaaaaaataatttagaaaataaaattatactgagaaatacaaacagctattcacacaggaatggagagttcttctttacagtattcaggaggtatacacttatttccccatttaatccttcctggagcagctcttcattttcaatcctcattccttacatctaaacttagtccccacgtctccctcctagaggagataagcattctcaggatgcagtagtttcgattctctattccttagaggaagatgaaggcatgaaaatgtttgcttatggatgctttgtatctttttagaaactttatcctataatcgggaaacaatgcttgtggcattggaagagacttgcatccaatgaattctgtagttattcaacttcccctcagcatttaatcacccacaggtggcatttacaatgttctctactcgttcctgcaaacattatcccttaattacatcacagtgggacttagagtgcattagtgcactgaatgatccagaaatgtaggagggcaaaggaggacaagtctggacggattacaatggacccaacttgtcatcatgagaaacagacccacaaatacagagttaatcttcttgagctgtactggccactgtagaagtgccaaggacaccccgttagaaatgccaaggccaccctgttagaaaccaggtcttggggaatgacagaagagatttctctccagtttggttgtggccccttctcttggctcacagttcttctctgtggctctcaggccaccatattttatagtctatttaaggaaagagagagataatgaacttggtttggaatcttacttcatgaaaatttcacagaatttaggaagcatcttgtctaaatatcttgttctaaatttttagtgttcttctccagtccttgtgtgctttagggtggttttgattagattgggcttgacagttacccagtcccagatgagtgtcccctttcctgcacctccccccattcacgacatggaaatggaaagaatcgagtgaggtctgaaccccaggtaaaattggcaagctgactaagttcgccttgggtgacctcaccttttcatttctgtccattttcctctctttttgttccttgccatctccccatatctcaaaaaacctggaccttgtagcttttctatactggcccccaaaataaaagtctcttttcaagcaacgatctctaaactcatttgctatggtattgataacaggtatggattagtcttatcactcccaagagtattatcattttgggccaggtgtggtggctcacacctataatcctagcgctttcggaggccaaggcaggtgaatcacctgagtgaggtcaagagttcgagaccagcctggccaacacggtgaccccttgtctctactaaaaatacaaaaagtaactgggcgtggtggtgggtgcctgtaatcccagctactcaggaggctgaggcgggagaatcgcttgaacccaggaggcagaggttgcagtgagctgagatcctgccattgcactccagcctgggcaacagagcaaaaaaactctgtctcaaaaaaaaggtattatcttggcagggacagcagttcctatttcttaattgaagaaatccagatttcttctcattccaagagtctgtcaggtaactttcactgttgatgttgctatttccatgccaatcaataatcctgatcatacctgtatcccttaaggaaatcaaataactgaaaatgaagatctgtggggcagataaattcaggaatatttcttcgtttatagaggattcacctcatgaatttgaaatatggcttggcttataaaaagttgatctgcctggagcttgtagctaacacctctgtcgggccaaacaataaatgcttacactgagaaagccaggtttgggatttcaaattaatgtgcccttaacataaactgcagagcccccctgggtggagggaactattacctggttctaatagcagatgttttctggccttgagtgccagtggtaaccagagtcacacattttaggattttggtattgatgagggtttcagctgaatattacttgagttgaactccagttatctttacctgtcttaaaggagcagctgccatagtgcctcaggtaaagttggcttgggataggctggcattgccttccagtccccagcctcaccttcctcccacctcttcactgcctcttttctttgccctgccccttcaggtgtcctgcgtggggcaccattcgagttgcattctagtgtattaggttggtgcaaaagtaattgcggtaatgtgtgtgtgctgccccgtgtctctaccttattcaagtttctttaaggaacagctgtagatgagttctggtagaactgggtagtgctcccagaagtatccccgtgggtccgtgagggttgggcattcataaaataaatccttgctctaacgatagagaccaacttctagagccagaagtgctcatcccaggaatgaccaggggctcccaaaccagcggctcgggccctctgcagtgccatgtgcagcctctgtgggttagaggcatggagctagagcagggtcctctgaaccagagccaggcaggacactctgagaaatcacaagcagaaggacagcaattctgaaagcagagcagaacagctggaaaaactgagctgatgaaaaggattatccgaatccaagcttggcgttccttgctctgtgtccagattaagaaaatgctagtggtttgcctaggaacacatttgcaccaactcctggcttattttccatgtgacccaacagctggtactagagacaccagctgctttctggtgggggcagaatgaaaacagcatgggctgaggccaaggcccagcaaggtcttcaagggcatcctatcctgcggccgccagaggggtatgtgcggagatcacaggcaatgaggttgtaatgagctgttaagctccctgccgtccctttaatgggtgattacagtaaaaagagccacataaagtacgttttcatctctcacttcagcccccgagagcctctgaggtcttgtttatccaattatcagacttgctgtggaggacggtgcttgctgagaacaagcatatcagttggaacatgatttctctgatggataattagctgttttcaggactcctcctattcagctgaatgttctcagaccagaagtctgatctggcctaacggggatgtgctcccatatcgcagtggagtcttaaggagtactacccaccttctcttctgcgggggaaaaggaatggcgtagcatgcatgcaggacctgaccggaaggaatgtctgcgagttatgatttagtgactagaacttctaaggaaagaaatgaaccagaaataactgcaaacgaagtggttaggaagaggggcaggacatggggagtatccttgaaagggacttaatttcatccaaggaaataggttcccagtttaagcccagttagctctgtattcagagtggatcttctcagtgctaggtgaaggaagggtggttgtgcatcagagtaagtgtccagccccaccctgaagactcccattcaggtggtctgggatggggcactggtggtctgacactctcttttgttcaaaatcaaagcgtccccctccttctcatggaagggaagcttccaccaacccttaatgagttcctgtaccatatggagttgtcaaatgctccataccgggcacagcggctcacacctgcaatcccagcactttgggaggccgaggcgggaggatccattgagcccaggagttcaagaccagcctaggcaacatagcaagaccctgtctctacaacaacaacaaaaaaattagccaggggtgggggtccacacctgcagtcccagttacttgtgaggctgaggtgggaggatcgcttgagccaggaaggtcgaggctacagtgagccgtgatcatgccactgccctccagcctgggcaacagagtgagactctttcaaaaaacaaaaacaaaaaactctgtcctaagtatcagatgatgcggaagcccagtacttggttttactaggcttagcaagcagtcgcttatggaacagaagcttttataaacaaaccatgtagttaggaagggcagtggcagcccaggcaaaatctagtcatttgaattagccaaggaacggagacaaagacaaagtgaatttctggtgctagttgcaacttggtctcgataataaatcaggaacacaatccccacattcctaatgccttgctccaaaactcagcaatcctcctatttgtaagaatgaaaaaattcaggagggaaccaattgcctaaggttatgacagcaaagctaccgttccagtataatattcagccactagaggacacaattcactcactttctagattcagacacacgactacctttttcgttacaaaacatatgaagtcgtgatttatgaaagtaggacacatattgtattttttgcccttgaagtgcaagaccaggaaaaactgaaaagtattgcagcatcctccgagatcactgttgtcattttttcgcaaaggattttattctagcctgtcagtttctgcctcctttcattagtaagtcctgaccttagacatctggcatttttttggaaggtgtagtggggagggggaccaagagatgcatcccttaatgtagctaaagatcgaaatcttctcattttggggagagttgcttactatacatatttacacattcaccaattttgtctcatatgtaaaccacagaatgtgccgaattttcctagaatcatggttgaggcaggtaggagtaaggaggtgctgtgtacattagtgtcactgattccaccgttcacaactccataccactctccttattttatactcttgagtccacagtgctttggtgttacagcccatatagaacggtcctacctaaaagtcctgcggtcggtttaacagtgacgagtgtcatttttccactgtcctttacatagaattcagcaggaagcttcatgaggcaccctgtttctacatgagttgccctggttggtggaggcagaagcaatggagaagtggtgatgaaattaagtcaaagttaggcttgcatttgactctgatcttgaatagtttgtctagattagagggagcacctaaaatccaaaaagccttttgtctttgatttctatacttttgttagttttacaaattattatttaaaatcagtcctttgaagtggcttcttctcttctgacgggacagctttgggaaactgtttagtcttatttcttttgctattgggaagttgtgggggacgctattttgcagctttttcatcctcagttctgacctcctcatgtgctttacagatgcccccaaaggtcagcattcatccacctttcactgagagtgtttggccatctctaaagcagaggtattttaacagctctccttaatggatgtcctgtggtttcaggcctcagacaggctgcccttgggccctcagcagaagtcgggaatcgtcttatacttccagatcgtcttttactcaggcaaaatatgagatgctgtgtcagggtttcccaagggaagaaactgagtgggaggtgcaggtaaaccccacagtacaaaataaaacagagctgtgagtagttgaaaggactgtgttttgacagcgtaataaggtaattgtttaaaaccatggctaattcatcagatgtcatgtgtcttttatagttaaaagatgaaatttctttacccactggtgtcaacaacagaaagattctaaaactttcaaaaaatgtgccagtcctggctgctttgtttcatgttctttgacaactttcaaaatgtaaattgagattcatgcaactattaatggaaatataaatatcatggcttcataaggataaaattagaggagctcaacataacggctcattttaatgatttctaaggggtttccatgcccaggctaataactgtacatttagcaataagcaaatctcaaagcctatttcttatctttccctagaattacagcttttaagcccaagctggtcgttccttttataccactccactcacttgataggggtgacatgggctgagctttctctcctatcagggctcaaagacaagtttagcagcgtttctaaacttctgtcaatcagctcacaggacacagaccagtttcgttatcccattaacagatttacatttctgttctctggaagtgtcagttaatgtccttaaaggtaatatacacaaatgtacacaatagtctctgaatttttctcagaagacacactcagaaaccttagaattctgattcattctctttggctcagacttggatgaatttgcttctcagagtagggacatgaaaattattcttaatttatacttcatgtaatctgtttcttctttctccctccgccgccctccaatagctcttctgagcttgtttgttcttcccctaactcccattgttgaaaacatggcctcccctcattctcacctttccaggaatctccttgtgctcctcaagttcggctcatcgcaaacttggagttctgttttctcatgcccttctttcattttcttcttttaagagacaggatcttgctctgtctccaagattggagtgcagtggtacgattctagctcactgcagcctcaaactgctgggcttaagtgatcctcccaactcagcctcccaagaagctaggaccactgctgtgtgtcaccacaccagctaattattttatcttttctagagacaaggtctcactctgttgcccaggctggtcttgaactcctagcctcaagcaatcttcctacctcagcttcccaaagcactgggaggtgccactcttcttgtgttttttacctttgcatttatttcctggttacaatacttttaacttaatggctgctgaactagattctgccaatgtacgtgccgtccaggacacgttcatgccactttaattttcttagaacatcaatgagatagtcttactagggagagataaagggcaggggtttggttttctggcaggttttctttcattttaataacgagccaacccacggaggaaggaattgattgatggctgcttcctcttttgtaaagaacaaacatcaaattagtggtttgtcctcactttgcggataagcagaataataacacctgtgcctctccctgcattattttgaaactaatataattttgtttggacagaacgtagatagcaaccttaatggggaggaatgtggaagaggaattactgaagggggaccagtcagcctgtcaggcagcaactctggtgccaaagaatggacataggatcagagctgtggacccccgtcctgtttgtaaacttcctgagggtggcagagattcataccctttctcccatcaggacaaaaatcagtgtgttggagctcactcaggaaatgctctttgggattggcatgggaaggggatgaggccgattgacaattagcctagttcactgggattttgttgtaggagctgggtggtggcaccatatggccaacaggggatgccagcgacatccctaatttctctggcttcctgataggtcctggtagggtcggggttccaccgggatttgcctagtatggtctacctctgactgaaattaaactctaagtaggtaactggggaacgcctttctccagagagaaggttttgatgtgatctcatcatcggggactggattggacctggagaaatcagtttttctatagtcttgtttctagagtggcaccctggtcttgggcaggtcagaaggacagatagttggtcaccatcttcaacacaaatcatggctggaaaagggccccagtagggagtgcctttctcactcaccaatcaccaaggctagaagatagtctgcagattctttcagatgccacaaagctgtgattacagctgcccattggcaaatcaggtactagtttttgttaatcacattgcagtcttccttcactgtttcttcccctggtcccggaattaaggctgggctccatttgacaagttatcttctgtgcaggtagagcagcaggctgtgttagctcacagcatctactcagtaggcatggaaatatccactgaatgggactgagaaagtggaatgggaggggaacgtgtgaagaacaggaagtttgcctctttatgtccaaagtctgtctacttagagcaacaggatggtgatgatgctttctggttaaagatgtcatggcaacagtcttccctagacagctctctagcaatagccagtggcatgtaaaccctgcatttttgcactgtatccagtgtttgcaactcccttgtagaactttccctgaagtcagcaagaaccctgtgagaatcaggatttgtctagaaatttagcatttacctaatcaatgattctctagacatgtcagtacctccaagtgattcatatgcatgtttggtgggcgtcgagcatgtggcagtttggagaaggaagtggagaatgcagcagcagcaggagaaatgtttgatgttgctaaacatcaaccccacagcaagcctagaactcggggaatgggaggcatggtgcgggtagctgctgacacacagctctagagatagctgcctgcaaagctggatgggactccaggcaataggcttcagggcctaactgctctttcaaggtcactgattgttacaggagccatggtctgcagcattgagcatggaattattattactattaagcatgatcctcaccgtgatgctcttggggtggaacaaaagagcccagagagaatatgcttattttatgcaacctctaacgtttcctcccagagttgtgatgaaactgaaccaaactctagcatgagaatcggcatcccaggccagcagccaaaacaagtggtgacacttggccaggcacggtggctcatgcctgtaatccctgcactttgggaggccgaggcgggtggatcacaaggtcaggagtttgaaaccagcctggccaacatagtgaaaccccatctctactaaaaatacaaaaaattagctgggcgtggtggcgggcacctgtaatcccagctacttgggaggctggggcaggagaatcgcttgaacttggaggtggaggttgcagtgagccaagatcgcgccactgcactccagtccagtgacagtgtgagactctgtctcaaaaaaaaagtgccgatactttatatatcttctgaaagaaatgaagtctgtaagaaggactgttaaccctcagaatggtctggggatgctacatccccttgtggacttgtcacactggtatgagtgtagggagtgggaacacttcttctcagctccttcctcaccatgtgtcattcagggacaaagggagcaggatatcttccctttgaaaaatctcatatgcctggcaatactcgtcaccctgtgaataatgttgatgcattcacctaaccagtattataagcccctgctgtgtgtcagacactatgcttggtgctgaaatagacaaggaggggactgcctgtcttggaaggcaaatcccagtctcctaagagacactagaaccacaggcaaccatgctgatctatgcaatgacatgtaatgcaactttgtcctgcaaccaccttgagatctttgaaagttctcctacctccaaaactcagacaagtcctctctcttgccaagtgcctaaagcaaggatatgtttatagaggcagctgggggcatctggccaatttatttcccagcagacctgctgcttcccctgattccaatactttcttccccaacccaaaccaaggcgtctggcaatgttaaaaacatcaagaatgataaaacaagcattttaatgaagattattgatgtattcattggctgtttctttaaatgggtagagaactaataaaggatctaccccaaataaccaaaaatatcagcctcagcaccagcagaaattggaagcgttctggtatttatatgtgtttttctcagctggcagatttgttttaggaaactatttgcaaagcctgggaaaaatgtgctttctctgtctgttaaaggaacatgcaggttggttggtgctggttctccatctgacagttctgtctggtggcctcaaaaaaaaagaaaaatacagcatagtccagatttggactatgcaaatggtgtcttgaaacttaacttttaggtcttgagcaaagccaagtattattgaaatgtttattttgtttttatctgcaggaggttttcattcaaaatgtggtgctttgggggaaaaggaagggtgtttgtactaggtactttttagcattcttcttattatctgacctatcacagcctcttcaggagacattaattaatttagttcatataatcaacactggaaccaaggaaaaattatttatacttttagaaattctcatgttcttatacttctttggagattgaattgactccaaagagactattttgtgattaagaatatttttgtggccgggcacggtggctcacgcctgtaatcccagcactttgggaggccaaggcaggtggatcacctgaggccaggagttcaagactagtctggacaacttggcaaaaccctgtctttactaaaaatactaaacttagccagccgtggtgacgggcgcctgtagtcccagctactcgggaggctgaggcaggagaatcacttgaacccgagaggtggaggttgcagtgggccgagatcacagcattccactccagcctgggaagaatatttttgtgtggggagtcgttatattatgtccttagaccaggaggtccaattgaggcagaaatttttgaagtaaaaccattttttttgaaggaaacacatatttaaatatcaaagaacactggacgtatacttttaaaaatttacatacttgtgttagttatctattgctgtataacaaaacctttgcagctcaaaacaacagtcattatctcacaagtttatgtaggttacgcaggtgcagctgacctgcttggtctgagctttcgaaaagtgcagtgaggatgtcagcctaggctgccgtcacctcaagggtcccctgggggtggatccacttccaagctcactcatgtggctgttggcaggatgcagttgctcacgggttgttaggctgagggcgtcggttcctcactaagccagaggcttccttaagttccttaacatgttttctcatggggggcagctcacagtgtagcaattggcttcgtcaaaacaagcaagcgggagggtaagagacagaaagcaagacagaggccagggtctttcacagcctaatctcaagagcagtacctcatcacttttgtcctattttgacaaacgtcgtattgacttttgtcactacatcagaagcgagtcactaggtctagcccacactcaaagggagaggatttcacagagcaagaatatcaggaagcagaatcattggttatttcattagaagctgctggcacagttcttaatgaagctacaaaacattgaactgggaggaatatgggggtaggagggtgacagggagggcaggttaattttgtggatgctgaggacaacgtgcctcatgaaaagtgttcccatcagactggtgtatttctgtttcttttcttttttttttttttttttttttttttttttgagacagagtctcgctctgtcaccaggctggagtgcagtggcacaatctcagctcactgcaacctccgccttcctggtacaagcgattcccctgccttagcctcctgaatagctgggattacaggcatgtgccaccacgcccagcttattttttgtattttagtagagactgggtttcaccttgttggccaggatggtctcagtctcctgaccctgtgatctacccaccttggcctcccaaagtgctgggattacaggcatgagccaccgtgcccagcccagaatggtgtatttctaggacatctgcaatgcatcactctctaataaaagaaaaaaaaatagccactccttgacagatactcaaaggtgtggagtcccttactaaaccacactccaaagaaataagcctgcaaaatagggaaaagttgttttttacctagaaagcagattctctgcattttcttattttcaaatagtggggagaaaccctaagctgtacatatgaaggaatggattcatttctcctcttgcacagcaccccagcaccttgtacaccctattcctccctaactcccaaccgcacactcacctcccaagcatctgcagatctacatacatattatcaaatgtacagagtactgagtgaaatggtcactgtagctatggaaaggtgagatttgcaggctgtctgaaatgtttcttgctaaagtagttccaatccttcccccatttagaaaaaaatacattcttagtaaatgactttcaggcagaaaaagaaaaccacactggaaataggattctaataaaccaacatggggctctagctggtgaacatatttctgagccatccctatacagaaaccacaagacaaataagaaaaagtaaatccagatcacttagacccttcaaaccacatcctgggttccaaggacagtggctgcgagttaggaaagatacatttatccagtggaccttttgactgtcttgtcaatcttaagaaaaaaatgtagagtaaaaaattttggctgggcgtggtggctcacgcctgtaatcccagcactttgggagaccgaggcgggcggatcacgaggtcaggagattgagaccatcctggctaacacagtgaaaccccgtctctactaaaaatacaaaaaaaactagccaggcgtggtagcaggcgcctgtaatcccagctactccggaggctgaggcaggagaatagcgtgaacccaggaggcagagcttgcagcgaggcgagattgcaccactgcactccagcctgggctacagagcgagactctgtctcaaaaaaaaaaaaaaaagaaaaaatttggtttgggtcccttcccaccttcccttgcttcatcactttccttaagcctctaagcatccagatcttccccaaagcagtgcttcctagtcagtgattaccctatcctctttttattccttttcttcatgcacaccttcagtccataaatccaagctttttgtaaggagggagggtgagtaaaccaattcatactaaggtgagagtgaattatatataaacctcttaatatattaaatctaccaagcagtgtttcagaaggaaatctgctaacatgggcatcttacttgaaaaaaatttcagttggttcaacaaagtatggtttagaaatcattttcaatcaggatcggggagagaatttttttttttcttaaagcagttaggtttccccagcagatttcgaatgcttggatatttgtgattcttttctatgggaatctgatctggataagacctaagaccataaacactctagctttccctttgggtctttgctattgaaaactagttggacttaaacaagtgaagtgggttttaaggatggctcctttcacccatttctaaaagatagcattcttgagggtctgctttatttagcagaaggaatgctggttttccaatctctcactcaaaaggaacttttacttatctcatagaaaagaatgggatggagattaatgtaatagaaaaggtattctacaaatatcatagcagctatatttaatcaattcatgttcaaagatcaattagtagtaataagagttgtgctgtataaaatcaccatatctcatattcaaattgcagatcatcagttgaaaaagcatggattgttttctcactgaaagaaatctttaaaagtggtaccataagagacattaagactggctattgttttatttctctctctctctctttctctttctctctttctgtcatttgatttctgactttcagtggatttttttaacattacaaaatcatagagaaagaatattggaccatttattgtagagtttttaaacaatttgataccattttttttttctggcgtcttaactgcatttgctgtttgtgaggggtgtagaggtccctgatgttcagagtacagtaccagcgtttatgtgaaatattgcagcctggcctgtggaggacaggggttactaaggggcaagctgctgcttgcgataacacccccagtgcctccttctaatcttgcgccatttcccagggcagacagccttgtggggctctgactggtgccctggaacatgttttaccttccatttttcttgctctgatttctgaagacagaatgttctcttcaacctacacatcaggagttttccttctgttttcctttttcactggttcctttgtgaatttgcacttttatctaacctaaaacattggaaacaggaataaacacaaataatggcatgaggccgtggccacagaatgacaagacaggacacagcaaatgttttgggtttttttcacatttatgaaccttctcattctatttatttatttatttacttacttatttcttgagacagggtctcattctgtcacccaggctggagtgcagtggcatgatcatagctcactgcagccttgaactcctggactcaagtgatcttccagcctcagccttctgagtagctgggattacaggcatacaccaccatgcctggctaataaaaaaaaaattctgttgtacagatggggtctcactatgttccccaggctaggctagtctcgaactcctggcctcaaacagtcctcctgccttgacctcccaaagtgctgggattataggcctgagccactgtgctcaactgcttcccattctaaaaagtgtctaaggcagttatagaggttatataacaaggtataaaatttctgagtgaaaggaaaataaggagagagaaataaatctaagtgtgtgtaaggttaatatgtacacagaatgtttattaaggcctttgacagttcctttaaaaattacctgcaggccaggtgcggtggctcatgcctgtaatcccaacagtttgggaggccgaggtgggcggatcacttgaggtcaggagttcaagacaaacctggccaacatggtgaaaccctgtctctactaaaaatacaaaaattagccaggtgtggtggcatgtgcctgtagtcccagctacttgggaggctgaggcaggagaatcgcttgagcccagaaagtggaggttgcagtgaactgagatcacgccattgcactccagcctgggtgacagagggagactccatctcaaagagaaacaaacaacaacaacaacaaaacctgcaaatttgagctgcctagcagccaagcaataaagggaatcacaatgaacgataagattcatatatctgccaatttaaaaacaaaccagttctcttgggtcagtgcttctcaaacttgaatgtacatttgagacacctggtgcattgttaaaatgtaggttctcatctagcaggtccatggtgcatttctaactggctcccaggcaatgctatgctgatgctgatgctgacgctgacgttgatgctgctactcattggactgccctttgagtagtaaaattttagctcactcagaaaaacctcatagtttatttggagtaacatccctttagcccttgtagatattataagactacattacaataaagttctggtgagtctaattgttgaccagagagattgtttacttcagagcacctggatttgaattgcagtgtgccacctgctgctgtgttacctggtacaagttaatgcattctcttcacacctcagttttatcatcttctgaatgaggctaatagtagtacctgtcatagatgcttgtaacagtgcctgcatagagtaagaatgaaataatgttagctattttttattgttacatttaaaatagattttgctggtagtgaaatatgaatgataaaatcatctcctcagctgttttccttgcataagtaccttaaaataatgtatttgcaatttccttctgaatccttgaataaaagacaccagataatcagaagatgttactgacattagtaggcatttgaagttcactctgatgggatcagtctatttacaacaaattgctatagagagtaaaaagcgccaaccttttcctgtagtttttgaatgacagcatctttgttcatgcagttggctttgctgcatttccacttcatcaattttttggctctgtctttgcaaaaaaaaaaaaaaaaaaaaattacagagggagaattttaaaacacaaatgaagaaaaagaaattactttgaaattgccaaaattgtttggctgaaagagcttatttagaaaaacagagctttttatgtataaacctgtttcattggtgttgtatcagaattgcatgttgctagtagtttactatcaaaacaacacttgtgtttcaagctgttaaaaaatgaataaaataggccaagtatggtggctcacacctgtaatcccaacattttgggaggccgaggcgggcggatcacttgaggtcaggagttcgacaccagcctggccaacatggtgaaaccccatctctactaaaaatacaaaaattagccgggcctggtagcatgctcctgtagtcccagctactcaggaggccgaggcaggagaattgcttgatcttgggcagtggaggttgcagttagctgagatcatgccactgcactccagcctgggcaacagagcaagactccatctcaaaatttaaaaaaaaaaaaaaagaataaaatagaaacactgatttttctggtattttatacccttccccgaatatccatacccaaggcatttttaagatttccctaagctggaagcaccagaccacatgttatttaaaacatattaagatgtacctactgtattatgtatactttgtatatcattttataacagtctgcaaagtagcaggaaaaaatttttgccttcaggttaaactcagaagagttgccattggctaactgaaaaattttgcatttggtaagcatttaattaaaaatttattgatttcggttttgaggttttacttttcatatttttagagccaataacttctggaatctcagacatttttgtggaatcttaagttgttcatagatcctaggtgctgtgtttgtcatcctgagagcttaaatggccctgtccaaacctcagcctcagctcagagtaggaaattgtcaagcacttggtaactggtaagcaaatggattttagtcactaaatggagcgggaggaatggagtgctccctcaaaaagagcatttcagctggtcacagtggcttgggcttgtaatcctagcactttaggaggcccaggcatgaggaccacttgagcccaggagttcgagaccagcctgggtaacacaggaagatttcacctctacaaaaagtaaaactaaaaaattagccaggcattgtggtgccttgaatctgtagtcctagaaacttaggaggctgaagcagaggatcgcttgagcccagaaagttgaggctgcagtaagctgtgatcacgccacagcactccagcccaagcaacagagcatagactccatctccaaaaaaagaggctgtgacagaggaaggcagggggatgttaatcagagagacatagagactgggagagtctgaaagagaggcagagagacttacacaaattaaagacacagactgagagaaatggaaaaatgaagagaggatcccagacagattgattgacttcccaggtaacatataatatcttacaatcctgcagaatgtttaaagttgcattttaaaaggcactccgtttgttcacacaatcctggtaagaagatcatcttaattagtatcatactttgcagctttcaagcagttcttaggcatcattgcgtttaagacctggctccagccgttttattacagatgaggagattgacttgttcaccttacatttgtagagcattttgcaatttttttgaaggacatttccacccattatctaatcacaagtctccataaatcccatctcccctggtataaaagcagcttaaattacaggtgctactaagatgcaaaatgcagcccacaaaatcagcaaatattttttctttgtttcctccttttttaaaaaaggcgtagatttcatattactactttgtttcaggccgtatattgaagtaacaaaaataaaaccaaaattgacaccaattttatttcgaaataaaatctacttttttcactttcccacatcattttctagctgctaaccttcatgcatattcaatttttgcatatttacagccctgtcaaagataaaattttattttctgcattttcactcaacattatacactgagtattggccatttcactcatctcagtgccactttcaaagagatacccaggaaaagcagcagcaagggttgttcgaccttgaacaactacagataatactttggctctctttgagatttttaaggccctgtaagtaaaatattttcagattacagaaggcttgggattctgtctttatcacatgactgattggtcctccatgttctccttggcagatgtgggtatcagtgacacaatgttttttactcaaaacatggtttagcttaccagtaccaggaatggccgatgcatacgcattctcattgtgaaggtttatttgcacctccactcttcttaaccaggctattttcacagaagaaataaccccaacttcatgaaccctattcccatgacctatttgccaatctgttaaaataatggccaactcaaatgatcagtaatgattgactcaccatgacatcatccatcacctttgtcactggaagcccacttgccttaaagggtgcagcatcttccaactttgctccagcaacttcagctcctcattaaatccctccctgtaggtcatccctgcaaccagttgacactggagctcagcagccagctgataggggccttcactcctcttgtcgagctgctcctctctcctctcaaagccctctttccttctctcctgctggctgacctagaagctcagctaaagaggtgttcaaagggtccagtcgcttaaacaggtggccagtgtgctttctgctataactccttgctccttgagctcagctccaagctgtagaaggccatggaagagcacattgatgtcatcttgggaataattaacagggtccggtttttctgttcgtttccttgcaccagatgaagagtaggataaacttgggagaagccaaagtgatgtttttgtattgtggctttgaatgatttcaaggtcccttggttaacctattctcagcaaaagaaatagaagatggtcccaagatggtaagagcagagtgtttggttgataatttgatctaaaagtgaccagactccacaagttaacccccagagctgctcaattacagcagtttaaaaataagttgaggattcgttgctaaatcagtggaaagaatttggagtttccaaaatagtttgtaatcaagaaaagccatctgaggaggccctggagggaaaatcgctgatgattatcaaatgtccagttctcaatgcggtggtatatgtgactgaaaaaaaccacttttgtccacatttggggaaagataagattatactaaatgcctggcacatacactggaccttcagttacctagaaaactttcaaaataactttgccataacaagtggcaaattattaaggtcatgggctgtcttctcaaaattacttagataacatgattctctggccagtatgagacccttaatttatcacgtatgaagcatatgagcctgtttatccgttcgttaatcattatttttatctggcttgggctctgggttactggccatgcaggcagatcttcccttccaaaaggaaacgttattattctcttgtattcgtttctttaaaaacatgcagatttaacaaaacatattacttagcactcttactgatttagaaatatgatgacccttaggaaatgcatctccttaaaagaaattccaggcaaactcatttaacctttctggatgttagtttcctgaccttcaaaaaatgggatgttggaccaaattatcttgaagtttccttccagctgtgtgctcggtggggagtgctggcagtgtggggcaggacactgaatatctgtggtggtgatgtttggatacaggggtgagcaacccctttggaagcaacatgcaaaattgctgagcagtggtgggggtgcatgggaatgggtggcggtgcccctgtattggagtgtaagagacaagtgtggtgagagcagtctggcagggctactactgttatgatttacacagtccctttcatccagctacttcaaagcaccttcacaaactctggctcattattccttcaaacacagcattcaagaaagattgataggcgccttttaattaattcaaagatgatgaagctgagcattacagaatataaggggattcttccaaaagtatctgcactgcagaggggcatgatatataaagtgttcatcacaggtttctaactgaaacaaggaaatgacctgaacgcttatttttagaggagaccagtatatattatggcatattcagaatatgcaataccatgcacccattaaaatcatgtttattaagaatagtcacattagggaaatggtcataactgaacaacgtttagtggcataaaaaaagataaagctttgtacatacagtatgatgaaaatgtttaatgtggctgggcatagtgacttgtgcctgtaattccagcactgtgggaggccaaggcaggagtatcactgaaggccaggagttcaagaccagcctgggcaccatggtgagaccctgtctctacaaaaaatttaaaaattagccaggtggtcatgatgcatgcctactattctagctactagggaggctgaggctggaggatcactggagcccaggaggtcaaggctgcagtatgccatgatcataccactgtactccagcctgggcaacagagtgagatcctgtctcaaaaattgaaaaaaaaaaaaaaaaaaggtttaatgtgtagaagggaaaaggctaaatggaaatgtgttaaagtcttaacggtgatcttccttggagcaatgatatagtgggtggttgctattcttttctttatacttttatgtacttttatgttatgcaaggttgaaaaaatgggcacatattgctttcatagtcatttctgttaagataatcatatgattatgaaagagggagtgtgtgtgtgaaagtggaatggaccaatcaaatagaacagtaggaagacctcagaagatatgacacatgagctcaaccccaaagatgagaagaaccagccatttagtgaatggggaagccctctggggaacagaaggcacgaaggaaggaataagtttggaatgttctaggttttgaaaaaaggccagcatgggagaatgatgaaagataaggtcagagccattgccaagggcaaggtcatgtaggacccatgacgaaaagtttgggaaacccttgtaggggactgacataatttattttacatttttgaaaaatccttctgaccaatatatgaggaacattgtaagaggcaagtgtagaagtcaagatctattgagaaggcgttgcaggggtccaggtgagaatgaggatggttcagagtggagagacagggacaaggtaagttggagtgtgggtctgacttgttagccatgtggaggaaataattatcataataactatcatgtatgtttttagggggctctataacttcagtatgttttcagtgttcacatttgtaggtttacagagtttgtacttgataaggtacagaagtaagtcacttctcaaaaatcatgcctttagaagcatatatcatgcttctattatagtaatgataataatagaagtctactgctagtcataaaacttatctgttcagagaaggctttttttttttttcagagaagtcttccaggtttcagctgttgctcattaatgctcaccacagccctttgaggtcgatgcaattatgctttggaaaagctaagtaacttgccaaaggccatgcagctaaaagaagcaaaagctggattcaaatctcagctctctgcctccagagagaacaccctcaatcccgcttaacagacattagctctgcttatttgattggtggcagtggagatgaacagaagtgaacagtgagcagagaggggtctgtaccccacacacatccctgcaccccaactgtcaactgtcttccatcatcatttactatatccacgtccactcctgacagcatcagtggctcagtcttaccgacctgcatcagggttttgggctctgcctctgtttagacagagcacgatttgggaagtgctgctaagtcagccagtggctgagtagaaacagccctgcagtgggcctctgcctgctctgtggctcgtttatcatgtgtctcatctttaaaagttggggctcagtctaggtgcctcctggcctgagcaccccagaattctatgctgatcccttcattgtgacatggcctgtcatctactcttctgggaagaccatctgcacctcactgatacttgaagctcattgagtattgtcacatatcagcccagaaagtcacagggtacagcaactcatacttgctcccagcaccaggccagccccattctgcctccagggagtcacccaaaatagagagatgagggtaaaataagacctaggaatactatttatttgcctccatggcctttgaacttgcacatccaacgtaacggctcctgtgtgttcttgattgttccaattatcatttttcctctcgaatacctgagagcattcattattttgcaagagatttgagaatccctgtgccctaacttttctttccttgatgtgggatgttcttctgtgactaggtaagtttatctcaatgtgtccccaaataatttctcagaatgttaaattcataaaagctaccatgaaaggataaataaatgaaaggagttctgaggtcaaaacatttggggaaagaagagtctttctccttctgaggcattctcagtgcacagtaacctgtttatctcgctttgccttgctctttcccaagcacatttttgctcaacgccccctaccttccccatacacttgttaacactttgcagagcactagggctctgtgggacaggctgggaaatgcaggttgacatgccactgttaatacctagaaaattaaggcaaacttgtccctgagagatgtcaggatagcacagtatggaaaggccatgcttatcagggctcttatctgagagaatacagtggttatgagcatgactctggaactagacagtctgggttgaattccccgctctgccatttagttatatgatatggggtgtattacctaacatctctgtatctcatttgttcctcacttgtgacatggggatgatgacaatgataatagtaccaacctataggatagctatgagaattaaacaaattagtaaatatgaagtatttggaacattggcctgactcaggataagtcctgtttaaatgttagtatcattattattgtttcttcaagccaggaatatacttcatcaattatgtgtacactcattccttcattcaacaaacacttacttaatactcctgtgtcctaggcactgttctagtgctggagatacatcagtgaatcaaaaacatgagagaaaaatccctgtccttgtggaacttacactgtagtggaatctactactaataatgcaaatagaaagaaaaatatatgcaagttacccaggcactgggtagcctagtacctgtcctatagttgtcaaatggatggatatattattcttattgttgttgtcgtttacagtaattgagcttggaggtttgagctgccatcttagataagaacagaaagctaagccaatacgagtgccatgccagtaagaaaaggaaactattacataaagattaggaagaaaaaagagaagaatgacaagtaggccattatctatggccatgagttttatttaaaatgagctggaccttttttgccttctttatctgtgtatcagatagacaattacctctaggcagatttccacattccaagacatgaagactttctaagctgcagcagacacatctttacttgtagcaaaacagagagcgatgggggttattttcagatgactgtagctgaagaggaagaatcaagtaattcactccccccaataataattcacttctgagaggaaaaacttctttggaaaaagcaccccatgaatggaagtctcagcatttgctgaagaacttagttaaaataaactctagacctttttcattgattctttatctcttcttttccagaaaccttctctatgtctacccacagaggctgaactttgtaaacaaactagcatcagcccggaacattacaataaagatccagtttatgtgtggagaagatgctagcaatgcgatgccggtaaggagggaaacgaacatttgcctcaaatcagggtgggctgctcacccctgtcacttcacacaagtccgggactcatcagtgtacaaagtccgtctattccaggccaatactgctcagcatgtgcaagggcttctgtgcccaggatatcagtggggaaacagggtcagtcttacttgacgatctctttctcggcttattctgtagtgagcttggaacatacagatcattttagaggattaaaaaaagtcataaagtctttccatactgcccataggaccaccccactctaaaggcatacaaagtaaagagatggctcaacacgtgcgccatgtttgctgagtgtcttccatgcacaaactgtacacactgtgttatacacacacagtgttacacacttactcaagcctcggaccacagtgctgatgaatacaaagtaccgcctagtaattataaacacacaccacctccacaccttctaggagtggatctttgttctgaggcaaaatataaatcaaattattcatatatatatatatatataaaatgcagtgtgctccaaggaactcaaaatgccagaatttatactttttaaaccatctcctactaaatgagatggtggttagctattactatttcccataagtcatagaattcagttaatataactttctttctttttttcttttttttttttttttttgagacagagtttcactctttttgcccaggctggagtacaatggccgcaacctccacctcccaagttcaagtgattctcctgcctcagccttccaagtagctgggattacaggcgcgtgccaccacgcccagctaattttgtatttttagtagagatggggtttcaccatgttggccagggtggtctcaaactcctgacctcagctgatccacccgccttggcctcctaaagtgctgggactaaaggcgtgagccactgcacgcagttaatatacctttctaaaaagaaaaagaaaaaaatcctttctcttaatgtcccacccaaagaaaaaaagaaaaaaaaaaacctttctcctaacgtcccacctgtcttcccaatgcaaggtgtcttaagacagcggtggggtcctcttagtcctctctgctcaggcccctggcatgccactgccaggagtgccagatatgcttgtgcagatcctgtggcaaccaagatgcccagccaagagtgactgtgggctaaagtccagtctgttcttcattcactgagccatgggttctggtgttgggattactgcatctagaggaaagagctttttttctctgcacaaaggtgagtgcacttgttcataatgcatcctaaatgctgcttcaggcccaaggaggtatctttttctaaatggcacaaatgtggataaggcagtggagattcaaatcacctaagtgagtaggtctgtatgtttgagagagaagaacctggaactggggatttctcactcaagacaaaagtatgtaactttggcctgttggatagacctctaggcagtgaggcagagtggagagagtactggttttctaatctcacaaacatgtggcctttggtcactaatatagccccttggaacctcatttcacccttcatagccagttcctttgcactggtgtgcttgggccagttgtagtcccagcacttttttttttctttttgagacaggatctcactcttgcccaggctggggtgcaatggtgcaatctcgactcactgcaacctctgcttcctaggctcaagcgatcctcttgcctccgccccctgagtagcagggactatacgcatgtgccaccacgcctggctaatttttgtatttttttgtagagatgaggtttcgccatgttgcccaggctggtctccaactcctgggctcaagccattctcccacgccgacctcccagagtgctgagattacaggtgtgagccactgctcctggccaacccagcactcttaattgtacaaaatgcagctctatgagaccagaacatcctgttggcctgatgatagtcaatttgatgtacccaaatgttactgataatttgatcctttctctactggtgaacaggtcatctttggaaaatccagcgggcctgaatttctgcaggaagtgtacacagctgttacataccataataagtaagtctatttcagcattctaaatatatgccaagatggtttcatcatctcctggtttttccaagtcccgtgggtggttcctcctaactatttttataattcagggactgaggggcaaaggaaatccatgccagttccgtgactctgtgttgaagatgtataactttgccattaaccaagactgagagaagaacgtgtcttcaagaatccaatatagttttgacttttccagaagcttctattctagtatgatgcaaagaggttgtattacgttaattaaggaaacacatttcctaacttgctttgagaccctggaggggaccagaagcacagtccggctccccttgccctgtgtgtccctgtccgctccacttgacacctgccccactgtctgcctaggctgaccaaaggagaaatggaacactcattattccaccggcaaatggagtcatgggataatgcccaccctattattcatgttccacagggaagggagagacacctgcacagtgttggacggaattgggtttgatccgggcctgataacctgggcctaattaagtccttcatttaagcacattctgggattgggatgaggattaagtgaggtaatgtacattacatacctacattactttacaatgtacgtaatgtacttcgtaattaatgaagaacctagggcttcataatgcagttaaattggttcctttttcctcctgcctcattcatttgcttctactctttgatgagtgcagctaggtgctaggcttggttccttgggtagaaatggaaaaaggaggtcacagcaggagtccaaacctcatcctttcttcaaattaagttgttggagttttccattgtgtgggggagttgttttttgttttttgttttttgttttttgtttttcctgacaaagcctttagttcatgaacagttttatgtaagggaagtgcatctaataacataagcttggtctcagggacttccagcttcagagcagagtaatgtaaaatgaaaagcaaaacaccaggcaaattctgaggagcaaaggggctgtggcgttttacaatcagagaagtcatcattcttgctaaaagttatttgtgtataatgtgcttttgaaacaggtctcctgacttttatgaagaagtgaaaattaagctccccgctaagctcacagtaaatcaccacctcctgttcaccttctaccatatcagctgtcagcagaagcaaggagcctccgtggaaactctcctgggatattcagtgagttgtttccagcctgctgactcacactgcagttgttggtgcatctgaggtccctgcagagataaacaaccaaattctattcacttgattttttccagtcagaagtagcaaaacatgctaagccacattatagcaagaggcagaaatgatttgccttagcaaatgtcaaatttcaggaatggaaagctagcgggtgatagatgttggaagaatactcatctgttttttaaaaagcattgcagtgttcactatttccaaatttaatatccatgcttcacgtatagaactagctttgtcccccaagaagaaaccattttttctttaaaagatataaaaggtgaaataaacattgatgttgttcagacacacacaaacattggctacagagaaaaatgctactgctttagctccaaaagcaataaatcatcaatattaccatttcaggaggtctcggagatttaaaatgcaaagaactggacagaaattactgccaaaaagagtactggtcaatatctactcactgtttagttgcatttgattattgcgagctagataaattatcagaattatatgctgtaataaataccactttattatttacatcatctgtttcagtggctgccaattctcttaaatgaacgtcttcaaactggatcctactgtctcccagttgccttggaaaaattgccacccaactactccatgcattctgctgaggtaattggcaagctggccatcagctgtttcttgtccagctgtagtcttggaccaccttcccagactcactttccattcccatgtggccatggatgttcatcatgttctcagagagcacattgttctgataggatgggaggaataactgactgtgaaacctcattcttttaaatgccaccaaatcagaatgttcagtagacgcaacctacacccaaggcagcataaccttgcattatctaccacagagggattcccagaataatgtattatagaagaggaggcaaactaaggccattcatagtaaacaactgttcccatcaaggatccttataaaagattcccaggccagattcatccgtttctttcttgggtcagttgtcacagccctccggtagataccaaggtatttattctcctaccaatcccaatgccaatagcctttcccacttcctgtttctggcactttctcttgctcatccactctgctgcagtgcacccatttaaagagaagcccaggtggatcaactgaggtcaggatttcaagaccagcctggccaaggtggcaaaaccccatctctactaaaaatacaaaaattagctgggcctgctgttgggtgcctgtaatcccagcactttgggaggccgaggcaggcagatcacttgaggtgagaagttcaagaccagcctggccaacatggtgaaactccatctctactaaaaatacaaaaaaattagccgggcgtggtggcgggtgcctgtaatcccagctactcgggaggctgaggcaggagaatcgctttaacctgggaagtggaggttgcagtgagctgagatcacaccactgcactgcagcctgggtgacagagtgagactccatctcaaaataaataaataaaaaataaataaagggagcccaggggactgtccaccctgactgcaccagctgtcacactgctagcccacttctcagttccttgcataggtttacatcaataagtattattttgaagtaaatctcggacatcatatttcattttagtctgcatcttaaaagataagggatttgtttttaaccatcacaataccattgtcatactttaaaattttaactgtaatttcttagtatcatcaaatattcagtcactgatcaaatttttaattatcccactaatgctatatttttgacgcttgctttttaaaattggtattcagataaggtccacacactgatattgattgttacatctctggagacgcttttaatctacagatcctccatctcttttgctttccttgcaattttaagttgaagaatttctcagaaatttgaatttaatttcaaccgttccagtcaactttcttctctgttctttcgccatctaccgtctcacttccggctgttttcctcttattttcttttttccttaaagagagaaccaacttttgccctggaccacaggcatgtgtctggtaaaccaaaacttctctcatcaaagccatctaaggggcaatccgagtatgtccacagacatttccctgattggtctttatgatttggacatcaacacctttcagtatccctcaaaaccaccttcttatcatcaagttgcacactctaatttcttagaaccccctattatctttttaagctataggaaagacctgagtgttggagagagacaaatctgtgtccaaagtctagattctgccactccctagctgtgtgaatgttggtgagttgcttaccctctctgagtctcgaagatgaaactgagcccatatctgcatatctgcctataaggttgctgtaagcattaaatgagataatgcttgccaaacaacaaactcaattcctaagtaaacattaattcctttttcttacttgcgctatgctgtgtttatagatatacccttagcctctcttagtatcctttaaacctgcactgtctgataagatagccactagctgtatgtggctattgaggaaaatatggctagttcaaactgagatatgtgctataagtaaaatatgcaacagatttcaaaaacttcatggggaaaaatgtgaaatattgtattaataattttttacattgattacatattgaaacagtctttaggctgtattgagttaaatgaaatattactttcacatggtccttttgtgtttttttttttttttttttttttttagagacagggtcttgctctgtcactcaggctggagtgcagtggcgtgatcacagctcactgtaatcttgaactcataggctcaagcagtcgtctcacctcggcctccttagtagctgggactataggcatgcaccaccacgcccagctaattttttttttttttttcattagaaacagtgtcttgctatgctgctcaggctggtctcaaactcctggcctcatgtgatcctcccactttggactcccaaagtcctgggattataggtgtgagccaccatgcccggcccctttttacttttttaatgtggccactagatgattttaaattacatatatagctcacgttatatttccactggacagtgctattttagatcacagatggcaaactcaagtgcccacaggatccagatgagtaacataaatgaatgccttgttctggtggcatctgttcactctggagattgtctcttccccatctgaaggtcacagctgttctcttcactctgcagattggtgacatgctgggatataaggccaattttttcatttcttccagtactcaaatgaagttagaaaagcagtcttttataggaaattttcaggctttcaaatattggtaattaattttttaaagttcctaatacttcaaacagaacgtgtgtgtaggctagagcccactttgggccccagcttttgactgcttcagatagctttaaaggtctccatcccctgtacacatctacctttcattatgatgaaagacatacaaacctaggcgaggccctcactcaacactgcaggacatctctaaaggaatgcaatttcaatgggaatttaaggcaagaaactgtctgtaagacctacgaaggtaatgatatataaacgtataaaagagtcactttgagtaattaaagcaggagccgacctggcctagaaacatgtgggaaacacttggaaaaactgtggtgaaagggaaagtaatatcgggtactcaaaagtattaaaatttcatgtcttgtaaagatattctatactttgtcctgacaattctgattaatggggaaattgctgggatcttaatttattttaattcctagaatccagaatcatcaatgctggtttggaacttagagacagattacaccgttcagccctcttctcacagcatgagaacagaacactaaggcccagaaagtttagttgagtcgtctaagtaaaaataactagtttgaagcggggcacagtggctcacacctgtaatcccaacattttgggaggctgaagtgggcagatcacttgagcccagaagtttgagaccagcttgggcaacatggtgaaaccacatttctacaaaaaatagaaaaattagttgggtgtggtggtgtgtgcctgtagtccccgctactccagagactgagacgggaggatcatttgagcccaggaggtcgaggctgcagtgaaccgtgattgcaccactgcacttcagcctggcgacagagtgggaccctgtctcaaaaggaatgaataaatacataaatattaactagtttggtgtagaattgaagttgaatccagggctcctgactccaagaacagttagattagttttcaagagagttctgtatttgtataaccctgacatttccagtcaagttggtctgcattgcttgttagtaatcagaaaagggaattggattgctaatcttttttttttctctttaacacagaaagtcccattacagaatcctcccattaagtgggctgaaggacataagggagtatttaatattgaagtgcaagctgtttcttctgtacacacccaggtaaggaatgtcaaggttaatcatgaaggtaaaggtgcagcggaggagcctttgaaggacaggccaataaaagatcagtgaaaatccttgtctacagataaataaaaaataaccctttagttctttgtggggacatgcaaacctctttaggtttcatttgtcattggaatagaaagaccttacaaaaccgccgagcacctaaaggaaagaacctagtatctgcactgttggtggagaaactttgcagggggacttgatttgaaactctcatctgctgttacttcttttccctctgtaactctgccactttgccagcttttaaaaagaaattccgtactctctcctttacctgccactgtctgagttctgcatctgctgagacctctctcttggcagtatgcttacctggtacgctgacctctgcttacagaacatgtcagagccaaaattatttcttctttagctaataattattgaaacgttcaacttcatgcaccacattctacaaagaagttcatagcctcggtctgaaacatcatgtcttagaccttctggtctgaaacgctggataagaggttctacccataaagagctattcgattgtgtttgtgaatccactggtgaacattgatggtataaaaccccatgaggcctgccttctcccttcgcaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacaggtatgaacctgcagggctgggctgggaggaggcaggagcaagcaagcattgccttctttaatgaaaaatgactttccagaaatccagagacaatgtgatcttcctttccactgatgatgtgtgctcaagggaggccaagtcttatgctattttttttttgagactctctgcatgttggaaagaaaaagaaacattaaaatagggttcttaatattatagctttttgtaaactttattaaatgattataggcagtctttaaaattccatttctggtaattgatgaatttattttaccttgaagatatttttgttttcttgactaacaggaaatggaacattttaaggtaagacaacctgtgttaaatggagggaaggaactctctacattgaaatgcaatgcaatcaatttttaaagttaaaacataaactcactattttaaagtgtatagttcattggtttttagtatagtcacaaggttgtgcaatgatcgctacaatctagttttataacattttcatcacctccaaataaaaccccatcactccctattcatccctccccctagaactcatccgttctctcttacagtctattttaaatgcttacttttaacaagttaacactaaatacaatgtgtacattttcccttagaaataatctcaaaagcttatcctggaggcatgaccagagtccagtggttctcctaactcttccagggtagactggctggtatagggcatctttatttgccaccattttcagctgtgcctatatagctctttgctttccagtccagcagacgtcttttgggtaccatccatatgcccagtactgtactaaaagttgtaggctttgtgacaataaccaagagcatctcagacctcagaggacttataatatggcaaagagtcagcagcacaggacaagactcctcaaagggacacagctaaattttgcagtggttgtggggagggtggtatcaaaggagagagtgagaaaacatccatctgggaggatgcaggaggtccacataaagagatggccttgaagaagggatagagtgaaaaccgacagaataggggcaatgagatgagtgcagcactgcagagaaccagaaaagtgtgggagtgtcaggaagaaagtcagtagcacagttggtggtggaacagaagcacgtgtggaagtgggctgggacaatgaagtgagacggcttttagagccagggaggggcatgtccccttaatctctcactctgctttgcaccctgatatgcatcttctgtggttccacagatcaaacgtcctgtgttggaggctaacttttcatccatgtagcagttgcctctccagctagattcttgcagagctctgccctccttcgattactttctgtgcccccgcatatgtggcacactgctttgtatgttccagctagttaatacagacttgttcaccagacaaaaatatttatatgttttgagcagcttctccatagcaagttgccaccttgtggtgtgaggaccacagggtgttggcataggcagaataagtggaggtggctagtctacaagcatttattcagaacctattctgtgtctctgcaatggaaagcacagtgggggcacaaaagatgtgagaaatgcacttcgcatgggaaggattccagctttcacagacagacagtttaccaccagacatggctggagaatcatgtaactcagtttcacttgagccctgtactgtgtggagtcagacggcttcatggaggaggtgggacttgtgctgagattcacagggtcggtatgattttgtggatgggagtgaggagggcttcctaggcgaggacaacagcatgagcaaagtctcagaggtaagagagcaggcatgatgggacaatacaatgactgcctcattttaagggatgtcgaactgagccaaaaagggtacaaggttagataagtatattggagccaaactatagaggcttagggcaccagaacaagaggttctatgcagtaaatcaaatgtgtatgggcccactgtgggaatgacttgatatgcagacatttttaggttaatctgtacaagaatcagggttgtgcagcacatctcaaatcatagtgtccacaacagtcacgtgagcatcttgtaaagatgcagaacctgattaatacactctctggggtggggcctgagattctgcatttcttagtagcaagcaggtgatagtggtcgtgtgtgtccgcagcccccactgagtagcatcagtttacaacctggcttagagaaggaggacgtctggacagtcttatgtctttgtcattaaaaaccatcaatgctattcagtggcaggaggaggaagttcaaaagagggaatgtggaggcatctgtggtactcagagccagcatgccagagctcaccaaaaccatctacccttcccaggcctagttaaattggtcagcggtcaggactcattgtcactgtcctggagaaacttccacctcaggctccttaaggaccagctgtgggactacccatttttctcttggttcctcagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggtagagttgccctgagtgtgggactctggtgggcggggcaacaccacctccaccccactgcagtgtaatccaaaataaaacatcctatgctgggtgcaggggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcacttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagccagaagttggagaccagcccagggaacataatgagactctgtctctacaaaaaatataaaaattagcagagcatggtggcacatacctttagtcccagctactcaggaagaagctgaggcaggaggatcatttaagcccaggagttggaggctgcagtgagctatgattgcaccactgcactccagcctgggaaacagagcgagatcccatctcttaaaacaaacaaacaaacaaacaaacaccctaaaattccattttcgttttcaggacaatacaaaacttacatgaatgctgaaattatgtgtttctttatagatctttcttcctccctccttgcctctttttatgctctaaacacttattttgtctgcccatttgataatccctcactggtctttacccacttgctaatttatgattcagctgagaatctcttttttaagatggagaagtggtgactgatgcctacgattctagtataataaaggaaataatatatatccaatggcagtggttcttaaactttttgttattaaaaaaaatcccttttcacatttccctcaaactgaactattgaaataatagtaatgcatttccccaactcttcttaattatttacataagtaataatcaagtagaacttcttgtcagcatgatataaaaattagtgtcagtgagttcacaaaattgcaggcccaaataaacatgacacttttgttggtctgtgcagcctcatttctagtaaatctgaaaatttgattgagtttttaaaaatactagtgatgtggctgggtgcggtggttcatgcctgtaatcaatcctagcactttgggaggccaaggtgagcagatcacttgagctcaggagttcaagaccagcctaggcaacgtgacaaaagcccatttctataaaaattacaaaaattagccagtcgtggtggcgggtgcctgtagtcccagctactcgggaagctgaggcaagaggattgcttgaacctgggaggcggaggttgcagtgagctgagatcatgccactgcactccagcctggaggacaaagtgagaccctgtcttaaaaaaaaaaaaaattaaatagtaatatctcatagatttccataaccgcttgtgaaaacatgtcaacatttaaagatgaaaaacagtgctgtatacatcatataccgtaatcctcacaaggttcagatgactctatggatttttgaatctgagaaaacctcactgcatgaattgtaaagttgtcatttaaatattgacaaattaaaaatatccacatttttagcttctcatgagaaatcagaagctctagcaaccctggggtccatttcccgatggcagtaatagactggagccagtagtaccccctgcctttgtaagaggcatgtgttggctgtttaccatgatctccaccactccctggtgccttatgccccatctacttctctccaaaagattgcctcctaccccaaccaggatttgttaagaagtctctaattccaaggcctaatccggtggcttttcatccaccctatccctcttcaattccttcttaaactcagtaagtaactctgttcccctgtctgttgacatgtctctgcctggtggggtgcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaaggtaggaaagatgtcaaaccgtggaaggggacacaggcttttttattttttaactaaaacttggagaagtaacacagaagcaaccactactgctgcccaccatgctggtcggatgctttaatgctcagctttggagtgattaacgttctttagaacagattaagaccattctgacagatgcagcagcaagaccagcatctgaggatttgctgagaactacttagcttgggtagcaaagttttaaagcatcaggggtttagccacatggagtcatgtggctaaaccatgcattttattttcaaggaaaaaaaatagctttaacttttgatacctggaaaggttgcctttaatttagttttgtttctttaatacctacctcttacgttcattaacatccacagattgattatctcacaaaaaagtccaaaggaacagccgggcatggtggctcatgcctgtaatcctagcactttgggaggccgaggcgggcggattacttgaggccaagagttcaagaccagcctggccaacatggtgaaaccctgtctctactaaaaataaaaacattggccaagcacggtggctcacacctgtaatctcagcactttgggaggccgaggtgggtggatcacaaggtcaggagttcgagaccagcctggctgacatggtgaaaccccgtctctactaaaaatacaaaattagccaggcgtggtggcacatgcctgtaatcccagctattcaggaagctgaggcaggagaatcgcttcaacccaggaggcagaggttgcagtgagccaagattgtgccatttcactctagcctgggcaacaagagcaaaactctgtctcaaaaaaagatacaaaacattagttgggcatggtggcgggtccctgtaattctagctactcaggaggctgaggcaggagaatcacgtgaacacgggaggtggaggttgcagtgagccgagattgcaccactgcactccagcttgagctacaagagtgagactccgtctcaaaaaaaaaaaaaaaaaaaaaaaaatcccaaggagcaatgccaaattttacaagcatataaaaactgacatcctgagagggttgatggcttgccctatgttgtttttccctctatgaattctttatttttttcatggtaaagctttactttcagaacagttttagagttacggaattatatactctatacccagtctctcctttattaacattttacattcaaatggtacttttggcacaattagtgaaccaatattcatggaatattattcattaagttcatctttattcacaccttctcagtttttctctaatgtcctttttctgtcccaggatcccattctgaatgccatattacattttgcagtcttgcctccataggctcctcttgctggaaacaatttcttagactttctttgttcttcatgaccttgacagttttgaggagtaatggtcaagtattttgtagattgtctctcattaggaattttttaaagattatgatattattcacataccataaaattcacccttttttaaaagatggagtatacgatccaacagtctttaatctactcacaaagctaccacgatgaattcttagcctgaattttttctccaatgatctgtggcctcagggtggccgagctattagagtaatatcatttcccctgataaagagaaatcaaaatctctaggtttagacacagacacagtttcacccttacaaattccagccacttgacactgtgtggtgtgaggaaggaaatctgcaggccagggtttggggctgggcgccaatactgccccgctgtgtggccatgggaaagtcatgtaactgtgctgggcctcatgtcctcatctctgcagaggtcctggtccctgaatgaacttaagaaccatctaccctgggtcttttaaaaacactggatttggccgggcaccgtggctcatgccagtaatcccagcactttcggaggctgaggcgggcagatcacgaggtcaggagatcgagaccatcctggctaacacggtgaaaccccgtctctactaaaaatacaaaaaattagccgggcgtggtggcgggcgcctgtaatcccagctactcaggaggctgaggcaggagaatggcgtgaacccgggaggcggagcttgcagtaagccaagatcgtgccaccgcactccagcctgggcagcagagcgagactacgtctaaaaaaataaaaataaataaaaaataaatgaaaaaaccactggattcaccccctgagatgctgatgatctgtagtttgagccatcaggaattattcgtattctatcctttttgacttacaaaaatcagttcagggatgtgctggagtgagctcatacctgttcccaaaagctgattgcttagttttccagaattttttgagccagttttgaaacagacattgttaaaattaaatcgtataaacttaaaattaaataagttatattaaaaacaaaggtaatctgaatgcaatgtggtatgctagattgtatcctggaacagaaataggacatgagtgcaaaaactggtgaaatccgagtcgttcgtgtttagttaatagtaacatatcaatgttagtttcttagttttgacaaatgtaccttactataaaagatattaagagaaatgcaatgaaagtcatataagaaatactacctttgtaacttctctgtaaatctaataataactatacaacttatacttcaaaattaaaagttcactttaaaaaggtaaacctagtcccttcctaataatttcactatatgctacaatatctaagttcttccttctttacgtttactgtgtctgtgtgatggaaatattatataatggtttgctaccacactgcatttctatgacatcgtgttggtagattgaaatcagttatgatgaaagtatttgtggcacaaaaattggcaaatgctacaaattacccctacccccctgacaactggttgttaaacatttgccagcacaacacaactcagcctcatattgaaagcccctttcagtaataccactttctgatcacccaggaaagaagtggtctgcagctattactgacagccttgatctttctatttttctttaataaaatgaaaatattaaatttttatgtggacagggttagcaattttcgaattattttgttgcatggggagaaaatgtctgatagagcatgagcactccacttcccttcagaggtagtttttgacaatgtattggtgtttaggagacagcgtggtgcagtaccgtactaaaccacagagagacactgttcccacacattttttcctggcgtcccctgaagtcacagactcctagaagggactactcagcagcccagattcttaaatagtttttaactgtaggttgctacacacaaactattaacgggtgttgtctcaagagcaagtaaaattaggtataacttcactgtctttgctttgttttatatttacttatggcaattgttttacctttgtaaccaggaaaaaaaatatgtataaaaaaatgaattctgaggttgtgatttccagatgtctggcttacctttccatggttggttgactgttaagccatggtttgtgtattttagatcgccgatcgcaactgcagccgaatgtcttactattgctctggcagtagtgatgctccaagttcacctgcagccccaaggccagccagcaaaaaggtactgaagagagcaatgtgaggttcatcccaggataagaacagaaggatttcctcatgccctcacactgtgcttgggaatagtcaaagtgctcccctgcctgtccctgatgtgctaacacacacacaccccacacacacttttgcagccctgtcctttacgccacatttgaccacctaattgcccattaactcagtgtttctcccactttctcatgcatcagaattacctggaagccttgttaaaactcatcgctggaccctacctcctgagtttctgattcaatagatctgagctggaggctcaagaatttgcatttctaacaagttcccagctgatgctggtccagggaccacattttgagaaccactgcattggcctccttttagtagagggaaagctgggcacaagtcatccttgacaaaagtgaatggcaataattaggtatcatttgtttcaataccatataaactaatatgaaatgcttcctcataattcttcacaatcagccttacctatgagttcagaaactttaaaagctgttaaactgcttaccaggatttttaaagcaacaaaattccccaatcatagtcccagcctatgtggtctgagggatggagggaaaaaaaactgtctgccctaatttcctctcttctaggcactcaagaatctcaccattatagtagctacttaagtttttaatgtctttgaagacctgtattaaaatgtaaatatggcagggcacagtggttcatacctgtattcccagcactttcggaggccgaggtgggtggatcacctgaggtcaggagttcaagataagcctggccaacatggtgaaaccccctcctactaaagatacaaaaactagccgggcatgatggcaggcacctgtaatctcagctactcaggaggctgaggcaggagaatcacttgaacacgggaggcagaggctgcagtgagctgagatcgtgccactgcactccagcctgggcgacagaatgagactccatttcaaaaaaaaaaaaaaagaaaaaaagggtaaatatgcttattgcaaaggataacacaggaagccatttgcaagagctgacatcacagggaaatgtttattaaacaggcaaggagggaatgagcctccccaagtctccctttggactggatgagggaaagaccaagtgtgggagggccggggcctggtgctgtgcactttgcagtattccaggcaccatatgtctagtgagaggtaccaggatttaactataaaaggaaaagtgaaaaaagatatggttaggctaaaaacaaattagtccacttgctctaaaatttaatattaggctatcacaggccctatgcagtgactggttataggtattataccattttcctttcttaaaaaccattatttgcctacagcctgacttctttaacccatgtcctgtttggtttcgcagttgccatgttttgacttgaaatgaccagaatagagacattttatttcaaagggaagtttggccaatatgtttccttaataccttagcagacagagttttgctgcttggctattttatataacctccagagcaaggtgttcttgtaataatgctgcccagaaagcagcatgaattactttaagaagcagcttatccttgtctaatctcttcttgccataagaccctggcagacaaactgacctattttctagaggcgacctttgaagctgggggagcatgtctttcctacaatgagaagatcaaggtgtagtccagttataatatgtgcacagttagaccacctgctagactaaaactcaaccccacgcctctctcaagtgagacagcttcacttcagactcacaacagcaaacaaatgtgttaacgcatattaaaattattaaggtttgactaacctcacaaaacgaagtgaaaccagtcgataagctgaaacacctaagcattctccattcctcaccactaacccgcctgggatctaattggttaaaatacccaagcatgtatacagagattttccttttgtcatcttttagtttagctaagtagctctcaaattttaatgtacgcaagaattagtacattgggttgcatgcgtactggactctgtgggtaatttttttttttttttgaaacagagtctcacttactctgtcacccaggctggagtgccgtggtgcaatcttggctcactgcaacctctgcctcccaggtttaagtgattctcctgcctcagcctccagagtagctgggattacaaccgtgaaccaccacatctggctaatttttgtatttttagtatagatggggtttcaccatgttgaccaggctcgtctcaaactcctgacctcaagtaatctgcctcctcggcctcccaaagtgctaggattacaggcatgagtcaacacacctagccctctgtggataatttaaacgactgtcaagagcaatgtttgctgtaatcagtttttgctttaggtgttgactttaaaacttaatttgcaaataaggatatgatattagggtgttcaaatagctttagctttcttacctactttcttaccagaaaaaaaaaatgagtttatctacgtttattccaggttttgtgggcataagatgaaagaaaaccacagaaaattcccagacatcatttttggcattaattagggtgaccaactgttctcatttgcccaggactgagggagtccccaagatgtaaggttttctattttaggaccaggacattatcaggcacactgtaatggattgattgccctacctttagtcttgaacttcttcctcatcaaaatgattgtcaggaatatgaacacatagccagatatgctgtagaatggaaaaggtataagtcaccctgtgcactatttgctactgagcagtaggtgacttgaagggaagtgaagacgcaaagtggagctgggggactttccaagcatctggccctgggacatagacatttagatgttgtaagttaaggctgatactactatgcctttcagagcccaagatcctctcataaaccccaccgatcctgcttcccacaatgccatatgggcattataaaaacaaaaattgtccagtctcctagagagtttagacaccatctagacagtggtccctaaagtgtaaccctggaccagcagcagcagcagcagcagcagcagcacccaggaacttgttagaaatgcaaattcccaggctattgaatcagaatatctgggggtggggccccccagtctgtgtttcatcaggccctgcaggagattctgatacacagaggccgggcgtagtggctcacacccgtaatcccagcactttgggaggccaaggcgggtggattgcttgagctcaggagtttgagactaagtgggcagcatggcgaaaccccatctctaccaaaaaaaaagaaaaaagaaaaaactagctgggcttggtggtgcacgcctttagtcccagctacttgggactaaagtaggtgggaggattgcttgagccagggaagttgcagtgagcgagattacgccaccgcattccagcctgggcgacagagtgcagccctatctcaaaaaaaaaaaaagtttgagaactgctgccaccaaccaactgattttatggatgagaaaactgagggtgaagagaggaatggcttgcacatggtcacacagagagttttcagcaggacccaagaggaaagtaagacagtaccagttttaatggctacccagaatgtttcccccgtagaatagagtttcactcccaggctgagtccactccctcagatgtgtctgtcctgtgcagcactgaccccagccttctatgcaccgaaatgtcctccagtctcaggtgatctcagcactgactttgccatccaccacttactgcctagaacatctaagacacatgcttcaggaacgaacaagctattaaattggggggaataaaagaaaagaaaaaaagtgttggtgaataataatagcctttgtttcacagcctaatttttgtggttcttatttagcatttccatgaggagcttgcccttcagatggtggtcagcaccggaatggtgagagaaacagtcttcaagtatgcctggttcttctttgagcttctggtgagattcttgcgcgtttgtatctgtgctcaataggccaagagaagcacacagcagaaaggaattgacattttgttcactgagttgcccctgctgaaaacctggggtggtttcttgaaatctaataatctctcacccctcccatccttcttccactaaattgtgttgcttctaccatgaaaatctatcgccgtcctgtgagttctcatcaccttcaccactctccacctggccacacaccatcatctctcatgtgcctctcgcagtgacatcctctttttcctgcctgtatccatttttgctcttggcccacccattctgcacatggcagccaatactaaacagagaatgtcacgctccttttaaaaaccgatcgatgattttcactgcactgagaagaaagcacaaatttttatcatgacctaaaaagcccttgtatgattctgttgttttcctccctctctaacctcatctcacgccacattcccccatcattcagccacatggtcctcttttggtgctttgaagatgccaaggccattttggcctcacagccttttccagattctcttcctgctccctaactttcacctccgcacccccaacacacacagtttctattcttctctgtagatttcagcttcagtggaaccatccccaagaggccttttctgaccacctaatactgtaatatatcttcctctattatcctccttctgagcaccctatttatttctttcctagtggttatcacaatttctaattgttttttctgtctcagcggttagattttcaggatttgggtctctcttgtgtattatcccatctctagcctcagcacactgcttggtaccatgcaaggcccaattaatatctgttggaaaacagaatgaaatttgtatatctgtttatcctaaaacttctaccattactcgagcagaaaagcaaaaggtatagccataataccttaattttaaaataaggggaataatagtgataactatttttttgtttaattattaatggaagcaaaaggattttcccatagaggcactaaaaataaacattttctcaatgttgataaacagagatgcataatgagatgatgttgaatgaaagaggtctaaagacatagacaccaactatataaaaatatatatgcaaacagttcagaggatttggagtaggttgagatttagtgataatgttagctttatattcattgggttctttcccctgtcccattaagtgaatctttttttttttttttttttttttaaagagagtctaggctgggtgtggtggctcacacttgtaatcctagcactttgggaggctgaggcaggcaggtcacttgaagtcaagagttcgagaccagcctggccaacgtgacaaaacccatccctactaaaaatacaaaaattagccgggtgtggtggcgggtgcctgtaatcccatctactcaggaggctgaggcaggagaattgcttgaacctgggaggcagaggcagcagtgagctgagattgcgccattgcactgcagcctgggcaaaaagagcaaaactccatctaaaaaaaaaaaaaaaagagagagggactaaagagatgggaggggttccacctaagctctagtttttgtatgtaagttgaagcccaagaaaaagggagaaatgctgaacaataggacacagagaacaaagggcaaaggaaacaaatgaaccatccactggggaggaaataggaagcaatgtggaatagagttcagaagaagtcaggttcatgccacagaaacacacccaggattcaaatcccatgaagttttgcaaagtcccaacctctgttttgagaagggtcccaaagcatggtcccaaatccttgccacagaaccacctggaggtgcttagtaaaaataaagcagagattctttctcaaagcactaaaattaggaggctggaggccagcattgtgcatttacctgtcttctcaggtgacttctaagcctgttaatgatccactggtctacaccacctctgttctgtgaatcctatacagagctacaggtcttttggaatttgtactcagacaacaccagaatttttttttcattccaaaagccgagctaattaaggtggtggctgcagctcacaagtcttggggcaagagcattaacaatgagacatgagctccatgctctggcaggaaagggactgggccataagacccattcccctcttgtttcttgaggcatgagaagtatcaaaaccgtcaccccatgccctttatatcctgcttctatttacacatcccacccaccatcatgtctctccataaagaagattcactcagcctagctctgcaaaaatgaaaaaattacctgggtgtggtaacatgtgcttgtagtctcagttactcagcaggctgaggcaggagcgtcactggagcctaggagttcaaggctgcagtgagccttgatcatgccattgcactccagcctgggcaacagattgagaccctgtctcaaaaaaaaaaaaaaaaaaaaaaaaaaaaagaagaagaagaagaagattcacttgagtcataatccagctatggataattcatacaaataattcattcccaatgcggaattcagcattgcttattctgagtggttccatgtggcatcttagagctctctttccaaaggaagtttgcattctctgcaggtgtaatgatgtctctgttcttcacagaatcccaataatagttggcataccaatagttggcataccaatgggagaaagaataatcacatcaaaactactgagcatcttactatatatgtgccaggcagtgttttaagcattttaaagcatcatctaatgtaatcattatgcaatcttgaggcaggaggaacttttattatcccaaatttacagatggggttggaggaagggtggtggccataaagagagtctccaagtcagccaaatgcttcagcagtaccacttcactgcccctaactgcttttggccttgcacatttatttactagggcttcgttggcccaggagagaaagcataagctaaagcacatggcccatcttacctctaggaagtcccttatggtaaacagatgaagttttttgggaagaaagcccctgctgatctaagcatattgcaggggtttgtcaacatgcagatcacccaagacaccagttctaccagcagcctaaaacctaagtctgtcaggttctggcaggacagagtttccgttgcccaaaagggttaactgaaaagcattgatcaaaaggactctgctcagcatgtatgggaggttcaggggccaatgaggattggtgagagcccccagggtacagcagctggcagaagcctttctctatgctagctctaaagaatcaagagtatagcagagtaactggggcctagaaaaatctggaggcagatgagacaatcttagaaaaggagcctggggccttagaaaaatgttgccactaccaggacctcactgcagcagggatgagggcagtggaagtgagtaactacctgggcctctctgttctcccacgtaatgatccccttgtttgtgctcctgttggccaactccaactggaagccaaaggttaagggggcctgagtgatgtggtccctcgagacccccttcccagcattcagagacagacagagaaggacaagaaatccatcagggagctggggtaggggcaaatggaaactatcatcccccagccagaactttgcaaggaaattgatctcagactcagacaaggtgcccaattcttcatacattgtttatgcatttgcctgaccaatgcccaggaagttatttgaaaaccaaaacagttttgttttgtttttttccaagaagcttgagaaagacaacagcttccttggccttagccaacaacctgggcaatttaacaccctctagttgtgtcagtgcccaagcgctaatgaacaaccactttggcattagagctgttaaacacaatgcttgggcgactttcacacttgctaatgaataaaatccctgtgcttctagaaactgctgagccagaccttggagaaatagagataaatgggtgacctagtttactcactcaggacatgaagttccacattaaggggttctttagaggtacccttactttaaatgggccacaaaggcccatatagggggaaagatttctgtgcctcgccccactcaacagggccaggcctccactagtgtttctactggatgttcttctctggagatctggaggacacagtagctggcaagctgctgacagtctggaaagaggccattggttggaagtatggtattgtgagaattatgtatttggttgtaggatggccaaactcagcagacaggagccaaatacagcagtgagttctgaaagccttagtgctgggatggttagcctgcccagaatcaggattggcattgcccaaaacaaagaggccttatcttcttaagtcctttgttaggagcatagtgagagagaggcttttttcggacaaaaatgggtccagttcccacccttcattcgggtcttctcaccaggtgcatgcggccttgtgggatatgaagccatctctgtgtcccaaaccaaagaggatgccgccatgaggagaaaccatggtttctctactgagctttagggtttgatgtccttaggtcttccctgagctggccatggcgttgtctgaaaacatgaaacacataaagcctgtgtctctggttttttcttattttgccttccctttgttttttctgtttgtttccatgctaacaaaaattgccagtgctgcatgcatccttagaaactgaattctgctgttagtgtattaacgttctctcatgtagctcctgggagtggaagtcccctcttcttccagtctcaacacagagggcaaatgtgggtggttcaacttccagtgccattagtagtagtagtagtagtagtagtagtagtagtattgcagtggctgtctgactaatctagacgcatacatgaaaacgttttcagagtgtagggacccaaccacaagaccttctagtcttccccatgttcctaatagtgtaagcaacttccaacaaggataagactcaccctcagatggtgacaagggggcccatattgacctgtgaatctcctggccccaagaagatgtccaaaaaataagcatgatcttgatttaaaattgtggtaggcattgagatagtattattctagtcataatgcagacagtcaccaattgacacaaggatatctatatatagatacgatatgtatatgtatgtatatccatatagatatatctgtatataaatatctttctgtcagttgacgaattgtttgcattatatatgtaaccacagtatacaccagtttgtgtcaattggtgacttgtattgacacaaagatatctatatagagatactagatatagatagataatctgtatatagatatttttgtgtcatttggtgactgtctgcattatgtaactaaaaattagacttatggaactcaaaatttcccctagaggtaatgttttccctggaggcaatgttctaaatagtggttctgtttccagctggccaacatttcctgctcaatatataatatagctaaaatttataggagcagaagataactgctggaaactatagaactgtttctggaaaaactgtgctccctcgagaaacactgaaactcaagataggaggaacatttctcccacgttctccttactgtagtttcaggaacagaaaagactttagttcgcatcaagaaccttgtgataaactgttcctttctgagtcatgtgttctgtcctatgatagaggacacctagctggttacaggagcccagctcaggtctgccttccaggatgtaggcagttgagaacactgtagctaaagaattaagctcctggctttgtcagcagcaagaagggagcctctgacttggggtcaaaaagaggacacccttcccacctcccgccaccatggtaaccattggtgtgtctgcagcattttagtccagagcttgctcgggcaccaccagcacagataaagtgtcagaaaatccattgttagagagcatttctgtgagtctttcccccttttctgcattgtacaagcaggtcaccaatctccatgttgacatttcctccatccccctccgcaggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggtaactgtattttactctttattttctaaattgtttacctggaacatatattactttcataatcagagaaaaataagcatcattttaaaacaataattaaaatataactgtaatgacagttaaacgcagtatgttatactggactggaccctgatgtggggctggaaaattgttataaacaaattacacacatgaggccaggggttcgagacctgcctggccaacatggtgacatggtgagaccctgtctctactaaaaatataaaaattagctgagcatggttgtgcatatctgtaatcccagcaactgggaggcagaagcaagagaactgcttgaacctgggagacagaggttgcagtgagccgagatggtgccacagcactccagcctgggtgacagagtgagactctgtctcaaaaaaaaaaaaaaaaagaaattgcaatatggactgtggtttaaatgatcatatcaggctgggtgcagtggctcacacctgtaatcccagcactttgggaggcaagggtggtcagatcacttgaggtcaggcattcgagaccagcctggccaacatgttgaaaccccgtctctactaaaaatatggaaaattagccgggtgtagtggcacgtacctgtaatcccagcttctcgggaggctgaggtggaagaatcgcttgagcccaggaggcggaggttgcagtgagccgagatggtaccacagcactccagcctgggtgacagagtgagactccatctaaaagaaaaatgtagatatgaaagataatatttttgctcttaggaaatacaccttgaagtgttatggggtaaatgggcatgatatttgcaacccattctcaaatggttcagaaaaaaatgtttttatgttcatagaatgataaaacaaatgtagcaaaatgtcaagtattgataagcttcgttaaagggtatacagtagttctttgtactattcttgcaccttttctgtaagtttaaaattgtttcagaataaaagctaaaacatatataaaatggaataaatcaaatgtttaaaaggcagctacaaaaatcttaggaagcaatgtttattattaatcgctttgtcgttattgagaatgtgcatagtaccaagtgctcaggagattttcattcggttattcctcatggcaaactttgttggaacagcatggtatctccacattggcaggtgtgagaataaggcacagtgaggttgataaattttccaaaagtcacacacagccagcagtaaagccaagactggagattttagacccagatactgagtcacgtaaggcacccaggaggagtggccatgtggagaatgcggagagagttcgaggacctctcagcggcacggtagcaacctctttatcaggtccccatccatcccagtgacttgactggtcagcatggcctgaatttgcaaattgcatgttaacaaaagcaaaatagtttcaaaccatatttttaatagtgtcaaaggaaattgatttgtcattctgagaataaaggacataaacatgaaaaactgaatcccagattgctctgaagcactgtaaaatccctcataaacaggagcactgagaaataatacaaattaaaaattttaaaaataggcgtagcttattaattgggattcatggaggaatttaccctacggagtgaatacaccctgcggagtatgactctgacctctcttaggctggaaatgctgcctaattgaggaataaatttcttaggtaaaaactaattcttttatcctgattggattttctgtaataatccttaaaaattaagaaactgtctcattgaaaacagtaagtatttttcaagtcagtttgccaaaaaaaaagaaaatagttacaaaaaaaaaagttaccaggatataaaaaaaagtaggatccaacatagtatatagagaatgaggttaattatacacatataaatatgcatgtagaaaaaaaagtgactggaaggaaatgcacctaaatattaacagtgcacgaataattacttgattcaacctcacagtcatggctttagttaaaggagactcaactacttcgcccagtgccacccagaaggacagtggctgaaataataggacctgtctctcccaatgttcccaccagtgacctggaagttcaaatccagagtgtcccacaaaatgatttgggtgtttgtttgtttttaaggaaaatgaacaggcggaaaagatgaacatcagcctggctttcttcttgtatgaccttctctccctcatggatcggggctttgtgtttaacctcatcagacattattgcagccaggtgagtgtcccccccacccccacccccgagcgagccacttggttccttctcatataatgtgatgttcgttgccatggcacgctgtcttcttcattactgagttggcatgaatcctacacatcctgtgttttgcagcacgtccctcatgtctgtgccatggacattcctcagacatgctggtttaccttgattcctggagcatttaccgacagtgtagaagggtcaacagattcatctgtgggaattaaaatttgtgatatgatctgaatcttcaatttgacattcaacagaaaattaacatggctatacagtgctttcagtctttgacaagtccttgcgctcccagtctgaggtctcttttcacatattagggtaattaattaaattgctgttgtgatgctccgacttgaaagaacctttttaaagtgttcttaaataaaatcattcaaagagatttaatttcactgagcacatagcaaatatttcataaaccaagtgcatctatcagtgccatccccccagatttttaaatggaattattcatgtgctgtctccctcaaactaccttaacaatagtaatataaatagcagttattgttgctgctcctctccttccatatccctaatctagccactagtaccatcattactgctactactaccaccagccaccaccattctcattagtcccatgcccactatcaccaccttctccaccatcaccacctcccaccacctccaccacctccaccatcaccaccacctccaccatcaccaccaccacctccaccatcaccacctccttcaccatcaccatcaccaccacctccaccatcaccaccaccacctccaccaccaccagcatcttcaccatcaccaccacctccaccatcaccaccaccaccacctccaccatcaccacctccttcaccatcaccatcaccaccacctccactatcaccaccacctccaccatcaccaccacctccaccatcaccaccacctccaccatcaccaccacttccttcaccaccaccaccatcttcaccgtcaccaccacctccaccaccaccacctcctccaccaccaccacctcctccaccatcaccacctccttcaccatcaccatcaccaccacctccaccatcaccaccaccacctccaccatcaccaccacctccaccaccaccagcatcttcaccatcaccaccacccacctccttcaccatcaccaccacctccaccatcaccaccaccacctccaccatcaccaccacctccaccaccaccagcatcttcaccatcaccaccaccacctccaccatcaccaccacctccaccatcaccaccaccacctccaccaccatcaccaccacctccaccatcaccaccacctccaccaccaccagcatcttcaccatcaccaccacctccaccaccaccaccacctccaccatcaccaccaccacctccaccaccaccagcatcttcaccatcaccaccacctccaccaccaccaccacctccaccatcaccaccacctccaccatcaccaccacctccaccatcaccatcaccaccacctccaccatcaccacctcctccaccatcaccaccacctccaccaccaccacctcccccactaccaacagctccttcaccatcaccacaacatccaccaccaccatcaccaccaccaccaccacctcctccaccatcaccacctcctccaccaccaccaccattagctccaccatgaccacctccttcacctccaccatcacttcttccaccatcatcattgtcaccatcatcaccaccaccacctccaccaccatcaccacctctcccatcaccaccacgttctctgtggttagtcacttagtgactttagataagtttttccaattttatgggtcttaatttcctcagttttaaaataagaagggggggttgagagatttgagggctgatcaacgaaaaggataggaccataaaaagcagtgacatacaagcttcattgagcagcacttggacagggttacataagagcggaagcccctcccagcatgagaacagccataggcctgcagtgaggaggggaccatccagaggagcaggggaactcccaggggagaggaggattagggcagaagcttatagatctgggtgaggctgctccacagcacagtagggagtctctgggtcagagagctccaagggctgtagcagcttagggccctgtatctgcaaggctctatcttatcattaggaaacagctgtccatcgagattttatggggtctgcaaaggaggcaggcactaaatggatgaaaatctgcttatatgagctatttttgttaatgactgggcatggtaaaatttgagttaggtatgagccaagggatcagcaccagtcgacagtgaagaaataaacaaccgaggggccaatacacagaaacaatctttgacttgtttacataacacctctcctccaaaaaaagaaaaagacatgacttttctaaaggaagtcctgtctacagccataccaccctgaacgcacgcagtctcatctaagggaagtcctgataaggaagcagaataataaaaaagaatcctaaggaaacatcagaagtccccaagcatccccatcccatgcaccctgacccctgccctgcagcggatcttctgtcccaggacccaccagaatagaatggcagagggacacttcactcctccttgccctccctcttcagtatttaggattccaggttagtctgttttcaaaactttaagttgagtgtatgaaagataccctagatcaccactgcagacccaggcttagctactcacatgcaggctatcttcattcccgacagggaaataaggcaacccaaggtagatatctgccttccctgcaaaactcatgtttttattttctctttctctttcctttcttttctcttgctcactatctttctccttaaattcttcccttttcttttagttaccatttctttttttgtttctctccttgactcaaatgccaaagatccctagaccaggagtcaagaagcctgcatgctgattcctgggacaccattaattacttctgtgattgggagcatcagcctttgaggcattcatttcctcatctgcaaaaaaactaggctggattagatttatccactgattctgtggtctgtgtctgccagtgacatccacggatgttacttagcaccattagtggcactcaggcctcagaaggtcactgacccccattcgtggtgatttaattcattgatcccagctctctagatacaggatgaacttcataccttaagcaagttgtattcttacaaagtcgtctgactttatcattttgcataacctattatgttttctgccatctaaagattttgtggcaatggatataaccttagtcttttttaatagtcactaaaaatagacaaatccatttcctcaattactgtctgtcacttacaatgtgccactaagcaaacacccatcccttgggtaggggcattgtgggtcttgacctttgggaaggaagtttttggaatgcaccttactcctcttttcaaaacatcactcaaattgtttttgaaatgtctattttttttcttttgagatggagtcttactctgttgcccaggccagagtgcagtggcacaattttggctcactgcaaactccgcctcacaggttcaagcgattctccttcctcaccctcccgagtagctgggattacaggtgtgtggcaccactccccgctaatttttgcatttttagtagagacagggtttcaccatgttggccagactggtcttgaactctggcctcaagtgatctgcctgcctctgcctcccgaagtgctgggattacaggtgtgagccaccacacccagcctgaaatgtctgtcttgaatgatgtctcaagggacctatgaaagatacccatagtggggccttcttttaagtgccaatgtgttgtgggttcaagttccgatagccggcttgacccgacacctgttaatgagtaacctaagtgacaggcacatgaccaagttctaatcccttcaatgtgctggtggctccactggtccaaagtcagccaggagtgcacatcgaaaggttatgggatctggtaactgtgcttacatagaagtcatatgttttggttttaaaataatatataatggcatttacttattttaagtggatgtctaactatgaattaattctgtaggcaatatgtcccacaacacattggcttcttgtaaaatggctgaaaatatgtgttcatttaaattatattgtttagtctgtaatcccagcactttgggaggccaaggcgggaggatcacctgaggccaggagttcgagaccagcttggccaatatggttaaaccccatctctactaaaaatacaaaaaattagctgggcatgttgatgtgcacctgtaatcccagctactcgggaggctgaggcaagagaatcgcttgaacctgggagatgaaggttgcagtgagccgagatcatgccactgcactccagttcaacagagcaagactctgtatctctctctctctctctctctctctctctctctctatatatatatatatatatatatacatatatatatatgtgtatatatatatgtgtatatatatatatgtatatatatatatatgtgtatatatatatatgtgtatatatatatatatatagtttaaaaaacaaactactcttgaagtgagtgaagaggaggcatgtctatcacaaggatgatgcttcatatttctgtgctggggtggggggtgataatgatgaaatattgaggagctcaaggtgcatcagcgccccttccttcccctattttgcctttagaggagctgcctctgagtctgggtctttcagttgttcagcttgcctgggggaagcaaggggtctcttccagacagtcacctttttctgcttttcattgcttgcttcatggtttattttttaaaggaagatttttcctaaaaactcttctagctttctttctctttcttctccatttcctcctctctcagtctgggacaagctccttgagttttttgcaggtactatgtactttgctaaacagtttgatgcctttctctagggaactggttctacaactttccaatggggcctttaattagaaactacgagagaacacttgtagtataaaagtcatctagtcatattctattagtttcatacaggctcatatgaggtcaactcctttcatttagtttctcgaacatagtagagtttttgtaaaattaattatgttacggtgaagatgtacctcaagattttcagcacaggcttcccatggtattaaagatttgataaagtggaaatcgggataagaatcctcattctggacagctactaggctagaatcactaaggggaacagtaatgaatgaaaatttattagacctctctgtaatgcagaatttaccatctgttgcactatcccattagtttttattaaattgattgccttaacctggagagaaaggatatttttgtgtctgccaacctcaactccacttaccttgtaataaatgtttcattcctcttttcatttttcttcccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccaggtaataaaagaattatttaactaaaagaattattcaagctatttcatttaactagctcagtttaatcatgtatttcctataaaggttagtcttattaatttgacaaaaaatcaaacaattcaaaccagatcaagtatgctaccctgaagttacaccactagctaagaattaacaatctaagtaattggtttctccccaggctcaaggctccctgatcaggttaagtaaagccaagaatccaataagccctatgaaatttagaaactcatagaaaagtctcaaatcttcctttgtctgacattagccaattgttatattatgcaaatagaggattccaaagtaaataagttttggaaaccatgtattcaccaggtttctttgcagcaggccctctaagaggttttaacttgttcatgtcaattgcaaatgcacgagaagcagaagaggaaatgggaggaggtgtgcatgataagcagtgattccccaaatgatttaacatggaaaccccaccccacctcatacattttttgaaatgttactctggaataactttaagaacatgctgtttgatagtcacattccatttatagggaacacatcagtagctcagagcatcaggcaaaatttctcattattaggttatatttctgttgcatattccttgatactagtacaaaagtgaaggcttgtcttactaattgaaaaaaaaatcttagccatatatgccatatggcatgatccagatattagctacatgaccatcttactgtgaacagggaaagatctgactcacaagcagcaattcaaaatgtataaactttttgctccatcctgcccagcagcttaagtcctaaaacttccctggactaagcttaccctaggttctttcccaccttccccttctgactgccccagggagtggccaaacccaggggccaggctcacaaaaccatgaaggatttctaaagacactttagatgctcttaatgaaatataaagtgtgctcccaggatacaaatacaggacaggaattactgaggaccggtaaatctaatacttccctccctgacatcacttgtagttccaggccagcaaaagtctgacaatgtgcttaagccaaattcagaagtgtagctgaggccgggcacggtggctcacatttgtaatcccagcatcttcggaggccaaagggagtggaatacttgaggcaggagttaccagcctgaccaacatgatgaaaactcatatctactaaaaatacaaaaatgcatcaggtgtggtagtgtgactgtaatcccagctacttgggacgctgaggcatgagaattgcttgaacccgggagagggaggttgcagtgagctgagaccatgccactgcaatccagcctgggtaacagagtgacactctgtctttcaaaaaaaaaaaaaaaaaaaaaagaaggtacctgagtaagcagggccttaaacaaagggggcatttggttacagaggaattgcctgttcccagccccaggactgggtgaggttcttatttctctgtccaacttttatgctaggatttttatcttcagcttttgatttcaggtgggaaagggagcgtcattcatttttcaacagacccggggtgctttattttcatctttcccgctgggcagtcttctctctgtgggtatgggaaagtgcagtaaccactctgtgcctcagtttccttgtccgccttatctggcaccagagtacctacctcactggggagggctcacgaagcctggctggggcgaggactcagtaaacactggccatcgctattttcattccagttcttgtggctcataaaatggctccttacgtttctgtagaactcaagctcctgctccagcttccaggaccagaagatcgccagcatgttcgatctgacttccgagtaccgccagcagcacttcctcaccgggctcctcttcacagaactggctgctgccctggatgccgaaggggaagggtatgtttctggcatttaaaatggaagatgaagccaaaaaaacagatgttctttaataaaatttgcagtctagcttctcacacttggtaaaaaactctactgtagttgaccagttctgaggagtagaaacatctgtcttgagaatatggtacccataagcacaaggcacaagaaaggcctttcttgtgtagaaaggcaccagggatgggtaagaactacaaaatgacttttcttggtcaactatttcagtggaatttaccagttctgctatagcaggtttcccaaggatgctttgattagtgaactccctaggagcaaagccatttttaacaaaggggatagcatgcagaggcaaccacaagatgtcacttggttcaaagctgatgaaggaaataatggctgctgagaaggcagctgtcccatgcccagattaggtttcttgcagacagtgcttctcaggccaagagacaccacacatccagggcttctgaatccttttacctcttatctatctgattactcagggacatgtggcagtatctagcctagaagtcaacagacagagaggtagaccacccccttctttccttctctccctatgctccgtgagctcatggagtcagaaacccacagcctatctgattggactgaaaaagataatgccttctaaaatattattcattccgttcaacaattattgaatgccttccatgggacagacacagttaggtgttagagtacatcagagatatatcagtgcacaaaacagacaaaattcgctgcccctcaagagctcaccatccagggactcagattcaaagatgattaggattgcaaagtagttgagattcaacacttctggtgtttagattaggcatacagaattgcaggaacttgcccactattccataacagagaacgaaatctaaagccatggtcttcccagtcccttcccaggacccactctcctataccaaaccatctccctgcacagggaacctgttcccatgactcctatgctaaagaggtttccagaataatgtttgctaattaatggtagcattgctgtatgttatggatggatttttatctaaatggaatttctcaagttctctcaaagtgcttacaatttagtgaaggaaacaggaggttcctgcatgaaacaaatacaggagcacatcgagttcgtgcaactgcaacagtcacatgtgtcccaagctatgtacccaggctgacaccgctgaagtgactctatgtctgcgtctcctggcaggatagtgtggggaatctcatgcttttagctctcaattctgcctccttccagataaactggcctgagtatatcctttgagaacttcactttccatggcttcaattctatcttctcttctcaactctaactaaatttctcccaattatctcagtagaatgttctaccctacaactaacataaatttccacagcaacaaaaagtgcaccgaacacttatgctaataagtaagatactgagaagaaagtttgaacacaaagaaaattgccttcatgcacaaacatgtacatacattttcttagttgtcctttaatagcagtactttaagtgatttctagaaacatctttagtatttacaatagcgtagtttctattttctattttcattctagctggaaacagccatgacattctgttctggattccttgtaaaattgttgctgttatattactagcaacaaggtagagtatattcagagataatcatgtaattatgtttaatcaggtagatacattcttcaaacacacacacacacacacacacacacgcacacacgcgcgtgcacatgcacacacacagtaccctttctcccccaaaagagtaattaacagtgtaactcctttggcaacacagtaatccctgattgctgggttgtcagttactctcctggaaagtcattagatacactgtcacaacttcatcatgtaagctaaaacctcagaaaaatgtcatgcttcaacaatacttcctattgatcagcacttcctttttttttttcttttgcttccaagacagttggtagacttgccaacacctgtacatccatggggcaagggccagaaggacgcatctcagtacctgaacccctagggagctacagctccagtttccactgggtttcccttggatctctgacacctgggtatatccacaagtgtctatgcatcgttaaatccacagtgtttttcaagcatttagaaattgtctatcatctttgtgttaagccagcaaattgcaatgcctaattcaaaacacaacccattgccgggaccacagactaagaacaagaaaaacttttgaaatgcaatttacaattatcttactttagccacagtgcaagagtctgagtcatttaaaattttggttaatattttctatataacgttgaattctgatgtagccttattttgtttgaaagaaaaaaatgtatatatatgtatatattttttaaatctggattctttttttattattatcatactttaagttctagggtacatgtatacaacatgcaggtttgttacatatgtatatatgcgccatgttggtgtgctgcacccattaactcgtcatttacattaggtatatctcctaatgctgtccctccccactccccccaccccatgacagtccccggtgtgtgatgttcccacctatgagtgagaacatgcggtgtttggttttctgtccttgcgatagtttgctgagaatgacggttttcagcttcatccatgtccctacaaaggacatgaactcatccttttttatggctgcatagtattccatggtgtatatgtgccacattttcttaatccagtctaccattgatggacatttgggttggttccaagtctttgctattgtgaatagtgccgcaataaaaggattataaatcatgctgctataaagacatatgcacacatatgtttattgcggcaagatgtatatttttaaaattgaacatctatgactaggttccagatactccactatatattttatttactttttattatagtataatttatataaagaacctgaatcctaagtgtaaagtgcgattaatatttcctgtgaatatatttgagtaaccaccagtcagataaaaaatataatattccattatcctctctcagttacaggcccccctcaagtaaccactattctgactcttattattagaaattaatactgcctgttgttgaatttcatagtcttttgctgaatgttgtgactgtgacatcctttagtgtggtcgcatgtgtcagtattcattttttttcaactgtatgtcatattcctttgtctactataatttctcttctgtaaattgacatttgggctgctttctatttgtgggtattgggtattatgaaaacagctgccgtgaacatgcctgtgcatggttttgggtggacgttagaactcatttctttggggctataaatacagcctattttttattttaatatactgctcttgaatagtttaataaatatgtgtacatggtcttaacaaaatgtcaaaagaatatactctgagctaggaaaagaagagcaaacaagtcaaagcaggaagatggcagggaataacaaaggtgatagccaaaataaatgaaataaagaatagaaaaacaatcacggaaatccgcaagatgaaaagcttgttatttgaaaagagcaacaaaattcaccaatctttagctgagctgaccaagaaaaaaggaagaagactcaattactaaaatcataattgaaagattcaacacaatcatatcacaagagaccttacagaaataaaaaggattataaaagaatacgatgaacaattgaaagccatcaaattgataacctagattaaatggataaattccttaaaaggtacaaagtactaaaattgactccaagaagatatagaaaatccaaatagacctacagaagtaaaaagattgagttagtaatcaaacttcccacatacacctactatgtacccacacaaattaaaaatttaggctgggcgcagtggctcatacctgtaatcccagcactttgggtggccaaggcgagtggatcacctgaggtcaagagttcaagaccagcctggccaaggtgatgaaaccccgtctctactaaaaatacaaaaattagctgggtgtggtggcgggaacctgtaatcccatctactcgggaggctgaggcagaagaatcatttgagactggaaggcagaggttgcagtgagccaagatcatgccaatgcactccagcctgggcaacaagagcaaaactccatcacaaataataataataataataatatattttaaaatttaaaacttcctacaataaaagctcaaacctggggggctttactgatgaattctaccaaatatttttaaaagaattaattctaattttttaccaacttccagtcttctcttccaacgaatggaagaggtggaatacttccccacttgttctatgaagctagcattaccctatactaaaccagacaaagacatcatgagaaaactacaggccagtatctgatgaatatagatgtaagaccctcaacaaacactagcaaactgaatccaacagcatataaaaaggattatacaccatggctaagtaggatttatctcaggaatgcaagataggctgcatacctgaaaatcaattgttgtaccatattaataaaataaaggacaaaacccatacaatcatcttagtagatgcaaagaaaagcatttaataaaatctaataacgcttcctgataaaaacactcaacaaaccttttaggaaataagagaacttcctcaacttgacttaagggcctctatgaaaaatccacagctaatgtgacacttattagtgaaaaacagtgctttatccctaagattaggaacaagacaaaaatgtctacccttgccacttctattcaacatattaggagttctatctagggcaattaggcaaaaaaataaaacaaaagacatctaggccaggcgtggtggctcacgcctgtaatcccagcactttgggaggccaaagtggacagatcgctttgagcccaggagactgagaacaccctgagcaacatggcaaaacgccatctctacaagaaatacaaaaattagctgggcattggtggcttgtgtttgtagtcccagctacttgggaggttgaggctggagaattgcttgatcccagaaagcggaggttgtagtgagctgagatcacgctactgcactccagcctgggccacagagtaagaccctgtctcaaaaaaaaaaaaaaaaagaaaaagaagaaaagaaaagaaagcatttaaattggaaaagaagtaaaactatctctattcataggtggcataatcttgtttatagaaaaccataaggaatccacaaaaaactccattacaactaataaatgaattcagcagtgttgcatggtataagatcaacatacaagaatcaattgtgtttctatacacttacgatgagcaatctgaaaatgaaattaagaaaacaatttcatataaaatagcatcacaaagaaaaaatatttaggaataaatgtaacaaaagaaacacaagagttatacactaaaaatgacaaaacactgttgaaagaaagatataaataaatggaggatatcatatgttcatgaatcagaagacttattattaaaatagcaatactccccaaattgatccatagattaaatgcagttcttctcagaattctagcttgcttttttttttttttggcagaaattagcaaactgatcctaaaattcgtgtggaaattcaagggacccagtatagccaaaacaaccttgaaaaacaagaacaaaattggaggactcacacttcccaatttcaaaacttactacaaagcaaaagtagtcaagactatggggttctgacatatgatagacatatagatcaatgaaattgggttaagagtccaaaaataaatcttcatatttatagtcaattgatttttgacaagagtgccaaaacaattcaatgggggaaaatagaattttcaataaatggtgttgggacaactgggtatccacactcaaaagaatgaagttggaccctatattacactgtatacaaaaactaactcaaatagatcaaagacctaaatgtaagagctaaaactataaaattgttacataaaattatagaggtaatcatcatagacttagaaaaggcagtggtttcttagatatgacacactcgaaagtatgagtaacaagaaaaaaatagataactggacttcagtaaaattaaaacttttgtgatttataggacaccatcaaaaaaatgaaaaggcaacacacaaaatgggagaaaatatttgcaaatcaaaaacctaataggggacttgtatctggaatatatattttaaaatcttacaactcagtaataaaaagacaaataactcagttttttaaaaggcaaaagatcagaatagacatttctccaaagaagatacagccataagaccatgaagatgttcagcatcattagccgtcagggagatgcatattaaaatcacaattaaataccacttgatacccacgaagatggatataataaaaaagacaggtaataaagtgttggcaagaataaaatggagtcttcagacactgctggtgggaatgtaaaattgtgcagccaccgttgaaaacaacttgctgattcctctaaaagttaaacagaggctgggcgctcggcggctcacgcctataatctcagcactttgggaggctgaggtgggcagatcatttgaggccaggagttcgagaccagcctggccaagatggtgaaaccctgtctctactaaaaatacaaaaattagccaggtgtggtggcaggtgcctgtagtccccgctacttgggaggctgagtcagaagaattgcttgaacccaggaggtggaggttgcagtgagccgagatcgtgtcattgcactccagcctgaacaactccatgtcaaaaaaaaaaaaaagttaaacagacagttaccatacaagccagcaaatgtactctgaggtatgtacccaagaaaagtaaaacttaaaacttgtatacacatactcatagcagcgttggtaagtcacaatagctcaaaagcagaaacaatccaaatgtttatcagttgatgaatggataaaattcaccaatggaatattatttagcaataaaaaggaatgaagtactgatgctacaatatgataaacttaaaaacatcatgctaaacagcagacccagggttagaacacaggcagtctgtttctggattctatgtagttctatcctatattgcttggttttccagggttagaacacaggcagtctgtttctggattctatatagttctatcctgtattgcttggttttccagggttagaacacaggcagtctgtttctggattctatgtagttctatcctgtattgcttggttttccagggttagaacacaggcagtctgtttctggattctatgtagttctatcctatattgcttggttttcacagtcacctcattgcttaggagcgttttcatcactcttgactgtttaagagctctttagtcaatttcctttcaccataacctcttgattcctgtgttgtgccaacagaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacaggtaatggcccttctgttttctttcttggattgttgggggcccctgccaaatgccccatccgaatgagatctctgtcattcgttccagtgctgatatgttcatatgagcaattcttcacaaaaatggtctccaaacctctttaacactggccccaatcagttaaaaaaacaaaaaaagtcacatagccccatatgtgttttttgtttagaaattatttacttgtttcttcattcattcatttattcattcattgatctgctagtatggaatgaactttataaaccatacaccacaaaggatgaaataataacaagattactgcctttggagatcgtgctctaacaccttgaaataaaggtgttccttcccttttcttttatgaatatgtaagcaaaaaagcggtctcaaatgaacccaactaattgctccatgcaaaaaaaaaatcatggcatatgtcaatattagaaaattctatcatagcagagaaatattgcccttggcactaagtgactaattttgaggttaatatgtctagattagcaacaagatgaaaggataagttgtcttaaaggggttttgtgaaaccccagaatctatttacaaattacattgtggattaaggaatgtagagggaaaaaaatcctcccaaatagaagaacttcttatgttgacctgagaaaggcagtccattggcctaccctctccacagcgtacgtgtgtgtgcacgtgtgtgcgcgcgtgcacacacacacacacacaattcctatcccatcagagtagttcttgcttttcctccagctcaagggaagttttggaaatgtccatgctgctctcttggcagctgaagggtgctgggatctgggcaatgcttccctgagccagcctctttatagtcagtcatccttgaaatcttggaaccatccaggttttcccacctcctccaaatggaaagtgtcatgtgtgactaaattgtttataatactattacggtgacaagtatttagttcatgaaaatgggaccaaacgcctatagtctttaattcatacaaatcataaaatgaaaagcaagtattcctgtggaagtaattctctcctttcttgaaaaaaatcctctagcaaactgctaatggagtaactcagaagagaaaggttgagacaggggttagggtttgtagagttctgttggggccagagtgcaaggaaatgatagaaacaagctcagcacacagggctgagcaagctgcaccatgaggtcagcagcttcctctagcagcgcctgattgcgcggaattgaaaatggagttgtttttaacatttacagacataatgcagagcatggcatgtgacttgtagcccattttgagaatccttgatggcaagtttctaaaaagttccatttcaagagcttgcttgttcccaaagccaggaaccactttagcacacattatccgaagttttcttgtcaattagaatattccgtatcagtgactcggaatcagaacttttcaacatttggtctccaagccttttaaacctcaaagacttctttgtatatgcgttgaactttatgatcatgatgtagctgatgagagaaaaaaacagtgaaaagtattttattgttataggttacacagtacatctattaaatatggaatctttaggttgataaactcataagaatacagtctttcaaaaagatgcatctgaattcagattccagccccatttattaatataagtgacctttgaaaggctcaacctttccgtgccttcctttcctctgtaaactataaaaatgtgataacgatgtctaccttttaggtttacgataaaggtgaaactagagaacttctataaaagcattttgcacagcacatgtttgtatctttcccgatttttcttgtaactataaccctatggcaattaaggggaaataagaatgtgtctctatgttagttgtgataatgttatcaggtcttgcataatttccatgtgctgtttatttaaccatttgtttaaaatcccaatggccttaataagtatttctaaaaattgggttttggctcggtgtggtggctcacccctgtaatcccagcactttgggaggccaaggtggacagatcacttgaggccaggggttcaagaccagcctggccaacatggcgaaaccctgtctccactaaaaatacaaaagttagccaggcgtggtggcgcacctgtaatcccagctactcgggaggctgaggtaggaggatggaggggcagagattgcagtgagcggagatggcgccactgcactccagcctggatgatagtgtgagactttgtctaaaaataaataaataaataaataataagaactgggttttgttttcacaactttagtagaagaaatgttatttacactcaaatttttctaaataattgaaggcccagatggctgtaatgtcaacaggtctagaaaaacatgaatttttaggaaaacatgagtgaatcaatcagttgtgaatgttttaccacacttttcccagaactgcttgaaatattaatagtttttgattgtatactggtagcattcttaaaaaccagacttttaaacggtttatcgtttttttgcttgcatacatctagacctatctataaatatgggtatgtctatattacatagatacaataaattgacattcattttaaacatttgaaatatgacaaattattgctgaacttgtgataatagcttattattctatataaggtagttgcttaattctgtaattgtaggtgtcttctatttggtcattatttaaaataatgccaattattagaatagagaatgaagtttaaaaaattatgttacaggaaacaattatggaaggtttgaaaactttttgttcacacaatttgaaaaattaatttctagcctaatcttgtgctagacattgtctcttagcctgctgtgttttcctataggtgatagcagatacataatgctaaacatcaggtttgaaattactgtgctgactttagtgactgagaagtatcagtctcttattgggtaggggacatggggaaatgtcatgtttgacttgacatcacaaacgatgttttcattgcagttgcagatactcgcagataccgcaccagtggctcggatgaagaacaagaaggagccggtgccattaaccagaatgtggctctggccatagcagggaataatttcaatttgaaaacaagtggaatagtgctgtcttccttggtatgttggtgcacatgtgtctggttgatttttcatttcatgtcttctgtcttctgttttgttttgtttgtttgtttgttttgagacagagtctcactctgttgcacaggctggagtgcagtggcgcaatctcagttcactgcaacctccgcctcccgggttcttcatgcctcagcctcctgattagctgggattacaggcgtgcaccaccacacctggctaattttttttgtatcttttagtagagacggggtttcgccatgttggccaggctggtctcaaactcccaacctcagatggtacacccacctcagcctcccaaagtgctgggattacaggcgtgagccactgtgcccagcctcttctgtcatcttctgatgggagaactcagcttagagcaggcattgattatttccgcctcattttgctggaaagaatcattgtgaggctggcagctgaggtgcacacaagtcagaaagggttctggcaacagcaagagatgtgcagatcaaattcaggcagtcccagtggtgctgagttcaagttcaagaaaccggaaaagaggaaaacttgggaaatctgaaatccttgcaaaggagatcaaaccaaggctctctgagggtggaggcttaggctgtgttcagtctatgtgtgtgtaattcatacagtgtaatgcctccaaaaaaaaagactgaaggaggctggtagcttagcgtaagggcttcttaaacaagactgcagcttttctaggaccccagggagcctaaggagggttgtttggctctgtccttttgcatggactctgtgggctcaaagaggggctcctctgggaatgtatcctctgattcagttgaggtgggattcatctctgttcattgatgagctctgactatcccttgtgaagacagcactgcatcctccaatgtcatttactttcacatttcaatgtagggtatagatgtgcagagaatttaactttcttctcccgtgagaaagcagcatcctgacctaactcttcttgctggatgactttcttgtcttccttcctgcacttagcaagctccatcaccatgaggattggggggacagtgaggcaggaagatgagacagagaaaagacatttgagatttgacatcaccgatcttactgttggagaaatattgtgtgacctcctccacctttctaatatccgtcttaccaaagttagctgcttgaggtggtatatgccttttacattatttgcctctaagggaaaaactcaaaagcccaaagttcacctgttagaacatagtccttgtgaggttgtatctcaagatttcctttattcttgtcaacaaactcagaataactaaagttaaagttgctttataacctctattatttccatccaaaactaacatttccctcccatacccacaaattcctcattgcaatttcaccagtacattccactggatattagctacgctgcatgaaccaagggtgcagcctcattgttgttgtttgtgttgatgagatgagtaacagagagtgcgctcagcactttaaaatgaatacttgtggccaaaatattaaagcaaatagcctgaacccccacaccccagccccaggcaaacataaattatggttaaacttccattacagagaactccacaaacatggatttgattaatttgctgagcagttcatgacccttatgttatactttgcactatgtaacaaagaagctaaatcttgaacagcaagcttattcatggcacccagccagtttccttctcccctgtaagtctaaccctctgctgcccagcacgaaggagaaatacttggagatcttagcagcatgaaagcctctttgtatcactgggattgcagcacgcatgatcaaggcccaggggtgatcaccaggccacactgctcctaagacagaggtactcagatacgtggctgaaagcctagctcaaatactgccccaggtgagcctctttgctgagtagcgctactcaaagaacacagcttcccctgcctagggaaggcagggctactggcaatagatctccagcctagcagtgatgtacagtcatggtattttaagagaacactttgaatttttctgttgcttgactgttaagcctcaaatttttctgttgcttgacttcttccctggcctccatcccccaatctgcctcccttcagccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataaggtaagtctggagtggcacaactttataccagctcttatctctcaattgcaattctgtcttcttactcatcccctttgtttgggccatggaggcatcattaatttttctcatttctgtattcaaatccataacccatttgtaggtatagatatgatcatttcacagggaaaggatctctgccttctgcagagagaaccccatttctgttgacagagttttggcccataggatgctccagagcagcatctcagtgaagcacatgtcaaacttagctggcatcactgtggagtgtactgttttggtaactctccccatcaacggagatctcaccaaaggacatgtcctcctacctctgtcttgtccagggaaaacagagttctgacaaagtcagtacccaagtcctgcagaagtcaagggatgtcaaggcccggctggaagaggctttgctccgtggggaaggggccagaggggagatgatgcgccgccgggctccaggtgtgttggactggcccttccctgctctctgtcaagcagtttttcactgtttgtggggaggaatgtcctcccaacatgattagacaccattactttcttgagatatttacggtagtgtcagagacagcggattctgggagtctgtgtgtgacatttgtgttagccctgtgcctgtgagggaaagcgctgttctacaattgtaggaaccctgaaaacagcaccaaatgacatcttttaattaaaactcgttgatggtaaaaggtcacctctaagaatgtcagtcatggatgaggtggaaggtgtttccctcaaggctgaggcctttctatgtgacctttggctagtctatccggagcatggtcaagaaactgaacagttctggccccaagatcatcttctcgatcattcagggcactattagaatggaaccagttccctgaaatggcttcagagtgtcccagtcattcaaggattccaccacaggaggaatgatctcaaaaaggctgagcttgaatagaatgaaatccccaggtaccctcagtcttattcaccatgctcaaagtaaaacagagtgacagcttattgtattcgaagggacacagtggcagggaacttggagggagctcatagttttcagtggtggtcaggcaccctcatttgacacccatactttcatacccaataattcagtaagcccccagagtttcacaggaatcctctgctcatgagaaatgtctctctgacactcagaaaggcagaggttcttcttatattctagtctatcaatcaaagagcgggccaacttggacataggtgtggcgactttgtctcctaccagcaacctgcatggactctaattagcccgagaaatggtgctgaggcttctcagttgagcttgttatgaacttctggttatcttggagggtttcatgctaatcaaattcctatcatgcatttcttaactcctagggaacgaccgatttccaggcctaaatgaaaatttgagatggaagaaagagcagacacattggcggcaagctaatgagaagctagataagtgagtcactcggcaactttctgctacttttacctaaagtccaaaactatttttcccaggctgcttgtattactgaaacaactgcatccttccaagggttagaaaatgaaacatcattatctgtgtaaatacaattcatccagggacccaggataatcaaaggtatagggagttgtggtttccagctcttaaaaatttgtcacattgataagcatgtaaagaaaactaatatttctttagcaacctcagatggcttaataaaagcagctgattttgcagggagggtagcagggaaatagagaaagcaggacacggtgcctaggaccgtatactttcaaatcgatatttcctttctggaaatatgtacaagatatacattcagatatatttatgtcagtgctacttaaagttgttttttaaaattgaaaacattctaaatgctccagaatagaaaaatatatttaaaagttggattgccatcaaaatgttttaaaatcatcttaatgacatggggaaatgcttatgacataatgttaaatgaacaaaggcagggtagacacttggttttctagtagtgtgtggctcacgcctgtaatcccagcactttgggaggctgaggccggtggaacacctgaggtcagtagttcgagactagcctggccaacatggtgaaaccccgtctctacaaaaaatagaaaaattagctgggcatgatggcagatgcctgtaatcccagctactcaggaggctgaggaggaagagtcgcttgaacccgggaggcagaggttgcagtgagccaagatcgtgccattgcactccagcctgggtgacagagcaagactccatctcaaaaaaaaaaaaaaaaaaagaacctcaaatctctgatgacatatagtcaatgtattttttaaaggctagaaggaaatttaccaaaatattaattgcggttttctttgggtgctgggaatatcggtaattgatgttttctcttttatactttgctatgtttcctacagtagatgtgtattataatatatattgttaccagaaaaaaaattataaagaaatgaaagaataaaaaaacctgtttggatcaaaatctatgctatagatgaatagatatattgacgtgtattgctatatatgcaacaatttagacatatgaaagctaaaagtatatatgtttgactagatagcacatgtttccgataccgtttagccacaggtagcctaatgagtcccagggtttgctgagcaaaatgtcgtagagctaaaatcacccctcacacacagttgacaaggtaggataccccatgggtgatgaagcacccatcaaagggggtatggggcagacttgattagcagtgctgttttgtaaataaatgtgagttaatatctttattgttaccacaagaatgaatcattctggttaacttatgggactttggggagtcacatttattttaaaacattaaagaaataagtatatttttattatagatgtgacttggaaacccagttgttggtatcatgcctatttgctttgggtatgttattcttgcactaaattccctggactgatttataaaatacttggatcggagagtccatacattctacttcgggcaatgaacaacaactacaaaatatgcatgccgtgggtgctacagaattgcttaggtggtttagctcatctactctactagattaaaagaagacccctaagtaggcctgttttgcctgggctgtgtaaactggtgttttggaaaacctttcccttttgcttgcaggagcaacacaatattggtccttaccacgcatggcctaccggtttgctctaggttagttctcagccctgcgctacctggtgggctgctggttgtcagagctaatgattcacatctacaaattctcaggggctttgtgctttttttttttttttaaaagggaaaccatagtaaaattataactgttcaacctacctacctggaaaatttataattataataatggtgtctttcaccctctttctgatcatttttcgattattttggctctgtttcttttagagcaatgatcttcaacttaggctgcacattagaatcacctggggagctttaaaacctgtcagtgcccagctgcaccctagactacttcaattggaaactccagcaggacccagaaatcagtatttggtaaaacttcccaggtgattctattgccaccaaatccattgttttaaaggaatagatggtaagcttttcttttcttttttttttcttttctttttttgagacaaggtctcactctgtcacccaggctggaatacagtggcacaatcacagctcactgcagccttaccctcctggcctcaaacaatcctcccacctcagcctcccaagtagatgggactacaggtgtgtaccaccacaactgcttactttttgtattttttgtagagacagggtttcaccatgttgcccaggctggtctaaaactcctgggctcaagtgatccacctgttttaacctcccaaagtggtgggattacaggcatgagccactgcgcctggtcagatggtaaagcttttaaaaaaccagattagtgttagtgatggttgcacaatatgaatgtacttaacactactgaactgtatacttacaaatggttaagatggtaaatttttatgttaggtgtactttatcacaatacaaaaatttgggaaaaaacagattaggacactctagatttgtgctgtccaatacagtagccattagccacatgtgactatcaaatgcttgaaatatggctagttcaaattgagataataaatcaagataagtgaaaaatacgcaccagattttgaaggcttattgtgaataaaagaataaaatatttcactagtaatttttatattgcttacatggagacagtattttttatcttttaggataaacaaaatatattaaaaataatttcactttttctttacttttttaatgtggttaccacaatatataaaatgacatatgtggcccccattgtttctactagacagcattgctctaaatttaaaactaaactagcagtcaattaattaaaaaggatgataaggggccgggcacagtggctcacacctgtaatcccagcactttgggaggccgaggtaagtggatcacgaggtcaggagatcgagaccatcctggctaacgcggcgaaaccccgtctctactaaaaatacaaaaaagtagccgggcgcggtggcgggcgcctgtagtcccagctactcgggaggctgaagcaggagaatggcgtgaacccgggaagtggagcttgcggtgagccaagattgcgccactgcactctgcactccagcctgggcgacagagggagactccgtctcaaaaaaaaaaaaaaaaaaaaggatgatgaggttaaaatggtaaatttgatgttatgtgtactttatcacgatataaaaatttgatggctcatgcctgtggtcccagatactcaggaggctaaggcagagcatcacttgagcccaggagttcgaggcttcagtgagctatgatagtgccactgcactctagcctgggtgatagagcaagaccctgtctctaaggaaaaaaaaaaaaaaaaacttttagatttcatttattttacacatatattatcacttggaaaatgagaaaaagtgtcaagtggcttgggaccagagagcctatcctaaacatgaaaacaagtaaaacacacagaagtacttattttttgagtcctcagtggtatgtaagcagctgcagtgcccccattattaggttaatgggacgcaagaacaggtaagtggtaaccctggcccaggacatatgagctgatataatgataccccaaccccatggtaacatcttggctactgaggcatcttggtaaagtcaattcttcatacctccctttccttgcaactagatttggatgatgatacaaaatatccctttacagcttcacttagatttcataagaatggatgggctagcaaaaaaaaccattctgattccttaaagtgaaacctaatagaggagcgagcaccaggcaatttcccattccctagtgggcaatgaccagtaatgtccggcaggatattagatcacctgccctacaggaatacagtcttgtttcccaatggaaaaggacgaaagaccccacgcacttggctgagcaacctcaaggtgatctttgggaagttaagaggctgactctcccctgacttggctctgaagctccaccctttcctaacccagccgcatcactgccaagttcacatcacatccagtctcactctctctcgcatgttgcaggggcttccccttactcagatctagcaatggttttcatgcgtgaaatacagccatggccctgaggctttaggcaacaatctgagaggggagcttaattgctagtagcaactaataactgcttctctacccatagtgttatttttataattgtcctcatcattattaataatagtggggatgaggatgaccaggaaaccttacctagacagttgtttcgacaagacatgaatcacagaaggcacctgcactgtagttactcagggccagttgctctgttttcatttcaaggttgactattttggagatttctttacaccttggtgtatagattgccatcatgggaacctggccaggtttgacatgcgctttaatttgacctcttgttgtttcctagaacaaaggccgagttagatcaagaagccttgatcagtggcaatctggctacagaagcacatttaatcatcctggatatgcaggaaaacattatccaggtgaggaaaacaaacacccaatctgatttgttggccatgaatatgtttactagaataaggacttctttatgcaaaattgtgaaagacataaatgtgatcccatagtaccttttttaaaaaaatgaagttgagaagtttactatttacaacagtgtctaccttataaattccagagataccaaacattcttctggcttctttgacttagggcttacttggagagggttaggtgtttggccagctgaccctcttggttaaatctgtgtgagtatgtaccaagtttataatatggatgttgggtttatcgtttagtatctagaacagtagtggtaagtagaattttttctgatgggtcaactccagttgaatgatggtcactgtctgatatgggagctatgattatgactaggctaggtaaaaagagtgctaaatttgacaaatgatgtcttctttggacttaaatttgttaaggaaagtcatttgtaccatgaatttgccatccctgctgtagaaaaatatagctttgtgaactttgtaccatactaattttatcttctatgtgattatttccacaaattcccaagctgtctaggtaataatgagtttttaattaccctgaaaaatgagttcttacatgtttccattgagaagtcattcattagagtaggtccaggattgcttttagggctagaagaaatatcgttgaaacacagtgaaatcttaattctctaacttttgaattgtctaaaatcaaagtaatcatcatacaaaaataaacacaaaaagtatgtgatatttttgttgactttaatatctttgataacttaaatgcttggtatcacatttaccttatctttatatagcacaatattaggtgccaaatatctatactagcccccaaatatatttgcagttttcaaagaaagctgaaaccttttgttattatccttggtgttgttagtccttctgtaggtgataaacaagcttctatttagaaacattgctgccaccaagcagcccctgttgtactgggaagcccacaattgtgttttgcatcccataaggaaagctatgtcttgtatacaaagaaagaactttccaaaagatgtgacccaggatgagggagatgggccttataccttcatttaggaacccagaattaggtataaatcccaaactcattggaagcattgaaataaagccatttggaaataggtcttcagttcccatggttaatggatgatacccatggtggctcaccaaactcttaagactcaccactggacatggaacatcagcattactgagctaattgtcaggaacatccagttcattggcacagtgcagggattcaatgatgctgttcttccattcccccaggcgagctcggctctggactgtaaagacagcctgctgggaggtgttctgagggtgctggtgaattctctgaactgtgatcagagtaccacctacctgactcactgctttgcaacactccgtgctctcatcgccaaggtaaacttgggatgcttgttttcttcctcttaattaagagtaagattctcatctagcttcatacttctctcttcaggtggaccaaaagtcacagagcatattaagtggcatcacagtaaaggtcttaagtcttcctaggaagaaagcagatgccctgattctgtgggaagccaccatggagaggaaaagcagtggctcccatatttgaagtgtggacctaactctagaagtttaaaatggccattcgctgaaggtctatgacatgagaacagagatcaactgagtgacttagcaatttcactctttctctgtaatacctctgctgagtgagattaaatcctctatgtgacgcccattagtcttacaaaatgtcatgccataaaatgccaggaaggtcagaaatgaatttctcacggcctgaggaatgaggattatcctggggtaacatgcagattatttttccctttatttatttatttatttatttttgagactgagtctcgctctatcgcccaggctggagtgcagtggtaccatctcagctcactgcagcctctgcgccctgggctcaagcgattctcatgcctcagcctcctgagtattgggattataggcgtgtgccaccgcacccagctaatttttgtattattagtagagacagggtttcaccatgttggccaggctggtcttgaactcctgacctcaagtgatccacctgcctcagcctcccaaagcactgggattacaggcgtgagcccccgttcctggcctatttttccctttattgaagatctcaattggtgccttctacatggggtcttttaaatttaaaaagtaaaattcttctgctcatccttctcaggaccattttctctttcttcatcaccagtaatttcccaggaacccaagaaactcaggtttccttccatcatagttgtgatttcaccagtgaatgcgacctggctcacagtgcagttgataacacagctctgacccttttagctggacagttcattattaaatctcaagtctactccattgcttaaatccatcttctgattcacatagctcattatctttatggaataatgcattaactcttctaggctttttgcttgtccaaatggacatttgcatatttcaacggtccagaaagtgtatcaaactgccaagtgatgcctaatggccctttatgtctctcctagtttggagacttactctttgaagaggaggtggaacagtgtttcgacctatgtcaccaagtcctgcaccactgcagcagcagcatggatgtcacccggagccaagcctgtgccaccctttacctcctcatgaggttcagttttggagccaccagtgtaagagttcaaaccagctgagtgacctggaatcagtagagaaaaattgatgtaaagcatcagctgcgaaaaaaaataaggaaattttgcagtattgcagtttacttctgtcctgtgagaaagaaacaattgagtatgtagatagatagcagcttccattttaatttgcatctaaaagtgaattcatcagataaatgcagtggtctctatcagtgtgtttctaaaatagacagccaggggccaggaacgatggctttcacctataatcccagcactttgggaggccgaggtgagtggatcatttgaagtcaggagttcaagactagcctggccagcatggtgaaatcctgtctctactataaatacaaaaatagccagatgtgttggcgcatgcctgtaatccaagctacttgggaggctgaggcaggagaattgcttgaacctgggaggcagatattgcagtgagccgagattgccccatttcactccagcctggacaacagagtgagacttcatttcaaaaaataataataataaaataaaataaccaggtgcagtggctcatgtctgtaatcctagcacttcgggaggccaaggcaggcagatcagatgaggccaggagtccaagactagcctggccaacatggtgaaacccccgtctctacaatacaaaaaattagccgggtgtggtggcacacacgcccgtaatcttagctactggggaggctgaggcacgagaatcgcttgaacccaggaggcagaggttgtagtgagccaagattgtgccactgtattccagcctgagaccctgtctcaaaaaaaaaaaaagaaagaaagaaatggaagagtattttagattaaaagttatcatctgtgggggaaaaaatacaatagacaggttagaattcagaagagtgtttcctgtttctaaattctgactagctagtgccagaatgacctgtggaagaggattttaaatgatcggtgtcatctaacctgagttttattttaatattttatttatttatttattgagacagtgtcttgctctgtcacccaggctggagtgtagtggcactatcagagctcactgcagccttcaactcctgggctcaaatgatcctcctacttcagcctcccatgtagtaactgggattacaggcacgagccaccttacccagctaattttttttgcatttttgttgagacagggtcttgctgcatgcccaggctggtctagaacacctgagctcaagtgatcttccctcctcagccccccaaagtactgagattataggcatgagccatcctgcctagccaagacttgagttttattcaaagctacgaagactttggagttcagctttattatagaacagtcaagtttgctttagtttgtctagattttgataccttctttggaatttccatttgtggccatgttaataagtatgctcaagtgatatataaagataaattggcccatggaaaaaagtcagcctcctccaaatgtattagggatgattatttaaaagacattcctcaggggaccttgaggtagccatgtttttccatgggcctgtaaagaaagaagaaacaaaaccttgttgcttacccggagttcaaaatctcagaaatgctggccacagaagtcccctgatttatttatttagagacagggtctcgctctgtcaccgtggctggagtgcagtggcgagatcttggcccactgcaacctctgcctaccaggtttaagcaattctcctgcctcagcctctcgagtagctggaattacaggtgtccaccaccatgcccagctaatttttgtatttttagtagaggcggggttttgctgtgttgcccaggctgatcttgaactcctgagctcaagtgatccaccctccttggcctcccaaagtgctgggaggctgagccagaagtccctttcttttaataaagtttaaataaagtcccaagaagaaactcttggcacaaaaggatatactgtattcttggacccaactttataagaatcttccagcttgcagcacaaaggcagcccagtcctcaatgaaaatttaaagggagcctgacagatttatgtgagagcaatgtccatttaaaccatttaaacaacaatatgaatgttgtgcaaagtgtagctcccatttcattgagagaagaggaaataattaagacggggcaaaggaaacactgaggagttgtttgtgtctggccatgctgctttcagttatctactgctaagtgtgtcttatttacttcatcttttttttttttttcactgatgcagaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtacaccgaagcacataccttgtctcatgcatgagtttgggatctgccaactattgtgtatgtatgtatgtacatatatacacaatttatatataaatatataacatttgcaagtatttattgtccaatatgcatgtgctctcagcactctgagaggttttaaaaagaaatacatccatcactgtccccagtctcaatatgctaacagtctatttggagtgctcagtctcaaaacaattaggaggcagtacaagacaagtgatacataagtgcaaactgtgtggtaaggagctaaatgctatggaaggttagaggaagagaggtcgtgatcaataaacaatctggtggccaggaaagcctgcagggagggatgacactaaaggctggggtaggattccgctaggcaggggaaaagtgagggggaaattgtgagtagttgaaacaatgaattgtttgtatctgtagggatggtaaagggaccagcttgtctggtgaggggtaaggaagggccgagtttgagagagcttgtaaacaaggttgtcctaaggaaatgtgtaaggacagtcatctcttccatgtccattacgatgaccgtggaactctagcctgtcccatttgtcttttaactccagctcctagcctgctctatggtagggtcttaattaagtgagaatgaatgaatgaatgttttcttttattcccttagtctgagaaccctatttccggagtctgttttgccctctcgggcaatgttgcatcctcattctcagaatctttttcctctcctctacatcaaatcgttcctctctcatttcatcttgaccatactcctttagttccatcatttatatagaggtattcaccaacaagaccaatcaaactatgggcagtttaataaaggtcttcagtgccttcacccaatgaaatgactctagtggtagaaattttaggagccctggcaagctggcagaggggaacggggataagacaacattctgtggctgagttacctgccagggtctctagatcaagccatagtctctccctgtttttgtactgcaggctcccctggacctccactgttggttttataattaagaataaatgattacaagaggttctaaaatctctgaagccctgggaagatccaggaggcttctgagacatggaactcaagctgaggtcctaagctgcttcctacttggtataaaaatccctgatattccagagtagagtttagaacttttcaggttacaaataactgaaactggttcaaactaatttaaacaaaaatgttggagatagagatagtatgaggattcaggcagatttctggatctcaagggccaacacacatccaggtctcataaactcctgggctggcgaagatgaaaactacagagtcaggtctagatgactccgccatccctagtctctgctgccctctgatccaacccttcccatggcttccccttgcatttcaatgtaatcctaactcttcacctgggactacaaagctaagattattttgaggcttacactttttgcaggtggaggaacttctctgtaatctgaatagcatcttatatgacacagtgaaaatgagggaatttcaggaagatcctgagatgcttatggatctcatgtacaggtaagctttcctgacacactcaagggacaccatttgggggtcgaggatttgtcactgtggagttcttactaatgtaatgatcacagctaacatggatatagtgatttggatgatagccaaataatatatagaaattaaacattcagagtaggttaattcatatgtaagttttcagaaggatctccctaatttaaagtgaggcataataatgttattaaatataataacattattaaatataataacactatcttctacttaccacagaatcagagaaagaataattaactgttataggaattattttccatatgcttttgttccaattatattcagacatacatatatagttttactttagaaatcattttttacgcgtagtttaaaagttggtcttccagtccttgttcaggagaaattacttacagaggcaaaattgttctgatgcaacatcatacaaagggcagtacttttgtcttctgttttattttgagagaaaggaaagaaaaggcagaaatttgcctgagagccattaaaatagacatcatgttatcaggtattttttccccataaggcttttactaagtactatttcttggaggtcagcacagcttaaacatggaataaaaatagttggactaataaatgttttcttctgtctcgttttctggaaatatagggcaaaatctcaggtggaggggtacagggaactcttggggagaaaaaaagaaaaggtcacacaaagtagaagaacagtgtcattaacccactgtcctcaaaactacttctcactcaatctgtcttcagaattgccaagagttaccaggcatctcctgatctgcggctgacctggctccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccaggtagggtgtgtgcagcttttcccttagagcagtggttctcaactggggcgattttgtcccccagccccagggacatttggcaatgtctagatacatttttggttatcacaactgggatgggtgagtaggtgctactggcatctgactggtagaagccaggatgctgtgaaacattctgcaataggagagctcccctgacaaagaattgtctggccccaaatgtctgtagtgctaaggttgaaaaattccaagttcatacattacatttgcttcttctaattgctttcccatcgtcgttgggttttttttaaattactgtttacaataatggcacctagccattattaatagcactttaggagacatttgcaaacactttcacatgcatggcttcatttgaacctccccgtaaagctgtgaggcaggtaggtagggaaggcggttattattcccacttcgcggatgagagaactgagagagcaagttttctaaggtcacttaaactctttttcaaagacttgtagttgacacagtatactgacattgtgaaagtttggaaaacattggataaatgattttcctcctggcccattcatttgattccactcttcaactttataggggcccactctccaatccaaaaatcaagaaagaatcaaattgacctgagaagggagacaaaaggctgaatcagtaccttcttaggataagctgaaaattacccacatttggcaaagggaaattgtctgccagacctaaaagctggctcggatggggatgctcagtggccacttaaagtgttcttactgaatagtttaatagtctttagagagagagaaaataaaaaagcacaatgttgggtactttttttgtaagagacatagtttgtagagatgaccatccctgaaaccatgaacaatatagctacagtaatagagtgtttttcaagccagactcacgaagtcatttacaagggtttgtattattcttgtttgaatttacatggctgattttatgaaaagctttgttcttgttattgttcttcaacacaattttgtgatgttgtatgaaccagaaagaaagaacaattcaaagtagcttccccaggcttagagaataagtcactgaaactatgctggtgcagccaagagcttctggttttccagaacacagcaaagctgggtattgcctcctatgaataactcctcctttcttatggtcctcaagaacaaaaatagtcattctgtgatttcatgcttggcaaatgaattttcttcttaattcagaaatgtttgttataaaagctgataattaaatctcatccaaaagcataaaaataacacctgatttcaaatcacatagaagtgtacaagaaagttataaaagttattttagatgtatttgcttcttttctcaaatttattttgaccatgtgatactatcaaaaataaatattatagtactactctttcaattcccaggaaattgtaaggtttagcacttcatattgtttcatttactaaattattttatacttcttttattccttttcccatgactatattttattttatatttatcacttaaatatcaattgcatttcattattgacttttatatttagtaagccttactgttctaattttacctagaattcagttgatttgctaataatgacatgccaaagtgaatcattattacacaatcaacagaaatattccacattattccgacatgggggcatacagctctatctgttcacatatatttatccattgattccttcttttagagaatatttattgaatacttattctgtcctcatgaacgttacattctaaccagagagacgtaatataactaattattccaatctttgttcagttataattatgagaaatactgttataaagaggcacaagatattgtgagcatttatggtccaggccctgtgggtcagggaagggtgaagaaggtgaaaaggaaggcagaagaaactgaagtgtgagggcttcttgatgtagaggaggcaatgagttaggtgttgtcagctacagaagagaagccaaattatattaatgtgtatgagtgaattcttacttctctcaaatgggacataccaaatcaatttggaaatgtagctggcaagtgaaaggacacccaacccagactgacagaaggtaaaaatggaatttatcagcccgtctgaggaatgtgagcctggagtagcacctgccatactggacctaggggcccaaacaatgtcagcagagctcactgtcatcaccacttcccatctctgccatctgttgtgtcagcttcattcttcacaggcttcccacaccacagtttaggtttacatctctaggttcaagtctaggagagaagagagatgcctcctttctagcagttgcagagaaagcctcagtgcatcttactgatcctgtctgaacatctgatcctgtgctcatccctgaaccagccatactggccagagaaatggagtgctctgatttactgaccccgggtcatgggtccacacctggaattatgggtgatttcttcccctaaatcaggatgccttactttatagaaggaggaaagaattctagacagcattaacaacagatgtccagtgttgattttgcaaatgctctgtgctttaattttcaaccttgttctgctccaatgaaatagagcttttggaaaagatttataaactagagataaataaatatgtgcaaggaaaataactttgaggtcactgaattccaggaaactgagatcactgaaattctgtgtcccagagtgcaatatttatttcacaactgtagatacggacacattcttagatactgctgttacttgtacctccctgatcctgaagccaagaaagtctgcagaatccttttcctctgactacagctaatgaggctacatagcttcaaatctgttcctctaatgtggaaaattgcatacattctaatagtattagtatcttgggttattaaatgctttcaactgaatttcttggatcttctgttgtcacagaaacatcataatacatagggcaggtttggaagaaagactggccacaaaggctttgagagcctcctcctatattcctaaaactacgttacagtattgcatgtgaagagatagggctatctatgacaactatgtcctgactgattgctaaggttgattcacatgatcttgctaaccaggccagaaggcagacagcttttagttcacaagccaactctgatcagttagtagtggctgactggagaactatgcttaagaatttcgagactatgtccaagctctggggaaaaagtgctacagttgattagttatgcctgccatgattacagcaataggaaggagtggcatgtgtgccacctgtttgtaatccctaaactgggaaggtttcccatttcttctgtttttcatatgcatttcttccatagctgtgagctaggaagaaaatgattcttgacctgtcacatattcactgccagggccagtgctagggtgaagaggcactcaccctcagggtcgagcgggtacaagatcagtacttccatggccctaaaagcgagtacctctctaaattttgtcttgggtttctcatttggttcaccccaaccatggtctctgcatgctctgctagaggctctaaacgcaatagtttatgtaaaggaaacaaatgcatggaaacaaaatgttcaggaagaacaaaaacacacacacagtaactgctgcaatgccatgaaaacttccttaatgaagacagcctcgcttgctgttgtcgtatgtcatggctgtttatctgagtcaactccagagtagcaacatacttcagaaaaacaccactgtaagtcagaggtccactcggtgaaacagggagcctagttaatgttaattgggtctttgccttttgaaaaccaggacaccagccctatgtcccttagggttgtttcactaaagtaactcagctgttgtgacattgaggtaagtgtcctttatacaaaatctcctaatggttaaaaagaaaaacgtgaggtttgaagaccagttgctcagtgcgcctcttctaaatgaatggcagacagatactctcggggtagaattacagacctagtttagtcacggtcttggtaaggatctgcacaccagcttcctcgtttccccattcggggttcctgtggtctcttactagtctggtcgccctgttctccaggcttatactgtggtctctttcagaatatttcttccaatgtgctggaggagtctgtggtctctgaggacaccctgtcacctgacgaggatggggtgtgcgcaggccagtacttcaccgagagtggcctggtaggcctcctggagcaggccgcggagctcttcagcacggtcagtgcccagagggcatcccggggcctggcctcccatactccagctggacttggggtgctgggaacacctggtcttaatggcccagtcagccccacttcccgaggacacgtgccagggtgtgcggggcaggggatgggcccggggaggactttgatgtatgcaaattgcatgagcttcccaagggagctgagataacctttcatcacagtgccgatctgagcttcactgtatgctcattggttgggcagcagtttcacagtattatttctatttaataggggtggaactaagccacagagaggtgaaatggcctgcccagggttacacaataaatgatgaggcatgttttcactccctcgtttttcctctcagagagaaaaaaattagggaggaaccactgggaggagagaggaggaatacacagacagtgtcttccctcctagccactgtgcagtctgaaggaccatcacagaccaggaccagcttacagaaatgtgggcacagaaaccactgagactcctctggttaacgtaatctggatctaaacactcctagtatatatactagaaaaatatatagagagatgaagtcattgagattcagggcaaagaggaaacactcttgtctattttcttttctttttttgagacagagtctagctctgtcgcccaggctggaatgcagtggtgcaatcatggctcactgcagcctctacctccagggttcaagcaactctcctgcctcagcctcatgagtagctgggattacaggtgtgcaccaccacactcggccaattttttgtatttttagaggagacaggatttcaccctgttggccaggctggtctcaaactcctggcctcaagtgatctgcccatcttggcctcccaaagtgctggaactacaggtgtgagccaccacgcccaacttgttttcattttaataatctccctcctcctttacattttaagccaagaaagtattcagtactttactatatttagctgacccaattttgttttcatctatactatactcatccttattttccagtttttatttccaagtttcctctctacaattttatttattttaattattgttttaactgtcttctctctattcttgctttccttttcaagattcagaaaatgtctaatatactctcatttttcctcaaactcaacaaaatgaattagaatcctactaactctttggaggcatacatttagcatctggctagaggaggacctctgatgaaatttaaatatactaaaactgcctttctgaattgctgttagtccctgctaccaaacttctctcctgttttttcttttcgttttgttttgtttttgtttttgtttttgaggcagcgtcttgccttgtcacccaggctggagtgcagtgatgcagccttggctcactacagccttgacctcctgggctcagcctcccacctcaaccgcccaagtagctgaggctacaggagcatgctaccacacctggctgattttttaatttttttgcagagatggggtctccctatggtgtctaggatgatctgaacttctgggttcaagtgatcctcctgcctcagcctcccaaagtgctgggattacaggcatgagccactgcactcagccagtatttttttttcccccgaaagctcttctccttacttatcgccatacaggactacttagcgaggtgtctagttcagtttgaaggctaccactgtcccaaaagtgctcagataccccttcttgccctgtgaaatactgtgatacaacaataaattcactctccagcacattgtttggacaatgacctctggttgctcttcttaagtttccagtggattaaattctctctgatgctcttctcctctttccaagggaggcttatatgagacagttaatgaggtctacaagctggtcatccccatcctagaagcgcatcgagaattccggaagctgacactcactcacagcaagctgcagagagccttcgacagcatcgttaacaaggtagccggggagcctggctggcaggtcttgttacctggtggcaggcgaccctgtcctacagatgcttagccatccttcctctccagggagtgatttatctttagcacattgcttttgctctcacctgtcaaacagaaaagggctgaaattcttctaacagaggaccaaaattccatatgtgaaaacatacagcttaaattactttataaccaggaaatgtgagaaatttttaagtgtaattaaaagaagtcccagaaatctttcatgggattccttttgttgttatttctgaagtttattccataagcattaaatttttttaaggagtaatttctgtttacatcagccataggagtaaaatgctttgttaacacaatgagagacccctgccctttgcaactcagtggctcctcaggatgacataactaaggagagctttttatattttgttcctcaggatcataagagaatgtttggaacctacttccgagttggtttctttggatccaaatttggggatttggatgaacaggagtttgtctacaaagagcctgcaattaccaagcttcctgagatctcacatagactagaggtaagaaaagtgattctgtgcgcctgacctggtacactttacaaaaacaagttagagtgggtcatcaccaaaaataaacaaataaagagttatggattcatcattgatctctacataaagttttcccctttgcatttataaaaggcaaagtagaaaggtattaggtgagatcatgaggtgatgtaatattttgatagtttttccctaatactctgtgtatgcttttcacagtttggaattttatatggtgaatatttattttgaagtctgtgcaaaattcaatcaaggtcatgtgctttcttatcaccctttccaaatattagtagtttatactagtagatagagagtagtagagtttttcaacatgaagtttagcatcttgactttgaagtaatctagccaaatgactgaatcacccctagataatggtgaggccatcctttaggtatcactggatggcacctggggtccttctgatgtggagctactcagctgtggccagcccggctccaacctgccagtgagtgacatttggtccataatacaacagaaaagtgtagcatgttgttagaagcaaagctgaaagcatggagaaaaagagaaacagcctagagaaaggtcaggacaaaagaaacacaggttataagggccaaacactaagaactcagtcaaaggtgcctccccgatgggatttggatgaacaggaatttgtttacaaagagcctgcaattaccaagcaggactggggtcctttgaactgctcacaattaaccaaagattcactccttaggctttcattgctttgaatttgtgccctcctatgagtgtaaaacttaaaacatttgtgttgcctaatggcttcgtacactctccatccatgccaaaaaagacaagagggtttatccttacttgactcaaagaagccattgcccagggtggctgggtgagttgccccaaaattgtttagcacatgagaaaaagagctagcaattgaccccagtccacttggttccctatattgtttcccctacttagaattagaggtatatattttatcttcttgtgcactgtgatttgccacaatatgggaaggctggtgacttccaagttcccagggtacagaaggcgagaagtaaagagtgtgataccccaggagatacctcagcaaatataatgatgttagctgaattagaggccaagcatacatcttatagggaagcatataccagttgacagtgctatttttatttttgtcttaggaaatgctgaactttgctcattagctcagaggaactctcaataatcagtgaacatcattctaccttgcacttgctccaaacttatttcacttccaagaagacaaagagttgcattatgttaaaataacctttataaactgttggttcttcttacctaggcattttatggtcaatgttttggtgcagaatttgtggaagtgattaaagactccactcctgtggacaaaaccaagttggatcctaacaaggtatacaaaaatttacaaaaactaaccatcaagctctaaatcccttcgttctctacccaagaatacctaatgatctcatctatctggactctccaagtcacttaaatgcagtcaaaccttttcgtctagagttcaactactaattggtcagatcttaaagaaaatatagtcaaaggcaggaatcataataggagctaccacttattaagcaccaactgtgtacctggaactgcattaggccctctacatacatcattttatttcatcctgcaacgacccctggaagtagattttgtcattcctattttagagatgagaaaactgagacatggaagagtcaagcaagtttcaaggtcatgcaagcagcagagccagtactcagacttgaggtctgttgcttctgaacccctactcttcagcactgctctttactgcctttttataaaacctttaaactctccatttcaaactcgacaacacttagtggcttccttctttaggctgcaagtattccttccatccaagtccgggatcactgtgctgttgggggaatggtaaaaacggcttgggtttgggtttcctcactttcacaagagggtatgttccatttcaccccaaaatgggtgtacagttctgatgctaacacgtggaggtggtatcagctcccacagggtaaaggctcagtcctcctcaagactgccctgacttcagatgccagcttcaagagggacccccaggccagccacgcttctgatcagccagctacaaatttgggagtttctataacctgttagcttgaaaataggagaaaacaaagcaaataataataataataataataataataatttgggagtttctatgatacctgttagattaaataattcactacaatgactcacagaattccaaaaagtactctggttactatcagagtattatgataaagggtgaacatctttttgtgcctttatttatggcttcctggctcatcagtgtgttctccaaccaggaagctccgccaagtctcagtgtccagagattttgttggggtttcattatgtaggcaaattgaatacagtctccagcccctctcctgtctccagaggtcatccagttcctaccctgtaatcacagaattggtctttttggtggccacttggcatcctgaagctatccaggggcccagcatgagtcacctcattagcatcacaaagacacccatcactgaggaaattctaagtgtttctaaagctctgtgctaggaaatggagacaaagaccagacatattctttattataccacaagctgatgctgcccactcagcccaactcacatgtccatgaatgagctttctaagttactggaaatagtgcaagtgcaaggtatcattaagggccctgggacagaggaccattcaccatctagcaaacctataaaatgaaaggtccaaactcccagttccatcttccaggatatgaagaagataatggaagaggggaagaattggccaaattgaagagtttgtttttctacatttttcagaatgctttctcacttaagacacattccctagcctcggcttgaaagcagtggctgtggtaagagtttaactaatcttcagacacacatgtctgggagatggagttggccgtgtgcccacagtgatctgtacatagcacaagctgtgtaaaatgtgacctccctcagccaaggtgcccttttcccctcttttaaaattcccagggtaggttgtgagagtttggaatgagagtctgaacccagagttacaaccagatttcattatactaagtcgtgatttacagtctgaggtcagtgaccccactcatccctttcagtgggtgagtgtcccagcatctgaactcatggtcactttttttcctaagagattgtcgtctttaatgagtacttattcgctctgtgtttgagggtggaggtgatgtgagtgtgtgtttaaatgaggcctaggcagtaaaattcagttttggtgtttagttctatgagttttgacaaacacatgtgactaccttcataaccaagatatagaacagatccaccactccaaaatacttcccgtgcccattggtagtccatgttgcaatagttccttcctttccgttgctgagtagtattctgttgtgtgactacctcaccatttgcttgttaattccccactggagtgacatttgggttgtttctagtctttgttatgaataaagttgctggagacatttgtgtacaggtttttgtatggacataagctttcatttctctcctgtacacacataggagtggggttgctgggtccaatggtagtgcagtttaactgcataagagaccgccagcttcttctgcaaagtagctgtgcattttgcattcccaccctctgtgtatgacagctctagctgatctccatccttgccagcacttgatattgttagttttctttagttcggccattcatgcttcctcataactgtgaggtagtcattgtcattctgtaaaggaaagtttgtctctttggaatagcagtttgcaaactctcataccaaggcttccactgtggatcagtttgctctgctaggaaggtgcggccggtggccctcactctccccacaggcacattcccctctccctccttgcagccccttctgtccttgggggtggagaggaggaacttctgctggccacattctcccctgcatctgtagcttttctgcactgggcagggcggtgccggcacgccgtgttcctgcatgcccctccattgcgtcagggatggccgtttgcagaatagctcatcttctccctccgtgccttttcccccttaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggaggtaatgcacccaagggattggccaccactggatgagtgggctgggtggcctcccaggaggacccacaaacctctttcacagtggattggactgaaaacaaggagggatgcacttgaaatatgattatatggttgtcctttcactctcatagtgccagaaaatcccatttaggcagctacatattttatagcactattgtatattaaatatttaatattttaaagttatatctttagtataagtgtgtttatgtatttaattataatatttaatatatatttcaattataaacttgtacaacagatatatttaccttttaaatattttatataaaatttttctatatttcaaagcttagaggtgattcaagcatagtcgtgctgttaattattggagacgggacctgcacgtgggcagccccagtgaggcggtggtgtgctgtgggaaagggccgtgtaaggtagacaagttcactgactagcttctagtcctagcttcctcctgtgattttaaacaagctacgtaccttcagtttcttcatctatgcattagcaggaaagacctctaagtacagtacaagattatactcattttattaataaaaggactggtcaagaaggtctctcaaaccacagaattgttcaaaattctacacaccataaacaacttattattctttaaaacacatatatatacacttatttgtcgtcctttttatgcagggccacagacttctctgtgactgtgggtttgctgatcacaattcagcattttcttttataaaccacacccgtagtgctttgtccatgattttcagttttgctttgtgtaagcagagtgagagcttaaagatccttgttaaacaatttgagagcagaagccttctggatgtttatgatgtttttctccccgagactttgacagcagtcttgtgcacacctaatatgacaggaatttttatagcaactcactttcataatatcttgtccaaccatttggcttggttttcatagaaagaaatctttttctttccacacccatggttcatcagtttctccattatctaattagattgggtcattaaaataacaagtataacaggcataatcaagttggtgaacaaacacagatgaattgtggtgaatatatacctcatcaggcagaagcagaaatagctgagctaactggagagtcatccagcaggtagtgttcagctgggtaaccacatcagggtgtggctttcacagaagctgaagaaagcctgaagcagtgactcagtcgggaggaggtgggtttagaagccatctgctgtacttcctatacttcttggtttggacttttgaacactgagacattctaggcataacacagatataaactcatggtgcccaaaagcatttcaaaaccttttcttttcttcattcctgccttcctttcctttccttcctttcctttcgttcttcctttttttctgtgtctctgtctctctttctctctttttcatttttgagacaggatcttcctctgttgccctagagtgcagtggcatgaacatggctcactgcagcctcgacctcctgggctcgagcaattttcctacctcagcctcctgtgtagctgggactacaggcttgtgccaccatgcccagctaattaaaaatacagagagatatatattttgtaagagacaggggtcttactttgttgcccagtctggtctcaaactgttggcctcaaacgatcctcctacctcagcctcccaaggtgctgggattacaagtgtgagccactgcaccagcctgaagttttcttggccttccttcgttccccaacaacctcaacaacagttctcagctgtttgctagggctgtagaacaaagttccatagactgggtggcttaaacaactgaaatttactgtctgcacaattctagaggctagaagtttgaaatcaaggtgccagcactgttggtgccttctgagggctgtgaggaaagggtctgttccaggcctctctccctgacctgtggacagccctcttctccctgtgtctcttcacatcatcttccctctgtgttcgtgtccagatttcctcttctcgtaaggacaccagtcatattggactagggcttaccctgctggcctcattttaacttgattgcctctgtaaagaccctatctccaaagaaggtcacattctgaggtactgaaggttaggacttcgacatatacattttgggggaacacaattcaacctataaaattcagaaaagactctaccccaaaccagcagaacttagcaaatagattgattgacccttaaaagaattccatttactggaaattcaccctcagttggagaaggcacaggtgatatcaaaagcctgtgttatgatgggggagaaaatcttgagtgctgtgcttctactacagctttctgcattgtaagttgagtaacatgaggctgtgtgcggtggctcttgcctgtaatcccagcactttgggaggccgaggcagggggattgcctaaggttgggagtttgagaccagcctggccaacatagagaaaccgcatctctactaaaaatacaaaattatctgggtgtggtggtgcatgcctgtaatcccagctacttgggaggctgaggcaggagaattgcttgaacccgggaggcggagattgcagtgagccaagatcatgccattgcactccagcctagacaacaagagcaaaactccatctcaaataaataaataaataaataagtaagttgagtaacttgctcagtaataggaaaaggcacctgacagggtagaaaaaacatggactttgaagatagacatacttgtgatcgaattatgacctcctcccttactacctgtggcattctgtggaacttaaccttacaaatccccctttgactgtaaaatggagagtataaagaggttgttgagaggaataaatgctaaatgtatgtaaagttcctggaacataaggaatcaagaaatgttaggcccatctttctttttaacctgttaagagtattttaaattactctgaaagtctttccctagctgcctcttcaaattcaggtggcctctctgtcatagctccaggcttgtccatagcttatgagaccagacagtgacttccctatgtttacgtctcatgttcagtttgttttgacaccgattgaagttgccattgaagacatgaagaagaagaccctgcagttagcagttgccattaaccaggagccgcctgatgcaaagatgcttcagatggtgctgcaaggctctgtgggagctactgtaaatcaggtaagcaaaaccagaggtggcagctcctctggttcttattatttaggttgtcattatacgtctgcacccttcttccttggggttgatgaggactttgatccatagacaaacacagaaatgttcctacacttaacctgaacacctgtaaggtttagaagacttttaggaaacctcttccctttcatgtaacaaccccaggtaaaaaagaaatcctagagatgagtggaccaggctttaaggagtaccactttctcagaggagtctccacttcggggccagacctgacaatatgatgcaaatctggagtcatgttgaagaatgcttagtcatgaccaattcacgcagagtaattgcagggcttgagactcacctacaaatgcctataggagagaaggaaaaggatctagaacatccaactcttggctcagtcagcagatgaacccagcatgccaaggaccttgacaaccaggaatgacctgggacctgacttcttaggctacttcagacaagactagatcttcctatcagacttcttagaacgctgactcccaagttcagcatggtgctcaagcagtctcagatgaagggaggtaccagcctaatacctctgtccagtgggcctccttaattcaaatctagatctgttcttgtccacacttccacggcagttattcagtgagcatcatgagtcttttctcattcagcgtaattggatttccccacaaaagttctgagtgtacttgacatcaagggagcagaaacagagaagagaaatgcctattacattcccaagatcaggaaaaaaaaatgaggaaacgtttgcctttgtaagtgccaatcctttgataaaatggaagactttccaagcccacaaccatggtctatctgtacacgatggatatctctgactcaatccagcagttatgcaaaatgatgtttgccatgaaggcaactagataagtgaacaaaaatgaatagatcaaggcaatcctgatttttagaaaagcaactcaaagcacataccatttgatgtagttgtattacacttatatatgaatgaaaatctattattagtagtatttgattgataaaataatattcggcgccaggctcagtggctcatgcctataatcccagcactgtgggaggccgaggtgggtgaatcacttgaggtcaggagtttcagaccagcctggccaacatggtgaaaccccatctctgctaaaaatacaaaaattagccagtgtggtggcaggcgcttgtagtcccagtacttgggaggctgaggcaggagaatcccttgaacccgggaggtggaggttgtagtgagctgagattatgccactgcgctccagcctgagtgacagagtaagactctgtctcaaaaacaacaataaaaaagaaaataaatttgggctgtgtatggtgcgcacgcctgtaatcccagcaatttgggaggctgaggtgggtggatcccttgaggccaggagttcaagaccagcctgggcaatgtggcaaaatcccatcactacaaaaaaatacaaaaatagccaggtatagtggcacacacctgtagtctcagctacttgggaggctgacatgggaggatcacttgagcctgggaagtggaggctgcagtgagcagagatcatgccactgctctctagcctgggtgatagagcgagaccctgtctaaaaaacaaaaacaaaacacacacacacagggaaaatacatttatacttctgagtgttcctctaaaacttcagattcctcctaagaaatcaaaatttcctgagatgtccaagaccttccttatttttttttgtttatttcaaaccaactacaaaattaaatgttcaaactaagaagtcactccaatattttctcccaagcaatttaatttccttcatatatgtatgaatatattcatatatatgtgtgtgtatatatatatacatatatatgcatatacatatacatatgcatatacatatatatgtatgtgtatatatatatgtgtgtgtgtgtatatatatatatatatatatatttttttttttttttttttttttttcccaccagggaccactggaagtagcccaagtgtttttggctgaaattcctgctgatccaaaactctatcgacatcacaacaagttgaggttatgctttaaggaattcatcatgaggtaagaaggaaaatggctgggaatttcagtagagcagtggttctcaaagtgcaatcttagaccagcagcttcagcatcacctgagaacttgctagaaagacaaagtctcaggcaccctccagacctgctgaattggaatctctggaggtgtggctcagcaatgtgcagtttaacccgccctccaggtgatcctgatgcacactgaagtttgaggaccactgcagcagagcaacactacttgaactactaatgagtaactaacacgtcaactatgaaacgcttttgtggctagcatcccgtgtgcctcacaatcacttgttgtaaaacaagtatcatcatcttcctcattttacaaaagaggaatcagaggttcagagagaggagataattttacttaaggtcacacagacagttggcagcagagatgagctcaaaccaggtcttctgaatccaaatagtccacatgtccatcaatgtgctgatattccactgatgcactagagtcccagaggttctttgcattggcagtcattgtaatgttacaaatcttataatatcttatttttagaaacttaaaaacatacactgcctcaaattgagagaggcaagttctaaaaccaggcttttcaaaggtattatcctgtgacagttccccatgtcagacaagtctcatctctgttccttaattctgcagtggagctggcttcaagagcagtcagttaggaactgggtctttggtcaaagccttgtaatttattgcaatacagacagatatattgggtctcctatggtcctaaaaatatgagtatgaaggatgtgatggcatttcacctataagagaaaaggacttcagaaaaatgtgtagcaatatttctttctattcaaaaccttagagaagaatattaagtataagaatatcttcacttggcagatggggataaaggagactaaaagtttgctaaattcagtgaaaactcatcaaaatgctagcatttgtgaggttagagatatctcctccttcacaggcttttgcgagaggtccgcaattttgctgcatatacaggagacacactgtgccctgcagtgaatcacagccgcttggtaataggatgtttgtgtggctttgcgtgtttgtatttgtgcatgtgtgtgaacatactcacagattatcttgattaatgttttgatatttgaattgtttcctgtatttgacaacaattctgacagaaaaactagttgttgttgttgttttttcagtacataatacgtatcttttaaaaggctagaaaaatatttggggaattattttattattttattttattttgagacaaggtctcactctgttgcccaggctggagtacagtggcataatctcagctcactgcaacctccacttcccaggctcaagagattctcctccctgagcctcccaagtagctgggactacagacgtgtgccaccacatctggctaatttttgtatttttggtagaaatggggtttcaccatgttggccaggctgatcttgaactcctgacctcaaatgatccacctgccttggtctcccaaagtgctgggattacaggcatataccaccgtgcccggccctattttttattttttgtggagacagggtctcactatgccgtctaggctggtcttgaattcctgggctcagagattgggggcttaaaaaaattttttttcatatatttttatttaaaattcattatggttgaatgcttccaaagttgactatgccccaggacctctaaaaggacctatgaaatgtttgaagagcactcactatattccaggcatgatattagttatgggactacagagatctggcttgttcctctgttcttaatgacaggacatagccctgcatggctgaataatagaatgcagcatatgcacagaactttaagaatgactaactacaggactataaagatcagaaaagagaaatcagtttcaggctggagcatttgtgggaggcgttatggaaaaacaccacttaaatcttgtcttgactatatacgtggaagaaaggcgctagtggggaagagggagccaggacagtggccctgcctgatccaaggtatcactttcagctgctttagttacccatggtttgaaagtattacttacaatatgatattcagagagagagagagagaccacattcacataacttttatttcagtatattgctgtaattgttgttaatctcttactctatctaatttgtaaattaagctttatcataggtatgtatgtataggaaaaaaacataatatatgtagggttcggtaccatccgcagtttcaggcatcccctgggggtcttggaacctatccccgagaatgaggaggactgagtaccactgagtggaccagcaggaccacgagactctgtcaggaatgcctgtgatgcaccgggttcctctaagtccagctggagcagcgtgttctcatgagcatgctaggacaaggaggaaagattggaaatatgataatatcagtaaatgaggctctgaatacaatttaaatgtttaagaaaacttgtcaggagagtgattttcatttacttcagtttgcctcaattttttctactagttataaatcttgcaatccagtatctcacgggtatgatcctttccatgacaccacctaggtaaaatgtacttacaaaatccctactaaacatgcgtttctcattagctcccagccccaggaaaagttactccaaaaagaaccagtgcccagtaaaactagtcccaggcaagagatacaagaggaaatggactttcctaggggtcgctcctttaacaaagtcattagagtttcaataatgaggctatcattctccccagatggcctacagaaatgttggattttcaaaatcaaattcaccattttaaagttgttctcctacccttttaatggtgattccacatgggaaccagtcccacctttctccccactggctgggctgctgcattgttctaggaggccaggagactgtccatgcttcccagacttcactgttcttacacgtcacctgaggatttgtcaaaatgcagattttggcctgatgcagtggctccgcctctaatcccagcactttgggaggctgaggtggaaggactgcttgagcccaggagttcaggaccagcctgggcaacatggcgaaactctgtctctttaaaaaaatacaaaaaaatacaaaaatttagccaagcgtggtagtggtgtgtgcctgtagtcccagctactcgagaggctgaggtgcgaggatagcttgagcccgaggaggtcaaggctgcaatgagccatgatcgtgccactgcactccagcctgggtgacagagaaagaccctgtctcaaaaaaagaaaaagaaaaatgcagattctgattcagtaggtctggggttggtcctgaagcactgcatttctaacaggcccccaggtgatgctgctgctgctacactggaccaaactttgagtggagagcctgcaaagattgcttaatttcctccctttcacatttctccctattacctctccctccttccctgagggcttaatctcttaggccatccttatcatcatttaccacttttgccgtctgcttcctcccaaaaaataaataaataaataaataataaaataaaattttaatggcaaaaaaagaagttgtaaatctcaataaaattatgtgagaacaaaaaaaaaagcaaacatgctcaaactgctgcaccttgaaccaactatagacgtcagttcatccattcattcagcagttattgagctcctactttgtgccaggcactgtgctacatatgtggaaggatgaagtcccaatatcagtaggacaaggctacagacaaaacagtactgctgctcattattcatctctatgtgcaaacacaacagatggcctgccctccacttcattctacagagatcagaagtcgtgggtgagagtgtgctgatggtgcacaactgtgtaaattactaaaactcatcaaactctaaacataaaatgggtgaatgttacggtatgtaaatcataccctgaatacagatagtagatgaggttcctctgttgcttaattgcttctcaagtccaatctggaagttacagcttttaatgaatagagtaactattttttcacgttgtttgtgctgtgtattttctcctccactctgctaacagacagcagaggtgacgcagaagtggaaaatatttggggcttgaacagctctcaggtttcccctttagtaagctccagcttctcagcagacttgggctgtagatcgataagcccagatttccaaggtgaccataaatgagtctctgttgctgagagctaatagcggaaacatttgcttgccaggtccactgcgtctagtgccaccacggggcagcgacctttctgactcagctgtagtggaagcagaaacagccataaagaatcctggcagcctgatttgctgcagccagtactcatccagccagtcctgcaactcttcaaactgttaccaagctgggacctcaatcagcttctgtcttttcctgcaataataaaaaacatctcgggttcagaagccaagacaagaagatagagagatacaatcttctatcttcctcttctgctcccccaaacaccccgaccatttagatttttaaattttcttctttatacttatctggactttctcattcttataaagactaagtgatgttaaatttgtttttaatttaaataaaagatagtagtactcactggcaccagttacagcttgcctttaagagaagtagtttcagatacaccctgaaagggttctgcagcatatatgtggtcataggctcagaaaacaggctgttgagtggtggcgtttttaaactggagttggggtctatgaagaggaaggagaaggaatttgtccgagtagccaaaggacaaccaaatgtgtagagtgtaggtggaaaaagaagcagtagttttaacttgagaccaaggccatatgcctggcttatagctggaaatggggaaatggctttcctaggcagtatatgtggcgttggggttgggaatatgggcactcaagccagattgcctgagttcagatcccattctgcctcaactagatgtgtgaccctgagaagttacctaccctcggtttccccagatgtaaaatcggaataataattgtacctctcccttgcagttagtgacagaataaaatgagttaatacatggaacttagaataagacttcatacatactaagggatcagtaagtgtaacattgttcagtggggcaaataggggactgatggatttgagtgggaaatagagaattaatctgacttaaatacggagattgtctatccatgatttgtctgtctctataaagtttgaatcataagacacagtgatgctgatgagacattggcctgggagcagcaggattctgggtttatatccagctgtgctgtcccacaggtatgtgactggacagggcacttcacctctttgcatgttagtttcatcaactatgaaataaagagactagaatacagcatctctaatagtttatcattctcatattgtacaaatagttcatttacttagcctgggtctgtcaggcataataacgctaccatgtgctctggcttcagctgtgtgcagggactcttctgaacatttgatatgtttcaactaatttaatctttacattaatttatgaggtaggctcttatcacccacacatcacagatgaagaaactatgacatgaagaggttaagtagcttgtttaaggttgcaaagccagtaagcagcaaagcgggattcagagttgagcactctggctccagagtccatcctcttaattgccatgctgagctgttccctctagtgactatattcagttgctagtaacagaaggaagagtagcttaaataagaaatttatttttctctcacattaaataagattggaggtagtcgatgtagagctgtgtagtggcctcataaagtcatcagagaccctggttcttttccaatcctttgccatgccatcctggttctagtgtacccattctcgtggtcatgatatggttgctagggctccagccatcatgaccacatctaggcaagtcaggagtagaaatgaggaaacagcaaaaagatgtgcccatttcccagtgccttcacctatattatcagcgatccctacctgcatgggaggctaggaagtgtaagttttcaggtggtcacactgcctggagttctgccagtagggaagaaagaatggatattgagaaaacaactaacgaatgtttgtctgccacactgaggaacccatgtatgggctgtgctgaaaaaggggggccaaggctgggtacagtggctacgcctgtaatcccagtactttgggaggctgaggtgggcggatcacttgagctcacaagttcgagaccagcctgggcaacatggcaaaacctcgtctttacaaaaaatacaaaaaaaattaaccgggtgtagtggcgtgcctgtagttccaactgctcgggaagctgaggtgggaggatcacttgagcccaggaggcagaggttgcagtgagctgagatcatgccactgccttccaccctgcatgacagaatgagatcctctctctaaaaatagagggggtaccaagagatgcagggggggtgagggcagcatgactactctctctgtaggagaccttaactctataaatggaggccccaaaatgttactgccatcaaaagccaggaatccttttctggaggcgtaacttcctgccctttctaatccctatcaatctggtttctgtagaactgtgactgctagaaaaccccaggcatatttgttctaagaaaatacttgtgttcggtgaatttaccaacaaagggagcatcagaggatgtgagggaagtctggaatggttgtatcactaagtgagagcagcacagatgtttgtggacctattgagaatgttacagataagaccatttttgaaaagttgtttgcagtgtcattttatgatcttgtgtacattttccaagcgatgtggctattctctaggagggatagtagaaattatttcaattttaatcaaataacctagagaatataacccaaatgactgaaaggaagaaatgtagaaaaagtatataaaataattttttgcattataaaagtttaaagacataaagtaatattactacataaaatctaagttttttactccagctattaatatgtttttctttataaaacatcacatttattaattgctgtgtaacaaactacctcacaatttagtggcttaaaagaaaatttaattattatgcatgtggtacataataatttttgctttcctcatttctactcctgatacttgcctatgatgtggtcatgatggctggggccctagcgaggtgtattgtggccatgagaatggttttgctgcaacttggggttggctgggctcagctaagcagtttttgcctggagtctctcagttgcactgagacagtgactaggacttgaattacctgaatgcttcctcactcatgtctggtgtctgggctgagaatactcaaacagcaggggctcctcctctctctaactctccttctctccacatggtctctcctgcatgacagctttagggtaactagacttgtcacaggatggttcagaactcttatagtacagaacgagagagagacagaggccatattaccttttattagccagtcacacagtaccacctccaccacatcctattcagtgtggctgtcacaaagaaccatccacctcttgatgggggcatgggcaaggttctaggagagcacattcttgtggccattttcagaaatacaatctgctacactccagaagcatctgtttgccttattatcatagcttctgatttaattctcccagcaaccctaggagattatatgagcttattatccccattttccagagaaaattgaagatttttatggttaagtcatcctgctaatgagtagcagcttgtttcaaccgcagttgtctgcatataacacatttaactcagtcaagggcacatggtgagcaatcagaaggtgttagctagctgctgctacttctgcaaacaaagactaaggagagtttagctgattttaccaaagttgtccgagtagacttccccaaattagctgttagctttggcaggactcatcccacctcctgtagcctgccaatgttataaacttgggccttgaagtcatcctgaaactgatcttattttacacatggtggtaattgtaactgttagttaagaagcaataaaaaaataataaggggtgatatagatttctcaggattcaaaggccatatgccttcccttctatttcttccctaaaaccgttaattcataaccttagctatcctataatttgcttcaattaatgacaaacataaaagataggtgaaaatccagttaagggagttctttcagattctgtgtgagttaaatcaagtccttcttctatagcaggctaattccatgatgaagctgtggtgctaagtttatttttgcctaggcaggtagctcttccttgccacatgctatcctcttcctctttgactgtcatcctgaaaatgtgttcagtgttaagaggatttgataacaatgtctgggtatctccataacttagtccaaatctggtaccactgttaggaaaataatgtaagccatattgatcacccacgtcttattcatttgaaggataatatagttattactaattattgcgtgttaggtaacatacagccattattctgtccctttaaggtttattgatttgtaagttcccttgggtagaagagtacaaaacaaaaggcaaaacttcatcatgtttaaataacgtgattttcttctttggtgtgtaccgtaccgtgcaggagacagggaaaacaccaggtttaacggtccacaagccagataaccatgatgagttctaaagattttctctgtctttaatgttcttcagttttgtcatgagaagactggatatagctctgttgttgttcattagaggatttatatctctcttcaactctagaaaattaccagctgttatctctttaaatattgtctccctctcattttccattcccttggagattctattagatgtgggttggatcttccttatatctctatgtttcttaaccaattttttcatatttttttattttttaaatctcattggtgatttccttggatctgtcatacatttacttctccaattatgtctagtctattatttaacctttaacctttccattgagttttttgtcttttagcaactgcatttttttttttttttttttttttttttttggtgagacaaggtctggttctgtcacccaggctggagtgcagtggcatgatcttggctcactgcaacctccacctcccaggctcaagccatcttcccacctcagcttcccaaatagctgggactgcagtcacctgccaccatacccagctaatttttatattttttgtagagatggggttttgccatgttgcccagtctagtctttaacttgtgagctcaggcaatccacccaccttagcttcccaaagtgctgggattacaggcatgaggcaccacacccagcctagtgactgcatttttcttttttctagaagttctgtttggtccttttctgaacttttcctggtctcttttttcattttccctgtttatttgtttttatcatggattttataccttttatttattttctttttttttttctagttacatgattacttaggattttatacattttattacctctctatattaactttggttttttacattgttttattatctctaattcttattggactaattcttttgtttgatgcatctgttagttttccctcgtggtggttggtttcttcatatggtttgtaattttttattgtgagctcatctttggcgagagtggctcatatgccctgattgagaatgtgttcctccagaacaactttatgttggtttggctgaatcctagcaatttcagtaatcttggactggcttttaagttattttctcaccttgaagcacatacagtcaaggaatgtacatttgtaacttatactatgtgtggtgcaagcctagaatttccatttctcaatatgactttcttttccataaatggccctaagctgatagcaagttttcattctgcctctctggacatcttgcagcatttttctaaaccctctttcatagatgggatagcttttcaaggctctggacgatatgcaggtggcatatccagaatctccctttgccctggccaaggccacatcactaatcttgtgtgagctttgaagccccttcccctcagcccatagacctatacacagtcctaaaatcttaatgggcagtcctactgacagctgccttgtcaccagctcctgtgatcattctagctttgatttttctctttctttctggcacctggtgttcccctttctctttcaacaagtttttgctgtgctttcctagcacttccatatgtacgtagcaggaggaggctgaatgccatctgctctgtctgccatgttgctgtaaatcacagtgagttttttgtaagtgtaacagcttccattctgcagtgtgttttgagtctgactcttagatccatcacttcctcacagtgttatcttgggcaagcatcctaacatttctgagtttcagaaacaaaatagagataaatgctgactttttagggttgttgggaaaattaaacagataatgcatgtaaaacttcttgaaacttcttctggcacatagcaagtcagaggttctcaattctggctaggttggcttcagtatcccctgggcaactttttaacattagacatttctgggccagaagcaatggcccacacttgtagtcccagctacccaggaggctgaggtaggaggatcactggggcccaggaggtcgaagtttgccatgagctgtgatcatgccactgcactccagcctgggtgatagagtgagccccgtctcaaaaaataataaaataaggtaaaaaaaaaaaacaaacacagagatttctgggtgctacccctcagcagttatgattcattaagtctgagatagatcccagaaatctgcattttgaaaagctccacaggtgatcccgatatgccacccagtttgaaaacgttcttaaagttattcgaaaaatcgtaagtaatttcattgttctcagatttctaagcacttcaaagtcatttatttctcccacactgatattttcatctcagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagaggtaagaacagggcagaggaggcctcttcctgtgggataaagagcagcgcatggggcctagcaccttggggcatgctctgctgcacttggggagctgcagaacctcgaaagggtggaagagggtcccacagtcagagaggctaccagagtgtgattcattctgcctctgtcctccccatccctgctccttgacctctcccagacaccttggtgttggtcttgtgccagggtattcccagggctgaatgatggcctgtgttggtttttttgtttgtttggttggtttgtatgtttgttttggcacagtgtgaaggggtcgcagacctttcacttattatttgctgagttgtccatgactgatgtccatttctactgggtgatccacccccaaccctttctaaaaggctaactgatcttttcttgcttctgtacgctctctttccctctcctccctctcttttcttaatttcagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccagaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaatgtt

SEQ ID NO: 1689 - DNA, 192212 bp, Homo sapiens; identical to SEQ ID NO: 1688

SEQ ID NO: 1690 - DNA, 33606 bp, Homo sapiens
ttgagacggagtttcgctcttgttgcccaggctggagtgcagtggcaatctcggctcactgcaacctccgcctcctggattcaagcgattctcctgcctcagcctcctgagtagctgggattacagtcattcgccaccatgtccggctaatttcttatatttttagtagagtgggggtttctcatatacattctagtccctaattctgactgcccattttcttaaagtaactgtaaatttaggctgagtcttaagttctaatacagatggtaattcaatttctggcatattcaaggtgctagtctctgtatatcagagttgcagcctaatgcatcagggctagttgtccaaatgcttggagatggcaggtggcaaccacagataaggcaggcctatgtcaaactcaagagtgaatgtttttgctaaagtatttatatttttaaaatgttagtagtaaaccatgttgagcaaacgaaacatatttgtgagcataagtcaacccatggacctcagggctgcaattctttcatggaaatcttctcatgtaatcttcataaaatctctgcccctcaatttgctatgagcttgttctggtccttatctttccaagaaccctagaagttggagtgacctaacaacaaatccacatgggcagaggtccagggactgagctctgaaggatcctgaaagaaaacaatgctgggagcactgctctgaggagtacaaaagtgtaaaagagaaatgaacttaatcacaaaactgaagattgcactgaagaatacttaaaagtcctttttaaaccactcaggtggagagaatgcaattatctggcaccaactatgttctaagaacataattctccccaagattttgaagaacatatttaattcgtacatctacaatgcaaattcatctttcattggcctctataatacccagctttcccaaatgctcttccacagcacaaaaagtaacatcagtttgcaaataaaaggtgcaagaaggtgtacagtacagtcgtgaaaagggcaatatatacatgcatataaaagagaattaacaaacaaaaccttgatttctagagaacatggaagttataccagacaaggagaatgtaggggaatctcatatttatagtacccttacctatacatgacaaagtttacctccataaacaaaaacattagcagatgctgctaacattctgcaagtaataaattcctacttatgcatctgtggatattacactattaaaaggcacatttatttcttgatgcatgtctttgctaatgtcctaaatttgggttccaggtgatctagaaactccagtccctcttcttcctgccgatcgctgcagcaacctactgagccggccagagaacctttgccttcatagttatacgaacaaacgtagtcttcacaatgtttatgctcctcatcttgtccacacaaatacaccttctgtatcaaaaaagagcacattttattattttttaaaaaacacctaaacatattagcagaaaaatgatgtctttgatttaccttttactgtttaatttttaatcagagtgtgtcctctaatggattcctatatataaaaaatgcacaggattggtctgtattatagtcactcttaaaatatagcaaataaataaatgcttctagtgagcacatttaaaaaattaagactacgcatatatcacgcaacacatttataatttcccatttgaacacaaaacatgtatatttgaaatttacctttgtagcttcttcacgtatttgaggaaaaccaatataggctatgattcctatgtttatacactactatataactgtgatagtgtaatatattaaactggctaatatcaaacctatactgattaatctgaacataaaacaaaacaaggaactaaaactcaaaataaaagctcaacaatttatctggttgattttgatagccaggacttcataaccacacaaagaactcaagcacactgagaaatgtttataatttatgatccattcattcctgtataataaatatttcactccagctggttttcctgttaatttctagggaagaggctatgaaccttttatcctttgtaaacacatctacatatggcactcctagataaagttttgtaaactgtattttcaaaggtgaattttcaaagatcatttttatctttgggtttaaaccagacatccacatctatgataatccaacaggtaaaagatgttgaattccaggtatatgaggagtaaaacttttgggaaattctgatttataactagcatttaacttccatgtaatatgacctcaaagacagtggaacttacttcgccaagccgaggttgggtgaaactctgccagtccgtgtacgcatatctgccagtatctccctgccccactcccttgacggactccaaggtctgatgtccacctcctttgttggaatccaaagtgtagcctcctttgaccatctcaaaactttgctgtgttttgattccctggccaccaacagtaccaacagacatgcttgtgtcacaaatgttggatgtctgcatggggagtctaatatttgcttcctaaaagtaaagtgagagtgataaagtgaatttgaaaaatggaaactaacaattcattttcattttttttcaccataggcaaatcacttgcctgctgtgcctctctgttcctcatacataaaatcagaataatagtatcataggtgtgatgggttgaattgagtcccctaaaaattcatatgccctaaccctcagtaactcagaatgtgaacttatttggaaatagggtcattgtagatgtaattagctaagatgaggttatatgggattagagtgggtccctaagcgaatataatcagtatccttataaaaaggggaaatttggacacagacatgcacacatggagaatcgccatatgaagatttgatttccactgccataagccagggaattggcagaagctaggagagagtcctggaacagatccctccccagttccttcagagggagcacggacctgccaacaccttgatctctgatttctagtctccagatctgtgaaacaatacttgtctgttgtttaagtcactcagtttgttgtgacagccctagccctgtagaattgggaggtttaaatgatttaaaacactgagggcacttgaaactctgcttagcatagtaagtgctcaataaacattagtgatattatcattgacattgttgagtaataatctgtcatcatttgttcaccgtacaattcaaagggatgtgaaatctgatttaccgttacttcttctccaggtccttcagtatttgatacaattaaattttgctgggctatgtcttctggaaaacatttcttgactgttctcttagcagtgacacagaaacatgtaaacagaatacctaaaaagcaaaaaagatcaaagtaaaacacagacattaaatcatttgattacatgattttttaaagtcttcttgcatatgtctcaaaaaattcattccacaaattgagctcttcaggtcacaagatttaaaaacagaatattttaaaaatgtatttatactatttgtagcttagagagattaataatagctctcttcccaggtccagaattaacttatatgtgtcttttatttcttctacattgaaatggtaacttcatctaactgatatttaagatagcatcattagtagttaaaatcatacagaacacacttaaagggcttaaaataacaagactaagaacattaggcataaatacaaacaagaaaggcaattacataaaattggtgtctggtttcaaaaatgtacatcaactaataaagtgctaagaggaatatccaatttaatctgaaactcaaatcaatgaattaggatacagtaaagattataggaaaagtttgtaaatgcaaatgggttctttggggtcagagggagagagaaagaaaaagaaaaggaaaagaagagagaaacagaaagaaagaaagagaaaaaggcagtcttaattaagcgtgggcaatatttctattacttttgtacctccaaataacagtttgcacaatgcaaaatcttagcatcctttgcctgtattgcttttcctcagtggctcatatgaccatttttcactcacggaagtcttacgatgatgctaaatcacttcattaataatatggaacagaaatatctgagtaaattttggaatagctctgttttcacaaattctttttgtatgtatgtattccctacataaacatggctggttgaaagactatattattttacatggagggaatcttaatagttttacccagcctcttcattttacacatggaaaaatgagttcaaaaaggaggaaataatttacccaatgtctcacagataattattgaagaactaaggctaccacctctgaaactgactttaaatttaatctgctgttactgatacatttatcactcagagccccaagacataaaatagatacaatatttttaaaagaacacacttcccaaaggctattaatataaaaaacttccatgttttaaaaatactagataaaattttagctaacacattctagataatgatacttaatatacttacataataacaatacagaacccaacaccatagcaagaatagcccatcttccaagtattacatttggtctaacgtctcttgtacttttatccttcattctacactcagatggagttgaacagtcacatactctcactgttaacatatgtgttgcaactaaaccatgcctgtcttttatttgaataggcacagaataatagttataatcaagattttgccgttgacgaagaatggcagttttacctagggaaaaaaaagacagaatatatatggattggctgtttagatggcagtattattcctactcaatattctcagtggaagggaatcaatttagaataaaaactcgaatttttctttttttttttgaatttgtgatttcccagaagagccagaaaagtaattgatgttgctttatgctgatattaaactaatctgtacttaacatgttgctcaaatgttaattaaaaagggacttatatgttttcttaaaagatattcagaacaagagtctaagctcatcacaatggcactaattttttttaaagattaggtattgttgtttttagggttaataaaataatttcctaaaataaatgtgtatttattatgataaactaaggtgaaagaaccatcaccaatctgaagtccgtattgactataaaatttagcatgattacataccatccttttcttctatgttccagtttttactggcagaattatccagaaagaattgaaaaggtggtccattttcaggtccatctggatctacaggtttcagaacagcaaaatcctcattattctgacaaatggtcacttctttgtcaatttgaggtgcgtgatcgttgtaatcatccaaatgaactactaatgttccagtgcaagatcggccaactaagattaattaaaaataggttatttcttcacatgaaaatgcatttattttcaacaatttataaaatacacagttgacatctgctttctactagctgtctgagcttgagttcgcatacatgcttcccagatttcagacaccaagactacaaaatagggacatgtcacttttctttgaagactagggctggatcagataatttcttcagatgcttttcaaaactaaaaggtatgagattatgaggaaggtcactacagaatgacctgttgaaaataaaacagatgtcttacatccttctttatgaagcgcatatattcatccttagaatacaaacactttacatttggttgtcagtcactttctcagcttctccattgcatcatatacttttttcccaaaccttgaaaacttctctagaaatgcactaagtgttccccttcctgtctgctttgtagcattcggttgccactcctaggaatacttttctcctcttctttgccagatagcacactattatcttcaagaatctacttaaatgtcacgtcctcatgaaactcgtgacttccacagacaatggtagccatattccagtgctttctcagaactctttgctaatactttggctcacacactgaactgcaaaagtagcatagtaagttgtattcaccttgagagcctagtgatttgcccagtatttcccagctaactataacttaatactgacacattgaacataatgcagttcctatttttatacttgaaaacatttaattgaataagccagaaaaataagttttcatctctaccctaatgcaattcatatgttcttgacaacaggaactgtctcgtactcatctgttgattgccactattattggcctaagacttcacacatagtatttttagttaaaatagtgcccattatttgtgtttaagagataatgaagttcagaaacatgtcaaatcccaccatttgtaaaaggataataaactacaataaatgataagatatcaaaattgaaataaacagaaaggtaattgatgtaatttttcatgtttttgctttaaatactggtccacattttgaaacatgtatgttgaatttatcataaagactactataactcccatgcaaatataatttatttttctttttaatttgaaataaccctaagtcatatcatgtagtgtatttcaaaagaattttttctgttgaataactacaaaattaatttattcagtgacttttaaactaattgtttgtataaagtaactactatttatgcctattttaaaactacctgaacaaatttaaaaatatccagaaataaaagagagatatagctatttgttgaagaaatttgcaatagcatataaatactttgagactgccagaaaatagcaaataaagttgaatataagtaataactttaaaatcagcaaactaagaaatgaataatatgaaaaagaggccttataaagtaaaaaatttagttgcatacactacacatgagttgatatatatactataatttcaccttttaaaatttaagcagaaagcctttctctttatagaaaaatcgtaagaaaacacactttaaaaatccaaaaaaagtggtaattatagtaacgcaaatcaagatttatttaatcacatattcaaccaacatttatcccataacttactattttctattacagtctctgctttaagcatgttgataaaaacagatgaaagatgcttgaaatgatttaaatggaaggcaatcaaagacaaagctgagaaggtcttagaacaggggtgtccaatcttttggcttccctgggccacactgaaaacagaagaattgtcttgggccacacataaaatacactaacaccaatgatagctgatgagctaaaaaatatatgttgcaaacaaatcttataatgtttcaagaaagtttatgaatttttgttgggccacattcaaagccacgctgggctgcatgctgcctgcaggccacaggttggacaagcttgtcttagaagatatcaaaaattacaagaggttgatggtaagtttttattttacccctgggaagaggtaaacagccaaaaataagtaattactgataatagctgagcatgatgaagtcattggtgtgtttatttacttctaaaatttactttaaattaagcacataagcaaacatcaagtataaatgagtaagaaacaccaatcacagagctagaaagtacatcttgggttaactaaaaatcttcataatacttcaacagcaattctggaaagcagtcgttttttattgctactcaaatgtttcagtaactagaatcactgtattataaatcagcctactctataaattttaaaattaattgttaaaagatttaaatttttaattattaagctacaatatgcctcctaatgatttcctgtaatttgttcatgttctttttggactatacatgcaaaatgtttgccacttgtacatgacaacccttaaatatttgttctcttaagaaaatccttcttacagaagggaaaaataaagaagcacttaataaatgtttaatctcaattttctacattaaaatcagttttcccaagtgctaattatgtccctagaattgtaaagctttttgcagtgaaatgtataacgtggagattcataggactctcaaacaacaaaggaatgacaaatatcagcacctgcactgtgcatatgtataccacattttctgccagatacttggaaagggacgatttacaaagaaaaagggtctttatacaaaattgaactcataattaagcttgttaggagaacagaatatacatgagaaacaatgaaagcagccttttctacagaagccacaccatatatgataattgttatccccagttcaaaaggtatttagagaagaactgaatccagactaatggaaacaatcacaaaccttgtcattgccatttatttgaagaagttaaggggcctgaatttcagacaggaggagcaatgctactctaggtggaaggtatgtaaaacaatgctttctcgactgacagcagggacatcagccagactgacagaggattgacacaagaaagaaagttggattctaagacaggtagaatacctagatcatcatccaggaataatcatgagcatcagagcaaaatgtgtgtgtgtgtgtgtgtgtgtgtgtgtgtgtgtgtgtgtgtggattaaagttcaaagaaacaaaatccatcatatcactatatggtttttcactaaaatgtgtaacatccttatctttacttttttattaaacacacccaggttatctacggccctggaatgtagatttgttaaagtttgctttttattttctacactacattcactgtgcttacagactttgtcttttagcaccaaaaaacaaagttactttttaaatactttgttctccataattttctcctctccagatagcattttatttttaaaaaattaggcctctgcatttctgtaatctcttctctttcatccttaatctgagcaggtcttaactgatcgccacttctgataatattcatacattctttttgaggaaagttctcacatcatagaatctcttgtgaaactataataattctatagttgatatcgtgtaagaatttggccttatcttaacattcttaatttccatgtcagcttgtctaatacttagaacttaatagacaaaccaccagttggggaataaatgagtaaacataaagtcttctttgccaacatagaaaaaagtaggggtataatatctgagaacacattgtttgcattttgttattaaaaaaaaaaacaaagggacaaataaataagcatgaacattttcactactaccaacttatattaattaccatggaatttcatatgtatttattaatacagtcaaccattccttctaaagaaatgcaatagacacaggaaaaaaaaacccatagcattgtatcagctagtttgttttgaacatccagcatatgcatgtaaaaagagtggaaaccttcttggattaggcaggtagtcaaacgaataggctatgttataaaagcccaagttcatttatctttattatttatggcaatttgccaaaatttatggtaaatttgtcatcaatatgataaaatggaagagtgtagcttctacttatatttttatcatcctcttttaatatgttttgtatatttttatgatgtatacattagtataatagtacatgtatataaaaatacatatgatagcaaatatttaaaaacatatttataaatatatatttaaacatactaacaagtggtttactgatagaaatttgtatgttcaaaagaatttccagatcactactttactatatttggaggacattctttacagaattgattctaaaattgaccttggtaaaagattgcaaatcaccataaaagacttaagtcattgtttgaccattgctttataaaataggataaatgatttgttctccattaagagaagctcagaacaaacttactttgaacccaactgttttaggtgtgttgaaccctttcagcaagctcaaatcataatgtatctaaacctgtacttctgaaaaaaaacggtgatccttgagtatgccaccatttcctcagcagaaattaataatatatagatcatctttgaatccttagaccttaattttaattgtgatgtaattacatttaaatttattgtgatataattaagccttaagctttggccattcactacctcatagctttgcattatagatgcactgaagcctaaactgggtgatatccaataacatgaacaataaaaatgcaaacattgcttgaattatgttttgtctagaaataaacagatttcaccacaaggtttccttaaaaacatgtcatatatttatattttatctgtagaaaatggcactcacctgcatccactgcaacaactgaaatattgtattggttgttttttacaaatttggattctctatctagtacttttagagttctcaagtcgccagtgtgttgattaatttcaaaccagttatcttcatcccctaacttctgatacctaatttttagaaatcaaatatgaacggtcaaatcaaagaagggacatgatcttaaaatctgtcattttgaaaaatacataaaacattcataactttaaaaacaatttacatcacaattaaaattaaggagctttttgaaaagtacatcaccttaagccttcaccactggatatttccgggtccagtgctttgtatccaaggagttcttggccagctgggaagccatcttgactctgaataactttcactggagggtggcattcagggccctcatcactgtctataattttaacggtgacagttgtagtgcacattgtaggagtttgtgagctcgctgctttagagaattgtgcctcgttaatgacaccaacttgcaaaataacttggcgattgacttcatagttcaatggctgttaaataagcatactttaataagtcaatatataacattatatataagacttctaatttcaaattttcctacaaaggaatatcatttttacatttaaaatgtaacctaaagttaggtctaatacagttaaagaccaacaattagcttcctaaagtgacaaacattgccaaatgcaaaattgttgattctcagattcaacccatttttcttctcatttttcttttggaagatcttgccttcggcctttttcattataagtttaaatattaatagaaatgcaagataagtgtatgaaaaaattcaaattactttactgcttattatatgggataacagtgacaactaaattgcctccaaactaagtatatacaataattagatagaaatttggctataatacagcagttactctatgcctgactcaaaagatagaatgatatttaacagcaccttttcaaagcacattatatttcaggctgtttagttcctgatgaaagcgcttggtccttgatatggttggctatgtcccacccacatctcaacttgatttgtatctcccagaattcccacctgttgtgggagggacccagggcaaggtaattgaatcttgggggccagtctttcctgtgctattctcgtgatagtgaataagtctcgcaggagctgatagctttatcaggggtttctgcttttgcttctgcctcattcttctcttgctgccaccatgtgagaagtgccttttgcctccctccatgattctgaggcctccctagccatgtgaaactgtaagtccaattaaacctctttttgttcccagtttcggatatgtctttatcagccatgtgaaaacaaactaatacagtcctaaaatgaatagttagaaagaatcctaaaacaacatttaaatggtgaaaaaaatatcaagggggaaaaaacctaagaacaagaaaagaaaaagaaataaagaaagaaaaagtagacagtacaataattaaagaatattttctaaaaatcttatcaggagaacacaatgtctgcctgaaccttctgaggacttaaactgtctctaagaaattaatgaatgaagctatgcaagaagtcaatgagagctatggatagatggactaaaaaagaattaggtccagttaaagtaatcatcctagaaaccagtaattgcaattaaatttaaaaaatccaaagcaatggctacctggaatatagggggattaatgggaaaagttgctgaatatttagttcaatagtctcttttacagaatacatcatagagaggtaaaaataaaatgtactatgaacatgaaaggagttgaaaagttgaggcttgatttcaaatagtgattcttccattttcttcttttgtgttcttataaaaaagaaatgtggacaagtaagtgtctaagaccccttctaaagcaaatatctggttcagtattcaatatttctctgtcttggttttcttcatatagagaacaatgagttttgtacctgacatgactttcttctaagagagaaaattagggtaagagaataagaaacaacaaagtttatataaaccaatataaatcatttggccttgcactgcagtagtctagtcatatacatataagaattatctcttaaaatcagtgcgtgagttaggatattttaaagcatagcctgattattttatttgtttaccttgacaacacacagcactccttcatttgtatttggatctgtgctaattatgaagtttccattttcatttccttgtaggattttgtatacagcctttgagtgaggagtgtttggcaaatcctgatcctgtaccttcattcgtaaaatctccacgtcaattctgttttcttctacttctgtaacatactgaaagaattgccccttattattatcaatttacaactttgacaatgtagctttatattctaaaacacgtatttaaagaaaaaaataaataaagtgatgtgaaaagctgccctcactatatggggaaacattttacaaatttaatgcgtagcttagttctttcctcctgaattgccttttcatatcttttccattcttcaaaggctaccccaagtcttatcttctgaacttctctgagataattttcctaatcattctagacctcagatttatctcttctctgcacctctacaatatttacagtctatcctctcccatttttacacagtaaacacttaataaatgtcttatgttaatatattaaacactcagtacttgtaggtaattataaacgtatgttggcttcttatttctggagaattgttttcacaccagtgtttccaaatgtacttttgattcacttgcaaacctttagcagaaaagttttcctttttttttgagacattaaacaatagccctccacaaaaatattattacaaaagcataagatattaaagactaaaagaagtagtaaattgaatctgttagagatagaaggtgaattcatataggaggatgatagacactggagcgtaatagacctagatttgaatcctggttattccttgtatatggtttattagtatgagatcttgacttaacagactttctatttcctcatatgaaatatgaggtaaaatatatcctcatatattgtagggattcatgtaagaaattacatgaacatgtctatcactgtacttgcaggtttttccttctttgacttgtgctctggaataagttaatgaaaaaatgaaaggttatttatcaaaagttcaggaaaggagaaccatttcctgaaactattgtcataaaaatataaatatatatatgtgtacacaaacacacacatcacacatatatatatttatatatatctcttattgtttaccgcctaaggaaaagtttactcatggtacaggaagagcttgtttggagttgtgagccagcctgtactactgtctccgtaggctagttccttacttatcttaagaagttgaaatgtaaaggacaccagagagagagcctctcctccttcaccctacataaagatttaatgccaaggaatctggtagcagagcttaacaccaaaaaaataaaataaaataaaataaaagtttaacacatgagctacgtctagggctaagaagctcttcggtagccaagagcatggttatttccctagcatccagaaataactagtacttcaattatttgtacagaaatcatatttttctccctatgttatttgtaagtagtagttatttaaatcaaactgtcaaactttgtgatctcacagagctaccaaattctagacatgttttttgaaaaagtagataaatctagatgaatgaatagagaggtatactcacagaagtttctgtgaaagatggtggattgtcattttcatcctcaagtgaaatagtaattgttcctgtattaaataaaccgaaaggctgaccacccatgtctcgcacttccattattaactggtaagtatcacatttctgaaaaaaaggaaaaaactacattaatgaacacttttatttcctataacttgcaattctcacaaccacttgtttaggcacgattattgtacaaatattcttttttactttttcttttatatatttatttatttatttgagatggggtctcactgtcacccaggctggagtgcagtggcatgatcttggctcacagcaacctctgcctcccaggttcaagcaattctcctacctcagcttccagagtagctgggagtgcaggcgcccaccaccacacccagctaatctttgtatttttagtagagacagggttttactgtgttgcccaggctggtcacgaactcctgagcttaggcaatctgcctgcctcggcctcccaaagtgctgggattacaggtgtgagccactgtgcctggcccaaatattccttttacgtataattttgttaaaaaaaaataaagtacagaacaagatattggctgattggtacaatggaaaggtgatgtgtctaatgtaacattttaaaatttaaagctgctttatttataattgccaaaacttgaaaacaaccaagatgtccttcagtaggtaaataaactggtacatccagacaatgaaatattattcagtgctaaaaagaaaagagctatcaagacttaaaaagacatgaaagaaatttaaaagcatattactaaatgaaagaagccaatcttaaaagcctacatactatatgatttcaactatatgacattctaaaaaagggcaaaatatagagacagtaaaaatatcagtggttgccaggaattaagagagaagaaggcatcaataggagaagcactacagaagcaaaataatcctcaataggaggatttttagggcagtgaaaccactctggatgatactataatgatgaatgtgtgtctttacacattcgttcaaactcatagaatatatagcaccaagagtgaaccacaatgtgagaactatggactttaggtaataatgatgtgtaataatgatgtgtcaacataaatgtatcagttgtatcaaatataacaccgtggggcaggatgttgatagcagggaaggctatgtgtgttgggagggatagggagtatatgggaaccgtctgtattttctttttctttctttttttttttttttttgagacggagtctcgctctgtcacccaggctggggtgcagtggcgcgatctcggctcactgcaagctccgcctcccgggttcacgccattctcctgcctcagcctcctgagtagctgggactacaggcgcccgccaccaagcccggctaatttctttggatttttttggtagagacggcgtttcatggtgttagccaggatggtctccatctcctaacctcatgatccgcccgcctcaggctcccaaagtgctgggattacaggcgtgagccaccgcgcctggcccccgtctgtactttctactaaattgtgctgtgaacccaaagttgctacaacaaactttatgaatttaaaaagttaagcatattggagccagataaaagtattttttaaaacaaaaataaaataaatgtaaagcaattttatcatcaacaaatcaaatcaggttagtgatttcaagtgaggccctgtctaatatatggtactttcccaacatctctaaggaccgaggacatctccagagaagccctaaccgcagcctacagaagcatgctgagaaaggaggccagactggccatattgcaacttctctcgggagttcattctcagtttaaatgtagttcaatgactagatagttaattaatcatcattacttctctatccagaaaaggtgtagttgtggtgatgacaccggtatctgggtgtatggagaaatgctttggatgatctgggatttgttgtaagattttatatttcagacgagtatggagagtgtcaggttcgtcaaggtctgtggcggtcacttttcccactgaagttcctgtttagataaatccaaaagtgtcaaaaatttctactcatataattgaattataaacaaaataaaatcaaggcattgctgtagcaaattctcccccaaaccacaagtagattagttctactgttaagttgacgaatgtgaaactgttctaaatgtctccaagcctcccttactcgggaacttcagttaggtggcccctgtgaataacatgattcatattctacatagatgagaacagttcccacactacccttagaaacagtagttctgaaattctttctctctaagttcacgggctatttttaaatttaacttaatttaattttagatttgggggtacacatgcgggtttgttacaggggtatattgtgcgataccgaggtttgggcttctaatgatcccaccacccccgtagtgaatgtggtaccgaatacgtagttttcagccccttccctcctccttccctcccaccttttggaatccccattgtttgttgttcccatttttgtgtctatgtgtacccaatgttcagctctcacttataagtgataacatgtggtatttagctttctgtttgtgtgttaatttgcttaggataatgacctccagttgcatctatgttgctgcaaaagacatgattttattcttttttatggctgcatagtattctatggcatttgtgtactacattttctttatccaatccaccattgaagggcacgtggattcatttcatgtctttgctattgtgaatggtgtggcaacaaacatacaagtgcaagtgtcttttggtagaatgatttgttttcccttgggtatatacctagtaatggcattgctggctcaaatagtagctctgtttttagttctttgagtaatctccaaactgctttccacaggggctgaactaatttacattctcaccaatggcatataagtgttcatggaccatttttgaatgggaccttctctgcataccttgcctcttttataacccaacttgataaagttaatcagaggaataccacatcttttcatgtaataacaaatattttatgctttgtactttaataaatgtgataaattattaatgtatacaaataactattaatatatgcaagacaaaatcatagggagtagtctatgtatcatttagacaagcttcatagtccagacatgagagtattagacacattgcattagtattgtgaaacagcaatattattcacacatatgtacatggaaacagaatggaggaggccacaggaaataacaactgttcttgcaacattttaaaacaaagtagtcagtcttgttataccccttagtagtcttgggtcacagacttggctgcacatagcatcaaatcagtttaattttttttttcattttgtttggaagatatgccaaaaaaggcaatgtatatgttttatttatcagatcgatatttccatgccatgatatatttctggttccttgaaaatgtattgaaactttataaagattcaaattacgtactgtttcataaacgcacctgtgacacatatgtacatggtaaaaatataaaatatctttatatttaatatgaatggcatttgtctgttgcacattcagatctgttgtgtactaatctaaccagttagtaactttatgtatcaattagctgccttctatatgtgggtagcaagatgagcacagaaaggttttcctttgagaagtatataacctcataaaactagaacgttttatgtagtatatccttgaaagtcaagcatttaaaaatgttctacataattgtgtttaaaatattaataaggaattcaatggaagcaaaaatctagtgttttcctaaaattgccatcatcctaaacgctggttacaaagctaggctaaaatgaaagctaatacccaacagtcatttaataaagagaattcaggaaaacaacactgatattataagattttaatataaactggtactacacatacatagcctacaaaagtcaaatcctttgaatttcaaatgtctgttaaaaaaaaattccttggcaccataaaatagacattcctgtatgtttgattacatcactttttttggagtatttttcttgctttgaaggaaaagttgaatttttcctacatttaggcttctatatatccttaaatgacactttttaaaaaaccactgaatgaatgaatgaatgaatgaaaaaataacctcttactttgttggaagaaaaaatgatccctggcccacgtgtaaatcccctgtaatattctctatggatttctgggtatagtcccttttatactgaacaacaacttttcctaatggcaaaattgagcaatatttccttcactccagactttctaagcatgcattggtaaaccaaacaccaacttcagcaacaaccccaccctggagagaatttagtcaaataaatgctgccagaattataaaatcatgatataaaagggaaaaatgtataatattttatcatatgaatatgcttaaatttaagaaagtgtgctcagagtcaattaccacccttaatagcaatgtcatataacatcaattcctaatgggaaaaaaagtgtatgtaatcagaaataccagaaaatgcataaaatgcaatgataaaacgtaaacatctttaattataatacttacgaaatgtcaaatagtcttcttgtcatgctacaataaaatgtgaacttaccggatcggcaattttcaggcacagtaaagatagtcactctgtgttcaaaatatggggcgttatcattatcatcttcaattttgatgatcaaagggagtggatattctggtgcatagccatctgcagttgttgcatagccatataactgaaagaagggaaaataccatcaatgtattctcaaaccacaaattatgcacaaaagtaagcctagcagtgggggaaaatgtaacattaaaaaaaaaaatcattcccaaagacccgtaactaagaaatgatgcaatagagagataacccacagatgcagtctctgcctgccatgtgatttcaatcccctctcagcgttattgctcattattctcccactctaagcaccatgcactccagttgttctctgaattaactgtatgctgttttacttgttagaatgcatgtagattttccccaactatgtcattaacacgtgtttttaaagtttataaaaatacaattctatttatgtacagatgtatatatacatacaaataaatggacatcacaactatttcaggaactcaattatatgttttttacctatattttctcatttttctatggtaagcatgtatttctttgcaataaaaatgttaataaaagcatatacataccagaaattccatttcaaaatgaatgccttgtccccaacagccagtatgtatttaatgtcctttgcctttaaactccaaattattcctacaccttccttatgtggtttgtgcatagtaagtgttcagcaaatagttgttgaatggattttcatccctcatgggaacaactaaacctacccaaagtgaattctgcattaactcagctttttaccacaactagctcttctaattttccctactgtaaccacttctaagtgaactaggattaaaattccaggcatcaaactcctccctctctctcataagccttagtagtcagttgccaagttctagagattttggcatttttgtgtgtgtcatgcatgttctcttttctattcccactgccatcattttcaggtgactccaaatgcattctacatgttgactcactaactttgctgcagttgttctgacattccctgttctaatcgatgtggcctcagaagtcagattttattgtgctttacaattttaaccacgatactcactaatcagactcgtcagtgatttacccactaactgctaaattaaccacaaaatcctcattattgtgttaaaaggcaacatttcatgttcactgttcgtgctaacctggaaaggaaagaatgtacactccaaactctggaatggaatgtattaaaataaccattcatgttctctctgccttcctactcatttttctccaagtaacttccaggtggtatttttcagtaacaaaacttacattatggcttccatcagtctgatctctatatcttatttatcaataaattctaaattcaggagtggaatacagtagtctatcattaccacttcaccataccaccaccaccatcatcatcaccacttaccatcatcatcaccaccaccaccaccaccatcatcaccaccaccatcagcagcagctccatcatcatcatgacactgccatcaccaccatctccaccattatcaccattatcatcgcaatcaccaccaccaccatcaccaccactaccatcaccaccatcatcatcaccaccaccaccaccatcaccaccactaccaccatcatcaccaccactaccaccaccaccatcatcatcaccactaccatcaccaccaccaccactaccatcatcaccaccactactaccatcatcaccaccaccactaccatcaccaccaccaccaccatcatcaccaccaccatcatcaccaccatcaccaccattatcaccaccaccacatcatcactgctaccactattaccatcaccaccactaccaccaccaccatcatcatcaccagcatcatcatcagcaccatcatcaccacactaccatcatcaccattatcattatcatcaccgctaccactaccaccaccaacaccaccaccaccgtcatcatcatcgccaccgtcaccaccaccactatcatcagcaccactaccactgtcacatcatcattatcatcatcactaccagcacatccaggtatcaacatcagtcacccttcctaaaaatccttccctttctcttcgtatagatgatgtggatttttattccttaaaatgctgtcattttgatattttagctggataaaactataaaatggttttatatctctattagattacagttgctgtcaggcttgaagactgagacttactgatacgtgtatcctagaagtacctgacacagtaacacactgccttaccttgggtaagtcttcaataaatagctctttgcattcaattctactcatctttccttttaggaagacaaactacgccttcagttatccttctgtaaaaattgtcataaagattctattgcatctcttgtaatgaatttttctacctcattaaaatggtattaacaagtctccttatccaacctactaagtccacactgctataatttagactaatttgtcttagtttttctcttcaatggaaatgaagatcatctgcttcccaccatatgctcatttgtaatttgaaataatatttttgttatttgactacaagtaaatattatttcacattccgctgactcagagttggtgattttacttcaggtagtatcctggttttgttttattgtgctaataatgaaccaagtatctccaaaataaatcaaaattggaatcatcattaaaacagagcctaactctctaggagaattgacttatgttcatatgatagagtaactcattataaatatgttatttagtcaacaaagcaacaatttcaaaaaactcaatagaggtaatggttttattactatatccatcattctgtattaaaagcaataataatatacttaagtgttgttacaataaaaaataatttagaatattattagttgtatttttagctaggttataagtgggttatttagtgtcatgtgcgtgttattgtgatatagtttcctctgaattattctatagcttaaagaatctcatctcttttagccctttcacactatatattgctgaaattgctgtcatctttggaaaaatgcaaacagctactgacagaaatagggacttgagtttggccttacagtggcaggcattcagtagatggggcagagaaaggagagagcagtaacaccaaagctgagtgggtacagaatgtgaattaacagcacatatatgaagagaattaatcgacttgtgtgcccagaagagaaaataaacattacaagaggccgggcacagtggctcacacctgtaatcccagtactttgggaggccgaggtgggtgaatcacctgaggccaagagtttgagaccagcctggcgaacatggtggaaccctgtctctacgaaaaatacaaagattagctgggcgtggtggtgggcgcctgtaatcccagctactcgggaggttgaggcaggagaattgcttgaactcagaaggcagaggttgcagtgagccgagatcggattactgcactccagcctgggagacagagtgacaccctatatcaaaaaaacaacaaaaaaaaacaagataataaaagatagtaaggttctggttgaataggaataggtaagaaaggagcagattgaagctaacttttccaaaggtacagattatccccaacactcagagagaaaggaagtttgcagctgctttcacagcatcacttggaattgttgaagaaagttcccttcttatataactattctttgaatatgtattgaattagacctatggctactactcccaaagctacgaaatcaaattatttcaaataaaaataatctattattaatacttaacatgaatatggcttatataaaatcaaagaattaggaaattccatgaaaattcccaggtttaaggacaaaattctagaacacgtgtattgttaaatctaccattagaatatcttcaacaacttttacagtttacatagtggtatcactggtattacggcatttaatgatcagaacactactgaggttgggaacacagctactagcagcccataaacaaagaagaaagcgaactctaggaggttgtgatttgtttgaggctacaaggaaaggaacagatacttaggatctaccaattcccagaaacatacattattcaatattttaaactattattaaagtatattacgttaaaaacatattatcttattttaacctctgcattgacagggaagtcttctattctatcctgcttcaagtgattttataattgcatcaggtttacatcttgttgctatacctcacttaatgaattttactaatttgcaagtggtgtttcttaatgccaattcaaacttaactgtgttaatgggacctacagaaacatgggtaattctgaggcgaaattatttaaaagtttaactttgaggataaatttcaacctattttattcatttacatttttttaaatgttaaaaatagcaaagtaacttatttttaattataaactgttctctccttttccctctggcaatgatcacagtaagaagcaaagatagaaagcaggttggcaaacagaaccctatcaaacaattcctcagcaaaattgaaaatgaagtgaatattgcaacatacagagtatgagctttttatatctcctcaagagtgacttctagtgttagatcttttctctagtaaagaaactgtaaaagcagcagagaacttactatcaattatttatttgtttatgagtagaaagatcaaagtgattgcaatggtgcttagcttacttctcctgtaagaacttggatacactattttttaaagtaaaagtgtgttatattactagaagtaaaatatgtttattctagagaatttggaagggaacataaaattataaagaaaatatgccactacaatcccaccatgaattttgtatttaattatgaaacatctaaagtggaaaatttatacagtttcaaatttttcactaccttatagactgctttggaggatatccttacgatagaatctactccttaggataaattataaggtctttccctctctattttttacttactagcttcatatttcacactcttccttagcttcaaattacacttcagccagggtttgttgttgttgttgatttctttttaacaagtaaatatttccatttctgatgcatcttcctggaatacttgtctaccacttcccatccccacaattgttaacttctttcataactgccttgaggtggccactaactactactcattctccagatgtctgctaagatattactctctgaactgcccaagtatgagataagtttcatttttatattctcctttagcaaagaactttattatactcttatatcattcaagacaataaatgcttaatcagttttattcaccaccattccaaaaacctactatgaatatctcatttcatcagatgagacatcagtccaccaaagagttatataaaattaacagaaacaaaaggatttaattatcagaagagttagaattgtcttgtctttgggtaggataagatagaatcaaatgaattgataaacttgttctgggttactaaggaagtaaaatggtactaagggatctcattgctgaagaatagtgagagaaagggatgcaaaaaaaaaaaagctatgtaaggggctaaggcagtggatccaacacttacacatttagaatcacgttggatgactggatctcatcccagaacaattaaatcagaatacttgggcatgggtccaagcatcagtattttttttcaagttctcacatgacttataatgtacagccatggttgagaataactgagtcattttattatggataactttaaattcagtaaaactctttgttatttctccaggattacagaccaaaatatatcctttaaaattccatcgttatattttctttacctcccccgccacttcccttattatatccactgtttttccccatcaatggtgaatagaaatttaaagtttatattgcatattaatatcttgaatattaaatcaaataattgattcttataatatgtaaacaagcatagttgaaaatattagtaagccagtaataaagatataattatgaataaatatttcaataatcctaccgcaaactgttcatatttctcacggtcaatgctccttgtacaaaagatatccccagtgtctttctctatgtaaaacaaattgaagggttctttgtccacgcctggcccacttatggaataaaagatggtgtaattctgtgcagcatcagattggatctgcagtaataatttaggaatagaacaaatacgtcatgatgaatattttcaacctaacctcttgtgatggtttatttttttaccactacccctctttcctactctcctattctttctttcttctgcttaggtgcccattatctgccatgttttccgaatttttatttgcattttgcattgtgcaaagccacaaattctgtcacttatttgatctcaacttttttgtcatttgtatatctataaaacatgtagagtaatacacttttcaagttttatctatttattcttatcttcatataaataatagtaacagtttccgtgattttgaattctttggaattgaaaattatgtgataataaaactagaagtaaagcaacttttcttccacaattaattcctcaagaattagaaaattttggccgggcgcagtggctcacacctgtaatcccagcactttgggaggcctaggcaggtgaatcacctgagatcaggagttcaagaccaaactggtcaacatggcgaaaccttgcctctactaaaaatacaaaaattagctgggcttcgtggtgggtgtccgtaatcccagcaactcgggaggttgaggcaggagaatcgcttgaacccaggaggcagaggttgcggtgagctgagctgatgccactatactccaaaatttcaaaactgttctatgtttgcaatccagctatgtggcagtgaggcaatcttacttggtaagcagaaatacaggtcatttttataaaagatgagtgttagtttaagcaagaattgaactatgcaaaacatgtaggtgtgccttctgtacattagtgttaacaagtctagcatagtatttgggtgaatttagacatagacctaagagcaccagaaactccaaatataaaacttgtttctaaatttctaaatatgatatctgtaagaaagtaataagatatactgggtcacttctatgggaccctagttctggtgaatagatgatcattatttgtaccattagtttaaacctctgattcaatatgctgtgcaattcaaatgaaaagtttaagaacaaaaaaaaatttggacacatataaaatcaaataagtgaaatgcacctgctgaacgtgttgtggaaatggacccaacgagttctccatcaatgaagctggaataggagcccatcgtctcttgctgcgcttgagggctgtgtctttggtatgtctcttcttaggagactacatttgacaagaaacaaagaaatgtagcattgcttatcattttttggaactgtgattattttacacatacatcaacaagcagatgtaagggttacacattacaatatcatggctagtcagcaaagcatttctattgataaaacacacacacacacctcagactacattatgttcccccgttctacctatttctctatttactcagttaaccaccaggaaatgtatagggcatttggaaagatgccactttgagaaagtataaactccccctaaaatagataattcattaataaatatttaaggatcaactttattccactaggactggcacaaccaaaatctgttaaaaccctcactccacaatacaatcatttatacatctatgtagacacaggtcagcatttgctcaagtatacttgattttatataatgtggggattttacaatgtggatataaaataacatttttaaagtcttaagcatattaagaggagttcatacaatcaaaaagaatttagttgggaaatcctctcctaaatagaatcatttattaagaaatggttttataagacgaaattcattgtggtgaatttgctgaaaatgagatgtgaattccagcaactttttcctccctgctttctgaactgatctctaccgctcagtgcaagaaaatgagcctagagttaaacattcaaatcaattctgtggattggccacacctccactctctgaagagagggcctgccctatagaatattctagtaagatgggagtaagctttaaacagtctcttctcctctttaaagagagactcaaacccgcaatcagtgggaagagagccgcacagggtggagcccacatctccagcctgaatcacatttcgctgagttttagacccgcccctgtcttgtccttgctcctcaggttggtttgttcttattcccaaacttgaaatcactattagaaaactctgatattcttactttgctcctggtctacagagtcattcatctttataaaagtttgtaaatggctctgccactccttaaaagtctagtctttatttacactaattgtaagtggaaaagacaaatttgtcattcaatagcatagattttaacatgaaacacgttaaaacacatgaaacacgaaggactcccgtaagcatattactgtgctaggctgcttaagcccttgccttataccttgttttctcttgctgacagtacaacttttatctcttgttgttcccgtctctgaccatctgaaaggaaaatggaaaaacttttcctttcagaagacaaaatgaggtcatgtgttgtgtaaattgagccatcttctagaattctgaaggcagggtcactggaccggattaggctggccgacttgagacactcctccagattcactgcagggaagaaatatcacagcagtttgtcagatgaaacaggagtggaacaagttttacaggaatgacagccgtgagttaatgcatgagaagcagaaaaagggaggttacatttggaatgtgctcagcacctgctattctaaaacgtgggggccatgaaaattaaataattatattaatggagtcacattttccactaccttcgtcatacattaatttgagaaataaaatattttcctagtgtcactgattttattctcttttctttgaactcttaattattgtgtgtgtataaatttatatatgtgtatacaaacttgattttttatgtcataagtggtataaccgtatgatgtcagtaggttttgaactttttgcagtagtttgatacttaaaactatcttgccaaaaataagaaaactaagtggctcacacctgtaatcccagcagtttgggaggccgaggtgggaggatcacaaggtcgggagttctagatcagcctggccaatatggtgaaactccatctctactaaaaatacaaaaattagccaagcatggtggcgtgcacctgtaattccagcgactcaggaggcttagtcaggagaattgcttgaacctgggaggtgaaggttgcagtgagcagagatagcaccactgcacttcagcctgggcaacagagcaagactttgtctctaaataaataaataagaagaaaaccagtctattcttaagtaatatttcccagtaatattgcaaataatctttctgtaatatctttcaaggtttagtaaacccgatgcgctgtggttattatcaaattacctcctttacagattcatatttaacacatttagtgtatttactatgtgtctttagagtgtggactgtttattaatttcaaaccttaaagcactgggcaaaacaacatctggcttggaaaggataccatttctgtattgtttgtaattttttacatgtgaatgcaaagccagtgaaaaaccttgatgaaaaaaattttacgtttgggctcagaacaaccaacttatacttcagagatggctatggtactaagacccaccaaaactgtatttgattttcacaagctgttctgtgaaatatgtcacatttattcttggtggatacttgttcattgtaatcaacctcaagtacaaattttattgggggcatttagattttgagacatccatttcatgtctaatcaattgaagaatcttggctttgaaattttggcagcagattagtttatacaaattagaatatgctcctggttttggtgccttgctttgtttgacgtaatccaagataattgagccttctgatgtttgctaatttttttggcaagagaagtatacaactaactttggtattttaattatttctaaccactaccaaaaaacaagtagcctgtcttttattgtacatccgattttaacttcaagtagctactatgtggtttttttttttttttttgagacagagtcttgctctgtcgcccaggccggactgcggactgcagtggcgcaatctcggctcactgcaagctccgcctcttgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctactatgtggtttttatcccaaactttacaagagcagcctgcagctaaatgtgacaagttacagctatgaaactgttaatagtgtttctcacctttgcctacaagtgtttcagcctgaagatgagaaggaactcgaagataaactttctgacaagcatcgcaaagtaatgttaaaacctcaaaaaaaaaaaaagaaaaaatatcaggaattaaatttgatcacaaattttcacattgtagctttttcttattgataaaaatattgtcaattttggaaacaaattaatcatttaattctttacatttttaatactcactttaaaaggaaccagcaaagagaatagctttaggaatagcactgtcatttatttgtcaatgaaaaaaattaagtgaatagtagttcttagaacctaaatcatattgtgtcaatgcaagaaaatatttcacaaaccattgactttatatagaagttatacgtctctaagaccattcataaatgccattctgatttttagcatgaagaaaatacttacctttgaaatgcataattacatatatgccctaattctctaatcatcattttactatttgaagttatagttgatgaagtctagaaaatagttaagggcttttttaacctcacagaaaaataatgcccccaaaaaatcattgttctcaaatcaattttgtgactgacttggccaaaacgccaaaatctaaatgatctcaaatcacatgactaatctaaaaagaaatatatgtcaaaatatggagagtatccttcagatgggtgaagatttttaattaaattcaaggcccagctattgtttttaaaacctaggtagttcaaagacatagacactatctgaaaaaaacaaaagaaaagctatcatttcaaaaatgtctataggttcaaaatatattttacttctttttcttggcattttctgtttgttcctctttatcaaaataactgcttttttattatttaaatataagatagagtagagctaggttttccagaaacatgtaggtcaattttatgatcagctttcagcttttctctgaattctagagttacgggacccattacttgcgaggaggaaagagaatggattaacatccatattaaggatgtgcacttcttttccagctcatctcaagtctaccagatatactgtagcagtctaattaaatagtttgtaattttacaaaaatctatgttaggcagaaatctggaattaaaaggccacatttttatttagtcctaatttaaaaaccactttttaaaacgtgagacattcgtatttatttaactttttaaatatgttcatccctaatgccaaggaacataataaattatacttaaagaactttctaagcatagaccatactgttaatagttgtctaagtatacaatgtggaaacagcatattgtaattaggctatgcataaacacatacatatacatatgtacacatacatatgcatatacctgtacatatacctatacctatatatgtatgtgtatgtgtgtatatatatacacacagtcatatattgcttacattctaagaaatgcaacgttaggtgatttcatccttgtgcagacatcatagagtatacttacatacacttagaggatatagtctactacacacctgggttatacctacatggtatacaccatgatttatatatgtatgccccatggtatgcaccatggtacagcctaggtgtatagtatatagtatagcttattgtaagctacaaacctgtacagcatgttcctctactgaatactgtaggcaattgtaagtatttgtgtaactaaacatttttagatatagaaaaagtacattaaaatacaatataaaagataaaaaatggttcacctatacagacgagctccattataatctatgggaccactcatatatgtagtccatcattgactgaggcattgttttgcagagcatgactgtatatgtgcgtgtgtgtatatatatataaatgtacatatatatatataaatatatgagacattcttatagttatatccacacttccactcccacccccatcttctttccttcttgtcctaggattccatgttgatggtcctccctctgcaggcagagccactgaaggtttccattcattaaatactattcccgtcttcaggttaaatcactgactaagtggcttagtgacacccttttagtcagtttcagagtcagaaataaataaacaggagatgaattgtccaagagatattagacagtacagggatcagaagcaaaagaaatgtgggtagaatcctttgaaacatttttaccacattttaccaaacttgtactaacttaagatggtatctgagttatcgtctccctaagcagttacaggatgagaaggtgaccatcaaccctgcattgtatattatttacatggagaaaatgtttgtcctcatacctgccatttctaaaaatatattttgaaactcaagtattttgctaaaatgaaaaaataggaaactcacacctcagaaatgatggacggatgtgtgaaataacccccctctcttccctcacctccaaagaaaaaatagcaccttacacagttacaaagctattaaaaacccaagtggaagccaagttgaggatattttcaatgacagtcacatttttgttatttttcttaaactattctttgcttaaactgcttcgtgggtaaaattcaaaaagtcctggataatttgcatgttcacccagaatcctttctctttttttgcagcttagtagaactcagcatgttaaataacatgagtttatgtaatcactggtagcagaagtaaacctcagaaacttctgggccaaatgcctaaagaatgaattcacttctctactcttagaaaatcaccacagcaggatggaagagggattcccttgaaaacttttaacactctggcagtgggtgcttgagaagtaagctgaacactttccatcctgaatcccaagcctctcaactcttccctgaatcttcctcagatctgcttttgttttccccaatctctcttctctgcctcccatcctcactcctagtctctttcaagcccaaactgcagagaggaagcaggtagtaacatgcttgaattccctaatcctttggttgttactcaccaggagagagaaaaggagctgcttacagaagatgctccctggggcagcagaggccagagccatcagaagcagtcccaatggccagggacggtggccagataacagggcagcctgggatgcacagagcggctaagaagacgctggcacttgcacagggtattctgctgccaccttgatgcagctgagcttggtttggaagacagtccggaggcaagtgataaacagtaggaggagcaacgggagaatttctttccccctattccctggccagtctccttccttccagttcaattacgtctaaatgcaaagaggctttcctacaagt

SEQ ID NO: 1691 - DNA, 33606 bp, Homo sapiens; identical to SEQ ID NO: 1690

SEQ ID NO: 1692 - DNA, 3824 bp, Homo sapiens
gcgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcaggtaagcagtggcctacgccgagggggaaccctttcgccaccatcctggcgtcctgtccttcaccgcaggagtgctcctggatcttagaatgagagccgggtttccctttcattcctcgcatccccagagtcatgtgttagagggatgccaaggaaccccacacagcccaccccctgccctcatccctagcggagcgcagaggaccgagcttttgttttggatggagagctctggagctgcgtgggtgggtggagggggagggcttgttttgatgagcggggctgcgccccccacctccagtaagacttgccttgccttgcttgccgcctgtccccaaggaaggaccgtgatccttggccgtggatgtcccggcagcccgggtttgggggcgcgcactagccgcggccatgggggtgctggcgggaatccctcgcccgcacagccgccgctgcggagcgctgcgagctgcagtggagggggattctccgtatttgcgtcagctgttgttgaaatgggctctgccactggtgcgggtccaggaacattgcaatgtgctgctatcaattattaactacctcgggagtcaatggtagccggcccggtctcttgcctggcagctcgggtcgtcctcgtcctccagtgattgctttccagtaaccaggcctcccgcttctctctctcctgccagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagtagctgcgattggg

SEQ ID NO: 1693 - DNA, 3956 bp, Homo sapiens
gcacggaggggcagagaccccggagccccagccccaccatgaccctcggccgccgactcgcgtgtcttttcctcgcctgtgtcctgccggccttgctgctggggggtgagtttttgagtccaacctcccgctgctccctctgtcccgggttctgttcccacctctccatagagggccccaccagtgtgggtccctcatcctcacaggggaggtgccagctgggacaaggagaccagaagagactgaggttctgagcggtgaagccaccaccaggagcccagagttggggtttgaaaaccggggagggggggggggtcgcaggtcgccctctgggttcaagtccaggtctgtctgtgccttggaggggcaccgtggggaggtccctttgcctctccgtgcctcagtttcctcatctgaacaacaggggtgcgaacggccccgatcccgtgggttcccggtgggggatcccgtgggttcccggtgggggatcccgtgggttcctggtgggggatccagaggccccgtggccgggaggggacaggctccttggcaggcactcagcacccgcacccggtgtgtccccaggcaccgcgctggcctcggagattgtggggggccggcgagcgcggccccacgcgtggcccttcatggtgtccctgcagctgcgcggaggccacttctgcggcgccaccctgattgcgcccaacttcgtcatgtcggccgcgcactgcgtggcgaatgtgtgagtagccgggagtgtgcgcgcccggctcggaccccgcgtcccggtctgtgaggtgggtggggggaggccggggccggggctgctggcgggggggggtccgtccagggcccgcggggcccctcgagcaccttcgccctcaggcccgtcgccggatggggacgacaaggcgcggctgagccccgacccccggggccgcccctgagccccgcctctccctccccggcagaaacgtccgcgcggtgcgggtggtcctgggagcccataacctctcgcggcgggagcccacccggcaggtgttcgccgtgcagcgcatcttcgaaaacggctacgaccccgtaaacttgctcaacgacatcgtgattctccaggtgccgccgggcggggcggggggcgcaggggcggaggccagaggcctggggagggtggaggctgcgacggaggggcgcgtcggggccgctcgtggggacctggggtggcatcgtgggctgggtggtcccctctccgcgcctcggtctgcacctctgtgaaacgggaaaatacccgccatgggccgttgaggggttaaatgagatcctgcagggaggccccgatctgctgtcaatcaacaaacttactgagaagggaggccccgatctgttgtcaatcaacaaacttactgagaagggaggccccgatctgttgtcaatcaacaaacttactgagaagggaggccccgatctgctgtcaatcaacaaacttactgagaagggaggccccgatctgttgtcaatcaacaaacttactgagaagggaggccccgatctgctgtcaatcaacaaacttactgagaagggaggccccgatctgttgtcaatcaacaaacttactgagaagggaggccccgatctgctgtcaatcaacaaacttactgagaagggaggccccgatctgttgtcaatcaacaaacttactgagaagggaggccccgatctgctgtcaatcaacaaacttactgagattctttgtgtctctccattcaccagtcctgtggcccagggcaggggccgcctctgtctttgggaaaaggggcaaaagtccccacctttccacccctgtccgcggcttgcagttctggttatttcctgggcgccgggccccgtggctcaggcctgtcatcccagcactttgggaggctgaggcgggtggatcacgaggtcaggtgttcgagaccagcctgagcaacatagtgaaaccccgtctctactaaaatacaaaaaaaaaaaattagccgagtgtggttgtgggtgcctgtaatgccaactactcaggaggctgaggaaggagaatcgcttgaaccccggaggcggagattgcagtgagctgagatcacaccactgcactccagcctgggtctcaaaaaaaaaaaaaaagattcctccctgggaagggttagagggagagtttccttgtcactaagttttctcatagctctcacccagtgcagtggcgcgatcgcagctcactacagcctccatctcctgggctcaagccaccctctcagcttggaatggggggtagctggaaccacaggtgccaccacgtgggtccaccacgtctggctaatatatatatatacacacacacatacatatattataaataataaatatatattttatttaaataaaatatataatatttataattattttataattataataatatttatataattataaatatcatttataattataatatttattattttataaaataataaatataaaatatataaaaatatttttataaaataataaaaatatatatatacacacatatatatatattttttgagacaagtctcgctctgtcgcccaggctggagcgcagtggcacaatctcagctcactgcaacctccgcctcccaggttcaagcgattctcctgcctcagcctcccaggtagctgggactacaggcgcccgccaccacgcctggctaatttttggtattgttagtagagacggggtttaaccatgttagccaggatggtcttgatctcctgaccttttgattggcccacctcagcctcccaaaatgctgggattataggcgtgagccaccgcacctggcaatttttttttattatttttgtagacatggggctttgccacattgcccaggctggtcttgaatgcctggcctcaagtgatcctcctgcctcgccctcccaaagtgctgggcttacaagcatgagccaccgcgcccggctgtagtttttttgttaactgagcacctactgcttcctgcactcaagccacatccagggacaacctccaacgccctgagccttggtgacggctcccactctacagatggggaaaccgaggcttgccttggggagcagagtgtggggtgggtatcctgccctgcaggatcccagaaccacagtggaacctgagatggggaaactgaggcccggagaggggagggtcatcatcactgccccgtgtgacgcgctgacgatctgtccccaccgccacagctcaacgggtcggccaccatcaacgccaacgtgcaggtggcccagctgccggctcagggacgccgcctgggcaacggggtgcagtgcctggccatgggctggggccttctgggcaggaaccgtgggatcgccagcgtcctgcaggagctcaacgtgacggtggtgacgtccctctgccgtcgcagcaacgtctgcactctcgtgaggggccggcaggccggcgtctgtttcgtacgtgccctgggtgtccctctgctccccacccgctcccagcccggactgcagcaacaggcaccgtggctagaccctaggagggacttcccaaccctgacaggcggcgggcaggtgggcagggcctcgcagtccagcttccccaccttgtctgcctccacagggggactccggcagccccttggtctgcaacgggctaatccacggaattgcctccttcgtccggggaggctgcgcctcagggctctaccccgatgcctttgccccggtggcacagtttgtaaactggatcgactctatcatccaacgctccgaggacaacccctgtccccacccccgggacccggacccggccagcaggacccactgagaagggctgcccgggtcacctcagctgcccacacccacactctccagcatctggcacaataaacattctctgttttgtagaa

SEQ ID NO: 1694 - DNA, 119732 bp, Homo sapiens
taaattaaattcgaatctagtttatttgcagaattttacttaaccagttgtcatttcttcctgtttctcaccattatataaaaacttaccctttgtacaagtatgaaaaatgtggaacaatgaataagtagtgaatattgcacatttaatgtccaaaataaagttgtggtttttaaaggtcacactagatatgtgggaagaaaacgagttgaacacacttaagtatgtgtctccacataagtgattttaaactattgaaagaaaaataaattctatcagtgctcaatgagagacagtacatctgtacattaaaaaataaaagttataatcaacaacattccttcgcaatttcattatcccaaaagaggatcagtagtataattatttttttttcaagttattttcatcaggaatcaggaacctaccagagtgaaggaaacctcaaatacagctactcctggacactgatgcccgaggcatgctgtggaaaccggaccaaaatgaagtctgcgttagtaagtctagaactttacccagcacaacccagacacaaatggaagatggtagaaggggatactttcttttaatcaacacacttatttcccaacattatattctccattttgcttaataagacaaagttaactgatcagaaaaatgatcagctactatctcaaaatgagctgtacagttggcccaaaatgaagagcaggcagtagtagaggattaagggcaaagtgccttgttgttaggcctgtcatgaagatgtggggtgagatctgtcttgggcaacaactgatattaagctgaggtctgcagtctcaacttgccactagcttaatgtgcctcccatggggcacagctactgaaagctgatgctgcccaagcatttagggagataattatgccacttggaccacactggtgcgactctaaccccagggctggggccagaatgaggtaaaggaggcaccacgggggtaaacccaaggaagcactctcttggcacctgcaagcaagcaccaacttaaatgtatgccccaggtgcctcatttgtctcaccctagccctggccctgctaatccggggcacaccccttttaggataacacggactaatttggacactttccccaaaccgtagcccagttagacatgatggtggaaaaggtctaactaaagacattgcaggggagatgggcgcggtggctcacgcctgtaatcccagcactctgggaggccggggcgggcggaccacaaggtcaggagtttgaaaccagcttgtctcaatggctgggtgaaaccctgtctctactaaaaaatacaaaaattagccgggcgtggtggcatgcacctgtagtcctggctccttgggaggctgaggcagaatagcttgaacccaggaggcggaggttgcagtgagccgagaccatgccattgcactccagcctgggtgacagatgagactcgtctcaaaaaaaaaaaaaaaaaaaagacattgggggatttagcttggatttagcctaagaggtgaggggtggggtggaagtggtgttagacatgtgatgaaaactgaaaatatctaaaggtctgcctcaaggaggggcaagtgaacagccccagcctgaactgctctggacagaaccacgaccaataggcaacgtagaaacatcttggttcaatagaaagcagaactacagagcctgcggatggcagcctaggcctgcccatcacaggctggaccaccaggcactggacaggggcagaggagaggcaggaggatccctgcagagtgagaggggcactagatgaacgtgaatgacccttctgactgtaaaagtctacgattccaggacatttgcttcctgctccagaagaaagaatttcaggaataaaaactcagtgaaaaagtatatatcaccttcatttgaaaggaacgaggacatgaacactcttggcttgtatgacatgtacacactgattttgatgatgaactgagaggaaccaggaggccgtcacttggttgaaaggaagttaggctggtctatgggttttcattttctggactaggctttccccaacctcaaagaagtgagagacgcaggcacacaaccccagtggggcagaggcatgcgatgtctgagccaacaaaggatggtgagactgagaaatgagtcacgccttggagctgaggtcccgagtgtgcaggaaggagctttggaaacatgtacaggtgggtcccgaatccactgctactgtcatgctatgtagacagttgtgtagacacatctggcaggacctccctccctctatgtctggtgtgttccagcattctgcccttcacttgttctattaataggcagtgggacaacatgattccgggatgcagcctgcctctgcaacccacctgtgcactgcagcatggggagtgatggagagggagagagatgtttttcatggcaaccagaatcctgcctcctcctgctcccaggaagctgttagacatctttatttggtcccgatgccactgttggccaccctgtggtgaagtctggagcctgcagccgttcgccctccacgctgctcagtccacagggccttggtcttgcttgattcccgtcttgatgtgcggcacccatcactgattctgaaaccacagccccgtgctctctggaggccaacaattttttcaagccaaggctcattacccctgcaagccaacaggcgggctggtctctctgccgcccttctttcccaggaggctacagcagcatggccatgtctgaactagctcagtgtctttatagcacgttcctagcccagagtttcccatagacacctaggagttgagtcaaccttccaaggttaagcaagaaagagttaaagaggaagcgctttcactgaccatctctgattattaatgaagttcaatgtcaaataaattaaatgacatcaggcataaaaacctacagcaactttaacagctgaaacactttacaagatagtgtgatatccctataatttggtttttaaacagttacaaccaaagataaatgattttattttttataatttttacagaccaaaaaacattatacagattaatcataattttctttaaaatgtgcatactgtcactcaaaaatttcacatcctaggatatcagtaattatatcctcctcaaagaaaacacaaaatatttccaaacaaaaatcgctgttgccagatcagactattaaattgtccacagcttctcaaattttcttatacagagaacaagatgattaattttgaaaacggagagaagcaaaaataagaaaagctgagacagatccctctgagacggacattttgtggcctgtaaaactcaagagactaaacagggatgttctttatcagagctgcaaagcgtgtctttaaggcagaatcgttctgtccaagtaaagaaattcaaagtaaagaaaagctcctaccaacttcccaattttgggggaagcattccaaaaggacatttgaggagagattagcactctgttaactatattcctatacccctataaacattcttggtggctgtttagacatttttaggtaaatattctcaggctacagactacccatacacaaagacatattaagccagctatgcaggcaaaatccatctagagctgatagaatgaggaacgtgggaacagaagtcaaactgctcattcccaggagaaataacatgagcaagaagatggccacagaacaaggcaaagttacacacaggctttggtaatgaatgaactgtcaacaacagaaggcacgtggctatggaaaaaaagccaaatttcagtagatctcccgacctgacccagtttccacagacaagtgtttcagcaggtccattggcttcatctgagtttgaagttaaaaaacaagcagggaacagagaatcaggtcttcagtctccctcagtctctgtctcctgacactgagcctttcagatatcgaacatggtgtctatcaaagggtgcaaacttaggtgtcgacaggggcaagtgatgtgaatgaggctagggtcagggcccgagggaatgcacagactctcccgactagagagaggcagccctgtctgcactcctcaccaagtggaccaaacaaaacatctgtgcaaaacatgctcctcccagactgccagcttgccatcctgattcagacaggcagcttctccatgaggatacacggctggatggaaattgacttgtcatcatctctactgcccactataatcacgatcaagtggtcgtattttacacatgacccactttaactaactcggcatttttatctcccttctgagaaaaacaatactttaaaactattgtatttgtccacatttgagaaatgcagaaatttttcaaaattgacttctttactttggaggaacacaaatggggtttaaaagtaagggtactgagtgacttccaaggttgtcagatctggaacatttacataaaacagagacagaagtggaaacatacaaagaactccatctggaggtcttgtgagatgactgggacattcggcaactgtgagtggctctgcacccaagtggaacttagtaagtttctcttgtggataaatataaaaacttaaagagtccccagaaggtcttaagagctaagaaaacacacacacacacacacacacaccccaaaattatctaatatctaacgcctcccaacttgcatctcagtcaactacacattggccaaactgagctctacagtgcaattgagcaaagttacttgtgcaacagcaaagttaaatgtaaacataaacagcaatgggtttttcaagagcctcagtgttaactatcgtatgtggtccaaataatgcacttctggatacagacagttaacgagaagagccaagaagcttttcccatcttgaaggcaatggccaggatgccttataaattgggtggcttgcaatatttgatcctggtattcaacatactgcttacttgatgccatggattcaagagcattcagagcctaaaagacacggaagatgagagggttaactccatagaggcacataatgtgactgccagaggtacagcacacccattatcactgtgtacttcaactgtgagccttgtgggaaggaggcctacagaactgaggccaggagtccggaaggcaggcattgattaacttaaccacaaccagaaggaggccagcagcccaagcctctgtggcctttgcagcatcccacacccagccttccctgtttctgttctgtgccatttcccaaccttgccttaccaagagccactgctgtggcaggctgctcttgttgctgggcgcctcacctgccacaccgatttctaaagcctgccttgtcctcgttctccccagtcccacctgtggggtcctccccaccagattgtccactccttccgttctagggcgcaaccggaaatcccaggcaccagcctcatcttgctaaggtgaaatctgttcaatctgctgttgggtatgttcctaggttatgagataatgttatatgaaactgtctaacggaaaggaattctagaggaaccagttgctaagtgctgccaagagtaagtgagaaggttgttaaatcagccaacaagcatgaagtacataggttcctcccgaatccatctgacaaatgacacaaaatcatggcagaaactgtttccatgcctctcttcagaggaaggaaagaaaagcattctttgactccagaattttgattattcctttcttcatagtaggagaagagaaggggaagagactgtatatggagaaaacaaaaaatcaacaatggctcttgatttttggggtgaggagttttgttttccaacttaacaagctcatccaccccaggattctgacggtgttcccctcctcactggggcacatcccccaccatggagtgccccactccctccttgtcccttttacagaaaccactgcactagaaaatatgtattaaaagatggaatgtgcttgattcaaaaaccataagagaggggatttttttgaggatgataaataaaccagaattttagaaattaactaccaggagggctgtagatggaagtctttgggctgaaaataaactgaaggtatctgggtaccaaattaagagctatgtaaacagagttcaatttaagaataggaatcaactgggacaggcattcccatgaatcacagtgtccctctgtctctctccctctcttttccttctttaaatttagtcccccaaacagtctactttgacagtttgcctaacgataatcattttctaaaaagacaactttcttcaaatctgaaaatcctgatgacaagtatgtatgggacatacagggagtcatcactttaagtccaaagaaatgaaggcaaagaggccaggcctgggcagcccagggccccagctaaagcaagaaactgatgctgcaggtactggtggccacaggagacgtagtcttctcaaatacaccctgcatctcactgacttcacaacctgccctcaggatattcatctgcccactgggatgtttcatgtaagacaataggggattcaaacagcagctgtctaggcaatgagtgacaactatcagctattttataagcccagatccctgtggagaacctgctaatctgctaattattctgtctgatccttgctcttaataaccaagatctgacattgcatgtggctggcttagacatgacaaagttgccccagcagaggagctaaggtgttcaagctctgagcacttacagagacagccctgcagagcagggaatgggagaggcctggagccagactggccagtgcgacttccagccccaacacttactaggtgtgtaatttgggacaaattacttagcctttctctctctctctctctttcctcatccaaaaaaccaggataataatagttcccagctggatgcagtggctcatgcctgtaataccaacacttgggaggctgaggctaagaggaacgcttgaagccaggagtttgagaccaacctcagcaacaaagcgagacccagtctctacaaaaaaaatttttaattagccaggagtggcaatgcatgcctgtagtcctaactacttgggaggctgaggtgggaggattgcttgagcacaggagttcaaggctgcagtgagatatgatcacaccattgcactcctgcctgggcaacagaataaaaccctgtcttaaaaaataaagtcgtttctgtgctatagcattgctatgaggattaaatgagttaaagctttaactcactaatattggtcgagttaaaacttataatagtacctggcacagagggagtactcacgaatgctgatcatcattttttactgtgcacctttgtacctggccagcatgtccataggttataggaatgtggccttccatgtttttagaagaagctataatttctagctaccattctgtccatgttaggttattctagcatcagccaacaatagtcaaccttcagactcacaaaacaggaactactttctcggttccaagctaaagctcagctaatttccatccatcccaactgtagccacatcttctgtgcgagatcccagtccccagctccagcccctgccccagcccaagcatgtggtagataagtgcatattcacacttatcagaaccaaatttaatgctagacagacttttcgtttggccttacttttctacaatgacagtagcagcgatctagacaactgcctacaaaaatttggaggttggcacatgaaaccattttcccgtaagtagggcacatgaaagggaacactgtgctaccaccacagagcatcatgtcatgacgcgcacaggctacggctgccacctccctgccttctagggaagatgtgcaggcaaacttctaacccttcattgtatatactgacctgctgagctttgggggtcagatgtaattcagagccaggcctcaaacggatctgatcttccataggaacctgaactgaaaggaaggcagccatgcttcgggcaaccactcggaaccttaggcattagggagaggtcagaagaagtaaatggctattaaagtaagcattttgaaataaacaccatattttctatgacataaaaagatgaacacatttccagatctactgtgttgttcaccttctcaggaaaatcttaaatatgatcaagaagaagttttatccattatcaccatccaaacaatatatgtataattcagattcaagaatgaaagtgttggcaaagatgtggagtaactggaacccttgcacattgctggtgggaatgtaaatggtgcaggcactagggaaaagagtttggcagttcctcaacaagtgaagcatagagttaccataggacccagcaattctgctcctaggtatacacaaaaaactaaaaacagatgttctaacaaaaactggtatacaaatgctcatagcagcattatctgcaatagccaaaaggttgaaacaatccaaatgtccatcagctaatgaatggataaacaaaatgtggaatacaaaggaatattattcagccataaaaacaaacgaagtatggatacatgctacaacataaatgaaccttgaaaactttatgttaagtgaaaaaagtccaacataaggggccacacattatatgattccatttatatgaaatgtccaaaataggattcaatacataaagtcataatgtcaattagtggttactagagacacggggattaaagggaatggaggtgactacttaatgagtgtagggcttccttttggagtgatgaaaatgttctgaagctagattgtggtgatggctacaacaacattgtcaatgttctaaatgtcactgaattgtgcatataaaaatggttaccatggaaagttttaagttatgtgtattttatcacaattaaaaagaataaaagacgcaagccaaatttaagtaaaacaaaatctcgcagtcctgctatcttccaccgcaaacaaaaaaacatgacgttaactggtttggaatgagtgagtcccaaagttacaacatcacaatgggctattccacaagaatgctgacatcatcaagtttgcaaactcttttcaacactgacaagggcttgaaaaggaaaccatgatgtaagtaagtattatgagagaaaacaggagctaatggcaaattcttccatgccttgggattttttgcaacaaaaatccagacttgcttctcattacttatccttcttaccaacaggccttttattcattttttctgtttttttgagacagagtcttgctctgttggccaggctggagtgcaatggtgtgatctcggctgactgcaacctctgcctcctgggtttaagcaattctcctgcctcagcctcctgagtagctgggactacaggtgcttgccaccacacccagctaatttttatatttgtgtttatttatttatttatttatttatttttagacagggtctgactctgtcacctaggctggagtgcagtggcataatttcagctcactgaaacctctgtctcccgggttcaagcgattctcccacctcagcctccagagtagctgggactacaggcatgtatcaccatgcccggctaatttctgtattttttggtagaaacggggtttcaccatgttggccaggctggtctcgaactcctgacctcaagtgatctgcctgccttggcctcccaaagtgctgggattacaagtgtgagccaccgcgcctggccaccaacagatcttaacccagcttgacgactttacagttcactagactgagtccctcacaggttctggatttccctgaacgcctcaagtgcccagctgacttggcttttaaactatgctcgcataccgtccatgactagctcaaaaccaaaaagaaatcagtagtgcagttaggttacaaagtccaaacacaacaggagatactattaaaaatactgtttgaattgaaaattttttttaaaggtaagaaaaaataaaaatgctttttagaatgtaaagatgtaatcaggctctgttttttttttctttttttttttccattaatctttctggagaacctagatcctaagtcgaaaaacctactgaagtatatcacaacctgtaagtaggtacagatgtctgaggcctatttagaacaacagtgttagaaaggcgcttccttacctgttagacaaaggcgacttccggccaaacccaattgcccccaggatcccagagctgagtctctcctcagccacgaggttctgcctgctctgaaccaagagcagaattcgaatgacagattctgtcaggacggagtcattctgctctgtctgaatgagggagagctgaaggacttggtgccaccacaaaaacagctttgcctcttcctccacggagctaggggaggcaccggaggaaaataaaattagaagtaaatttttcccactcccatttaactgcaagtccacatcagagtttgaaggataggagacattcagtacttcaaaagcacaggctaacggctgatgttaatagagccatgggattgtaaccaccgccatctgtggaacacctactacacgccactgtgatgaacttcgtgttcttccacttcatcctcatgacagccctatcaggtagggattactatctccacttaactggtaaggaaactgatgcttggtgtttcaaagtgccagttttaggaaacaaaaaatctgctcagaagattagcctattaattaagaatctttccaaaacaactgtcaccataccttaaaaccttattttttatgcacctcttggttctgtgtacttaaagctagacttaagctctaaattccaagttaaccaaatacagcaagtttgatgtaacagcctgagggccaacgtaccttgggtacacctgttccagccacttgcttaagatgagcagcactttcatttcattccttaaagtctgttcgctgtttaaacactgaagcaagtagacgtaaagagtcaagtaactgcccaaggtgaggcactcctgcaggaactcttccatggtgagctcgggaacctgaagggataccagaatgggtccccatcctgaattctgattgagagggcctaagaacatgaagaagagacatcaagatataggcaagaatccaattacttgacaactctagcaaatattttcactttaagcttcatgatttttttttttgacatagcaacctatgagataataagcttcatgtcaagacaacctttcttacagtgaccttggaggctacaaaagtcaaatatacctcagggctcagactggatagccctcaggccagatgcctgtccccagcgtagccaccagaaaggtttaagaaatcagaattcagggctgcatacgtataaatcacctttctatcacattatgatccttaaaaccacatgtagacactgcctgtcctggtcagttaagaattttaactttaataccctttttaagaacatatgaacacttatgctttccgacgggaaactgttatcactcaatctgtgagtagttttacttatcaaagcttagtttaactcatgtattgaaactgtttgatttttagtaacacacatgagtttggaatagcagtgttatcctaatggttctccactctttgggggagcgagggtggggtggcatggtgacatgcacaccacctccatgggtgggcatgtgctgttcatgggtggtcaggacagggcagatggcaggttgtgggcacttcctggatccttgctccgataccctccttctcactactgcttctctcccactgactgcagtgtgatgtgttatctggatatcagagttgagaagtgctgttctcagcaattcttaatcagactaagccgcttccagagtctgacagtttagaggtagaaagtaaaacagatttttaaaaaggaggggtgacaatgaatgagcccttcataatgctttaaaaggtctgataagcagcaattttaaaaacttctatgaaaactccttttaccaaaagtgacaaaaacagggaaaattaacctcatggactatgattatatagatcctggtatatagcatttgttctgaggactatgacttggcctgtgacacaacacaatttgcatatcataacaggttggtctgaccctccaaaactaacgtgaagtggattagagcttttctcccttgaaatgtgattgtaccaacagacatggccacaggttctcatgctaactgcagatctttatgaaaaatacgtatattcagaaacatccacaacatttgtagagcagaaaattagaatggcaaatccctcactgggaagagtctggaaacatatctgctgatgacaatgctttcatctttctggaaaagaccaatacaatggagcgtaagatgacctcctcttactttctttgaagtaggcagtgatgcaggcttctgtagtctcagccatgtggcggacggacgccaggctctggcaggctgctgttaaaaggggcagcaccaccagcccatgcattttttggccaatccaggtccggatactgccccgaaggaactctgctgttggaatagtcgcgttgttcatcatcatcaggacttccataaagaggctgctgagggccatgtggcgggtctggctgtccatgtctgaaaggaatatagacacactcaagaatggctgccagaaaggtactatccatgtgatcaggagaataacagtgcttcaatcttagctgttctccaggcagattttacagtgctagtagctgactgcaagggactggaaggaaggctctggatggtgttaagtttgtacaggtagtatgcggcacacggttactaagagtaaaagcaggaactactgtgagttccctgggtacagcagcatagcagagcaatacttaataaatagacaaatctgaagctggtgtgaaagagtaacttatcagaacatgcctagtcagtctttattttccaacctttgctcatggaaaaccaaatacgtagatctcaccagtcattcagtaaaccaagtagcaaaagtacccactgtcactgccaccgctgtcaatattctagggtgatttacacacattaaaggttattacttaaaactaaatataaatgtaaggaaaaacctttgtaaagtgtcctaacagcagctcttttatttctttgttttttaaataaggaaagtaaaccaactggtaatttttcaaaaaaaattggaggtaaagagagaggaattcaagaaaaagaacgaattcattttacaagagaactgcaaatcttcacattcaaaaacagaaaatatattttactgagagttaaatggaataatttttgccaactcttctagctctcctcaagctgtagctttcacaccacaaggattcagtatttatgtcaataggaagggtaaaaagttgagagatcttactcatcgcatctatcaaaacaaattcatctacttatgcagggttaaataaaccctcacttaatctttctgtacgacctacttactatcaagcaaggacttaaaaaacaagtttgagagagatagtaacagtatatctgtctatttcttcatgtatttctatgggtacaaatattcttggaaataaaggctcatctctgaatttcaacggaatagcaatttaaattttatctcttaattatgactaataggaatagattactacaacagaccctagtctctcccattcctgttcatatcaacagggctctcaaatcttttcctaaataccatatctgatcctatcactcttccgatgaagatctttccagaacacccttctctcctttccctggccagctattattcaaccttcctggttcaatcatatctgaccaactctagaacagtttctccagcattgcttgctgatagtttttttccataagatttattgaatgtggctgacttgccaggctgatgctaaaattttagatattatctcactcaatacttacaatatctacatgaaacaggtatgaccattaacaacatttagcaccgtttcatgtttattggtgatcagtatattttcttttgcagaatgtcgtttcaagggtcttgtccatttttttctactaagttgtctttttcttccttgttttatctggtatgacaatcttagtcattcacagttattataattaattactgatgtagctgggtctaaatctactgtcttcctatatgtatcctatttgtccctcctattctacatttctttttctctcttttgcttcttttagatcattattctactttttccctgttttagcttgaaaactaaatcctctcttaaaattctgacagtggttatcctataaatgaaaacatgcattcctgattttttgaagtctaatgttaattggttcccagatgatgtaatggctttggaacattctaacttcatttctccactgttgccatagcccaacaaaccatttctattattattgtcttatacagtcagatttcatttagatttacccacacatttaccagtttcattgttcttcattcttagtttcttcctatttattttctctttattatttcctcccctctactgtctttgactgtaattttgccgtctttttaaataactgtttaatgcttatctttttaattttcaccttttaaaaaagtctatgatgagcacttaaggccctgaaagtaagtgatacggtttggatctgtgtccccaccaaatctcatgttgaaccgtagtccccaatgttggagcagagtttagtgtgaggtggctgaatatgggggtaggtccttcatgaatggtttagcaccatcctcttggtgctgttctcatactagagttctcagagatgtcgtagtttaaaagtgtgcaacatctccccccttgctcattctctctcttgctccttctctggccatgtggagtgttactctcactctgcgttctgccgtgattgtaagcttccttaggcctctccagaggccgagcagatggcagcaccatgcttcctgtacagcctccagaaccataagccaattaaacctgttttccttataaatcacccagtgttgggtttttctttatagcagtgtgagaacaggctaaaataataagtcccatgttagctgcatcccacaaattttgatgcactgtattttattattcagttgtaagtattttaaatttctattatgattattcctttggccatcagttatttaaaagtttgcttcttaatttccacagtgtttttccctctagttctatttagttactgatttttttttctttgtcatgcaacttcggggcagaaatacacagagatgaacatctggcttttacaaagttttctgccttacagatctatttatctgatattaatatagctatgccagctttctattttaatatttgcctgacataatcatcttgtggaaagctttctatatccttaggcttttgatgtatttcttatcaacagcttaaagctagatgtttttggttattaacctaccttaacaatctttgtcttttaacttaagcattagtccctttaccaatacatttgaattttatcatcttattttggttatttttctcactttctccatgcttcctttcttgccttctttggactgaacatactttggacattcctttttatctccctctactgacttggaaattgtacattttaatttctattcttttggttaatttcttaaaattgttaatattcatactttaatcaaggtataaagttaatctcttgaccactaaacagcagtagaaccttagaacacttttaactcaacctccttcctagcatgctttagtattttctttagtgacacctactgggacaaacactctcagggctcaatgaaagtatggttctttacctcgtcttcatcattaaagggtggcttttcttagtttacaattctaggttatgagtcattttctcatagcacattgaagttgttatcccactgtcttacagattcttttattgatactgagaagtcagctgtcagtctaaatgttgctccttggtaggtaatctgcctttccttcctggatgtaaagggttttgttttgttttgttttttaattttgccactggtacttctgcaggttcactatagtgtatacaggtttgaatttctttccatatatcctacttgggatttgctgggtttactgaatttgaggattgctgtcttcatcagccctgaaaattttcagccttgctatctcttcagatattgcttctccccagttaagtatctcctctccttctggaattctacttggataataggatgtatattaaaccttctcagcctatcctctatgccttttaacctcactttcgtattctttttattttagagatggggtctcactattttgcccagactggagtgcagtggctattcagacacaatcattgcacactgtggcctcgaactcctggccatcagcaatcctcctgcctccgcctccatgcccagctcacttttacgttccttctctgttcctctgtgctgcaatctgagtattttcttcagttttgttttccagtttaccaattttctcttcggatgggtttaatctgttgaacttatccattaactttattataatctttatatttttcatttctaaattatataaatctctcaaatctgcatatttctacaatcccttgcttcttactgatatcttcaatcctctcttatttcagcatataataaaaataacttttttgcttactgtactaattattccactatcttcaatcttttcatttctgacgctgctgttgttttctattactttgctcatggtaccttgtttcctgtgttttgtgactttttttactgtgagtttcttggaactttgaggcatgagttaaagatgcgtttctccaaacaggagctatggttgctttttgccagatgctggtggcaccgccaacccagaactactctaaattcttagattgaggttgttgttattactgctgtttctaccaatctaggtagtctgaattcttgcttcaaaaccacatgagggtcagcttgttatcaattctcaaaacagatatctcttttcctgcataaacatttaacctaacaacgaggccaaaacaggtaactgtctttgccttcctctcacaagaggaggtttacttctagcttatctttacagtaaaaatgtcaccctgtggattatgcatcggatttccttttaggctcccatcttaggcaggccctgggctttaccacctccccctaatatccaaacatattcagcaaaactcttcagggtgacagcagcctcagaactccacctacctttatgggtttctcctttcacttaggttctggcctctgaggttcccttacctttttgccactccactaataaatttaatttccagtttcttaaaaatatttcatccagcacccagttatcttcagcaggagaggcaggcagtatgtctagtccaccaaactgctgggagcagaaggttctccagacacagtttcttgacaagtctacaggtgattctgaagtgccctcccagttaaaagccaaaatccctagaaatgccgctcactgaaaggtctctgatatctcctaatcattagatcccattgtccagcttaaaggtcagtctcgcccaccacccaacagcatctgccagtgtcaatccttccccactgctgagtccctggtgtccaaacacctctctgaccattgcttctctggaaagaggagtgccagtgtcctgaacatcctcctgatctcacagtgccttacgcacagcaggaatgcattgactgaatgaatacaggacttccgactggtcacttaccgggcgggttaaagacaatgatatcgtctaagagcttagacatttcctgttctaggactgctaaggtgatttttccattttgttccagggtgctgaggaattgaaccatctgatgagtaaaagcttggcattttggaactgcatcctgaccaaaaaaaaaaaaaaaaatcattcaaatgaatccaagcaaggagtgttaactgcatatttcctgggagcatggcactgcaatgaatgcttgggtagggagtagaggggacagaacaggaagccacatgaagacttagtcccacgtggcccaaggggcctagtgaaaggcaaatctatggtaacactttgaccagggcccatgttttcccaaattgtggcagaatactcttccttttttactacaagaataacaacattaaccaaacactaactacttgccagaaacttttccaaaaacttttatgttcattatcgaattcaatcctcaaaacaccactttgagacaaggtactatttctttttttttttttttgagatggagtctcactctgttgcccaggctggagtgcagtggtgcgatctcggctcactgcaacctcctcctcctgggttcaagcgattctcctacctcagtctcccgagtagctgggaatacaggcacctgccaccattccccggctaatttttgtatttttagtagagatgggctttcaccatgttggccaggctggtctcgaactcctgacctcaggtgatccgcccaccttggcctcctaaagtgctgggattacaggcgtgagccaccgcacccagcctttgcaaggtactatttctaatcagatgagaaaactgagggacttgccctgtcaagcctaagttcatattaccaacctcccttcctccctgctattctgctgccaatgacattcagatcatgaaaccagcagcttgctggcagccctcaatccttttgacctttcatcgacatgtgacattgctagtaagtaaaagttcacccaaagggagaactcaacccaaaagatctacaaggccaaaagatgagtatatgataatacacatcctccgacttcctctgctgagcacttcctagcttcgactgtcctttgtagcacttatgctgctaccaatctccaggaacagtctctgccttttaaactacctctcaacttacaagatgcttctggctgtcagtaggaatagaaaggcccgcagacacttttaggagcttcatgattaattcagcataagattcttttgccaggatgatggacggcgggtaatggctgctgaaataacttagcacactctggtacgacacaatatccacaagatgccatgaaagtgagcttgtctgtccaaggagactaagtaaaggtgaatcctaaaaataaaacacatattcctttagttccagagccccaatttttccagaaatatgtgttgctaactagtctgtggaataactactaagatggcctatggtaagcacagaacagttatgatatcaagtaagtatctactcgagttaggagtactagtgaaagcaataaccaaacttttggcaaaaacacattcatattaagatgtattgagtatctggaacccaggttcttttctttcaaaagaactccctgttctggtgggacatgccaaaattgacttcaagaagcatacaagagattgaagtagatattaatgagatacaaaataaagttgattaatacattctaactcagtgtggttctttgcataatttagaatcagataatgagctatccaagaaaatcaggcatctggttaaaggtacatctcatatgccaagcatctgttcacactgataggggcactggaaaaacaaatgaaaaactacgacctagtagaaagcaaagatctaagcagccttgccgaatttttgccataagcttcccaaacttactgtttggtctaccagttgaacttcctttgccaataaaatcatcatgaaaaggaggcagacaatcatgctgcgggtttctgggtggggactggaattccaggcatcagagagcacactaacccagttgacttcacagagtacagaccccaaaaataagaaacagctcttggggcttcctcgttccacctaaaagaaaatgaattaaaatcattctgttgccttgtgctatctatgtatctggaaaatgtatgtaaattgtttcataattatgtttttaaaaaacactttttccccagattatatcacttagaatcccacctcctagagatttagacttaatatttgtaatatctttccttccacagtgtatgtgtgtatattttagtttgtctgttcagatttcagcatttattccaatcattcttaataagcgaggaatgaccttccctaaccccaacctgggtggagaatcgctgccacagtaagtcactggagctgcagggagtgtatcagaatcctcaggtgtgccaggacagggcaaagttgaaatttactagtcagtagttcccaaacttaagtgtgcatcagaactaaatggaaggtatattaaaacagactgctgggcctacccctagagcttttaattttgcaggtatgggttgggagccagaatgtgtaagttcccaggtaatgctgatgctgctgtcccagggaccacactactttgagatccactacactagtgtatattatttatattgcctttttcctttttcctttttttttttttttgagatggagtttcactcttgttacccagattggaacgcaatggcacgatcttggctcaacgcaacctccgcctcctggcttcaagcaattctcctgtctcagcctcctgagtagctgggattacaggtgcctgccaccatgcccagctaattttttattttattattttattgcttattttttattttatttttagtagagtccgggtttctccatgttggtcaggctggtcttgaacccccagcctcaggtgatctgtccacctcagcctcccaaagtgctgggattacaggcgtgagccaccgcgcccggcctatattccctttttaatgtaatgctgtattataacaatgtctccgtattattagtctttacaatttttgatgactgcatgtttaaattctatttaaaatatgagaggccgggtgcagtggctcacacctgtaatcccagcactttgggaggccaaggcaggtggatcacaagatcaggagattgagaccatcctggctaacatggtgaaacctcatctctactaaaaatataaaaaattagctgggcatggtggtgggcacctgtagtcccagctacttgggaggctgaggcaggagaatggcgagaacctggaaggaggagcttgcagtgagccaagatcgtgccactgcactccagcctgggtgacagagcaagactccgtctcaaaaaaaaaaaaaaaattagagaatgaggaacagatgtactataaagtatataagaaacctcaaagatctcttacaagctatttaaatacttctaatttgtttaaaataaaacatggctactcatgaatttttcctttcaaaatgaagattaaaagctctagtctatttataaaatcatgatcaatggaatttggtgatgattcatttcttgtcattactgttattatattatgctaactactaattctcttccttttagaaaatgattcttcattgtccattataatctgttctctatcctcatcctcaaccccaccaaaaaaatatagtttattatgccaacaagacacaaagaattaaaagatccccagcttctggggtggtcagggtcatctgccattagaataaaactcctagagacagagtctacagcatcccttaacaggctgtgctactatctaatctgtcttatagttaaggtcatcctttttaaaactccatcttatagttctttaaaccacctttctctagtatgttcataatggtgataaatatttacttaatgcccgtctcatatactaaatctagctataaaatcattcttaagcctgggatttctctagaacaactgccctcagcttttcttgcatttcagctactgagtggctgacaagagcagcacagatggggttccattaagggcactaaaaaagttaagtatattttgctaaccttcataaataactgtagatctgtatcaaagcacttaaggtgtctcaacaataaatgtgacagtaagagtaaacactaactgatgagactatgaacaaatgaactgaaactaccataaaaacctaagacaagagtgtaattaaaaaaaaaaaaaagaagaaaaacaacaacagctccaaatgcctgactagtatgtaagttacactacactctctgttttctggttttgtaaccattgcttctactgcaaagactcgcatgcactctctttttttaagtcatttcaggtctgcacacgattatgatgcatcatcggttgtcacaatgcattttatctcctataatcaaattattcacttgcataactgctaaaagaaactaatagcttcagtaccaatttacatttgctttaataggacatttaacgataagcagttgttgacacaaactgtaatgacacaaacacatcaataacaaccaagattaagcataacggaggcattaaactacgtactcacacgtgacaaagtctaggggatgactgacatattatagataaaatctttctctgggttttaaaaatggtcctgtagatgttttaacacgataaaatgacttccacaagacactgttttccacaggcaccaccgaggcaacacagaatgtattcatggtccacgctagcacacactgccactatgcctaacaaccacagtgaccaggctgctccctagaagccagatctctctaggctgcgatgccgggaatgaagggcttactttgaagaaggcctccatgagcatctggtcagggtgcaggtccttccatggcagtttccggtacgtgctatggaaagcgtacagaatgaactctggcattttgggtgctgtacatgcttcacaataatgcatcaggtgcaaccaaagggctcctgcatcacctggcaacagcttatctagaatgtgaaaagaaaatagagctgaagacctttggtttaccttaaaaaaaaaaaaaaaaagcaaatttgaactaaaagtctaaaatctaaggttctcatgattgacccaatttcaaagattttcatgtagggagagtggttaaggggactactggcagattagtaataaagaatggtactttaattacccactcgggtaactggaatgagcagatgctgtgtgggaaataatcagcttttctttaaaatttctaaacgtatggctttttaactgaaatacactcctacagcttgttgccctcagtatgtattcagttttacacatttagtgcttcattcatttggcactcaggagaaatccaaaatccctcaaaaggaaatgttccattttttaaaagaaggcatacaaatagccaataggtgcatgaagaaatgctcagcatcactgatcattagagaaatgcaaactaaaaccacaacaatgtatcagtgcacagctgttaggatagctgttatcgaaaagatgaacgataacaagtgttagagaggatctggagagaaagaaactcttaaacactgttggggggagtgtaaattagtacaaccattatggaaaaaggcatggaggttcgtcaaaaaactaaaaatagactaccatatgatccagtaatctcacttctgggtatatatccaaaagaaaggaaatcgatagggagaagggataaccacactcccatgttcactgcagcattattcacaatagccaagatatggaaacaacctaagtgtccttcaaaagatgaatggatttttctaaatgtggtgtatatacacaatggaataccagtctgccttagaagaggaggaaatcctgtcatttgcaacaacatgaatgaatctggagaactcatgctaagtgaagaaaacgaggcacagaaagacaaatgccacatgctcttactcatatgtggaatctagtaagttgaactcattgaagtagagaatagaatgacagttaccagaggctgtggggtgtcaggggaaaagggagggaatgaggagttgctgatcaaaagggcacaaagtttcagagggcaggaggaataggtttcaggatctattgtacagcagggtgactaccgtccacaacaatgcattacgtatttcgaaatcagaagagaaccaactttaaatgtctcatcataaacaatgaaaggtaagcaaggtgatggatatcttaattatcttgatttaatcatgccacactgtaaatcacactgtacccatcaatgtatataattatgatttgttaatcaaaaataacattaattttttaattttagaaacggtggaaatgttccaaatgactaaaacttaattaacccttggtgcaatgaaactagtccattaactgtcattcatgtaagtcattctaaaataaatctcacgcttttctgagacctggattattactcaatattatcctcacaagtatcaattccattaatgccttcaagggctaatgactatataagggacatttagtctaaaacaagtggtttcagactttctggttccatgctaatggaatgcagtcaaagaagagagagccacacacagtaagaacagaaacctgatggtttctcaacacaaatcttttaaaaaatggccaacgaggctgtgtgcagtggctcacgcttgcaatcccggcactttgggaggccgaggcaggcagatcactttaggtcaggagttcgagactaacctggccaacatggtgaaactctgtctctaccaaaaatacaaaaattagccaggtgtggtggcaggcacctgtaatcccagctactcgggaggctgaggtgggagaactgcttgaaccagggaggcagaggttgcagtgagccaagatcgcaccaccgcactccaacctgggcaacagagtgagactccttgtccaaaaaaaaagccaatgagcatcaacacattgtaccagacaactctcatttctaacatgcttgtaccctcaattccacaacccggcatggaacaggaatgcacatttttaacaacctttaagacagaggttaatgatagcattcgtttaaatatggataaaagacagttttgtttagataaagttgggtaagtatgtagaagatatccagaaggatgtcttaggatagactgagctgatagttccagccaagacacaaattctgtgacgtcagataaattcttttcattttcaggtccccacttttctcatccatagaaggagctagtggatcagataacctcactaaaaagctgcaatacttcttcatcctaccttgcaaagctctcctgtttcctttctttgaacccagctaccaagtcttgatgtctgtgaacccttctgtcctatgccactttcttattttattcatatacaggggcaagagagccttggggtgctttcccctatactaagaaattaaatatggctgggcatggtggctcatgcctgtaatcccagcactttgggaggccaaggcaggcggatcacaaggtcaggagttcaaaaccagcctggccaatatggtgaaaccacgtctctactaaaaatacaaaaatcagccgggtgtggtggcgggcgcctgtagtcccagctactcgggagactgaggcaggagaatcgcctgaacccaggaggcagaggttgcagtgagccaagatcctgccactgcactccagcctgggcaacagagtgagactcagtctcaaaggaaaaaaaaaaaaagaaattaaatatatagcctttatgattataatttggtgctcaaatctttttctcagtaatcaatatattctggatggtaaaaagcagctagaagtctgcctttcaaaaaaataattgagtactactaggatttcatgtgttactcattgaaccactatttatcaaacacacactgagaatatggcattaccctagttttgtagggagcaaaaagaagcaaagaataacatttctgttattctatgaagagtttacacctcttcaaggtaagataagatatataaaagataaatcagaaatacaaataaggtacagccagacaaaatgaaatgagctatccagccatgaaaaggcataaagagacttcaatgtctattactaagtgaaagaagttaatctgaaaatgctatgattccaaccataggacattctagagaaggtaacactatggagatagtaaaaggatcaggggttgaggggagggagagatgaacaggcagagcgcagaggatttttaaggcagtgaaactgctctgtatgataccacaatggtgggcacatgttatttgtcatttgtcaaaacccaccgaatgtgtttaccaagagagaacactaatgtaaatcatggactttcattgataatgatgccttaatgtaggttcatcaattataacaaatgtatcaccctggtgtggaatgtccagagtggggaaggcttgtgcatgtgtgggggcagaaggtataaaggaattcttgtactttccacttaattttgctgtaaacctaaaactgctctaaaaaataaagtccgttaaacaaaaaataaaatctattacaaaaaaaaaacaaaactggatgacatatgcttaactgtatgtattagctcattttcacactgctgataaagacatatccaagactgggtaatttacaaagaaaaagaggtttaacagactcacagttccatgtggctggggaggcctcacaatcatggtggaagatgaaaggcatgtcttacatggcagcaggcaagagagagaatgagagccaagcaatacgggaaaccccttatcaaaccaccagatctcatgagactcattcaccaccaggagaacagtatgagggaaaccgcccccatgattcaattatcttccactggctccctcccacaacacatgggaatcatggtagctacaattcaagatgacatttgggtggggacactgccaaaccatatcactctataactaaatgccacacaaacacatggcagccacaggggcactaggtgtattcagtggaagaaaacaccatgggccagaagcaaagaggaagccagagtgttaaacagatgctgaaaccagccaaccgaggactatttgcctgctgagttttaacagcacaagaggacagaacatgaggttttctaaggactatattcttactgaaagggtagaatggggcaaaagaggaaacttctctgccttaccctagattgtgagtcaggagagatcaaaaagtttactgtgagaattgaggccagcccgcaagtgagtttggggtttcatttcatgtaactggtagcacgggaaaccccaaaccaagaagttaagtagttccaattgacaacaaatgtagatcctctctggaggacttacacaccctcagcctaggccttatgagattcccatcagtctctctaaatatgggctcacaatacaaaatttaaaaacacacaaggaaacatgcctccaagaacaagaatccaaaggaaaattaaacagcagcataagacaacccccaacaggaatttcagataatagaattaatgtacatacatcataaagtaagcatgtttaaacaaattctaaggaaataaaaaatagaattttaaatgaaagaaaagatactaccaaaaaggatcagggtacatttgaaaaacaaacaaatagatctagaaatggaaaaaataatcacttcaatgaaaaattcaattgatatattttaagcagatgagacagagctggagagagactaaagaaatggaaggaagacctctagaaattacccataataaagcaaaaaaagacagaaaatatgaaaaagaggttaagagttagggaggacaggaagaaactcaacatgcaggacaggcaatattggaagagagaaagactgcaaatttaccataactgagaaactcagagcaacctaacaaaaaaaggtaagaagttacacacctaaaggccgggcgtggtggctcacacctgtaatcctagcactttgggaggccgaggcgggcagatagcctgagctcaggagtttgagaccagcctgggcaacatggtgaaaccccgtctctactaaaactacaaaaaaattagccaggtgtggcggcatgcgcttgtagtcccagctactcgggaggctgaggcaggagaattgcttgaatctgggaggcagaggctgcagtgagcccagatcacaccactgcactccagcctgggcgacagagcaagactccatctccaaaagaaaaaaaaaaaaaaagttacacacttaacactaaataattgtatcagcgacttttcttcagtcacaaataactgcctattaaataaaaattaaatagaggaaagtagaagaaaaagactgactgacttagggaaaaatgaaaactaagcagagacagcctgacatcttcctacctttaaaactctcatgcagtgagtcaatacagtcagtgaacagctgcacaatgcttgaggccaccacagtatcactctctagccaggggtaatgccgctgttggctgctttaaagaaaagaagcacacacttaggaatgcaaccgtgattaaaatactgttaagtcccagtgtctagggctggcctaagtcctggaagcctgtccattatgtaggcctgacacacatttagaatacttaaaaggctgtaaataactgcaggcgaattgtagcttgtaacaccagccatataattttctttcatctccttcataccctttattccaatgcaattagatttcaaaaatgtgctatctaaataacccttaaattaacatctttttacatcaaatttagacccttggacatcttggttacatttcaaatgccgtagaaaaacaccctaagtcagcttcaacagttttctctactcaaagcattaaaaaaaaaaaatcaaattcacataacaaagagatggccaaatattaacaaatagaaaatgagcaaataaaatttttttttttttgagagagagagtctttctctgccacccaggctacagtgtagtggcacgatcttggctcactgcaaccttcacctccagggttcaagcaactcttctgcatcagcctcccgagcaactggggttgcaggcaccgaccaccacatccagctaatttttgtatttttagcagagacagggtttcaccatattggccaggtttgtcttgaagtcctgacctcaagtgatccacctgccttggcctcccaaagtactgggtttacaggcatgagccaccacgcctggcccagagaaattctttatatgaaaaatttaattggctgggcacgggagctcatgcctgtaatcccagcactttgggaggcagaagtgggcagactgcttgaggtcaggagttcaagaccagcctggccaacatagcaaaacactgtctctactaaaaatacaaaaaaaataaaaattaaaattgaaaaatagctggacgtggtagcatgcatttgtaattccagctactcagggggctgaggcaggagaatcgcttgaacctgggaggcagaggttgcagtgagccaagatcacgtcactgcactccagcctgagcaacagagtgagactctgtcttaaaaaaaatttttttttattttctgaatctggtctagaaaactcaatatccaaataggttccgttaattcttactggaaataaacaagcagccagcactatggtaagcagtctatatgtacacagtcactataaaatcctgaagcttgcagattattcagatagccctctagcaaaagcaaacattcagaaccttttatactttccttaagtggctcgtaaagcatcatgggttaatgcaaagagtctagaaacagaagtctaagacctgagttctagtcgcagcttcagcactaaccaaccagctatgagacttgagtttgacattcatgttctctgagtctcagaatcaaattcaagtttttgaaaacaactcctataatgtgatgtttaccactgtcgtaatttttataaaaccctgacaagttcaactagcttctgcttgtatactttcagggaaaaaaaagactcagaaggcaactcactgaatttggacagctctatacctctaagtatttcaaatgcttgtgaaataatgctttaattgaagagtcctagatttaaaggtaattcccacccaataattttatagccaacttagttccaaaacacaactgatgtagtagagaaaaatcagtctcataaaaccctcaagcgaacagcatcattttttctgaaattaaacactaaagtttattcaacctcttattgtggaaaactggaaatgagtgtccagttttgttccaaaattattatcaagataatatctctgatgatccagactagcaattccataaatagaaaatgtcttaagttttgaaaagaagccttttctaaatttaaatatggccttacactaaaaaattaaatctgtgaactcatcacttctaccaaataccatttagaattttaagtctacaaacgtcaaaggaatttgaatatctaaaaaactgtttacctttcgttgtcctctaaaaccaggatccatggcttaaagagctgaatgattactgaatgtagggatttcagcactaaaaagttttagagacaaaacaaaggtcatcatttgtcatttgtcaatatcactgctcacattatatagaaaaatctacctcttattatctgtagcttcataaacctatgttaatgtataaacaacatgcttagtgtaactatgtatgtttacgttttcattggctacactggaatttctctgaattgaagaatttgtattacaatacaatatcatggataattttataacacacttttaaaaaagataaatgtataagatttagaaccccatcttagtaagacaaatgacagaaagggttggaaactgaaacctctctgtaccccaacctgcaaaggaggggcagagacaagctatagcaagcaccctacattcactatgtaatgaatatatccattcatatattgtgacatatatgacacatatatgggctcatgcctgttctatatatttctactttctctccttgacactcaatataaatctcttaatgtgcctatttaaatctctcttaatggaaagtccaaacacctagctccacatcgcatgagaagtatattacctgttttcctgctggcagttgggtcttgggccaaacaggtcatttctaagtcaatcagccttttcacaaggtagcccaagaatgtcttcacatcagccatataaggactccattttgagaataaaccaaagcttttaaagtccatcttggataaccgaagcttataaaaaaagtctgaaagccactgtatagtctccattacctggaagagacaactagtcaaaaaatgcttactaaatatgtattttagtaaagtgttatgatacactgtgatgggggtgtatatagtaggtctttgactttataagagagtggcaaaaatataaagcatatgagaaataaatcaatggttttttgtttttgtttttgttttgaggtagagtcttgctctgtcgcctaggctggagtgcagtggcacgatcttggctcatcgcaacctccgcttcctgggttcaagcgattctcctacctcagcctcctgagtagctgggactacaggcgtgcaccaccatgcccagctcatttttgtattctttagtagagacagggtttcaccatgttgcccaggctggtctcgaatccctgacctcaagtgatccgcccaccttggcctcccaaagtgctggggttacaggcatgagccaccgcgccaggccatcagtgggtttcaaaccttttctaaatcagtggaaccattatttcaaataaattctcatgcaaatgcatatcaaacagaaaggataaaacccagagctccatgggacactgcatcatagaaacccgaccagaggtctcagggtggagtccgatgggctagggtgggcaggaaagatctacaggggagtgcctgcccttgtcttggatacatgggcaagaattagactcaggggaatggggtgagccatctggaaaaaggggacacgagggaaccaaagcacttaacacaaagaaaaacacatggctcttaaagataatgcacaagttttccaactgcttaaaaaatgaatagcaagggaaataaaaagaaatgcacaaacacgtcagagaccaaaggctacacacctgcttgtctgacaagagagcatcagaagagctgggaagcacggcgccctcggtggacgctgccccctgctggcagctgggggcgcagcagcccagggctctcagagtggccttccaacactcggggctcagaagctgctccgcggagcctgccagcagggacaggaagagcaagtcagtggctttcccgaaaggaatattttaacttgtaacaaagaatatgagcaccttataaaggaataaaaataaagccaaaatccaaaacaaactcacagggatatctggggtgaggaggcccaagtaaagagaacctaagagaagaactggccacctgcacatttggttttcctggttcctggtaaccctgctgggagtgagcgctgctgaagctggtggagctacactcagaggggtgggagacctgaccctccgaccctgactggggaatggtggcagtgcctctcctggctgggggaccacagctatctatgagtgtgacagaaacaacagtcacaggacaacggaaaccacatgatgaaggcaactcagggcctgggctctccagaaggagtctcctaccggccccccaattccccgaaaccaagacccagaggcagcatggaaacgctggacaagtccagcagcccatattctgaactagtcccaactctgctacttaataacttcccatcccacaggacaggaataatatctcctaaagtactttccacccagagcgaacatgagaatcaactaaaataacaggttcatggagcaggtctgaggagaacgatggtgaggccagttacaatatgtccagtgtgaggtacctggggacagtgccagtctgtgtccaatggccactggggtctggatcttaggacagcgccccaaaattaagctatcactggaaatcacacatgcctagaaggtggcagtgacatcagggaaaacaacgggctcacccagagggaatgaatgcagtagaagagcaaaggatgctcccaagggaacatcaacatggtagccaaggaggagaaagaaaccaggaggctgaagctcatgacatctgagaggtatcatattgttattcttaagtctgaattacttttcttggtaagaacaaatttctagctaaattccagtcaatagtggtctaatataaatggtttacaatctctttaaaagatttcagggaaaaatccacaacacacactatttgaaactttaaaagcttagagaaaaaattagctatgcacatattcattggcatttgtacaaatgtatttcccttccaccattctccacccaccctgcaacctgcctctgtgggaaacaattaaagcttgaagtgctttcaaaatgagaggctgcacatttcaaggtcctttgggcaacccgatacactggatcattaacttatccattaaactatttctatgatgtaacacaaaaatttggtataaagcaaaatttcatttgctattatatctataaaccgtatgaagtttgcattaaaaagtaaatactatctcatttatcaaattttaataaaattactgcctagcgaaactccaaaaataaaaaagcctaccctatttatttctcctctaaactctaaaattgctatagaaaattgtaagaagggggaacagaagtggcaggaatgtggagattgtaatgctgctctttcccttggtaaatataaataaagtctatcattacatatggataaaattaatttgcaaaaaacaagagtaaaagacttagaaaggaaaaactcccaaaatgtttggaactacagagaaacaaactgtcatattaaacatatcataaggcacaacctccttgctttgccagatctgtcgtctgcagagtaagccagtcctttcccaccccacttcaagacagctgaaaagtcaagacaaagaagtacctgcatgactgtggactccaccaaactggaggtgctgccttgcccaattagagcccattctcaaatttagaacaataactggccatatttacagtaacaactttttgggccttgttcatcaagccctttagatgacaattagtgattctaaactcctatactggtattactttcatatctttgaataacatctgtaagatgaaaaatgtgatattaaatattcactaagatctagttagttacaattaaatgaagacacttactttgcataagcagcctgagaatgtcactgtactggtcaggaaactggtagagaagaagataagtccagtgcttacagaaaagattaaatggcatcaaaatatcctcatctggttcaaggccccaggcagtaagtgccaagtgaatggactccagaagcctggtacgatcagacagaggaggtttagtggcgcttaaccattgtttaagatcgaactaaaaagaaaaagaaacaaaaagccgttttatttgcactagaaaaatagtttaagaggagagaggtctgtgtaaatttagtttaaaagccaaaaattacccagcattttataaaaattgaaattaaaatgtataaacaagtacataaaagattcaacctgaggaagctaattgtaaaataaataaataaataataaaaagagaagtacataaaagaatataagaagttcactaattgggtcgggtgcggtggctcacacctgtaatcccggcactttgggaggccaaggcaggctgatcacctgaggtcgggagttcaagaccagcctgaccaacatggagaaatccggtctctactaaaaatacaaaattagccaggcatggtggcatatgcctgtaatcccggctactcaggaggctgagacaggagaatagcttgaacccaggaggcggaggttgcagtgagccgagatcacgccattgcactccagcctgggcaacaagagcgaaactgcgtctcacaacaaaaaaaaaaaaaaaaaaagtagttcactaattggtgccattatgcatctatttctgtgttactatctagaatctcagaggcagagttttctaagctctgtgtgcttttcttgcaatttaaaaattttactgatgattcattattggcttataattttatactgttcctcagagtctcatacatttctgtcttataataagtttcctctccaagaactggatcagaacttcgtagctctccttcactggcgacagtgccacaaataagcagccactttatggaactgtctcaatttaacagccatgtttctggtctgcatcagttacctgtctcagttaataaaattcagactgttgatattcccttccaaaatcccaaactataaaacatgttctcctccattataggctgagatcaatctgtaggccctaaaattgtcaaggttgtctttttttttttttttttcacaacaggtctcactccatcacccaggttggagtgcagtggtgcaatcacagctcactgcagcctcaacctccagggcttaagcaattctcccacctcagcctctgaagtagctgggagtaccactagcctggtgtttttttttttttttttttttttttttgtacagacagggtttctgtgttggccagactggtctcaaattcctacgctcaagcaatcttcatgccttggcctccaaaagtgctgggattacacataggagccactgcacccgaccaaaactgccaaggttttgattcatagatgtaacagaaatacaagtgaaggcaaagtagctaagactctgaaattctcaactgcttaagtaaactcattaccttggtctaacagagttaatattctaatgttatatactaagatattaatataaaatataatattaatataaaataaaatattaaagttaatattcagaatgagatcaaaggcaatttgcttagatccagcttattctaaatatgagagagactaacaaaacctttgtcaaacacaatttaggcataaattcaggataaattttaaaaaaggatgtactaaactactattatgaatattttcaaaactgtattaagtttttaaaaaggggtgggaattaggtcctttttacactaagtggaataagactaccctatacaacagggatccccaagccccacctcctgtcagatcacccatggcattagagtctcatagaagtgcgaaccctattgtgacctgtgcatgtgaaggatataggttgcatgctccatctaatgcctgatgatctgaggtggaacagtttcatcccaaaaccatcccctctactccagtccatggaaaaactgtattccataaaaccggtccctggtgccaaaaaggttggagaccactgctatacaagacaaccaatgccccaccccctaagaagcagctgtggggtcagactgcttgaagctcatgcaaactgtgaaaaaggcctctcagcctctgctgtacctggaaacaaaactgcagaggtccttttatttctgtagaggaggaagcaacaatcattcctacgtttcaacaatatggtgaggatggaattacatcttaccttggttagcagcatgaaaatcatatcactgttgtcctcacttagaaacttcaccacttgctcatacagctgtatgaactctgcaggtgcagcattgggagtgaagaaaggagacagcagggagcagagcctgctgttcttcagaatggtttcaagtacttttctgcactctgatttaatgccactgataaataccttggaaaaataaaaaggaaaaatgtcaccagattcttccctcacaacctttatttaagcaagcaaatttttaaggggcaccaaataaggtgaatagaatttttttctaaacaaaagtctgaaacaatcaaaagacagctaaaatcaacatagataagcctattgcttccaatggaagtaatattagaaattctgaagaatccataaatctgatttggacaagtcacacagaaaatgctgagttagtccgggtgcagttgctcacgcttgtaatcccaacactttgggaggccgaggcaggcggatcacctgaggtcaggagctcaagaccagcctggccaacgtggtgaaaccccgtctctactaaaaatacaaaaattagctgggcgtggtggtgggcacctgtaatcccagctacttaggaggctgagacaggagaattgcttgaacccgggaggcagtggttgcagtaagctgacatcacaccattgcactccagcctgggcgacagagcaagatgccgtctcaataaagaaaaaaaaaatgataagttaactatactacaagacttttaagacattaaaatattggggtactttgaatccacaaacatgcaatgtccccaccatgattactacagtacccaacatggtgctgcattacgtcagaaaacaaaacttccaggttatagattttactgagagttatatttaatacctgtcaaaaactaacttccataataatatataatcaagatgacgtcatcttgttttaacttggttctaatatttaaaagtacagaatataagcaaaaattgaaacaatttcaccggcaggaaggctttcatatggttgaccacaggcggaaataataaaagaacaagactgataggcttgaatatattaaaattttaacttctataaggcaaaaatatcataaaattaaaggaaaaaaatgacaaactggaaaaatgtttttttaacacattccagatgccaggttaatagtgtgaggagctctttcaaagcaatcggaaaacaagaatctccaacagaaagtgtacaaaggaccacaatcaccaattcacaaaagtatatataaatggccaataaacatatgaaaaggcatataacttaacaagtacttaaagaagtacaaattaaaataataatgaaataccactcccttatcagattagcaaaacttaaaagaatgagagttcctaatgttggttatggtatgaagaataacaaactcaaacactgcaatgatagcataagtaggtgcaaaattcccagggaaggcagagtgactatgtcaagcatgatgtaaaacatcaaatatacaatgtgtatcaaattcctttgacacagcaatcatacctctaagaaattatcctaaagaaaatagtccaacaagttcacaaagacatacaagaatatttacctcagcctgattgcagcaaaacaatctacctaaatatccatccatcaaacactagctcaacacactgtaataaatctgtatcatggagcactatacagacatgcaatgtcatgatataggtctgtatttattaacatgaaataatgtctaaaagatgtgtttaaatgaaaaaggaggttacaaaatagcatgagcccattttaagtgcctatccatatctatatatctctatatatgtagaaatatgtttacatatacatatacacaaatagacacacatatacaagacaaactataatgaaatgttagctatgtagtcagtatttctaggtagttaggattataagaaagttttcttcttcatactttctatgctgtctgcattgcttataataagcatacattaattttttttttgagacagagttttgctcttgttgcccaggctggagtgcaatagcatgatttccgctcaccgcaacctctgcctcccagtttcaagtaattctcctgcctcagtctcccaagtagctgggattataggcacgcaccaccacacccagctaattttgtatttatagtagaggcagggtttcttcatgttggtcaggctggtcttgaactcccaacctcagatgatctgcccacctcagcctcccaaagtgctgggattacaagtgtgagccaccccaccggaccagcacacattaattttatgatcaggataaaaaacttcctacaaaaaaatcaatgatgatacctgttcagcattacttccttgtaagcatccaataagtaagtactcattcagttgaatttgggtgagagtacatggttaactagtgtttacatatttcaaacaagaggttttcctttcttttatgaaacatttcataaatctgtatgattacccttacccttattaaatatctatctatgtcactgtaagccaaataaataaataaacaaacaaataaatgttgaccaagactagcaaccgggacacagcagtggggaggtggagcaagcactgagtgttgtcagaagccctgggatccagtctcagctccacactcaccagctgaattctttaggccagtcacttaatcttctagaacctagttttctcatctttaagaagggaatctcaatcacacagattccccatgaggattaaacaaactgggaagtatttttataaacaatgaagagatttagtactgttattgttaagaacaccaaggatatatgacaagttctgatgtctccctagactttcaaatatgaataatctcccttgtatgagaagcaaaattctataccaacaattctaatcatattttgagaagcctacaactccaagaggcttctgacttgggtaagactctgaacctgtaatataagtctgaagtcaatgctgactatatccaaagaagacagacaccgcagagactcattatctgatcaaggcaaaaggtacagatagccttacctgtcccaagatctcaatacatgaagtaaagaactgccttgttgggggatgacgctgcgtctcatcgctgacgtaatccacaatagtaaagaaaaggctaatgccaactttctgaatcccaggtgtaggctgcaacttgtaggcattcactaaggccctgtgggaaaatgtgggtaagactgcagtctacagtaaaagattccatactcacaaggccttctttgataccctacaatttctcaggcaatattcttaagaatcctcagagcacccatgaaaatgtcactttagaaatatttcatggagtaaatatatgtatcttccaattttactgacaactgattttctttttttttttctttttggggtgggggagacagagtctcactctgtcacccagactggagtgcaatggtgtgatctcggctcaccacaaccttcgcctcccgagttcaagtgattctcctgcctcagcctcctgagtagctgggattacaggcacacgctaccacacctggctaatttttgtatttttcttttatttattttattttatttatttatttattttttgacggagtctcactctgtcacccaggctggagtgcaatggcgcaatctcagctcactgcaacctccacttccagggttcaagcgattctaacacctcagcctcccaaggaactgggattacaggcagctgccataatgcccagctaatttttttgtatttttgtagagacggggtttcaccatgttggccaggctggtcttgaactcctgacctcaggtgatctgcccgcctcggcctcccaaagtgctgggattgcaggcatgagccaccgcacctggccaatttttgtatttttaatagagatggggtttcaccacgttggtcaggcttatgtcaaactcctgacctcaagtgatccgcccaccttggcctcccaaagtgctgggattacaggcgtgagccactgcatctggccgattttcaatacttagtaataatttcatagtctcctaggggaaaaaaatcagctataagaactaattaacattctcatccttattaaaaatgttcatattttgcatgtaattcataatttgttatttaactttttgtattctttatataatttttttaaacacaaaaccctgatttctctacattttaaaatccaaaacactgactaaagttgagataaagatttctgtgtagaataagatcctagaataaagatagcccttccaattctcacacctttttgtgtccctttcccagtaaaagaaacatcaacctcttgtttgcctggtctcctccttcccaggagccccagcccaacacacaaaaggactcgatgctcccctccatacaccatcctactctactgaggggatcagctgttggaactggaatgtggagtcagtcaccttaaagtaaaggcagagtcaacccccacctcccaagtcatgtcatggtggctttggaaagaaagaggacagtgagagaaagccacaatgaaagccaaaagaaaacgatggtcaaatgcaagttcacaaccacacttgagagtcctaattcccctaaataattgtgctatgaactttgttcagtcatctgagttgacaaggataagttcctgggtaaatgtgactttgatataacacataagcactaaatctctccacaactgaatttcaatgcactatatcatctcacaattcaggggtcagcaaactttttctatatagggccagatagttaatattttctgctttatatctctgttacaaccactcaatccttctgctgcagcataaaagccatagaaattataaataaatggggatggctgtgttgcaataaaactttatttataaaaataagtagcaggccagatttgactcaaaggccgtagtttgctgatgtctgtactaaattaacctgtgggtgctgcaggggtggtggtggtatagtagcatgtatgattactattcatgataacaaaacagtatttcaaattataatgcctgcaaaacttacgtgatcaagttttctgcatgtacagcagcttccacaatattaagtgatggtggtttagcagcttctgcttgcaactgcttcacttccttccgtaaaacatgaagctgttggcttatggcttcattcttatgcatgccttcaaactaacaaaaattaaagttatcaaaagacatttccccccatgtgtcaggtttcccatgaagactcaaactgaaataaaattattgtcttataaaaataccaaaatttgtatctctttatatgactgccttataaactggtaagatcttgaattaatttatcaatagttcaaagccttttgtaggatactatttcacttatgtttcaactcctgaaatcctcatcaaaaacacatcccatgtcttccaccactgaggcttttcttgaagcacaggaagcccctccactgctgatcatggctccccagccgtagcccttctgtgtgctctcaatccaacatacaaaacactcaactccaaacactcaggctgcgtacacatgtgtgcccagcattaaaaaaagatgacacagatgctgctcacaaatgtcgttttgaaaggaagaaaatatatataatcataaaacaaacaacaaaataagataaaatatggggaaatgcccaaaccaactccatgccaaggaaagagcaattggctaattcctaaattcaccaatttaggttcctagaagctggtctttgataaaatttttattggttttcagtaaaggtggaaaaacaaggagaatttattgagcttctttaaaaaaaaactaaatttttttcaactcaaaagattatccttttttaagattagcctttcttatttgagaagccatcaacaaaccctttctctgactgatagtgacatacataactggtttgtttatgcaattttaatgtcattttttggatgtggatagaggcagaagaaaagagaagacatcctgggcccagattgcaacacaaacacagaactgacatgacagctgtgggggatatgggacagagatacaggaaggaggagcctggccagggttgcagagtgcagtaaaatcagactggggagctgagagagccctcttggagaggctttgaaatgcaggccggggagtctggacttacaggtacagctgaagagaccataacatttagaaggcaagagttctaaactctacattctcctcctgtcttccccaaacacatgggtgagcagtaaggtctacattttttccttacatgcacctgcccaaacccagtcttcagccatcactgcaatgattaaagatatcctttataaataatgtaaataattcacaaacttattacctgaggctcttatgtcacttatgaggcccagggttattatcataaattctgtataaaagttcctgaagggcggccaggcatggtggctcacacctgtaatcccagcactttgggaggccgaggtgcgcggatcacttgaggtcaggagttcgagacatgcctggccaacgtggtgaaaccccgtctctactaaaaatacaaaaattaactgggtgtggtggcaggcacctgtaatcctggctactcaggaggctgaggcaggagaattgcttgaacctaggaggcagaggttccagtgagctgagatcatgccactgcactccaacctgggcgacagcgtgagactccgtctcaaaaaaaaaaaaaaaaaaaaagttcctgaagggcaatggtccttcctatttgttttacttacccagaaccccagcacagcataactctgacaatacactgagcaactattttttatgactgtgataataataactttcttgtataaaactcattaatgtattaaaaatctttacaaaacttctttaaaaaagaaaaaagctctgtgacatcaaaatgcacaaaagtgaatattctagaacatataatgttaacaataattaacttttactattggagaaatgaaagattaaaaaagaaattacttgcatttaattagataataaatcaatacaagtatctgaattaaatttgaaatctttcaaataacagaccaatgtttaatatcctaaaatgtgattaggagtatctgcagtcagcctttttgttcaatacatcaccaaatacagttagaccgggactatgcgtgtcacagaatcccctggctggcctggagagacaggagccaaacaggaaaagagagaatctgagataaggaaggaagacacagaatgaagggaggtggaaaggcaaaggatccagagaccacttgactggaaaaatgcagacaggactaaaactactctgtaatccaaactttacaactgccattccatgttgtagaaactactaaaataaaaccaggtggtttaggcaagtttagaccctctcacaaaaaacatccccaaattattattattttctagtctacttatttttgtttattgttcccactactgttgaaagttttctttttttactgcaatgaaggtgagagcaatggaatgtctatcagttcataattacaagaagtagtagacaatagaacaaagtagcatggtggaagcccctccacttgagtcattttaagtggacacagaaatttaaaagtttccttgtctaaatttaaaagttggacaaagcatgtccttcagccagtttttacaataatgtgaggccctcagtgggtcttttccatcgttcatttcttggaattaacaaatttttcacatgataataaatcaatcctggggtcagcaagcatacccacaataccaaagtacatcaaaaggaacccaattataaatcaccccatttccccagggaacatcactgaattgttagagccttctactgggaagagagaacacagaaagaagcatgtctcacttcccataaaatatatttgcctttgtataccccaaacaagctatccatagctcagacgcttgcagatagctggaaatttccaggacattctttcccagaaaaaatctattaaggaataaaatattttcatgatataatttgaactctttataaaggagtcattcaaaattatatttaaaatctgaagtcatttcccataaagctaatttttaaaaactgatctaatctagaatgttaagatcacaaattctctaatcactgaaaaaagaaggcaatactattatacagactcagagagaaaatgaaatggtacctatattcatttacatgagatttaactgtcatgatcagcttgctcagaatcacactgcaagtattcagaagctgcagctgaaacagctgaagcaaaacgacctggcaatattgaatgggaaaagtaggggtcttgaatttagacatatgcaggcttgaatcctgatggagctactcactagctatgtgactttggcaagtctcacagtgtctctgaacctgtttctctgaactcatcctcattctgtgaagattaagttggataaactaggcacagtgcctcacatctgtaatcccagcactttgggaggccaaggtgggtggttcacttgaggtcaggaggtcaagaccagcctggccaacatgattaaactccatctctactaaaaatacaaaaattagctgggcatggtgttgtgaccctgtagtcccagctcctcagagagaatcatttgaacctgggaggtggaggttgcagtgagccaagatcgcaccactgcactccagcctgggcgacagagtgagactctgtctaaaaaaaaaaaaaaagttaagttggataatgaaagcaaagcacctagcataataccagggacatgagagtgccccaagcaagtgacaaaaagtactgtgaacatggctgggaaagacagtgcaaccatccttactgcttcccaagactgaatatttgggagacatttacactagagtaaaaatatacagtaagcagtgtatagtatttaagttgagtatttaagtatggaaagtattaagttgtttaaaagcaaaggtaagcacaatcaaggaatgaactgttaatttttaataagaaaaagttccaatttccatgatgtctgtcatggccaaacaatatccacaaaattccccaaagtagttaaaatcagggaacttacttatgaagggcataaatctagagctgttcattccttcaaacacatccattttgcagcactgactgtatgaggcactgatgatacaaacatgaataagacaaagtccctgaccttgtgtaactcaaaatctagtaacagcatagaactaatcataacacaaaataagttgtaacacagcctaatgagtggtgtgttacaaataaggatgcttcctttcagcagaggtgtactaaaaaaattaaaacaggccaggcatggtggcttacacctgtaatcctagcactttgggaggccgagatgggtggatcacctgaggtcagcagttcaagaccagcctggccaacatggtgaaacctcatcgctactaaaaatacaaaaattagctgggcacggtggcacctgcctgtaatcccggctactcaggaggctgaggcaggagaattgtttgaacccaggaggcggaggatgcagtgagtgccactgcactctagcatgggtgacaagagcaaaactctgcctcaaaataataataataataataataatattaaaaacaaataaagatggaaaccttattcccaaagagttcagtctggcaggacaaaacagcaagtgactgcaacagcatttaggcacaagctgcaatgagggaaagaacatctcaattcgactgcaagagtccgcaaagacttcaaaagaggtttggcctgaactaaatactgaaggctgagcaagaaagaggtcagaaatgggtgggaggagaacaaaagcagcatatgcgaagaacaaaggtattaatgtgtatgttgtgtttagaaaaatgcagaaagtctaaatggctgaaaagtaaaatgtctgtgaagtgggagagaggataaatgatgctgctagaaaaagatcaataacagattatgaagggcgctaagggtcatattccttttgatactgccaagtaaatatgggtttttagcctgaaaatgtgatcagatctatgtttcaaaagatgagtaatgagagaatggaaaacagactaggcagggagagagatatggacaggaaatctaattaatgcaacaggtcaagggagaagcgaggtgtgcataccatggagaaatggcaacagaaacacagagaagggaatgtcacgggcttcagaaagccatttcagaggcagaaccaatatggaagcaactttggaaaatacaggaatgaagtagggtagggtaactggaagtgatgatattgatgcctaagtttccagcttgggagaccagctatgtgaaattataggaagaagagatttggaaggtaaaggtgagattaatttgggaatatggagtttgaggtatttgtggaacattcaggtagaatgaggcaggtggaaatctagatttggaactcaagagagaattctggactagagaaacagaacaggattatcaacatatgagtaaatagctcttttgttcgttttgaactattctgagatctattggagttatacactctccagaaaaaaaaatttatgcacactttcaggaacttcaccaattctctaaagaccattcacagaccccagattaagaactccagcacagacagtaggcaaaagaagatgatgtcatatgaagaagagaatcaggataactagcaatttaagggtttgagttgaggaggaagaaaccctggaaactgagaagtgcttagagattcagagggaaaagatgtgactacataaagttcaatatcacaacagaaagatgttaaaaggaatcaaaactactgaacatagccatgaggtggtcactggacacatctatatagagggctacagttttatgtataaaaataacacaacctaccttttgcaggacatactctctcccaatgacagtttcatgatgagtcataaacactgagaactcaccctctctatcctccattaacacctctttttccaaaactaaagtcatccataaccaatattatccatttgggtattggatggcttcatatttaagtacaatctttggccaaaaatctgagcaaaacgaacaacttgcatagataattccccaacttcatagcaggtagagtttcagctttcctctatcttgccctttgccattaatgtgtaacaaaacatatttttatcttcaagtcctagaagtatcaaccagcaaataccgcctgggatagcctcaactagcaacaacagtactatataactttcaagattatttaagtctccgcctataaaagttgttcactgtccatgtttttaattgccctggcaaatctgcgttatcaggcaaaacactggctgcagtcgatactattattgatactgaacttctaggagccatcagtgagggatctcaagcttgtggaacttcccaagtgggactaaaagtcagggcactaagcaaacgagtgaggccagcagaaaagtaaaacctgctttaagaaaacttaaatatttctaatgaggttagggccacaaaatacagctattttttcaaattctttacgcttctgcaacatctccttttttccctctctccttcattacttttcccccttctttcttcaagctatattagcaattaccaatttttctttttttttcttgagacagggtctcactctgttgcccaggctggagtgcggtggcacagtcacagctcactgcagcctggacctcctgcggttaagtgatcctcctgcttcagccacccaagtagcttggaccacaggcgtgcgccaccatgcccggcttatttttgtataatattttttgtaaagacagagtttctccatgttgcccaggctgctgaactcctgagctcaagcaatctgcccacctcaacctcccaaagtgctaggattacaggagtgacccaccacgctcagcccaacttttctttaaagaaaagaaagcacaagaactttggtatgtttgtaaaaacatctaagccatgttcacatcagtccttatcataaatcatcttttctctgacctccctccaatcaaaattacctagaagacattttagaaaaggtgtttctttttatttcagaattaacaaagcaaaagattatgtttaaaatctcaattcaagggttcagacaaataatataatactatgatccctttttctgtaaaggaaaagagacaagtcacaggtaggcttagagcttcagctccctggcctgcctggtggtattttccactgcaaggcccagagagttaacaggaggtcagggcaagagacctgttctttagctgaggcagtaaatatttacagttcttcacagagcaagccatcagccagaactggaaaaacatttctttatagttatctcacttgtcacttataaaaatgcattttagaattctcttctctatataaaattaacagtctggcaaagatatgtagttttaaaatatggaaaaacacaaattggtgaagacacccctttttttattaaaaccggatacattttcagttttttcctcactaactcgaactccacccaaaattggcaaacttttctcccagttttattacttcagcaagcgatcttttcttaaatatttctaccttggtcttactataacagcattagtaactgggaaaaaaatacaccaaaagaaaaccaactgtataaagcacctggccaaagataactcaatgtttaagagtcgcacatatttacaataacatacgggaaaataagttggactcatcctaacttttaggtcaaatttctgaactttagacaaatacaactatgttgaaaaatcagagacacattttgaaagtaatgaaaaatacaatacatataaaagattatttcagagaagacattttgtagaaaagagtctcccaaggaaattgatggagacattggaatagttacaatgaaaattagcaaaaaaagaagggaaatttctgaaagacaaacaagagggagtaaaataaattttctccaatttccaaaagctaacaaaaaagaatcatttgtgtgtagacagatttagacaataggcagtgctaatctccaagcatttctctttcagcttaaggaatactgacttcactcgaaggaggaatacagtgcggtgattaatgaacacaggctggccgggtgcggtggctcaggcctgcaataccagcactttgggagtccgagacaggcagattgcttgagcccactagtttgagagcagcctgggcaacatggcaaaatcccatctctactacaaaaccccatctctactttaaaaagagcactggctctggagccggactgcctgggcctttctggctgtgccacttacgggctgtggcacttcaggtgagcaacttaattaacttctctgtgactctacttccttacctgagaaatgaagataatatgataaaggccaccttgcagagttgttgtgaggataaaataacttatttaaagtgtttagacagggcctggcataaagtaaatgctatggcacactagcttcagcgaagcttccattgtgaagtgcataccatattgcagatccaaattctgcctatattccagtgcaagaaggtaactctgagaggcagttcaagtttcagtcacattgttgcatgtctctcctctgcctgtcagcaagttccacccaactaatctgcttcccatatatccttcccacgttcatcttcaggggctccctgccatgtgcagcagacagccagagttcccaatgatggtgcacaccaagctttccaatgtgaattcccaccaacacccccaaaacacttggaacgggctgacctagccaccgacccctaaatgacatcatggccactccatttccaaattccttctaactgtatcatcaccaaagtcttttaatcaattgagaccggacgcggtggctcacgcctgtaatgccagcactttgggaggccgaggcgggtggatcaccaggtcaggagttcaagaccagcctaaccaacatggtgaaatcccatctctactaaaaacacagaaattagccgggcgtggtggcaggtgcctgtaatcccagctactcgggaggctggggcaggagaatcacttgaacccgggaggtggaggttgcagtgagccaagatcgcgccactgcactccagcctggggactccgtttcaaaaaacaaacaaacaaaaaaaggaatcagttgaagccctctctctaggaatcttctcaatgattctgatttttttttaattcctatttgaatatctgtcttataggactcatctggtacctacaaaaatgtgtgattagctctatgagtgttttcatgccctgcaaaactagtaaatgtttgggacacagacagtgtgctatatatgtctttcaatctttctcattgataagccaacattacggactcaattaaaattctctcagttctgaagaaatttaaacacttacctgaaccgtgacaactgcggctccttggcatttcttaccgctgctgcctctgcactccaaatgtagtgtggtctgttcttcacgattcacatactgctttggcattgtgtctaacagctcaccatccagagcaacctgctgagattcccgaagagctgcggttctgaaaaacatcatcaggaggtaaaagaaagtcttaggaaaggttatatgataggtgataaaggcttccagttacccacagccagcattatagtgcagcaaaagacacataaaccatagtaacagaggaccaaaggttgtgagccaagacttacccaaatcatcccccagcagagaggctaaagagaaagctaagaaatgaaagaaaagcctatagagaagtgagacaacttgatagccacaaacaaagctccatttagaatccatgttataccaacagaccctacaagaacaactgagaattctatcctaacttcatcaccctcaaggggtgccttaattataagtaccaatgacttcttaggtattagcaactcaaaacgaaatgtcaaagaccaagaaagctaatcgcatacatggggtgtcaaaactggtctaacggtatgtatcattacattaatgggcaggtgcttatatgtgcactcaacacacacgcaacaaatgcctggaccaaaaacagacaaggaaaaaaatactgataagaaattgattcatggcctggcgtggtggctcacgcctgtaatcccagcactttgggaggccgaggcgggtggatcacgaggtcaggagatcgaaaccatcctggctaacacagtgaaaccccatctctactaaaaatacaaaaaattagccaggcgtggtagtgggcgcctatagtcccagctactcgggaggctgaggcaggagaatggcgtgaactcgggaggctgagtttgcagtgagccgagatcatgccactgcaccactccagcctgggcgacacagcaagactctgtctcaaaaaaaaaaaaaaaaaaggaaattgattcacataggatttgtaaaagtaaggctcgcttactgttaatgaaacagacttactccacgtacgctccttctcacaagatctcaagttagatcaaaaccttaaatggttgatcatattgtatccaccttgtgaactcaaaacaatgacttttccacacttcaatcaatatttatgtcaatttcttaaagaatatggagaagtagagagtacagcaatgagaaaagaaaggaactcttacttcacacctttccaacatcatctttccaatatcagaagatctcttcatgagaagcatacgaaaatcttagctggcactgctgatgctcagaaatgccaccacaggaaatgtgaaattgatagttggtgagagtaccacataatttcgatgtgaaattataagacttgtcacaacttggttaaccaagtgaaccgtctgggccaggttggtcaaactatcctcattgtaaaaatgctgacaaggaagccactccaggtagcaaattatccaggctgtcaaagccaccaacatgggaacatgatccgtgaggctgcatggtcttacctggcctgctgttgcaacagattcaggtctgtgcacaccagctgggtggcgtccttctgactcaatagcacagcagaggaaataactggcacaggaggcttcgtcgggtgcagagcaaggggaggctggggagcctcatgcttccgcaagttacttaaaaccctttctttagctgaaagaaaattaagtcatatatactgagcaatcaggtgaattagcaggagaacagaagcatgtggtacaattcagtagaattcctatcctcaaaaaatttatagtcttacgatagttgaagagttaaagctcatgatcttaaattattaccctagacaggccttgcatgacatgctaacaagtttggacttgatattagtgtaaagctactatctagtgccttacgctaatatcacgtggatctagtgaacacctctatgcaagcttgaatcagatggtagctatcatctgaataatggtttaggtaaatggagtaggtctggaggcaggtcacccagttaaggttttaatgccatcatccagaattcagaggaatagaagaaaaaggaataagcgttatggaatatagccgagtcaaaaatctgaaatcaggtcaaggtttgaacaggaggactggatgcagtaagagataaaatgaatgaagacatatgcataagctccttcagcacttctatttatgcagtcatatagtccatcagtcatttattcattcactcaacaaatgatttatggagtccaaataagcaatcctgtgccacacacacacacacacacacacacacacacaaaggtgaatctctaccatgcaactttgccctagattacacatgatctcatactgtttaatcaaattcaaatgtttgatacttctagacttagtacagagctgaatacacagtagatatccaatagattcctatcttccctccctctcccttcaccacactatacacataccacacagcaggtggggactgaataacatgaagaaaaatgctgctacctacccaattcttttcaatagcaagaaacagaggaaggcagtggtcaagggaatttcaagtcagtaagtcaagtcaacaagtacttaagggactacagtgaatttccgattacattccagatgtaacattccattttctattcttgttgagaaaaattaaagaaaaattaatagccatgactttacttggcataaggagacttgtattgtttgtaccccaaacagatggaattcaacatttcaaataggtcaagtacagcactatcccttatagttagtgtttttccactagaactaactactctttgcacagatgtaaccaagttaggtattcaccactggataagacttgttactatttatgttaaagttcctttcaagcaacataagaggccatgatgctaaaggaaaactgggggctctttcaaacccaatataagttaccataaaagaaaaaccaaggtattttaaaaacaaacaaacaaaaaatctaaattcatatttaacagtaatcaccactctggaccacaactgacaaaaatattgaagccaataaaacaaatttagtttaagaaaaagaaattgctatcacaagggtgctagtgaaatttttcctacaaccaatcataaccacaaattaaatcatttgatataatcatcaactaatctcttatatctgagaaaaacctgaaactcactatttagaagtataggccctaattttgtttagaagtacaaggtatcaccagacacaagaggtagaataatgagtggtgaacagcaggtctctggagtcagacggctctgcccaataaccagctatgtggcccatgcaggcaggtcacctaacagcttacaaattgggtttcttatctgctcaatagggataacctaacaacatagggtttttgtgaggactgagttaatgcatataaagcactgagacagtgctcggaacaaacgaagggcttcataaattactagcttaactccagcgaaaacaattcgtattttagggcagtgttcaggcaacatagaaacactatgaatggaagggcatgaacggaaatcatttaatagttcccagatctgttcatatatttcttcttcttaacaaactttcaggaatagaaaaatgagaatctacgttgttggcttgagggcaattttcatccctttctctatatacctttctatatcatttaatatttaaaattaatatatatcttttataatcagaaaaaaaattattgtttcaagaaaaagtgcagggagaggaaatgttggagggaaaaattttagagccttagaagaaaccagccagcaccattttacagatgaatggcgtgaagtccagagaagttcttatttgtctctcttcatacaactaacgcgttttggttagtggcaagctggaataagaaggtattctgcatttctctgaatcacctcagtgtcttcttacactatatattgtaataaatattttggtcaacaattgaatttacaatgatatgtcctatatttttgaaatatagtcagtaattaaaattaataggttaccccaaatatcagcaactttataggttaaatgggcttttgtggcctgatagaaaactaactggtaatttataccactgtttctctagaaaaatgtactgggagaaacaagtaacttagaaacttcaggaatctgattcatttgtatggtaagggttctaggtacaaaggaaaagagtttataaaagaaaaagacagacttctgattttcaaaactgcaaagtaattacatttacagttgcaatttacaccattgtgtaagtcaactgaaatctctttttaaagcaccagaggaaaaatgaacactgggggaataaagtatgtcagcctcaaccctcaatggctctgattcaatcattcattcactcattcgaaggggcaggtgctcccaggacccacccagcaaaggatcagtgaagtccagctgcacggacaaactgcagggtgtggaatgggactcaagcttggcctgtgtccacagaccaacagtctcctgaaactcatgatagatgcgctccatgttcaaatactccatccacagatcctgaaacagaacgacagtactttaactctgacagacaagtcatagattcacatataaaactatgtatttaactataaagtgaaccagtaagtttcaacacgaagtggtctactccaagtcctccaccattaggataaattgccattaaaatgaccactctaacaatccctgcagtagctgtaaaacttttttgattgtgtatcatgattagaaaaaattttaacagccctatatgtatatttgtaaattatatacatacactataaagctaatacattatgtatactataagacataggtaaaaaatagcaaatgttaaagaggtaaaaaataaaatgttaaaaaataatcaaatctgaattagatcaagacactaaatccaactatcaatttacagtaaatacaggggacagaaaaacatgttaaactacaccgtgaagatacaattagcaaaatccatactgtggggagcctctatggacaaactactcagtttcttcaacaaataaattgcaaggaaaagtaaagggataaggggaggacttgtagattaaacagacttataagacatatcaaccaatcacaacatgtggatcctgatttaaactatgaaaataaataaaaaaaaaacttttatgacatttatgagaaaggtggaaacttgaacattgactaaatatttgatataaaaaattatttctaatatgtttaggtatgctattgggttatgtcatttttttatccctatcttttaaaatcttcatgcatcaagtgctctctgggattacctccaagataaaatggaagaggaagtggatgggctatagatgaaactagacacatggcatatgtggggagggggagaagagcatgcccattatactgctctccctattttcctataaaatggaattttttcataataacaggtgtcaaataagtaaataaataaaatgagaaaacaataaatatagtagctctagtaacctctccctacactcccatgggctgtcttgcatattctgaattatatatatttcactttggtgatcactacactttagaatgggggactgcctttaacaacaacaacaaaaagtcaaattatcaatgaactttaaatagtaatagcaagtgagcaaacagggactatgggtttgtggaccgtgattttttttggattttaagtgttctaaaggcccaaggatccctctaaaccaaaaaatgtccttggcttctcaataagcatactgctgtgaagtcccaactcattatttccaaaccaacctcacagtccaaggcattccagactcagaggaggagctccaatgtaatcctgatcacaatcctgaattctacatgcagctgagtgttcaatgtgctgggctagatcctcctattgcatacatgctcctttaaatagggtcactctgtcactttctctgcctttatgccaagtaactgttaacagaggctaatgaatagagcaactactaggaattaatgataggtaagcagagacatcttataaaccataaaaatacaaaacaaccctgagcttgaattacagatcaagaaattatacatcaagcaccaagcaagggctgacttaaaaagaaaaagagagagaaagcaagcaattaattctgttgatgctgaggaaccaggataaatctcagagaaccaagaaagctatggctaatttttaaaaacactgaccaagtacctaccatgtacaaagccttggatatggatgaggggtgtcaagcataaaaagatgaggatggaactgaactcaaaggatgtcaggacaccatggtctcatgtgtatttttcttgtttctctggccctatactctcagtcttatttctctgtgcgttaaatgctgttatctctcaatgttccatcttcagtcctcttcttaatctacatattctcttaccactaaatccacatatccgactttgcctcattcctgaattctagatatatacctccccttctgaccaactccttgatagagagctctcgttgaagcccctcaggcaccccctcttccagggtttatctctgggggacaaagtcagaaatttggaagtctttgggtatctgattcttcctcgatatatttttaattcatccatttgtttaataactgctgctatttcaatagttctccaaacaaagacttcaaaatacaagccaaattatttagaaaagtatacatggcccttagggatttcattcctactcatctctctggtttcatctgccccgcctcaggtgctatgccctaccctgcacctttctgaacatgcccatccctttctcacctgctatatgtcgctgcacatactggtctttctgcccattaacatcctctctgccactccctaacaccatgcctttcctttccatctgcccaactcccatttgtccttcatggctcagctcaaaggtcaccactccaggcccaatccaaatcaggggctattcccctatgtttccatagtaccctgtgcattccactctcgtaatttttttttttttttaagacagggtctctctctctgttgcccaggctggagtgcagtggtgcaatctcagctcactgcaacctctacctcccaggttcaagcgattctcctgcctcagcctcctgagtcgatgggattacaggcgcccaccaccatgcccggctaatttttgtattttttagtagagatggggttttgccatgttggccaggctggtcttgaactcctggcctcaggtgatctacccacctcggcctcccaaagtgttgggattacaggcgtgggccatgcacctggcccataatcttgatcacaaaatgtaataactgtttgtttagtctcctgttggccaataagctcttaggaggcagggaatgtatcagatttctttttgtatcttcggtacctggcacttagaagacactcagtaaatacacacagaaggcaaggaaagcaagaagaaagaaggcaaggaatgaaggaaagaaaacaagaaaaagacacctactggagataaaatatacacatgatgtgaaagtaggagggtttaaggatccaaatgaaagtgtttcaactcttagagtttcctaaatcccatcctggtgctggggtcaatactcaaaagactgcagccctagaaaaaaaagaactagaatagaagagaattatcttccccactttttccctgtccccaagatggctagaaaagcttagagaaaactgacatcacaagttttggcctgaaaaagggtcacagacatctttgagtgcctgggggagaacagcttaggacatacgaagactgaaatcaagtggttccagaagagcaatcagaactgtgacaatgacaagtaagcacctccaagccaaacaaaggtgagctcctgatctcctccatgcaaccaacctcccacatcacatatggatccctacaaattcttacaaattcttacactgcatgtaagaatgggagtagagataattgcttaaaggtattcagctactaacaacttccaattaaaaaaaatatacagtcagaggaaggttatgtttatgaggtcgtaaaaagccctagaacaagcttcaagccttcaggtagaaggcacggtggggctggagattcaaaagggagtattccctccatataatcacttagatactgacaaaaccatagaaacaatgaccatctgagtgactacccattttcttatcaataaattgttttattatgaatatgaccagttcaaattacattcagatatgctaaaaaaaaaaaaaaaaaaaggagggctataatttcacctgctgattctgcatcacttttgctagcctgtgaatatcataatgctttggtagagaagggatataggtatctcctttttgaaaattctcatcttctagccataatatatatacattgaagagcctaaaagataaaaacataattatacgaaacataaaaagatgagcatacaaacaaagcttcttacatctctaggaacactggcacccctacataagagtaaagaaagcccataatacagaaaatgtggccaacaaccaccacggctcccagagaactcctggtccagcaggggaggcacgtcacagattattcaaatatgatgcgataattgctaaaacaaaaggtatgaagaaggggctctgacaacaattcttaaagtagatttaaatacagtacacagaaaaaaataactggaaaagatgatttttaccacagacctgggatctgaatctggagcttttctttcctaggcaattcagtcagttatttttgcttagaaaagcaaaaataatacattcaaataaaaacattttcagagaaaatattaagagctattttaaacttatgcattgtaggaattttccagctttaggctcaagaaccatctcccacctcagagaatcgcaaataaatatcacagcatgtgtgtacgcccctctcatcaagaaggaataaaatcaaatcagacttaaaaaaataaaagttctggctgggcgcagtggctcatgcctataattccagtactttggaaggccaaggcgggcggatcacaaggtcaggagttcgagataagcctgaccaacatggtgaaagcttgtctctactaaaaatacaaaaatgagccgggtgtggtggtgcacacctgtaatcccagctactcaggaggctgaggcaggagaatcacttgaacccggaaggcagaggttgcagtgagccaagattgtgccactgcacttcagcctgggtgacagagcaagactctgcctcaaaaaaaaaaaaaaattccaattttccagtaaaaaccttttaaaaatacaatacttccttcatttttattttgcttttgtttttaccagcagtgctagaaaaatagtcggcaaatacacaaattactgggtaggggactgggagatggtctggcctgactttactcaataaagtggaaaattacctcctttacctctgcaacagccagtccaggaagacagacaaggacagggctttggggttcttacagggaagaggttgctaagtagttctctcctccagcttctggctcagtgaaatagatggccactttatgaacacataccaggagggggatataacagaggcagaaaggaatatcaaagactctcttggcttatctaaaatattcacagagaaagccgtccactggttaaggctggttaaaaataagttctccttcaacaagcaacataagggaagaaatcattctggaggctgacagagagtcgtaaaaggttgagggcaaataaacctaaggcctcagtgctagatgaaatggggacctcacctagctattgtgtattgaggattaattcttaagagccatttttattaagtcttatttgtaagactagtatttgatttatatcaaacttataaatgaaaggggaaggaatagtgtgaaaggaatccaaacctacttcagagttcttaaccttttagaggaggcaaatattgtaccctgattttatagggcacatatttttgggagattactagacccctcatctcaggtggatccctgaatcccgtgaaggatctatgaaccacacttaaagagccctgccctggtcatttgtttcttttgaagagctattctaagctacgtgtggtggcacacacctgtagtctcaactgctcaggaggatcacgtgagcccaggagtttggggctgaggtgcactatgatcgtctcactataatcgtgcctatgaatagccactgcattccagcctgggcaacatagtgagacactccttcttaaaaaaagaactattctagcaaggtttttttgtaacagagtctcactctgttgcccaggctggagtacagtggcatgattatggctcattgcagccttgacctcctgggcttaagggatcctcccacctcagcctcccaagtagctgggaccacaggtgcacgccaccaggcttggctaattttttttttattttttgtagagatagggtctcactatgttgcccaggctgtctagcaggctttaatagttgtttacctgctatgataaaatttggcttatttctatttttacgtaaagaagtagaagaggatttatcgctcagactacaggcactcgacacaagtacatccaaactgttgattcagttctcttgaggaacataaaagagaaacatttcaagatgcaaatctatatcaaagccaccttccatattcaatctaaccgtgttaagagaataacatctagcagtttgtaacacagttaactgctccagcatagtacctgtgctgcaaacaacaatgtaggtggctaaataaccatactcacctcaccagctccttgtgcagttctggtgaagtcaggtaaccaggggtgccagagtggctctctggcagcccttcactgccctctgctggaacacggagggccttgcttgcagcatggtggaagtcagccacctcggtcaaacgtctcttcatttctttcaacaaattgatatgagcaggactttgaaaaaaccttcttccaatacaaccatctatgggtaaccttaaaaaacacaagcacagatctataacctttcaacacaagatgtactttctgtatggcataaaatagcagttaattagcaaggcaatttactgtgattgtggatatacaccattaaattaacacctattatttctacctcaaagattattttgatggtccaacaagatggtgtatatgaaagtagttttaaaaagtgtgaaatgctacacaaatttaagacatcactacttagaggtacagcataaagatggtttctattcttgaagaacttgcaatctggcaaaaactaaaacagaagcgactaagaatctatctatctatctatctatctatacacacacacacacacacacacacacacacacatatatatatatatatacattttttttttgagacagagtctcgctctgtcacccaggctggagtgcagtggcataatcactgctcactgcaacctccacctcctggcgactctcctgactctcctgcctcagcctcccaagtagctgggattacaagcatgcgccactgcgctgggttgtttttttttttttttagacagactcttgctctgtcacccaggctggagtgcactggcgtgatcacagctcactgcaagctccgcctcctgggttcacaccattctcctgcctcagcctcctaagtagctgggactgcaggcacccgccaccacgcctggctaatttttttgtatttttttttttagtagagacggggtttcaccatgttagccaggatggtcttgatctcctgatctcatgatccacccgcctcggcctcccaaagtgctgggattacaggcgtgagccaccgcgcctggccgtgctgggccaagttttctatttttagtagagacagagtttcaccatgttggccaggcttgtctcgaactcttgacctcaagtgatcctccctccttggcctcccaaagtgctgggattacaggtgtgagccaccatgcccagccagtatctatatatttcaaatgagtaagttaagggaatgaggaattgaggcaggagctagagagcaatggttcgtaatagtggatggctctggctgggtggagtatcttcatatgaatcccatgaaaatgctgaatattcccaagtacaacctacaggtgacagacaaagcctggcctttgttcacacgcgcaccactcatcacaaggtcccctcctacaagccccatgacggtcacacaggcagcctcagtttaaggcagttgctctccctttgcatctccagaagttctgtgtgaaaccttgcccaatcccagggtgttgtctttactacactggtcatggaagatggtaaagagaagctgccacaagacaccagcaactcaataaagatccagtctaataaatgtcaaacatagagacagagaaagagtcctcaccagagatcaccaaagaatgattccaactcacactccacagtctaagaacacatagaatgagagcagtgcaaaggcagaaatggactcacagaaacctacaatactgggcagcatacccatactgtggtcccggacggtgaagatacagaaggaagaacttctgccaaatgagtggcaggagggggtgatcagaaggtgtgaccagagcctggtgggcccagcgataaatcagcagcctctggagggatggcacgatggggagcttcagctgggtctgggctttctacaaaaaagaaagggctttgagtagccacaaaatgaacataaatgcaaacggttaactctttctaagtgatccaactgaaacaccaaacattctgttttcaattcaataatatattttttaaaagtcacataaaactcacttctccaatccactagttaacattttaacctccttggtagcaagacatgtagggcagctttttattctgtcaaaacacttcacagaccccaaaatgggtatgggtcttaagagtcatctagtctaacctcattttcatttctgaaattccttggcgaatacaacgttatagtgcaagggaatagaaagatatgaaaaccaaaagtaaagccggggacagtggctcacacctgtaatcccagcactttgggaggccaaagcaggtggatcacttcaggtcaagagttcaagaccagcctggccaacacggcaaaaccttgtctctactaaaaatagaaaaattagctgggtgtggtggtgcactcctgtaatcccagctactcgggaggctgaggcatgagaattgcttgaacccggaaggtggaggttgcagtgagctgagattgtgccattgtaaaattccagcccgggcgacagggcaagactctgtctcaaaaaaaaaaaaaagaaaaagaaaaaaagaaaatgtcactatgtgactgtcaaactttatcaatcttttgaaaattcagatttcaaaaggacattcgagaatgctgaattctttgagaggctctgaaacccaaaagcaaattctttaacaggctctgaaacccaaaagcaaaatctatactaaaatagaaggtctttaaagccttattccagtctttcccacatattagtaagcctaagaatcagctaggagtttcaaaaaataacctccttgtcccactcgagactcagagactccaaatcccagaagatgaggtctaggaatctgctttttaacaagttctccagggaattctgatgtacgtgggatgcaatgacaacacccgtcacatgtgcaatgatccagccttcaaatactaggctgagactcttgttaaacaaaccttgagaagcaagtactcttcaattacacagttttaagtattggtttggttgttgagctttccaaacattcacaacaaaataaaacacaaaagctcaaaagctacgggtgaatccatcagcatcaaagtgtaagccaccttctaccactcaaatgcagaactgctatttgtaccttcagagcttggtcaggggtgaaagcagagtttatcaccaattccccttcaataactctccggagctgggagtcctcttcaaagatggattccatgttgagcactgtccaggcaaaccagacctataatgacaccagataaaggggaggggaaggaggagctcgccccactgacgaaatacatcctgatattccacaatttaaatctcttcctatctcaagctcaatcagcaaatatttgcagtttctaaaattaacacctttttatacctacctatatccttgtcgcagatataaatttaaataaaatagatcattggaaaatgttacattcctttggaaaggctactttagtacaagatgttcattaactccatatttaccaggcaagatctgtgtgcaagagagacaggaaagaggaccagacaggggctctgtctttaagaagtcttccatctactggagtagacaagactaatatataagtaagcaaaatgtgaagttgagcagtgacgaggactgagtcaaggtaaagtgctatatcagagaaggttctatgtagatgtcagagggaaaggcatgctggtaagagaatccgctaggcagagacaaaaagaggaaaagcccgggatgtgtctaggtaacagcaaggagtttgttccagctcaatccatgagaggtgggaagaagagcaagaagtaagacaaataagaggttgaagaacattactactgatttaagagatgaaacagacataattttatacacaaagtctaagaggtggtaatgataaaaataatgctgctgctgatgataataataacaatggccaacactcagtgagcactggttatgtgcgaagcactgttctaaatgctttacatataggtgccatcattattcccatttgacaattgagaaaactgaggacagataggtaggcaagctgcccaaggcacagagctaacaaacggcagaaaccagattgaaacccagactgtctggttccagtgaccactctaaacctctctgcagtgctgctgggcagtctctgcagtccggctggctgcggtatgatcaagagctgtctactcctgagacagtccttaattccactgaacctcagttacagctagacacagtagtgtgcctgtagtccccaaatactagggaggctgggagcaggagaatcacttaacaacaggagattgagaccagcctgggcaacaaagtgaggccctgtatccaaaaatgttttttaatttaaaaaaaaaaaaaaagaaacaactcaggcagggcgcggtggctcacacctgtaatcccagcactttgggaggccgaggtgggcggatcacctgaggtgaggagttcgagaccagcctgaccaacatggagaaaccctgactctactaaaaatacaaggttagctgggcgtggtggcgcatgcctgtaatcccagctactcgggaggctgtggcaggggaatagcttgaacccgggaggcagaggttgcagtgagctgagatcgcgccattgcactccagcctgggcaacaagagcaaaactccatctcaaaaaaaataaaaataaaaataaaaaactcagttaactcctctgtaaaacaggaatggcaacagcacaacctcaccaaagggctactgtaaagattaaatgaaaaagtatacttacactagaataagtgctaaataaaagttagtttagacaattagtaatttctttgtaaggatgatcatgagattaaagttcacaaagataacaaatgatcctctcagtgagtttcctacctgagtgggcgtggccaagccctccacaaaggaaggagtgatgttgcctgccacaatccagcttaccaaagatgagagcagactccggtcacagtggtaacccaaggcattctacaccgggagatgtggagcagagagaggaggttttaaggaaaatcttatcaatgacctttacaagagtatcagcaactgtcttactacaatacaagattctgataagacagagatttcaaggatgagtccaccagcagcaatagtccaaggcagagcattacagccaaatgtaacaagcgggactcttcctgggctgtcctttccaacttccctagggtctacgctagtggactacgattatcgggataaggtaccattaaggcaaagcttaaagaaggtaatggccacagagtagaactgaaaactgtacttgggggaatctttttagaaagctactttatctagccaatcactgaaagataaattctctaacaggttaattaccttatgttgttggtagagtaatttctgtatgcagtcttcctgcatcagctgaaaagctgctttacacaagtggtccatgaggaagaggataggttgttctcggtaccagagatgctggcttatgagagcctgaacccagaactccaacacagcaacggggcccacttcattgggctgagtgcttacagatatgtgtgcctgtggagaaaaggctcatgtgatgggaaagataacaaccagcctctcattttttaaatagcaacaaaatgctatctacctccactacaaatcccaaatctattgcctttcttggccaaaagcacactaagccaagtgatctgaaatgactaaaacctaagtgtgctaacgctagaggtcttggttgggaagacaggcgggagtgtgcttaggggcttgcaaggccctcacctggatcatgctgttgagaagcttcacgttgtccccatggctggctcctgtcaggtgctgtgccaccttgtgggtgacctgttgtgtgacaccctgagggacaccgctgtccaagtgtaggaacaagaggagatgcgataaaaacctgccaagcacacaggaggacgcactttaccttccgatcagaactcaacagaattttccctaattacttatgaggaaacagaaaattcctaaattggtcccatttttcgaccaaagcactatttaagaagggattctagaagaataaagttttcacatttaacatgggttaaaaggaattctatctacccacagaggtattaagaacagatccacgacacacaaacacatgcaagttaaacagcattagaggaaaaacacccaaaggcaccactctcccctcctcactccccaactccatgaataaaggcagagatgtttccaaaccattcagtttccaaacttgcctcatacccagggtgctgattcttaaaaaggggttgaagggttaggtgagtagttcccaggacctaacccatttctactaaagtaacatctccgggggagaaacctgggaatccatatttaataagctcttttgggcaaattggagacatactgcttgaaaagacacataacaggaaaactgtaatgctccccttgtgcctttggatgtacttcatgtccccactgtacagggttcctccatatggggtgaggcctcacctcccctttcatcactgttcatgaggccccagccagatgctttactcttgcctccctagacaggttgttctcttcccaccttcctagcatcttatctgtttgcaacactgcactatgtgcactgtaaacaatttaaaacaatcttttctattgttacaatggcaaaccatttgctgcttaatatcagaagcacgattcccagaatctcagggaaacaactgctccttcatatactattaagctttaataagcaattcaaagttataataaatgaaaaggaaaaatatctttcatggtaataaaactggagtcattattagaatcactgttcatcaacctgcattctaaactggggtgcagaatatttttgccccataatacgctgttgaaatagcattccctttattttacttaagaaaccagaagacacaatcatttgtacttgctggactgtttaagagtgtctcctgccatagatggaacacacttactgctcattcttcagaaggtaatactggcaagggtaaaataaaggcagaatcttatccaggacatgaaccactgttctcaaatgtcttgactggaccagaattcccaatagtgggatgccttctgcacagaacttctcaatgctatggaaaaagagaaaggcactgaatacacaagggagctggttcataaaattctgttcttccaatgagttatgagccttcaataccttgggttatctcaggtctccaacacatgttttatacccaatcttcacacagaaatactaaacccagaattctagaattgcaaagaaacttaaaagttaatctttattttcattgtatggatgaggaagggtgaagtatcatgcccaaattcacataatttcctagagtaaggtcaaaatgagaacgccagtttgcaaatttctaatccagagtgctctctactaccatattttatttctcaaaaagagcttctcctaagagccgtagggactctccttgtctggatattcccacaaggtatcacagcaaagaggagactcaaaagtgacctcaatctgtcagtacaggttgactatcccttaactgaaatgcttgagaccaagtattttagattttggaacactcgtatcatacttaaaagctgagcatccctaatccaaaagtcccaaatccaaaatgccccaatgaacatttcctttgagtgcaatgtcagaactcaaagtttcagattttggagcatttcaaagtttagattttcagattagggatactcaacctgcataaactgcaaaattctgctaaaaccaatttggcataaaagttttattctctgcctcacttcaaagaatctatccttaaaaaataatctcaaatacggaaaaaaatataaaatatgatccatataaagaggcgcttttcaggtttatttttaactctaaaactgagaggttgaaaatgacttaaggcaattttagaaaaatcctttcaattggaaatattattgtatcattttaaaataatacacatgatgaccaaaggcaatgtggaaaaacacttctgctataaagatactagggaataagacataaaattttatactcatgatcataactactagtaaagaaaagttatttgtggaggcgaatacagggacaatgtcacaacaaaagagtcattgtacaagagtggcagaagtgagtggctttttctccactttcctaattctgcagtttggttatactgctttaattctgggggagaaaatcatttcaaaaaataaagtaattgtgcaaaggttatgccacaaggaagctacttacaattgtaaagtgaaaaactaaggatataaaattatacatacatctttaaaaagatcaaaggaaaaatgatggatgaaaataaacagaaaaaaaatcaatgattttatgatgggaaatattctgggtgattttctgacttctctacaatgtctgtaatattatattcacaaacaacttatgtccctgcctactccacccatacctaagattgttttaagttacttctatattccagtacacctaatcccaaatgcccaccatggagttttacactagagatcagccctgagaggaaatgctcattctcactctcactcccattcaggattcagtgatcagcacaaatcaaaagttatctctagagagagcccacagcagtatcagtgaataaagggctatggtcccagaatggatacaagaaattcgagaaatcataaaacacttaagttcagataactgcactcaagagaatcacgtcagacactgttctaggcatgttacatgtgtggttttttttttttttttgagacagagtctcgctctgtcgcccaggctggagtgcagtggcgcaatctcggctcactgcaagctccgcctcccaggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccactgcacccggcctacatgtgctctgactcacttaagcctcataaagtaagtttggtgttattagtactcccattttagagatgggaaacctgaagtacaggaagccgttaataacactagagctactggaaacaatataaagagtatgttcctaaggacccttatcaggtctcctcttttctaaatcaattctaccttcttttacttagctttcaaatctctccataatttggcccaaccaaacacctgatcacctccattctccaacatgaatcacaggcgtcagtgagaagtgtttcctcatcatttcccttcctctccccttacccactcagacacctgaggctcctttccacattcattcaacccaccagcatttgttgaatacctactaagtataagatctagagatacacaattgaacaggacaatgtccctaccttcatagagcaaacagtcaatgaggagcaggggagattacaatgacaataaaacacagtgagtgtgctgttcagaatgtacaggggctgcaggtggcaggagatggcccttgaagtaactgtgggcactaagtaactgtaagaggaacacaacatcactctgctcatcagcctaggatgttgtcttagtccatgttgcactgctataaaggaatacctgagactgggcaattaataaagaaaaaaaggcttatttgagtcataattctgccggctggaagactgggcatctggtgagagcctcaggctgcgtccacacatggcagaaggccaacgggagctggcaggttcagagatcacatggtgagacaggaagtgaggaggaggcggggtgccaggctcttcttaacaaccaattctcatgggaactaagagacaagaactcattcattactgagaggatggcactaagacattcatgagggatcagcccacatgacccaaacacctcccattaggttccatctccaacactggggatcaaatgtcaacatgaggtttagggggacaaacatccaaactgcgacagatgtcttgtctaatttaagactcctttccaaaagtcagctcttccatgaaggtatcccaccatactgatctctccttcctttacattctttctgctcagcttctaagtagttctcaatccagggtgtacattagagatacttagagaactggcccccagcccacttaggccaggattctcacccttttccctgcactgggatttttaaaaggctccaaaagtgaatctaaagaacagcagaagttgagaaccactgctttccacacatcatccagcctgcaattatattctatagtactgccgatttatttatgcctatcatctcaacaaaactgtcaacaacccaaggaaagctatcaaacaattctttatctctcctacttcatagcacaacgctgaagactacagctgattgcaactggtatcccactgaaattacacttactgtggaacaagatgttgaaatgaggatgctaaaaagtgttacagtgagtctaaaacataagaatcagaaagcagaggtcaaagagtgtgaagacaaataaatagactagaaaaaaattaatgcataagaaaagaatctttaaagagaaggatgtttaatcaactgagaagtcattcatgcattcaattatttactgcaccagatatagtcttcatcactagtgataaaatggtaacacaagacaaatgccattcctgggcacttctctcatagaagttatatataactgaatctctgagaaaattgaacagattaactatgatatagtgtgataaatgctccagtagaagacatacagacagctatgggctcatatcagagaggcatctgacctagtcaggcatttcattcttctagacagttaaggggacctctagttaagaaaaccaaacaccacatgttctcactcataggtggaaattgaacaatgagaacacctggacatagagcagggaacatcacacaccagggcctgtcatggggtggggggctgggtgagggatagcattaggagaaatacctaatgtaaatgatgagttaatgactgcagcaaaccaacatggcacatgtatatgtatgtagcaaacctgcacgttgtgcacatgtaccctagaacttaaagtaaaatttaaaaaaaaaaaaaaaaaagcctgagttgggctacgatcaatttttcaaaaattttactacaggtgatcaattatttttatttgatcacaattctgaggaagacagtacgaatctactgctgacacgaacattccactccaggagacaagcagaactctcttcataaagtaacatttaggtgacttgcttgtacaaatctgaagtatgtgaatttgggcagcatctccccttgataagctgttaatcaaggattattatttggcccaattgctccgcaataggtttgacagaggcctcagaacttgggatatgaaacataaaattctagaactatctgcaaggttcagtaaccctagtggttcagcccaacactgtacctgtggcccacagctgtcatagataaggctagataacagccaatgggcatgcccgctttcacagccttcaagagaggatgaaacgtgggtgactctgtcatgtcaggcacagtgacggagaagggaacagctggacaattcggctgtattccataatcgtttttgtgcagttttagcctcaagattaaattccaggcccattggttaaatgaggtctcgggtgtctctccatatcgaacaatactggccaaatatgaaacctaaaacaattatttattttgagccacattagtcacacacaaattaaatcagtaagctcatacactcatctccttttgtgaccaacaatgccctcaacgcagaggaatattctacttgctggtctccaattaatgttcactgcactacatcaaagcaatttttcactcgcaacttgcgcttacttgctagtcactttgtgaacctgatcttagctcatgtaaaagaaaagtgacataaaagttgatactcaatgaatagtgtgccgataaataagtttaaccatcaggacggaggtctcatatatagcgcttgtcaattttggtggtgtaaaaattcccaccatggtcaattttaagctaccaatggtttaataacctggcttgcaaagtttctaaaaatttaagtcagttctccagagccagtacaaccaagctctaacacaccactgcagttcaattcaaattctgtaatattagaatagttatatacaggctatttcttaaagaagaatctttatcaaaccatagaagtcaattataacatcttaaattgctagaaatgttcttaggatacctaatggtcaatagtataagtctatcatctttatttctaaatgtcttgggaagataaagattcatgtttccaaatcagaagagaaggaaatacctgcttcatactttcagagagaatcccagcatatggcttctgtgcaaggtacttctgataagcttcaagaaccattaaagccacttcagcatggactgcttgatccagatgaagggtagccttttaaagagaaaaataatcacaaacatacaaccttggttttgttttgtttttgtacctttgaatcaaaacattaggcagaatagtaacaaaggatcttcgatgtagaagctaaatgttccaaaaatcacatcccacacagtcaaactataaaatgacaatgggcaaaaaactgtcaagggcaataacactgtacctagataggtttgaacctgacttaacccctactccagccaaaaaaggttatctttgaatgtcatcccccattccacccaagaatctctacaaacacttcgggtcaagggcaacgccacaaaccaggaagatgcttaattaaacagaaaaatatttaatgaactgtctaggcgtggtggttcatgcctgtaatcccagcactttgggaagccaagacagacagataacttgaggtcaggagtttgaaaccagcctggccaacatggtgaaaccttgtctctactaaaaatacaaaattagccaagtacggtggtgcacgcctgtagttccagctacttggaagcctgaagcagcagaattgattgaacccaggaggcagaggttgcagtgagccaaatcgtgccactgcactccagcctgggtgacagagtgagattctgactcaaaaaaaaaaaaaaaagagaaagatatttaataaattatgtctacattcccttttcctgttctatcattagttacaataaataagacactcagcaacacaggtaaaatattccttctgatgcctgaagttgcctatcaaatttcctacactatcttcctttgcagcctggaaaaatacattccttaaacctttcagaaagatgactttcctaactcttaacaaaggcataaggagactctcacgcagctcttcaagaggagagcctaggtgattctgttcacaagccagagaatgtgaaggtggaaaacagccccctgtagctcttgcctacgagcatgtcaatgagagagggcccagatgaatctatgggcagtcccaagtggtcaaggacacctcagcagaaaagctcccgggcttcagtttcctcatctgcacaacaggtatcatgctgtccaggactaaatgacttgctcagaacaaaacctgtcagacaggtgtaaagggctgagtttgccaccattttcccttttaaatgttaatcttcttatggaagagctaacaaataaggcctatggtaaagaggcagagaaggtcttttaacagtgaaaatcacttgaaatgtatctctgaagatatatgctacatagcaaacccttaataataaccacaccactgagtacgtaatgtgtggcaagaatcatcctaaacatcttgtgtttcctcatttgtttaacctttacaacaactctatgcgcagtggcacgcgcctgtaatcccagctactcggcagaaggctctcttaagcccaggagttcaaggccagcctgggcagcatattgagactccatctcaaaacaaaacaaaaaacaaccctgtgagacattgaggtatactcgttaatatgaatgtttacaaataagcaactaaggcccaaagagtttaggaaacttgctcagagtcacacagccagaaggtggcagaactgggatcagaacccagggaggctggcttagagctcagactcttaaccaatgcatagtgtttcagaaaacaaccctgacaatgacatgcaagacaaattacaggagaaaaaggaatgagaggcagaagaggcaattaggagaaactaaagtaactagccagagacaaaacaacagatacagccaggcacggtggctcatgcctgtaattccagcactttgggaagccgaggcaaggtggatcacttgaggtcaggagttcgagaccagcctggccaacatggcaaaaccctgtctctactaaaaaatacaaaaattagtcaggtgtggtggcatgcacctgtaatcctagctacttaggaggctgatgcaggagaattgcttgaacctgggaggaggaggttgcagtgagccaagatagtgccaccgcactccagcctgggtgacagggcaagactctgtctcaaacaaaaaaaataaaaaataaaaacagatacatgggaataaggaaaaagggaagaattttcaatgtggaacaatttatcctcatttaatagttgctcattctgcaaaagagaattaaacagaaaatcctaaactctgacacagctacaaagaatttgtagaccttgcaaatggtactcagaaatgttagtgttttgacaaaatccttctttgaaacagatgcatgtacaacctccagtctccagggaatggtttgaacacatacctgtttagcaaatccccaattcagtccttcaagaataacacaggccagtttattcttcaccactgtcaggttgtaattcaataaccaatcccgaatcaccgctatctcagatgcagaaggttgccaaagatacaaaggcagttctttaaacaagtatagagaaaccttattaaaaagaaaacaataatcattaaataaagacttagaaacaatgctatattactacaatattatattattaaactgcttgtaaaaaaatttctccaaaaggaactggagtttttgtttaatttttagacaagtgaaatggaaatcacggacaaccaaatcaagtgggtattaaaattgatgatacatcaaaagcacatttcataatcctttgtaaagatcaatctttttaaatattcaaattggtatgcttcagtttaggtaaaccaccacactaatgcacatttttaaagtcatgataaatcgggggacggctattcactttgcaaaagaatttagcactttaagtaattattcattctatggcatttagaaagatactctattggcttccaagccatccaggccgggggtggggtgagtgggagggtggtaagatgaaacaagatcaacaaagagaccaagagttgatagctattgttaaaacttgatgataggccattataccatactattctcattacttttatatgtatttgaaataatccacaataaaaaatttttaaatcctatttacagaaagtctacagcactacttttaaaataacacatccaagtgtgcaaattaagataaatctgggccaggcatgatggctcatgcctgtaatcccagcactttggggggcccaggtggacagatcacctgaggtcaggagtttgagaccagcctggccaacatggtgaaacctcgtctctactaaaaattagccaggcatggtggcacgcgcctgtaatcccaactactcaggaggcaggagaatcgcttgaacccattggcggaggttgcagtgagctgagattgaaccactgcactccagcctgggtgacagggcaagactctgtcttgggagaaaaaaaaaaaagaagccaaaaacaagaaaaacacttgagaaaaatgtcatgagctcaaactgaaagaatcatatgatccactgtacatttctctggaattcatccactaatcactcaagaaggagcaacagaaaacttcctactgtattgaactgtatatgaaaagctttttatctcaatataatcatcttgcagtagcatacaatgtttttcttttctttttttttttttttgagacagagtctctatctgtagcccaggctggagtgcagtggcgtgatctcagctcactgcaagctccgcctcccaggttcatgccattctcctgcctcagcctcctgagtagctgggactacaggtgcccgccaccacacccggctaatttgtttttttttccatttttagtagagacgggatttcaccgtgttagccaggatggtctcgatctcctgacctcgtgatccacccgcctcggcctcccgaagtgctgggattacaggcgtaagccactgtgcccagccaacactgtttttcttaaaaggaaaatgaccatgtactgccactatggaaaacagtatgatggctcctcaaaagactaaaaatagaattatgacatgatccagcaattctacttctcacatgcccaaaagaagtgaaagcaaggcccgaaagagatattggtacatccgcattcacagaaacattattcacaatagtcaaaaggcagaagcaacccaagtccccatcaatgactgaatggataaacaaaaagttatacacacacacacacacacacacacacacacacacacacacgcaccaaggaattattatacaggcttaaaaatgaagtaaatgctgacacatgctacaacatggatgaaccttgaggatatcatgctagctgaaataaaccagtcacaaagaccatatattacatagttccattaatatgaaatgtctgaaataggcaaaaatctagagacagacattagattagggcttagggccctaatctatgaaaggtgcttaggaccccaacctaagaaagcttcttagagctgaaggagatagaagagtaagagtgatagctgggccaggcacggtggctcatgcctgtaatcccagcactttgggagaccgaggtgggtggatcacctgaggttaggagttcaagaccagcctgaccaacacagtgaaacctcgtctctattaaaaatacaaaaaaattagctgggcatggtggcgggcgcctgtaatcccagctacttgggaggctgagataggagaatcacttgaacctgggaggcagaggttgtagggaggcagaggttgcagtgagccgagattgagccactgcactccagcctgggtaacaagagcaaaactccatctcaaaaaaaaaaaaagtgatagctgaagtctaagggtttttgaggtgatgaaaatgctctaaaattgactgtgttgagagttgcacatatctgtgaatagactaaaaaccactgacgtatatactttaaataggtaaattgtatggtatgtgaattacatctcaagaaaacttttgaaaaactacatgaagattgcaaaagggattgtgacaaatgacagaaacaaattaaatgtgtcctcctcaacttaagttactacatactatttattttgcttttggctgactttaaataggaccttctttgtcagttgtttattccaagtataaaatataaaaactatgaaagccaaacaaattatgaaataaaaattgttaattaactataggtcataagtaaagtaaaaatatgttattgaacgaggtggacaagtcaaccttgagatttgagagaaacaatcacatctttttataagcagcagctaatcccaagttggtgtggtgagtgacacagaggctggcacagtaaatgttagttccttttatcctgtttatacccctagtgacaagatcattcccaagaaccttcctatttttgccaatgttccattactccaagatttgaaaaaacaaaaacaaacaaaatcagtgctcttaccattccaacctggtcaatggtctcttgaactctatccagaaggacggaaattatctcagggtgaacagctgtgatagtccctaaaagctctcgaccaacctttgaaaaagtctctctggtagacaaggtgacataagatacctaaatggggggaagggggaagaagatggcacttttaatatcaattagcagtcaaaacacacttatatcattttttcaagcaaagcagaaagaatcttacattgagccttaattgacactatgttccaaaaaatgttaaaacttcatacaggcaactgtctactctgaggccgaaaggtgcagggagaggaatataagagaatggcaacttcttataacaatgacttcaagtgtggattcaaaaagtatatcccaaagtctgtcggtaacaataaaatggttcctgcagtttcaaaacttttctaaatctgaggaaatcactacaatgatgaaaatcagaatgcatttcatggaaatgcctagcttcccctacagaataagaaccctaactacaagaccttctaaaacattgtttaccaactccttttgaattatgtcttccaaagtgtatgttacaatccattaatgccaatggtattttttaacacaatggaatatacagaaaaataacagaataaaataaaatagaaaaatgtaatagtgtatcacaggtagattaagtattgcttcaattgtacatacacacacaggatcagaatgtaatatagaatgtaatttttattgtgactcctggtcaaaacactggaaactttactcaagagcataaatattactttagcaacagatcttgagaatgtcacttaatgtctgtgaaaatatgtcttctctccccaagtttttcagatcatgaagacagtctgaattccagatccatcgagatcttaactttatgcatggttatgaagtaccagtataggaacagctgaatcaagtatttgatcctggaaagaacatccaggtttgtcattctcaaactggattattaggggaagataataaaacccaaataatcatcttcaaacataattttacttgagcacactagaatactttggaggagatattttgtatgcagataaacagataaatgacagcttaaagtgtaaaatgtgcaaggctttttaaatatacaaaaaactccaatgaacattttggtaaccactttgggctagtccctagatgctcaggggtccaaatttcactcccctccaccttcacggatggctcagtgaaaagatgaagaatgcaaggatctcctcccagcctgtaatttcatattatagatgaggaaaatgaagcctggggtaataagttatcttttttgatgtgagatggccaattaatagcagagttaaaactcaggtatcctaactccaggttcaatattcttcccaccatctcatttaaactggctgggaagctaggtttctgctactagccagagtggaagagtttagttgaaggggtgggggcgagggaaacatacatcataaaaactgtgtcaggctgtgtcacattgtctctcccttactgaaactggtgcaacaaatttcaaaagataataagtactggggaatggatataattcacattttcaataatccctgtagcaaaataatgttccactgattctctatcccttctctgaagtgtagacagtagctaaataagtcacaatttgtaaaagcaatcccccaaaaaatcaacagatggacaatccaaaagaaaacatttttagctgatttataaaacttcatattctaacctcatatatctccagaacaataatttttatgaagtcttcgtccacattggttcttctggcctgagccatctgagcaaaggtagtcagaaggcaaatctcttctgagctattcatagaagaaagacacttctcaaagttggtaaaatgttctgggtctgcaagttcatatcaagaaaattagagtggggaaagaataaatttatatcttttaatcactcttccagagaaaaagatttaggaatatttaaagatacaaaaggtctttctttgttccaaaatagatttctacaggcatcaggaataaggctggaccagatggcctctgaaattccaacaaactctaaatataatgtagcctcacagaaaacatttaacatctcttagcttcagtacccacatctgtctcaaaaggttacttaataagaaggttaaatagcatgtcactggtgacgtgcttagttaactgcaaagcactgctgctgtcaccaggcagtcaccttcaaaggcagtactgccaacttcaaaggcacacttgaagctacttggtaactgtcagacaaacaaagacctgactaatgaaaactgctaatactagcaactacttggcacaaatagggcattccaaaaaaaagagatttgcttatgaagaaaaactgggggcaagaaattagttataaccgtaaatgaaatactaatgaatgtcataaacgatataataaatgtgatatgttttgcctatatcacaaaggatgttgtaaaagcaatactaaattctgccattaggaagcaatattcacaaatatacatgacagtaaactacatgcaaagttctacagcagaaaggaaaaaaagcccattttaaaaatatatgtgcttggccgggcgctgtggctcacacctgtaatcccagcactttcagaggccaaagatgggcagatcacttgaagtcaggagtttgaggccagcctggccaacatggtgaagcctcgtctctactaaaaatacaaaaattagctgggcgtggtggcacacgcctgtagtcccagctactcgggagactgacgcaggagaatcacttgaacctgggaggcggaggttgcagtgagccaagatcacaccactgtactcccacctgggcaacagagcaagactccatttcaaaaaaataataataataaaattaaattaaatatatacatatatatatatatccttgatggaacttttcacagtaagaaggcaacaagccaataattcttttcatatttacacatttgagaaaccaaggtagatagctcaccaaatttcctgcattttcaaaataactctgggacatttaccaaaccaattttcattttccatctccaaattggatttatagtggaaattattacacaaagtattcccagaataatgaaaattggcatgatcattctaacgtatattgtgaaaggatatttaaaaagaaaaaaaagaattatcattcaaacttacaatgtttaaggtacaaatcaaggaaaaggccttatattttaaataactctatagaaaaaacaatgggaaagtgaaataactttctaattagcttttaaaatattaactataaggacaaacacatttctacagttatttatcatcagatttgcttatggctacactttactagtagtcagaatgttgattagactagaaataaacaaaaagaagccaaattaaaacagactggtttttaacaatcattgctaagaaatctgctagttagaaaatgttaaaactagttaaaatttgttccctggaaactgatttcaagctcaccctactcctattaccacagataaataagaactggttataaagaataagcacttctggcatttactaaatataaaaagtgaggaagggaaaagatgttagaaagccttattcttccacaaacaataaaaatcaagcctcctaacaaaattgatatataaaagattaagcaaaggagaagatgaaaaaacagcaaattagagcaggaggatcaaattttgcaaagactccactctcaaagctagaacatagtaggcagatgaaacttctctactgtgccactaactcctgtgtcaggtgatacaggccctaagggagataaagataaaagtgccgtggaagcctggagtccagacagaaaactccagcagcaggatccaaagctctagggcaaggcaaggctggtactgccacttcagggtctggaatcacatccactacagagctgagctgtttgacatcggctccatctgccacatgctaacacagagcctggcagatagtaagtccgcaatgaagggagatgacactacaaaggagacctacccaggactcaggtatacaaagtagtgctgctgaccatcccaggcacttccaaaggaaatgtctgcttctgtattagctatttcaaccacagaaatagccgccagaggacagacaatggctgtgagacctctcacctagctcactcgtaagcccaggtccaaccacggcaatggtctaatagaagcactgcccccaggacagtggagaagcactttacaaagaataataatataaggaatccagagctaccactaagaagatagaaagaaaaacagaaagggacaaaagaggacgcatgcagagccccataaaagaaaaaaacagaaacagaagaataaagacatcaagagagacagaaatggaggctgagtacggtggctcacgcctattatcccagcgttttgggaggccaaggcaggtggatcacttgaggtcaggagttcaagaccagcctggccaacaatgtgaaaccctgtctctactagaatataaaaattagctgggcatggtggtgcacacctgtaatcccagctactcaggaggctgagctaggagaatcacttgagcccgggagatggaagttgcagggagctgaagttgcaccactgcactccagccggggcaatgctcattctcaaaaaaaaaaaagaaatggaaataaaaaaataaatcatgaatgtctgcagaaactactttgcaaacagtagaggcccaataatttttaaagtatatgattttcttttaagtgatacagacatttaaaaatttggaaaacagcctttacttcctgctgtgaaggaaaaaacacttggaaaacagaattatctttggtgtttttttttagtcttgtatttcagtaaattgtctatcttttttaacgtatagggtagttttttaaaatcactacaacatacatctaattaaatggtgtttttcatttcgaacattataattttgttataagtaaatatcctggccaggcacggtggctcacgcctgtaatcacagcacttgggaggccgaagcaggcagatcacctgaggtcaggagttcaagaccagcctgggcaacatgatgaaaccatgtctctactaaaaatacaaaaaatagccaggcgtgatagcgtggacctgtaagcccagctactcaggaggctgaggcactagaatcacttgaacccaggaggtggaggttgcagtcagccaagagcacaccactccactccaacctgggtgatagagtgagaccctgtctcaaaaaaaataaaaaataaaaataaataaatatcctgtagtttagaggtggtatgacgcaaaaacttaagttttcaccaaaattaatttttaaagtacacctgtctacatctttagttcataaaaacaatacaactttaaaaaaacagcaataaaagaaagatattaaaatggctgggcacaaagccttaacaaatttctagacaattaatacatatctgttaatacaactgtcaactagaataatttcacacacacatgcaaaaaagtgcttcctaaaagttagaatattgtgtgtattggtatactgtttgggactaatcaaattttgatttcagatatgctagttgctatttaatacatcaaaactgtgaagcagtctcctgaatttcaaaatcattacacatgagtatgtagagtaaaacattttctcttagtccttctaaaagtaaaaattaagccctgaagagaagcacaaaaagatagggagagctggacgccgactgctcggcggggctgtaccttggagctgctgcttgcactgggcgggctgcagggaggaggagagctgctgcaggttctcgctctccacctggtgcatgaggtagaagagcttccacagcatttgcacagacagagtcccaaagggcatctcggacataaacagccaaatgccaagtctgcatgtaagcaggaatcattttatttattaatcagcttcattacactaagaaagtagacaaaccattggctctcaaggaaaaaaagattcttaaatcacactatgatttttctaatatgctttagtcataaacacctcaaggatggctaagaataacagcaaatacaaaccacccagtctgtgccagggactgttctaaccacaacaatgtgtgcatgtgtgtgtgtatacatgtatgtacaatatcaactcaaaccatcctcacaaaaaccaagacaataattatggatatggccgggcgtggtggctcacgcctgtaatcccaacactttaggaggccgaggcaggtggatcacttgaggtcaggagttcgagaccagcctgaccaacatggtgaaaccccatctttactaaaaatacaaaattagccaagcgtggtggcgcatgcctgtaattccagctacttgggaggctgaggcaggagaatcacttgaacccaggaggtagagattgcagtaagccaagatcgcaccattgtactccagcctgggcaacacgagtgaaactccaactcaaaaataataagtattattattacggatattagcaccaatgcacacaggctactaaggcgcacacaggtactaaggcacacacagtagtgggtggcagagaggccagctgtggatgtgtgtgtctgagcacacacacaggtacacgtgtgcccacagacacatgtgcagtgggtgggaggaaaatcgaaatccatccagtactcctctctgaacactgaacaaagttcaaattcctcagcccacattcaaaggcttccacagtatggctctgaatcatatttccaaccacagccctctctgtcctccttcagttaccactgcattccagcaagcctggagagaccccacacctccaggctggctccttccatgggtcaagccctccttggacttcctcctctgcactattacagaactccatccatacctgactttgccatcatcatacattctgccagtgatccccacactgtagtggcagaaaaaccacctggagactttctggaaaatgcagattcccaagcctcacctatagagaccatgattttgtaggtcacagctggggcacaagaatttacacctttatagtcacccttggtgactcagactcaagtgattcttaaaacacaacatgagaaacccctcatggtactgtaatttacatatgacatactaacctaacagcaatttgagagcagaaaccatgtcttgttcatttttatataaaccagtttataactagaaccttgtattttaattatctgctacttaaaccagtatctcaaaaacaatcagcactcaatagatgcttattaaaattgtatgtaaatgttatcacaactaaaaaaaaacacttgtatcaggatggtggccatgccccaagtcagaatctgctaaggaatggctggatgcggtggctcacgcctgtaatcccaacactttgggaggctgaggcgggcaaatcacttgaggtcaggagttcgagaccagcttggccaatatagtgaaaccccatctctactaaaaatataaaaattagccgggcacggtggtgtgcgcctatagtctcagctactcgggaggctgaggcaggagaatcacttgaacctgggaggcggaggttacagtgatggtgtcactgaactccatcttggacaacagagtgagactccatttcaaaaaaaaaaaaaaaaaaaggaaatctgcaaaggaatgtacagcaacttacctgttattaaattaaaaaaaaaaaaacttaaaaaaatacgaggcactcaaagctgttgccgtatttgagaaacaactactacaaatcatccaattacaaattatctaattacaaataaaccaaatttaagaaaaaaatgaatagtgcatgcctaatccacatctatgaacctaaacaggcaactggtagttcaaacccacacttacctggactctggaaaagccagctagacttctgaacaagagattaagaaacttctctaaggtcagttgggccaggtttctatcttattagttaattatcctaacacttcacatgggacctgatgctgttttataccccaaaacaaagaagggaaattgtagaggacttaaaagtaatatcacaaacagggtgtatttcaggctataaaattccctatatggcagacattcaggaagtctggcatatatatacatatatatacacacacacacacacacacacacacacacacacacacacacatatgtatacacacacatacacgtatatatttatataggtatttatatatatatacacatatatatagatatacacatatatatacacacacacatatatatacacacacacatatatatacacacacacacatatatatatattttgagacagagtcttgctctgctgctgaggctggagtacagtggcgcgatctcagctcaccgcaacctccacttccggggttcaagcgattcttctgcctcagcctcccgagtagctgggattacaggtgcctgccaccacgcccagctaatttttgtatttttagtagagacaggttttcaccatgttggccaggctggtcttgaactcctgacctcaggtgatccgcccacctcagcctaccaaagtgctgggattacaggcatgagccaccacgcccagccctggtttatatttttgttgtctgtcttttagtatagttcagttttgttttaggttgaagggatagctattgccagaaatttccatttgagtgccgaataaatttaaatttcatggctttaaatatctggttctcatataatttgtttcctaaaataaacttaagaacaatagctgtcaacattttaaaacaattatctttgtgaaattatatacacaatgttacagcaagggttcacagctcaatatataagctctagtaagtaactaggatgagagctttgcctctccactaagcaagcacaagaacaagtaacagatcagagaaggaagactcctcccatgcaccaggccagcgtcagtggacaggtgctactgcactgatgccctgacacagtcctgaacaggatttggtgcatctcatgagaccaccaaatttatggtataagtataacaggagtaatctaaagataaggccgggtgaagtggctcatgtctgtaatcacagcactttaggaggctgagccgggcagatcacttgaggtcaggagttcaagaccaacctggccaacatggtgaaaccccgtctctactacaaacccaaaaaattagccgggcatgatggcaagcgcctgtaatcccagctacttggaaggctgaggtggaagagttgcttgaacccaggacacagaggttgcagtgagccaagatcatgctactacactccagcctgggcaacaaagtgagactccatctcaaaaaaaaaaaaaaaaagataaatttctatacccaagttctatttaagttagactcaatgccttcacagtgtctaaaagtggttaacacttagctaagacctcctgatctttctctaagtctctagattattctattccccagatgaaaccacacaagaaaaacccccacttacatttgaaaagtcctttatggtttaaaatgtatttcctcatattaccacaattcaccctcatcacacatccatgaggttaatggaacagtagtatcattatcaccatctccgttttagaaatgaaaaaagtgagaccacaaatattaagcgactttcccagggtaacagtaaatggcagaccaagactcaaacttactatacaacacagaataaatcaggggctaaggctaagagttacatggcaagagggagtgtaggcagctagctcaggagagggccaaagcaggggagagccagtagttcataagcacagctgggtgggggtggaggcagccccgcatctcctagcggagggcataatcctgcagcagagcccactcctcaacttggccagtggctcagggaagggagcacgggatgtgcagctatgcccttgcctatgcctcaaacaggtcctaggctgtaagcagtggcacagtcagcatgatccaaagacagcatttacaaagctaagacagggaaccaagatccatgacattcccagaccttaaaacccttaccggaaggcaaattgaacaataaaatcagcaaatcatttgcaccacatgctgcacacctactgcgtctcactgcaggcactgcagtgggtatgtgatagatagaatctatccttgttttcccctgctcaaggctgccccaaaagttcagggtggcaaaaaactgagacaccagaatagtgttatcttaaaacagaaagaaattgagagagagagagagaccatttcagtcaacaggtgggtactacagataaggaaaccaaggcccaagaatttgccctcaataagaaatagatgaaatacactaagaaactattataaaagacctacttaagtggctttcaccgaatggttcttactagtgaggaagttacttctcactaaatatcatcatatgtcttacttaccttttggccttcagcacatgtaggacagccctcaaaaacagttcatcaaattcaacctgtagtttctccatagagtagggctgttgggccaatcctgagccttggttatggctcacatactgtgcccaatggtcacttacataaccaagagtcatcctgagcatgaggaaagataatacagtacttttcattagctcaatatctgcacctttatattacatttccaacattcatttattcaacacatatttattgagcacctactatccacctactattgtccaggttctgaaactaatgaaatggggaaaataaaatcctaccttcatggagcttacatttagtgaagggcaaagagacaacaaataaaataaagtcatatacagtctgtcacatggttgtaagtgacactgagaaagataaagccagagaaaggaataaagtatgtctggaggtggaggggtgggcaggataaggaggtgggttgggagcacgaaagggcttactaaagagggacatttgataatgtctggaaaacagtgaggaatcacataagtctctatgagaagagtgtccacgtagaagaaacagccaatgcaaaagcgccgaggggtgtcaggtatgtttaggaacagcaaggaggccaatgtgctgagaggtagactggctggagatgaaatcagaaaagtggcaggaaaccagatcgtgaggggccctgcaggccactgtgaggacgtcggctttttccctgagtgcagtggggagcacagtagggtcctgggcagacagtgaatgggctgactcacaattcataaggaacactggctgtttaagaatacactgaggtggggaaagggcagaagcgggtggtgggcaaagtcagaagcaggaagataagtcaggaggtttaggaatgaaatggggtgctagcagtgaaggcggtaagaagcagctagattctggaaggagcatgtttcattgattcaaaaggatgcatgtctttcacactagtatccctgcaattagaacgtcagaatccatgttaatattaatgatgtgatgccataatttggcagcattttccctatgttagtggcatataaaatgtatcttaaaaaataattggtggcattttagatttgataaaagatggtattttgatggtggagatgataaaatttgcagttagattgaatgtggggtataaaagaaagaaaagccacaggtggcaccaggtgttttggcctgagaaactagaatagagttgctacttaatgaaactgggagtagtagtttgggaaggggggagagtgagttcattttgagaacactacgttacaatgttaatgagtcatccaagtggaggtgctcggttggtagttgaatatacaatgtgtttatgagagaggtatggactggaaatataactctgagaattgtaacagtgtttagatatttaaagatgaatgaatgacatctcaaaaagcaagtgtagataaagagaagagaggtccagggactgagccctgagacactctaacattaagaagcctggaagtgagaatgaaacaaccaaggaggcagaaaagggactgtcagtgaaatggtggagaaatcaggagaatgtggtatcctggaagccaaggaaagaaaatgttttaaggataaaatgatcaactaactacgagaaaggctgctatgtaagctgcgtgagagatgccaagtaggatgaagagacccagaactggccactggatctggagcacaaggttcattagagatcttcatctgtaggagctgtttgggtagcggtgggaggaaaagcaagttcaagtgaggatggaggaataaaatgggaactaatagacgatctgaaggcaagcccttatgggaaattgttctgcaattagaaggtatgagaagaatctgcactagatacaaaaagtaagcagatggaaagaaaaacaaagaaagaataatcataatacactacagctgttatttacacaataatgtaaacagtgatcttaaaacagtaatgataccaacgtccttcctatagagttactgagagaataaaataagaaatcacagtcctggcatacagtaagcacgcaatcctacatcatgtaagtgagcttatggacaaattttatttatggtcttatttattaagaaaaatcagaaaaagaacgtctggatggacttctgttaataacaggtagatgggcttttagcttttaacaaatttatctccaagtcaccagccatcctccctcccactgtctcattctcctaactctatactcaaggctttctctagacctcaggagggacccccaggccgggcacagtagctcatggctgtaatcccagaactttgggaggccaaggcaggcagatcacttgaggtcaggagttggagaccagcctagccaacatggtgaaaccccatctctactaaaaatacaaaaagttagctgggcgtggtggcacacaccaatagtcccagctattcgggaggctgaggtgggagaatggctttaacctgggaggcagaggttgcagtgagccgagatcgcaccactgcactccagcccgggtgacagagtgagaccctgtctcaaaaaaaaagaagggacccccacccttttagggcatcctataatcacttgactgatttataaagctaatggatacatatctaaaataaatgaattaggccaggcacggtggctcacacctgtaatcccagcactttgggaagccgaggcagatggatcacttgagtccaggagtttgaaaccagcctgggcaatgtggtgaaaccccgtctccactaaaaatacaaaaattagccaggtgtggtggtgcgcacctgtaatcccagctactcaggaggctgaggcacaagaattgcttgaacccaggaggcgtgggctgcagtgagacgagatcgtgcccactgtactccagcctgggcaaaagagcgagactcatctcaaaaaaataaaaaaataaaataaatgaattaaaagtaattttgttttggaagcgaaaggagggagagaagttttgtagttttatggagtttcttttgggtggggaaggaagttgaataacagcatacgtatatgctataagaaatgatccagtaaagacaattaaaattaataaagcagaaaaaagagtataaaattaattcaaagaaaagcagtacatattctctaaatttattaagacagctgaagcagtaagagcctgtattttcctagatgccttctctctcacccagacttcaacccagcaacagctttggggatctcaactccaagaacaatcatctagcaagccagttaaatttgagataattaacgaaatactctaactggaagcaattatgaaattcccatcttatagatggtgaagaaaaaaatcttaactattacgagaaataagacctgaggtttacaactaaaacgtccatcatcccaattatgcagtatctgtgtctgaccagggtgaaaggaacagagaagggtagagcaacagcagtattacctgatcatataaccaattcgcttcacaaactgcctatagcgtgctctattaaaggtttctaaccccacagccagaagttccactagtgagttggcaaaggcaaaaattttcatcatctcttgaggtcttgttgtttcaggtaaataatcacctagaagttaatcagataaaagaaaaaaatcatagttactatgaaaaaacatgaacggatacatctgtataaatattttaatgaggactcaaagccaaggtggagaagaactgacagtctcattactctggctcccatatcaacatgaaatgggaaaaaacttgagacaatgtgccaaattaaaaacaatttatttaagttgggaatgtgcaagctagctagctttctcacatttaagcaccaagtgggaaattacaagcacaagaggagcctagaacagctaggcacaagaaacccgagttggagcctacacaagaagtaagactcgggccaggcacggtggctcacgcctgtaatcccagcactttgggaggcggagacgggcggatcacgaagtcaggagatggagaccatcctggctaacacggtgaaaccccgtctctactaaaaatacaaaaaattagccgggcgtggtggcgggcgcctgtagtcccagctactcgggaggctgaggcaggagaatggcgtgaacctgggaggcagagcttgcagtgagccgagatcgcgccactgcactcaggcctgggcgacacagcaagactccatctcaaaaaaaaaaagaagactcaatgcagagttcctgtgtttacacttgccactaccacattttacacttaagagaaatgagtctaccttttgctttaaacccaagaagatgctgaaagagttcatgaaaggggaactgtgctaaaatggtaaccaaatcatcttcattaaggagaatccaactggtctcagggtcttcatcctaagggaaaagacaaaaaatcatgtcagcagatttgatcagatcacactatgatctagcgttacaggagctaaattatcacaggtctcaatggtatacatgtgatatcctcatgagtcttcatggaccttttctccaggacagcaatttatagtatcagttccacagacagttacacagtaaatcccctgaaattccaagcacaattttatatgtatctgggtcacagcaagtgattgaaactgctctcattaaatgtccatcccaaagaaaatagaaaaaaagaaatcctctagagtgaggaccttatagggatcagtgctttgataacatcaattaaagaaccacagatgggccgggcgcggtggctcatgcctataatcccagcactttggaaggccgaggcgggcagatcacctgaggtcaggagtccaagagcagcctgggcaacatggtgaaaccccatctctactaaaaatacaaaaattagccagatgtggtggcatgcacctgtaatcccaacaacttaggaggccaaggcatgagaattatttgaacctgggagtcggaggttgcagtgagccgagatcacaccattgcactccaggctgggtgacagaacgagactccatctcaaaaaaaacaagaaccatagatgagagttcaaagttatgttagctgcaattctcttctcccaaaatcaagatctatgtagtatgcaacagacttaagacgaagcaattgacatttgctataggtgactaaagttctgttgtcaattactgctgccaaaagcagtataaaaataacagtggtcatacacaaagattacataggggaaatctttgcggtcttttcgtttgacacagagcactaaagtcaccttagaaaccaagttgattcatgtcccttaggacatgaccattaaaaaggacgctaccattaaaaagggaaggaagtaaaaagatcctgagaacctgaagaatatatcacctcaatttcaacaagggactaaggcaaaatcattcataatttccttaagccactcaatttttacactcttattatgtatctaaaatggctaacaagcatttcagaaactctacttaaggcagtagttctcaacttagctattctcaactcaaaggtacatttaacccccagggaggcttttaactatttggatgtctgggtgtgggcctgggcaaggtttgcaagttgcccaggtgattctagtatatagctagtaacaagaaaccaatgatgtggataattcagagtgccttcctccctacagccttttctgaggtaatggcactcccaactttctcatctactcctcaagttcttgaattcactgaatatttagggagtgctaaacaggagccaggcaccaatgcagggtgagataattaatcaaatattttgactggaagtatttataacgcctaatcattacatgtaattataacgctccttaatcattatctgtctgggattaaatgcaggaaacctaccagaaaaaaagacttctcccccaagaaagaccactctaaaaaaaacatattgctccactacaatctttaaaagaccaatctgtactggctcctaagaagcttgcttcagaatgactcctcagtttctagcaaaaatgcctgcacatccacgtcatttaccaccacctgaccacctcctcctgcaagtctcaggaagagaaaaacgactgtgaagggggctccctacttctgaatgagcactctgggaaatacacagacacgatccaacagctgccacggctgtcattctgagaactgttggctggacactttcatctccttttaagagagggattataataaatcggtcactggacattctagacaagaacaccaaatcaagattcagaccaaaataaaggactagaactgataattagctggagaacagaactgcttacaaatctaatcacaatgactatagtagaaaggaaaattaacaagggtgatctcgagaagctggattttgatcattaaattctcaccaaaaatggaaaaccatcttctacctttcaaatgagaatttctggataagaagtttatgagttaagggaaaactttgctaagctccagctctttatttctcagattcatatcatctgtaggtgaggctccaaccccagcaacttgttactatataaaaaaactcctaatatacatcttatgtaatatgactttaatttccaggtgccaaattctcccagctgaacagaatgatattctagagaaggggtgcagcacagcacactggctcaaagcataggctctggaggctccacatttaatgaccctatggtttaagagaagatacttcacacccctgcacctcagtttcctcatctataaaataggaatcataagtctttacctcatggagttgctgagagaattaaatgagatactatgtgaaaagtgcttagaacaatacttggtgcataagaagagttcacaatgattcatcaaaataatgcagatatgacaagttacctcttctcctccttcgtctactagcgtccaagtcccagacccaggccctgaggaggatggcttccgctcgctgggcttcatgtggcacataaactcagctcgatttctaaaggacaagaataatcactcccatcacttagatgtaggctacgtgagtgcattgtggattctctactcaccctgaagaagagccacacatcatcccaatcttccaatggtttaaattagtgaataagaactggccaaaaaccaaggctaataaaactgcactaattttggtggagaatgcaaccattctgaattagtaatgatgaataattgcagaaaagcagctacactagcacagctccctgcatgatgcaggacctcaatacatatgctgcggaccttaactcaaaccaggctcacaaagtcttgccagggaaactattttagcaactatgagttactgaataaaaaagggtaatggaggctgggcgtggtggctcacgcctgtaatcacagcactttgggaggctgatgggggtggatcatgaggtcaagagatcgagaccatcctggccgacatggtgaaaccccgtctctactaaaaatacaaaaattagttgggtgtggtggcacatgcctgcagtcccagctactcaggaggccgaggcaggagaatctcttgaacccaggaggcagaggttgcagtgagctgagatcgttccactgcactccagcctagcgaaagagagagactccctctcaaaaaaaaagaaaaaaggtaatggagaggcttgtttagggccaaaacatagatataaatgcaaaaacacttgtgagtcaaatcattatctaccacgtgcaggagcaggcccttgtatccaaggcagtaagggagaggaaccatcaaatctaaactcctcatttaatttcaaggacttctataatccaacccacccgagttcttcacctctattaccagctcccgcacacacctttgcttcagccacactgatctacctgtgctccgtacagctatcctaacctgtgttggggcctttgctcacactgttctcccacctacatgttctccattgtcccgttctcctactgaaatctaatccattctttttttttttctttcagttggaatttcgctctatcacgcaggctggagtgcagtgacacgatctcagctcactgcaacctccgcctcccaggttcaaatgattctcctgcctcagcctcccaagtagctgggattataggtgattacaccaccatgcccggctaatttttgtatttttagtagagacggagtttcaccgtgttggccaggctggtctcaaactcctgccctcaggtgatccacctgcctcggcctcccaaagtactgggattacaggtgtgagccaccatgcccagtccaatccattcttcaaacacagctcagttaccatgaaacactctgactactccactcaactctttattctcttcatttctattgcatagcttcgcaatttagcacttaaatctctctgtgctatttctcttctggcattaaatctcttcttccaagaaacagatcaccttttttgtctgtagcacctttcacaatagtatatatgacccactaaaagggggaacccataaaaatggttgcttatatataagcagttgaagggtcactttgaaacaagtatcaaacccaaagaaaatctgcaatgttaaattctagaatgccaacacttcccttagctgttcttctttggatctaggcagtttcaggagccaatcctttagaagaaagaagcatttcaatctctacttcacaaagctcttgcacacttacttgacaggagacatcagcagggcaagggattgcataaaatgaaagacccctgatgggttatgcaacactttgatctgaaatcagaaaagcaaaaagcatactgtagaaaacaaataacccaagtgtccataatcttggttcacaagcattctgaccaaagttgctgttaagagaacaaagctgaaactggtacctaatacacaagagtaaagcacagcccatgggttacctggtggcactgagtcagctgtactcaaagagcagaggtaactgagcagtttccaccaattatctgtaacaacatgggatgaaggacactactgctactttaatccaaagagagacaaaacaaaaacaaaaaaaatcctccttctacctaataagattcagacttcttgccaccagaagtgctaaagaaaaggaggtgtggagaagctgaatttggcaaacattttggctcctgcaaattctaagtggttgctatgagtaacaaaatgacccaaaggcaacagcagagaggagaatctaaaaaccacatagtcaactcctaagtatacaagagttgatcacatagacctgagatctctgctaatattaaagaactttgagatgtggtggcttctgtttgacctgtaccaactgtggtgtaagacagattgacttaggaagctgtattgagtaccacgggaaaaaagtcctggtgagcctttctacacaggaattgtgtagaattaaatgcgactgaaactacccagccagactacaagcagacttagtacagtctgtactatcaattatgggtagcccaacaagtttcagtctaagaacttttataaatgtatactggatatattttaagaattttattttaaatattactcttttttaaatagtcctttttttttcagcaatttcttcaggaataatgtctaataaaacctctcccccaacccctcagaatgagttgatgattcatcatacctggataaaaggaacagcccatttactaacaccagcggggcatcgaagaatatggtttagaaggaagaggtgatctccaggacagccaactctttgtagcacggatacctgaacaataaaggtcatatgatctcactatttttaataaaagaaataatttatctaggggtctagtaaagtcatttatccagtgcttcaatacatgcaatctttcaaaagagtaaccagacacaagatatactattcactgatgagtttctacgaggcctacaaatctatgagtactatgataacatcataagcagattctctacaaatctagctttttcttctttggcaaataacaaatcactaatttcctggccacaagtgaatagatataagtcaagtagtttaatctattcttagtttgtaatggtttcttaaatccaaataagtatgcttgaaacattatccttcatttaagaactctagtacaaacctaaaaagagcaaccaaggcagccccactgaaaacataaccaataaataaatagccctcttcccataacacactcaacatctttcctaagttttccaaatccttttacctttcttctttctcttaaaagaaacatttttaagcatgacattaaatatcacgacaaaaagaatgacatatagaaaatttttgatcgatactttatctaaaatgcacaagaccagaagtatttcagacttcagattttttcggattttggaatatttgcataaacataataagatatcttggtgatatggtttggatgtgttcccacccaaatctcaacttgaattctatcatccagaataagatagaattcttcttctccattgtgggagagacccagtgggaggtaactgaatcatgggggccggtctttcccatgctattctcatgatagtgaataagtctcacgagatctgatgggtttatcaggggtttctgctcttgcttcttcctcattctctcttgccaccaccatgtacgaagtgccttttgccctccaccatgattctgagacctcctcagccatatggaactgtaagtcaaactaaacctccttttcttcccagtctcaggtatgtctttatcagcagcatgaaaaaggactaatacatttggggctgaaacataagtctgaacacaatattcatttgtaattctgtacctgagacaaagtttctattaagtacttaggtgtggaattttccacttgtggcatcgtatcagcactcaaaaagtttggaattttggatcatttcagatttctgaattaggaatcctcaacctgtacctatattctgaatatacatctagtcttcaatttcgcatacttcctgcatttccatttctttcaaagctgaagtccagagttcatttagcataatctttactagagagaaacatactttgtgctcaataatgcactagataaataacttactaccatgtatcatgatcaaagaaaagtcattaataaactcatcaaataaattagctgaaaaagttgaagaccaaatgtaatgatataacagataattcctaaattatgaaagaaataaaacaaagactactgtgtctatctctgtccccttaccaatttctgcagccagagaagaatatcatcatgaaactgagtatcttcattaactctcctggtgaacatgaataagacactaatgcattcctttagttgacacagatcagagggaatgctttctgtctgcttagacgctgtaaatgaaagatattaaatgagtctctcataaatggtgtttttgggggaatttttagtgtcttcacttaaaccaataacaacaaaaacctttaaaatatttagtgcagataaaaggagaaaagttacatcaaaatacttaaatttttataaacagacaagtcaaaaatgtgtttaactttgaagtatttcaaaataatggaaaaatcaacctcatcataattttttttttttttttgacacagcctccactctgtcacccaggctggaatgcagtggcgcaatcttgactcactgcaacctccgcttcctgcgttcatgccattctcctgcctcagcctcttgagtagctgggattactggtgcctgccactacacccagctagtttttgtatttttagtagagaaggagtttcaccatattggccaggctgatcttgaactcctgacctcaagtgatccacccacctcagcttcccaaattgctgggattacaggtgtgagccaccacacccggccataatccactattttttatttgaaaatcagtacatctctgacctacccccagttaattgattagttaagaaaatgggggagggggaattttactttaaagtaccctaatacatcccccagaaataaaaattgcataattcaacaagcatacttaatattcatgtcataaagactaatttcttaaaatccaaaataagatgaaaaattcagaacattattaatcctctgttggaaaattaaacaaaacagccctacaaacaaagcagcccaaacaaaccacaagagataaagggtgaagaagtattccgatgattacttttataatcaaaaactatatttggactcaacttggtaacaagcacattaactaggacagcaaaggacattaatgatagatagtgagctttttggcatcctagagaagcagagaaagacagccacggagaaaggagacctggcaatgctcccaagaaatgtcattaaggcagatctcaatcctacagtgggggaggcctggtaaaactgcaagcacaaatggtaccttgtaagaccaattactatacagtcaattcaaccaggctatacccctcaatttttttttacttcaaaacacaagaaagagagcttcattacttacatacctcggccttgctggtgaattgctgaagatctcagaacagctgaactactgagcaatgcatagatgtaagactccacttgcaatcttgagagcacagaagtataagaatgaagggccagggtctggtggaggtgctcagatttggcatcgaatagcttctttagctccaccagtgcattttcattcatttctactctttggtagcgatgatagctgaaaactttcacttgatctgcacagataccctaccagaggacaaaaaggtacaatatgaaaccagttactctttccatttgaagtaagcaggcagcaagtataaggtacacaggcttcagtaccatcttcaaagagcttataatcatggtgaggagacatattactgtgtagagaacattaccagcaaatatatgatcaggtgcaaaggaacagaaggccaatcacaaatacatcgcaaattcagagaagggaagagtaactctagtagtcagcagtgggccaggcgcggtggctgatgcttgtaatcccaccactttgggaggccgaggcaggtggatcacgaagtcaggagtttgagaccagcctggccaacacagtgaaatgctgtctctaactaaaaatataaaaattagctgggcatggtggtgggcgcctataatcccagctactcgggaggctgaagcaggagaattgcctgaacccgggaggtagaggttgcagtgggccaagattacgccactgcactccagcctgggcgacagagctagactccatctaaaaaaaaagtagtagtcagcagtgaaagctgcaagaaaataatagaacttgtccctaagactttcatgattgatgatcttaccttctattttatgaatatgaagccaatgtgatatctccaaaacttcaaggtatctcaaaacatctctggatctaccctcatcattcttcatagttctactcaagagaatacacactccaccagctgtgttcttgattctatcctctcttcttcaatacagtatttccaaatatttccctccttactatgtacagagatatacaggtctgccaatgaatgaggattagggataggggaatgacatgtttctccccaatatcccctccagcttcccttcactgccaaacttgtcaagagtaacctcttcttccttgccatctctcctaagccactatgaaatggcttatgatcactttggcctccatagggttgcatctaatggtcttctccatcccctctcaaacttgagaggacgtctcccccttcctttgggggctctgtgttacacatcagggactctccattgcttatagttaagaaggtgagtttcactctcattttgtccactggcatcatcctggagctaggaatcagttactaccttcagattcctcatccccactcaatggggaagaccattggatgcaaccccatggaggccaaagtgatcataacaccttcagtttcctcatcccttctcaaccttgacactctcttcccattggatgttggtagcattatgcccaaggtcacaaactaatgacccatgggctgaatttcagctggagacatgatttgcttggcctacactgtctgtatgtgtctgattagttgctaacatttgcaaattaggattcctcacactaaaatctagatttctagtttttcttgtaaaatcataagatgtggcaatgctgaaccatcacaacctcacagcaaccatcatctagaacttgagaacggctgtcccatctaaaccaggcatgggctggcccagtgaccattgtcccactcagcctgcttcactcctccagcttatacacctggctcctgcaggcatttgactttgtgatccctgcactctattactctaggctgaggcagggtcagagtgggtgtaaggcacagactccagacctggacaacatcccaggaatagcagctccgctgcaaattccccaggcttctgatcaaaatacctgtacagacatttgttcctccttaaactgccacagccgacttttagcattttggcaatcagatgtcagagtaagcagctcagcttcagccagcagcagttgcttcctacatcgtgagtagttcaaaagcaactcataaaattcatgcctgtcttgatgagccatgctgtcaaattcttctaaatatgactcaacattttccagccatgaaccaggctccaagatttttagctgttctttagtaaatggtactagttccagttgagacgggagttctgggtagagtcgctcactgcgaagcaagggtttcactgccaccaaagctggtgcttctccagcaatttcagctggcaactggggatacagtttcttcactctaggtgtctgaaaaccatgtttggctgggcaagaactctgcaagccaacattctgtggcacctctgaagaacaaaccaggccttgtttgtcttctttactattctgagtttctctgacttgtatattttccattgctggctgagtataagaaaaattagattggggtgcactttctgaaagtccaccttgtaccgacatattttcctctacctctgtgaagttcttgggggtttctactttagttccaacattgtctccagggtggacctttggagtgactgcactgtcccccacacagggtctggcctctcccccttcctttgggggctctgtgttacacgtcagggactcttcattgcttatagttaaggaggtgagtggtacatcaaacatttcactctcattttgtccactggcatcatcctggagctgggaatcagttaccaccttcagatggtctcctttgaattcacaggctagagaagggatttcctgctctctggaggtttttggaagggagacttcactggactcttccctctgaggagtttcatacttcttcttttcctaaaaacaacatacataatgtgaaataatttatcacaataattaatgctttcagcaggaggaattttaaagttgcacataaaatctaaatttcatcatgtaacaaatgaaacctaaattcactttatcagtgtttttgaacagatatgaacaaatatgaaacagaaatgtgtttcatatttcgtattatccaatattgagcgtgttaaatttggagattcactagtctgatcctaatagaaaaagacatcacagtaagcagcaaattctgattcaaaaaatagaaggggaaagttaattagattgtacaccattttgccaggggttaagttaaatagatcagtctctacggatcttcagccacaataggtttgtcttcaccttgacaaattcactcaaaactcagggagaaaaggacggaacaacttgagcaacataacaattgtagtactggaataaaataaatatccaggagcccatactgacataattacctgaatgaataaatacataaataaaatgagtgagaagcgacaattcttccatacaggaaaattccaatgaatagaattaacagaaggaatgagaaaaacagaacacttaccacaagaacaccatggtaactgccacaggtaagatctacccatggatgctaaagtgagtaagtgaagagtttaagggaaacagagtatctgcatagtctcaaagtatctcctcccaaatatttaataacaacgaacaggaaaatagtaagtttcagtggagaatcctggaagataatgccttaaccaaatgatcaaagttacatcaccagtaatactgacatcagataacccaataggatattcccagtaatgagtaacctcaatctaatcatgagaaaacatcagacaaaaacccaaactaagggacagtctacaaaataactgaaggaatgtggtcatgaaagacaagactgagaaactggaagagactggagagaactacagtgatctgacaactaagtgtattgcgggacctggattagaaaaaggacattaatggaaaaactggtgaagttcaaataagttctacatcctactattgtaccaacattaattctttagggtgttttatttatttatttttttttttttgagacggaatcttgctctgttgcgcaggctggagtgcagtcacgcaatctcggctcactgcaacctccgcctcctgggttcaagcaattctcctgcctcagcctcccaagtagctgggactacaggcacctgactaattttttgtatttttagtagagacggggtttcaccgtgttagccaaactcctgacctcgtgatccgtccgcctcagcctcccaaagtgctgggattaacaggcgtgagccaccgcgcctggccaattccttagttttaatcattgttccatgccatagaatgtacggttatataagatgacgacacaagaggatgaagggtgaagagtacatgggaagtctctgtattatatttgcaacttttcactaagtacaaaattatctctatcatcataaaaaagctgttcactaaaaaataagttatggtttcaaaaaaaccttcaggcattaatacgcaaactagataacaggaagttaggctgaataaagaagaaaaaattatttaaataacatttaaataaagttgtttcattcaaacagactaaaaacctcattgaaatcactcaaatacttactttcttgaagaaattttaaggcaggcaaacatgagttatacaagctcttggttattttggattattctgctctgaatgtccagcagactaatagccaaaaaagtagggcctttatatattaaaaagaaaaaaaagatgaatatttttgacatggaatttgaggtcagcttgttgaaatgaacctgactgccaaacatttacaaatggtaatgattcaagaagtaatatgaccctccaaattacttcactccccactgtgaactgtggacatcagatccagaagtcagtcacccaatgcatacctcatacaaactactttgttaaactgcctaaaatcacaaataatagaaaaacattatatgagtgttaataaaacaaaaaagcaagcccaaactatgctgcaatgatgtttagcaaacttgctgtaataaacagggttcttagactgagaaatcagaaagaaaaattaagagggaaaatggttactacggcaagagaaatgttagtggacacatcagggactcttcatcgcttacggttaaggaggtgagtggtacatcaaacatttcactctcattttgttcactggcatcatcttcaaacatcatccttaaaaatacatatgattcgcttggcctatactgtgtgtgcatgtgtgtgtatgtgtctgatttgttgctaacatttgcaaattaggatttctcacacaaaaatccagatttctagtttttcttggaaaatcataagatgtggcaatgctaaaccatcacaacctcacagcaaccatcaactagaactcgagagtggctgtcccctctaaaccaggcacgggctgacccagtgaccactgtcccactcagcctgcttcactcctccaggttatacacctggctcctgcaggcatttgactttgtgacccctgtactctactagtctaggctgaggcagggtcagtatggcagaggccaaattttagtgagttgacaatcagaaaatgaaattagtaaaacaatttcatttataatagcataaaaagaacaaactagggataaattgagagaaagaagcataatacttgtactctgaaacttacaaaacattactgaaagaaattaaatgcaacttaatttatttaaatggaaagacaatctatgtctttcgcaatattgttaagatgacaatattcctcaaatggacctacaaactctacacaatgccttgcaaaatcctagctacctttttttgcagaagttgataaactgatacttaaattgcatacagaaatgcaagtgacccacaacagacagaaaatcttgaaaaagaacaaagttggagaactcgcacttggcaattccaaaatctactacaaagtacagtaataaagacagtatagtgttggcacatggacaaatagatcaaaggaacaaaactgagaatccagaaataaaaccttacatatatggcaaattgattttgacaagaatgccaaaacaattcaatggggaaatttgaacaaatggtgctacaacaactggatatcctcatatgaaagaataaattggacccttaccttatatcatatacaaaaattaatgcaaaaaggatcatacacctaatgtgagagctaaaacttttaaactgttagaagaaaacaaaaaaatctttataaacttgggtaggcaaagccttcttacatatggcaccaaaagcacaagcaacaaaataaaaagatcaattggacttcatcaaaattaaaaactttggtgctgcaagtaccatcaagctcacacctggtctggcaccagttgatcaataaactggttcatctgatcttgtggccccaacccaggaactgactcagtgcaagaaaacagctccaactccctgtgatttcatctctgaccaatcagcattcctggctcactggcttcccccaacccaccaagttatccttaaaaactctgctctctgaatgctggggagactgatttgagtaataataaaattccagtctctcacacagcttgttctgtgtcaattactctttctctattgcagttcccctgtctcgatgaatcggctctgtctaggcagcgggcaaggtgaaccccttgggcagttacaaaattagccaggcatggtggctggcacatgtaatcccagctactcgcgaggctgaggcaggagaattgcttgaacccgggaggcggaggttgcagtgagccgagatctggccactgcattccagcctgggtgacagagtcagactccatctcacaaaatacataaataggggccgggccaggcatgggcggctcacacctgtaatcccagcactttggaaggctgaggcaggtggattacgaggtcaggagattgagaccatcctggccaacatggtgaaaccccgtctctactaaaaatacagaaaactagccaggcgtggtggcaggcacctgcagtcccagctactcaggaaggtgagacaggagaatcacttgaacctgggaggcggaggttgcagtgagccaagatcgcaccactgcactccagtctggggtgggggcggggtggcaacagagcgagactgtctctaaataaataaataaataaataaataaataaataaataggcctgggtgcagtggctcatgcctgtaataccagcactttgcgaggctgaggtgggtggatcacctgaggtgaggagttcaagaccagcctgaccaacatggtgaagccccatctttactaaatacaaaaaattagccgggcatggtggcaggtgcctgtaatcccagctacttgggaagctgaagcaagagaatcacttgaatctgggaggcagagtttgcagtgagctgagattgtgccactgcactctagcctgggcaacaagagcaactgcctttacctacttcagttaaaaataaataaaggtcaggtgcagtggctcacacgtgtaatcccagcactttgggaggcaggaggatcccttgagcccaagagtttgagaccagcctgggcaacacagggagatcccatctttatctttataaaaataaataaataaagacacagaaggaagacataatgtatatataataatcattacagatcacaaagtaaaattcagacaactctatgtgtatcaattccatgtgtatcaagtaacataatttaagccaaaggtatttccttttttaaaaaaaaatcagagacaaggtctcactgtgttgcccaacctagagtgcactggctatttgcaggcacaatcacagcatactgcagacctgaactcctgtgctcaaatggtcctcctgcctagcctccctagtagttgaaagtacagactggtgtcatcatgccaacaaaagatatttcttacaactaaaaatgccaggcatattaagaaaaatctatttctttatttttgatctccacataagttacatacagattaaaaaacgattttaaagtcattcaaatggagaaacaataatgagtaaattttacaaaaagagttgataaatagagaaaaacatgcttaactatacattacagtaaatatgctctggagtgtgggtatatggggaaaaaaacctaaagaaaaatacaacaaaccattaccaacagttatttccaggagatggaattctgggcatttcatttctgggttgtacactgtgagagtgtgtgtatgtgtacactcatacacactttaagcaatgaggaatcagaaagtaatcatttaaaactaaagttttttttaagttttgggaaataaatgggaagtttctattcatcacttgaaaaaaacatgtaaagatgtagaataggcttggattcacatgtccaaggctactccacattgctacatgtttatttcaaaattaacatatgtaaaaccaaactcctgattttcccccctaaaacctgttccacccacagctttctccttctcagggtcttccttgactgttttctctcacatcccacatccaaacctcagcaaaccctcttggctctcagacttcaaacactcctcaccaccttctctctgacaatcctggcccaagccaccatcacctcttgcctgggtgactgcaatagtctcagatggtctctgcttctacccttgcccccttacagtctattctccaaaaagcagtcacagtgattctttaaagcacaagtggaatcatgtcactcctctgctcaaaaccctgtgttgattccatatgtcactcagagtaaaagctcacgcaaggcccaacatgaccaggctatgctacttttctgacttcatctcctactgttctcccctcactcactctgcactaaccacactgcctccttgcagttccaaggacaggtctggcatgccaccgccagacagccttttcctggctagtccctctgcctgaaacacttctcccccaatatccacatagtgaactctctcttccctttcatgtctttacttaaatgtcaccctcaataagaactagccaggctgggcatggtggctcaagcctgtaatcccagcactttgggaggccaaggtaggcggatcacctgaggtcaggagttcgagaccagcctggccaacatggcaaaacctctactaaaagtaaaaaaacattagccaggtgtggtggtgggtgcctgtaatcccagctactcaggaggctaaggcaggagaattgcttgaacctgggaggcaaaggttgcagtcagccaagatcgcgccactgcactccagcctgggcgacaacagtgagactctgtcccaaaaaaaaaaaaaaaaaactatccagaccacccatcctaacctctcaccagtactcctcaactcttcaacctgttctttttcttttttccatagcgcttataaagcatgatatattttcttcttcatgggtttttgtttgtttagcttgcttgttttttgtcttctccctcttgaatgttaagctccactaaggccaggttctttggggttttttctcttttacatcccaagtgcctagaatagttttcggaacataatgggtgatcaatgagtgtttgtttaataaatgaatggcttttaggaggcacgaaagaagctaaataatactatgcagcatcccccaacttcaaaccaataaccactcctgatagaaaggaactagaggtggaaatcaatcatttaggcatggcacaagggggatggagattcaaaggtttttcctgtgaccttctgggacacatctttctgtccttagcaattaccagatgttctcactattaataagttgttggcattcagaatttaatattaactgtcaaagaaaacactataaaatgcactgctcctgcagagtaagtccaaatctaagaatctactgtacttataaattatcaagatcaatgaagtcagggtgctcagagttgggggattttatagcagagaatgacactaaagaaatgaaaacattattaggtctctctcttaggcatcaggtgataagcaccacatacctaaccacaacctagcagccgaggttagctatcagatgattaacattgaggaatgtaggtcagctgctgggtgaaatccagaagccactcaaactgtctaaaggcaacagcacatgacactatccacttcctgaactgagactttgaaccagtttgtggttccctaaatagctgccaaattatactatagatggtaaaggtttcattaatataggactttataactataatcgaactataaccagcactaagaagtgcatcaattgactctaaaaaaaattactttctagattgttttattctaaaagaattaactttctagattgacaaagataggggccttgctggtatcatggacttttttcatccgttttctcatactagtcagaggaaattcactagagtaaattcctctgagtgacaaagcttggaaatattcttcattactggcatttatttcatcattcgacgaacattatcaagtgacaaagaggctacgaagggtactgagaacaagacaggtccctccctcagtgagttcaaaatctaagggagaagagaaatgttgacaaagtaaccacaaatgagatgagtggcacagaggggagcagagtgctattggagaggcagtgacaccaggaagatgagaaaaagcttctctgacgaagtactgtttagctgacacctcacaaatgagtagctggctaggtaaaaagggataggaaggggtgtcagaggaaacaacatgggcaaaggccctgaagcaggaaagaatataaaggttaagaatcaaaagagaactttgggaggccgagatgggtggatcatccgaggccaggagtttgagaagagcctggccaacgtggtgaaactccgtctctactaaaaatacaaaaattagcccagcatggtggcaggcaccataatctgagctactcaggaggctgaagctggagaatcgcttgaaccaagagacagaggttgcagtgagccaagatcacaccacttcactccagcctgggtgacagagtgagactcggtctcaaaaagaaaaagaaaagaaaagagagaaagttgggattggtggtagaactgaggctgaggaggaagacagaggcaagatcatacagagcccttagtccatgctttggactctagcctctgagtgatgggaaacctttgaaaggttttgaggagagtaacatgatcagttttgttttgaaaaatatatatccagctcagtttagagaatgggcagcaagaatgaacgtaaagaggccagtttagaagaaatcctccttggaggagggttgtactagttaggatggagaggaaatgcacagaatcaaaagaatatttagaaaatgcaattggcaagacttagtgaatgatcagatttggagggtgagcaaaagtagatgtcaaggatttttggtttgcccaaatgcctctgaaataaaggcctcttcataaactttaacaaaaaaaaattaatgtatgtttgtataggaaagttgcctaagatggataaaaaatataatcaattggtttttcatgatggatctaaaagcttaagatttttaactttttaatttagaaattgttttaaacaaaataaattaagagggaatccccttaacagactttttaaagcatctgtaacattctatctatggaaagacaaaagacatacagatacatgaaataactattaagttcctggattgagagtcaggatttctggctttaacctgagttctctcacgaactgcatgacactgagcaatatttaatccccggaggctttagtttcatcaatatcttgggggaaaaaaactagagattaagacttaagattctgctctcatagacaactaacatttatgtgttatgcactactgcattataggttcaggaatttttttttttcttcactggataggtatgttttcttttttttcctgtagtctcatcgttaagtaggtttagggatcttatgcatagctggccaatggcttttttcttcctcctgggcctggatagttctttaccaacccaatacaatgcaaaagcatttcttttaaaaatatttctgagccgggtgtggtggctcatgcctgtaatcccagcactgtgggaggccgaggtgggcagatcacctggggtctggagttcgagaccagcctgaccaacatggtgaaacctcatctccactaacaatacaaaaattacccagcctgtaatcccagctactcgggaggctgaggcaggagaattgcttgaagccaggtggcagacgttgtggtgagcagagatcgcgccactgcactccagcctgggcaacaaaagcgaaactctgtctcaaaataaataaataaaattcctgaaatttggtaccaaaatgactttctcaccagaataactcctcacagacctggatacaccaatgtgtctaactccactacagccgtttaaaaagtcatatcaagaaaacgtggtaaatactcagcatggaatactatgcagccataaaaaagaacaaaatcgtgtcccctgcagcaacatggatgcagttagaggtaattatcctaagcaaattaatgcagaaacagaaaatcaaataccacgttctcacttataagtgggagctaaacattaagtacacatggacacaaagaagggaataatagacaccagggcctacttgagggcagaaggtgggaagaagggaaggataaaaaaaccacctgtcaagcactatactcattacctgggtgacaaaataatctgcacactaaaccaccaaggtgtgcatttgcccatgtagtaaacctccacttgtaccctctaaacctaaaataaaagttggaaagaaaaaaaaagagcatcataatgaaagaaatccacataagtcatctacagtctactaagtatggtacctatgaacactaccctcctgttaaaaccttgttcccatgagaaaatcggattacagtatcatgcttaaattacacctgctttggaacatcacccacttctggggaaaaaaatgtcctgtacttgtaataccatcctccttatttcccaaatgtaaactctgtttcaggtaagccaaaattatgaggtctggccatgcgggagcagcatttaatctgttcatcttagaaaatatatataaatagggtgggcgcggtggctcacgcctgtaatccgggcactttgggaggccaagatgggcggatcacctgaggtcaggagtttgaggccagcctgaccaacaaggagaaaccccgtctctactaaaaatacaaaattagccgtgtgtggtggcgcatgcctgtaatcccagttactcgggaggctgaggcaggagagtcgcttgaacccgggaggcggaggttgcggtgagccgagattgcactccgccgagattgcactccagcctggacgacagagcgagactccatatcaaaacaaaaacaaaaacaaaacaaaacataggctgggcgcggtggctcacgcctgtaatctcagcactttgggaggccgaggcgggcggatcacgaggtcaggagatcgagaccatcctggctaacacggtgaaaccccgtctctactaaaaatacaaaaaattagccgggcgtggtggcaggcgcctgtagtcccagctactcgggagggaggctgaggcaggagaatggcgtgaacctgggaggcggagcttgcagtgagccgagatcgcgccactgcactccggcctgggcgacagagcaagactctgtctcaaaaaaaaaaaaaaaaatacatatacatatatatacacacacacatatgtatatatgtacgtatatatgtatatatgtgtacatatgtatatatgtgtatatatgtactataataaaatgaaaatccagactgcacttataaacaaatcaacttaaaatcactctaataccacatgtagtctaatacaggaaactcagaaaattcaaacacttccctactgtgtgagtcccgccctgggttaatttctagccattcatgccccttataaacaatcaagacaataagaaataaacagaggcagcactactatcatcttgaactttcaaagtgatcagaaatggcacagcactagtctacttataaagttctgccaaaggtaccttctccgcgtggaggaggggaacattccctctttatgcatggcagggactaaaaatgttctaggatataaaagagtaaagagagagtcaacgatggggctggaaagagaaaaattatttcacggcaggaaaccagacccaggtgaggaaagccaagagagcagaaaaggaagaggccagtgaagtcacaggagggagaaggaaaaatggggtcctgacagagtgtggcagggggatatggagaaggaatggaggagaagggccggtgtcaacgggtggtgggatcaaatattggaaggtggaggcggaagatgcagagggctcagggaacgggagtagaattggctggggaggccgaagagaggagcaaggagacacagcacactgccagagcctcgggagggtgggggagatcctcacctttgttttagtccggctggccttggccttggcccggcgctggggcttcaccgcctcggccatagacccttccgcggcgccgtcaccgtttgtttttgtcaaacccctgcgcttcaagcaacctgcccggttctggcctccggactgtcacatgatcgaatct

SEQ ID NO: 1695 - DNA, 37208 bp, Homo sapiens
tatattcttaaatatggtttaatactcttctccatttctgtacatcacaacaccaagattttgctgcttagtatctctctgcagaggctatagagaatgcaaaggctacggttttcaccccctcttatatgtgtttgtatgtgtaagtgtaatacatatcaatatatattgatacacacatcaatatataatgcaatatatatcaccgaagagaacacattgattaaagaaatacaaaaatttggcatcatttccaaacttaaatagtaaaaataaaaactacaaaaggagctgcataccctaaatgtatcatgtgaaacaacaagcatattcaaaaatgtaaatttacatccaatttctctggtcttgtcatatcacatcagacccatttacaatggcaaaaccctaaggtactgctgtgaagagagcatgtttgctcgctcttgggtgttctgcaaacaaatagcagagcccaaagcaaaaaagcctgttccggtgaagtctcccacgttggtgaacaccaaataatggactcttctcacagggggttgagacatcaggttacacattgacagacagtatttggacctcagagtacagtgtgagaaccagaaactttacatttaagacatactcccttcattcaagtgaaacaggattattggaacgataggcaggtctgtaacctgggaacaaggagctggttcagaccaataaagctacgagtgactgaatcaagtcagtaaagaacagcagtcaggcactaaagtgttaaaagtacccaatttgaaaaccaaatgcaccccactaccctagtcagtgtggaggtgataccaattgacttttaaaacctttggtccttcaaagtccatttggtatacttttttccatcgctaccactgggcacgtactatacactttgttcaactgtcaccaccctgggcacgccatgaccttgcatatcagctgggttcaagtctgacttacagcccagctgtgaagcataagcttcagggtttcaggccaacttttggatccaacatggtcttaaatccatggtgccagaagctgtgtcccatcccttcccacccgcccctaatttctcatgtgagaagtgcttgtaagtcccacatttgaaacagatgctccaaccccaccaggaggtcaggagtttataattacatgcagtcatacatgtctgtcgttcctgtgaaaaaccttgcagttcattttaataaatcaaaacattcacataatctcatgccatccaacacaaggaaaacacatccacctcccttttaacaaggattgacccaagcaaaataaaatcctctttaaatttcttcgcttccacttaaattgcatgttttatttctcccaatcccagcaatagcacagaagccccatcatatccatcccaaaccggtttcgagtaggttaaggttatagggacccttgtcagaacattgatacaaagggctcccaaacgccgggcacaaatgtgtctgcaaacagatggaagtaaacagtgcactggcccaaatgcttcatgagtcagtttgattttgcaatgcaatttgcatccttgaaactgccagtctggagggggacggggtagcgtgagggagtgaagttgaaagtgcctcctattagctcaccctttcaacattaaacagagaccaagagagaaatggttccaacatttcaccacatatatttcttcttacgcagtctaagctgagaatgccatgtaaatgggtcactgcgaaatgcagcaatttaatttttctccaatcaaaataagaaacaaaccagtatgatctcacttctattaacttttgaaggtttacagcagttaaagtatttttgcttctatgtatgaaggttaaaaaaatcattttttttcataaaatacaagagcaaccaatttcaccatccagtaaaagtaaaaactgggattcttttttaaattagtccaaagtggcgtttaggaacttagttgtaggctgctgcgctgacaccatgacaaaccaaagtgtagggctgggtctggttttgtttcggttttcttttcaatatccaatgctcatggattaagttctggaaatgttccaattgtaaggcagggatctgtttggattccaccatgggtatgctccttgggttggatgctggagggtgaggcacgttttgccggacccatgtcgactacctagtagtcatcaaggtcaaaaaattcatcgtctcctccttggtattccattccctggaaatctactcggtaccgcaagatacctggggaaacaaaccaaaaggtaaattacctgtgttcatgggatgggcatgtgtgtaggtggctggtaagggaataagggaagccctattctcttgcagaattgcagaaagcaaagaggtaataataaacatgggtccaaattaggaacctgcacctgctgcgtcaatcacctatcccagcagataataagcacctcaccggaagcagggctagggctagccaggagggaccttgacctgagaccctggttttaagtttggtttgctgatttgctactcacctccaattccaccaaatcctttcacaaactgagacccttcttgtgatttatctgtgacaatttccaacgtagctccaaattttttatagttgttagcaaaccattccaacaggggcatgctctcgataagctcatgttcctgtccggtctacagggatgaccatgagatacaaaaatgggggattaggatatatgaaggctaattagtccctctcacagccccttgcccacctatcactctcatcctcccatttataggcatgtctgtgtgtaaagctctgtaagtcatctctggttttgataacctaatggatatcagcagagaaattcggattatttcaaacaacacttctcctcaggctctaccctcagctatgaaataccaacacaaaaactcagtgggtattcagcttatgattcctactgttgactctagaagtcaggctgttgtagtgtctctaagcagcacccattcaatggctcagaagagacattccaggactgcttttgggagtggcctcgtagagaacaaagctctccaaaccagaatttgaggaagctatcatttaaacctatctcatacgggagggtcatactttcaactgttgtgatgcacttagagcaaaccagagaagccactgcagtggaagagctgatcaagtgaagaaagcagcacaggtttcacagtgcaggagaggcattatgtaaattacattttcctccctattaaatttcaaggataatgaaatgttttcctgattgcttaactacttaaaaacaaagacaaaaacaaacaaacaaacaaaaaccaggccaggcatggtgggtcacgtctgtaatctcaccactctggaaaaccaatgtaggaggatcacttgggcccaggagttcaagaccagcctggtgaacacagcaagaccccatttctataaaaaaaattaggctgcctggcatggtggctcacgcctgtaatcccagcattttgggaggctaaggcaggtggatcacctgaggtcaggagttcgagaccagcctggccaacatgatgaaacccagtctctactaaaaatacaaaaattagtcaggcgtggtggcgggcgcctgtagtcccatctactcgggaggctgaggcaggagaattgcttgaactcgggaggtggaggttgcagtgagccgagatcacaccactgcactccagcctgggtgacaagagcaaactccacctcaaaaaaaaaaaaaaaaaaaaaagggaatgagggcttgtgcctgtactcctggctactcagtagactgaggcagaaggattgcctgagcccaggggttcgaggttatagtgagctatgattgtgccactgaatccagcctgggtgacagaccaggaccctatctcaaagaaaaaaaaaaaaagaccggtcatggtggctcacacctgtaatcccaccacttgggaggccgaggtaagtggattgcttgagctcaggagtttgagaccagcccagggcaacatggtgaaaacgcctctctacaaaaaattcaaaaattagttgggcgtggtggtgtatgcctgtagtcccagctaccagagaggctgaggcaagaggatcacttgagcccaggaggtggaggttgcagcgagccgagatcatgccactgcactccagcttgggcaacagagcaagaccttgtctcaaaaaaaaaaaaaaaaaaaaaaaaaaaaaaagctgcagctccttccctgaaatcagattcgtatgtggcagatagatgaccacctcccacagcacccccaattagtataaggtttggtttcccaaagctcaccctctacacagccagtactctaacacacggatttacgcttgcacgtatcatcaaaccaagaaaataatcacatacctctttgtctgtgaaatgagatttatccttttcttgctctggagttagatagagaattttctcctctgtagtattaggaggaaaaaatgtgttaacctggctctcatatactaatctgtgtaagctccataagatgaggttagatgagaaaagggctcagggactcaatctctcaacattttttccataaacatgttagcatacactgagtgtctactaggtacaatgcttcaaccataaggaacatcagagatgttcaagatatagtcctggtcctcagcagatgtaacaatcttaagcagacgttaaacagttcaagcagaaaaatctatgcaggaatgtgctacagactgaaggactggggaacaatgggtagatctaccttctgattgctcctgaaatcagccatccctcccaaatctccaccccaggcttcctggctcagtaacaaatagcaaccttattttctaattctcataccttctgtgccttggcaatgaagaacatatctcattatatccagattttcatagactattagaatttctacagctcccatttccaaagcctttagtgtatcttcaacgccaaaacagtacttgcccgtgtcctggctgatttcatcaaagtatcgtcctacgattagggatcagtcaacaggatatatattaaagtttccctagtagatacaaacacacctattcgacctaatgactaaagaagataaaaaataatgcttttactgaggcaaaagagttaataaaaatactaaatattcctttttacatttttggtaccttgtctcatacatacaatcacgtacatacacacacacacatacacacacacacacacacacacacacacacgaaaacatttcacagaataagtagttgcatttcaccgatacctattaatttcttctcttgaatgaatttcacgttggagaggacttcagtagataactcaatagcttggttgaatccattttcaccaccataggatatatcaactaattttaaaacttttgattgtaacctctaacacacaaaaaaaatattattagtacttactggtacttatttaaaatattattaaaacacctttactcaaacccactaactcttaatggtatgcaaagctcagcattatgatcactgaagtctaaatatggggaaggagcccaatttaatcaaaagctgctcttaaagtgaacagcactgccaattatatcacacattttattagacctactataggacaactcattaagtgcaaacaaaaataagttattgtggaggaaaggggggaccactggctcctgccaaataaggtagtagaggttaagacgggctggggagggtggctcacacctataatcccagcactttgggaagctaggagaggcagacagcttgagtccaggaattctgagaccagcctaggcaacatggtgaaaccctgtctctaccaaaaagtacaaaaattagttgggcatggtgacacatccctgtagtcccagctacttgggaggctgagctgggaggatcacttaagcctgggagatcgaggctgcagtgagccatgattgccactgcactccagcctaggcaagatagccagacccagtctcaaaaaaaaaaaaaaaaaaaaaaaaaaaaatatatatatatatatatatatatatatatatatttttttttttttttaaaggcaatttctttggtggaccttctaccataaggctacttcctccagatcttgaaagtgtattatggctgagcccatgttataaaatgtgctttaaatgctttaggctgaatcagctgtcatactgctgagagctttgctgctatgtatctccaagaataaatcagaaaaagaaaataaggaacaggttttagtttctttgaaatcaaactccattctacagccaattctgacaacccaactaaacaaggaacctccacaggatccataagaagcccacctaaaaatggttgatttcagaagagaaggggttcagaaaagcacaggggaatgtttcctgataaacatctgtaaacctgctgtttaactcagaggcaagtttttaacccaaggaattttaaaaagatgtgtctgttccagtgctcacacagaggactcacctactcctacctagggtcttacataataaagcatctacttcttacttacctgatcaaacatatcagattgacttagttcagttttaaagtcagcggatccagctaaaactagaccagccacattcactttgtccccagaaataaacagctgcacagcagtctctgctactttccgaacatagttatgtcgcttttccattcttaaacgggcaaaacgcaaggctgactgacctcctctacctttgacacaaaagtagcaagagaaaaaggcaattattaagaactacaagatgtcttcaaattaaaaataaaataatcatgtcatcatctaagaaaaggacaaagaaaaatcaccattcccttaactaaacgttcagcataaactgctacttgttttcagagagcgactactaagtctatgtcaagagaggagctgtaagtaccaatgaggcaccagtcattacaggaggcttctctccccatcatctggattcactcccctcacatcatactgttttctctctctctcttttttgagacagagtctcactctgtcgcccagactggagtgcagtggcgcaatcttggctcaatgcaacctccgtctcccgggttcaagcaattctcctgcctcagcctcacaagtagctgggattacaggcgcccgtcacatttttgtatttttagtagagacagggccgggctggtctcgaacttctgacttcgtgatccacccggctcggcctcccaaagtgctgggattacaggcgtgagccaccgcacccggcccaccatactgttttcttattgctagacacaaagtaagtgggttcatgttctcctcctgtattaccgtgtttctttgggagatccacagtgaatttgtgcaggacttctcttgtgtttccttggagtgtgccaaaaagtgcaccactaccatctattacaatgaatccaaacttgctatcatctgaaagtagtgctgtaagagcctgaaaagcaaacacaagtaccacacggtgaatcccaaagctttgctaaggtcaaaaaaactctgaaaggatatatacaagccctttcactccactcaccatgctattagcactgtgggaaaaccttctacggaataatttatagacttcagttataaacatgtaactcttatggacaaatttgaacccaataaggaaataacgaatgatatctatgtgaagcttttcaacacatttgacatgggcatgtaaatataaaaccagaaagatatctgtatgcccatgtttatagcaatattacatacagcagttaatactactcaatctcaaaaaggaagaaaattttgaaacacactacaacagggatgaaacttgaatacatgctaagtgaaataaccctgtcaaaaaaggacaaatactgtatgactccacttatatgaggttcctggagtaatcaaaatcagagacaaaaagtcaaatggtggttgccaggggctggaaaaaagggggaacaaggaattattgctcaatggatacagtttcagttttataatatagagttctaagctgggtatgatggctcacacatgtaatcccagcactatgggaggctgtggcaggcagatggcttgagctcaggagtttgagactggcctgggcaacatagcgaaacactgtctctacaaaaaaatacaaaaattaggtggctgtggtgacacgtgcctgtagtccctaccagctacttggaaaggctttagtctgggaggtgtaggttgcagtgagccaagattgtgccagtgtactccagcctgggtgatccagagaccttgtctcaaaaaacaaaaaaactttaacttgttccttttttttttttttttgagacagggtctcactttgctggccaggctggagtgcagtagccatcatagctcactgcagcctcgaagtcttggactcaaatgatccttctgccttagcctcccaaagtgccggggttacaggcatgagccagcatgtctttaaaggtattgcagctaatgattctgagttttatgaggaaaaccttccttctatgttaactttatatccctttatgccttcccaaagagaaaatattgaaacagtcctgggacatacatagataagagttctcacagtggaatcggaatactacacacttagttgatctctaattgccaggggacaatctctttggaagtaagaaattgttacccattccattttatttttataaactgatcctcctctttggcctcccaaagtgctgggattacataggtgtgagccacaacacctggccttaccattccattttaagaaaatagccccttcaataattgactagaaagcagatggatcaactaagaatccatctttaacaaaccatgctagatagttggcattaagacatgaatattgtggccgggcgtggtggctcatgcctgcaatggcactttgagaggccaaggtgggtggatcactcgaggtcaggagtttcagaccagcctagccaacatggtgaaatctcatctactaaaaatacaaaaattagttgggcgtggtggtgcacacttgtaatcccagctactcaggaggctgaggcaggacaatcacttgaattcgggaggtggaagttgcaaggagccgagatcgtgccattgcactccagcctgggcaacagagcaaaactcaatctcagaaaaaagaaaaagaaaaagaaaaaagacatgaatatgaatattgcacgttaataatatagccttatcaaaatgacccgttaggtagattgaagtttttaataaatctgcttatcagggaataggcatatcccttattagaatatataattaccctgataaacaggatataaccctctcagttaaagctaaaatgtacaaagttagcaagattaaacagtatcttagaaaaggagttaaggtttggaaaaaagccaacaaggctaactcagtaagtgagcaaaagccagacaacatgggtacctggcactgtttaaatcaacaagattcaaaatcggctttcatccaaccagatacaggtaagtggtttcagtggctgagaggctccctgaaaaaccctctgctgtaagtagagtgtggtagtgaagagaaaaacagtctggattgtctatgcagtcgaccaagatccaactataaatggacttcccatcaagttagcaaaaatcatccactgtaaactgtcgacaaatgtcagttctaattccactgtagaggtttttccctaggttgatgaaaggcaagagaatgaactaaggagccagctgtgaattcttgattgttctactgttgactgatttaggtcactctaatgaggtttcctttccactgttcaagttcatcctatggcagctttgtcactcaaaagtttcaggggaaaggggggaaaatgagttcttacagttctgctactaaaaattttacaattgttatgtgaaaactgagtgcaataactcaaagagtataactggactgcttgtaacacaatggatatacgcttgaggaaatgggtaccctattttccatagtgtgatagctcacattgcatgcctgtatcaaaacatctcatgtaccccatatacacctactatgtacccacaaaaatcaaaacacacacacacacacacactttgggaggctgaagcgagcagatcacttgaggccaggagtttgggacaggcctggccaacatggcaaaactctgtctctactaaaaaaacacaaaaaattagccaggcatggtggtgcacacctgtaatcccagttattcaggaggcttgaggcacaagaatcgcttgaaccatggagatggaggttgcagtgggccaagattgcaccactgcactctagcctgggcgacagtgtgagactctgtctcaaaacatgctgaatgactagtgtcataataaatgtaaattgccttactttttgaaaacagacagctttgtaaaatggtacaacggtttggaaaacagtctagcaacttcttaaaaagttaaacataattactatataacctacacgattccacaaatctaagaaacatgaaaatgtatggtcacatagaaacttgtccatgaatgttcacagcagcattattcagaacagccaaacagtgcaaaccactcaaatgtaaaactgatgaaacgagaagctatataaaatatgaaatatggcatataggtatacaatggaatactacttggtaatcaaaagggatgaaatgtactgatgaatgctaccacatggaaccttaaaagtataaagtaaaagaagccagtcacaaaaggccacaaactatatgattccattatataaaatgtccaggctgggcggggttgctcatgcctgtaatcctagtactttgggaggctaaggtgggtggatcacgaggtcaggagtctgagaccagcctgaccaatgtgtttaaacaccatctctactaaaaatacaaaaaaattagctgggtgtggtggcatgtgcctgcaatcccagctactcaggaggctgagacaggagaatcccttgaatctgggaggcggagcttgcagtgagccgagatcataccactgcactccagcctgggagacagagcgagactccgtctaaaaaaaaaataaaaaaataaaaataaaaaaataaaaataaaagaagtacagcacaagcatatctatggaaagaaaatatagtggttgcctagaatgagacaggtaagtgggagggatgggggactgactgctaatgggtacggggaaagaattctggagcgatgaaaatgttctgggtttgacttcttacctctgtatggaatttgttgtcacacaaatacaatgacgtattaattggtttgaaaggttcaaagtcaatgttgactttcttttcctttccttcttctgttacaattgttccacagtatacaaccagaccatttggaggtactgcaaagaacacaaacaatttttctactttaccccatatctagtttttcgtcaattaatagaaaatgttcccatagcctattttccctgcctgatcctttaagtcataatttaaataaagcagaaaaagcttgaaatctctcaggcagaactctctccctaattttaaaacttcttctgagacgtttcagtacgatttattctttaaagtaaacaggctggacgtggtggtggctcacgcctgtaatcccagcactctgggaggccgaggtaggcggatcacctgacgtcaggaattcaagaccaacctggccaacatggtgaaaccccatctctacgaaaaatacaaaaagtagccaggcgtggtgatgggcacctgtagtcccagctactcgagaggctgagacggaagaatcacttcaacctgggaggcttgtggtgagctgagatcggattactgcacttcagtctctgggtgacagagcaagactctgtctcatcccaaaaaaaaaaaaaaaaaaaaaaattgagacaacgcctcactctgtcactcaggctagtgtgcagcagcgagatcgtggctcactgcaactcccacctcccgggtccagttgattctctcgcctcagcctccagagtagatgggactacaggtgtgtgccaccaggcctggctaacttttgtattttttgtagagacagggtttcacaccatgttgtccaggctggtctcgaactcctgacctcaagtgatccacctgcctcagcttcccaaagtgctgggattacaggcatgagccactgtgcctggcctacttaactttcaataaacaaaaaacaaaacaaaacaaaaaagctaaccaccaaggccaaagagacactgatgacagccgacttaagggaacattagtgaacaaagcaccatagcagcatcacagtataaaacataaccaaaatgtgtagagaaggaaaaggagcaaactccagattacctttgttataaagtttgagtctttgttgtacagatgtaatggctcccaggactgaaaggcggtttactcgtgacttaatgttagatgcagttccaaactcatccgctaacatttttgccactcgtgaaatctggtctttgggaggaatgatcaatgatatcatgctggtgccattgctgtggaagaaagaataactcattagggatttaaatatcatgtaagtaaactcatgtttctctctggtaaaagcaagctacagggagatgccccaaagttatggaaacaggtcactctcaaaggagtaatgtagggactatattagtcttgtttatgaacgtatacacagagttaggaacagtgttcagaatctagtgctcaatttgattgaatagtgaggtaagttatgtaaagaatacacttggagagatacttgagaaacacctcatttcctaaagaaagaagctatctatgataaataaggagtgtcaacaggctggaatttggtagtgaatctgtccgtgggagagccttcaaatgtggtggttgagtgggagacgccatgacaggatgatgcaatgagtctttccaaagtctaggcatatttgtaatcaagaatttagtattctaatgatgggaaaggagaactgtggaagtcacagaaatgtcccagttatgaaatctctctctctcggccgggcacgatggctcacgcttataatcccagcactttgggaggccgaggcgggcggatcacaaggtcaggagttcgaggcaagcctggccaacagagtgaaacctcgtctcaattaaaaaaaaaaaaaattcgctgggcatggtggcaagtgcctgtaatcccagctattcaggtggctgaggcacgagaatcacttgaatccgggaggcggaggttgcagtgagccgagatcatgtcactgcactccagcctgggcgacagagctagacttagtctcgagaaaaaaaaaaaaaaatctctctctcacaaactcattctctttaaatggcaacatattaattgcatttgagtttgattaaaaggaggaatgactgacagcctgataaattctgggtgcccaaccaaactcaagtttttagaactaaaaaacgggaccaaaatctgacctatggaagattttggttttttaactttttaataataacaatgctgatgtgtgtgagatgttgtctcattgcggttttgatttggatttctctgattaatgatgttgagcatttttttcatatgtttatggggcacttgttaaatgcgtatctcaaaatgtcagaaagatatcaaactaatgatccaatatcatacttggaaaaccagaaacataagagcaaactaattccaaacctagcaaaagaaaagaactaaaatcagagcagaactgaacaaaattaagaccccaaaatccagggaaataatcaacttaaccagaagttggttttttgaaagcataaacaagattgataaaccactgtctacattaacaaagaaaaaacgacagaagatccaaataagtacagtcagagatgacaaaggtgacattacaactgatctcacagaagtagaatgattctgagagacccttatgaacacctccatacacataaactagaaaatctaaaggaaatgggtaaataccatcaaggccctgccacatgggaggtcccttctgagcagttaccaacccatttttaagccccctttaaatttcaacaccaatgccagtaacatatcttttttgtctacaacttccaaagacacttatcatcactaccagtcaagaaatatctcatcggaaaattcctacttctatgcaaagcaaacacagtggctcacacctgtaatcccagcactttgggaggctaaggtaggaggatcacttgagtccaggagtttgagaacagcctgggcaacataatgaggcccccatctgtacaaaaaataaataatcagctgggtgtcacgtgatgcaggcctgtagccctagctattcaggaggctgaggcaggaatatcactcaagcccaggagttagaaactgcagtgagctatgatttgccactgcactccagcctgggcaacagtataagactgtctcaaaaaaggaaggaaggaaacaaagtgttggtgaggatgtggagaaattggaacccttgtgcattgccagtgggaatataaaatggtacagccatgtgggataagtgtggtagctcttccaaaaaaaaaaatttttttttaacacctaattaccatatgatctagccattctactttcaattacatacccaagagtgagagcggggacttacacaccaatgttcatagcagcattattcacaatagcctagaggtggaagcaacccaaacatccactggtggatgaacaaataaaaaaaagtggtgtgtgtgcacaatgaaatattattcagtcttaaaggaaggaaattctgacacacaaaatggatgaaccttgaacacattatgctaagaaaaataagccagacagaaaaggacaaatactgtatgattctgcttacatgaggtaacctagaatattaaagttcatagagacagagagtagaaatgcagttgccagcaactggagtaaggtggaactaggcagttgtttaatagttgttttagttttacaagacgaaaagtcctagagactggctgcacaacagtgtgaatgtacttaatactgctgaactatacacttgtaaatggttaagatggtaaacttcatgttatgtattttttacaacgaaaaaaattcttaaaaatcaactacttagtccatttataacttatttatttattttttttagatggagtcttgctcttgttgcccaggctggagtgcagtggcaccatctcagttcactgcaacctcagcctcctaggttcaagcgattctcctgcctcagcctcccaagtagctgggattacaggcttgtgccaccaggcccagttaattttctttgtatttttagtagagactgggtttcaccatgttggccaggctggtctcgaactcccggcctcaggtgatccccctgcctcagcctcccaaagtgctgggattacaggcgtgagccaccgcgcccagcctgtaagttaaaattttttagagcatgcacttccccaaaacagtagttcagttctcaattttttgcagatgaaaatcacctggggagttcattctaggtgattccttttcaaaaaggattcctgtaagtttcatttcttttctcatcctgatttttcttagtttagtcacaacatggataaacgactatttaaaatattagatgatctacatcaagtggatttcaaaattaaaaacttttaggctgctctacagagtagccattctcttgttttttgtttttttggttttttttacttctctaatcaacttgctttcattctcaaaaaaacccaaaaaccgacctttggacttcaaaggatagcattaggaaagtaaaaagacccacagaatgggagaaaatatatgcaaatcatattatctcttaagatttatgtaaagaatataaagaatatgtaaaaactcataattcatcaacaaaaaacccaaataaaaaatgggcaaagggtgtgaggagacatttctacaaagacatagcatgtgaagaaatcgaaatcttcattcaatgctgttgggaatgttaagtggtacaatacttccagaaaacagtctggcagtccttaggagtttaaacacagagttaccatatgacccaaccactctactcttagttagatacccaagagaactgacaaaatatgtaacacacaaaaatttgtgcttcaatgttcatggaggcattattcataatagtaaaaaaaaaaacaaaacaaacgaaaaaaagaaacaacccatatgtccaactgataaatgaataatcaaaatgtggtacattcatatgctaaaaactattcagcaataaaataaatgacatattgcattaacttacactacattggccaggtgtggtggctcatgcctgtaatcccagcattttgggaggctgaggcaggaggatcacaaggtcaggagatcgagatcatcctggctaacatggtgaaaccccatctctactaaaaatacaaaaaattagccgggcgcagtggcaggcgcctgtagtctcagctattcaggaggctgagtcaggagaatggtgtgaacccgggaggcagagcttgcagttagccaagatagcgccactgcagtctggttggggcgaaagagcaagactccatctcaaaacaaacaaacaaacaaacaaacaaaaaaacccttacactacatcaagtaaaaactgtcacaaaagaacacatattgtagacagggcacagtggctcacgcctgtaatcccagcatttcggggggccaaggtgggcggatcacgaggtcaagagaccgagaccatcctgaccaacatggtgaaaccccgtctctactaaaaatacaaaaattagccgggcgtggtggtgtgtgcctgtaatctcagctactcaggagggtgaggcaggagaatcgcttgaacccgggaggcggaggttgcaatgagccgagatagagccactgcactgcagcctggatgacagagctagactccgtctcaaggaaaaaacaaaaaaattagccgagcgtggtggcatgtgcctgtagtcccagctactggggaggctgaggcaggagaatcgcttgaacccgggaggtgggggatgcagtgagccgagaccacgccactgcactccagcctgacaacagagtgaaactgtctcaaaacaaaaaaaacaccacatattgtatagttccatttacacaaaatgttcacaataggcattccagagagacaaaggtagattagtggttgccaggggctgaggagagggaggaatgcagagtgattgttaaagggtacagggatttttaggttgatggaaatactgtttttctttttttaaggaaaatattttaaaattagtggttgcacaactctggaaaaacagtgaaataatgcactttaaaggggaaaggctgggcgaggtggctcacactggtaatcccagcactttgggaggcttgaggcagaactgcttgcgcctaggagttttgagaccagcctgtgaaatgcagtgagaccctggctgggcatggtggctcacacctgcaatcccagcactctgggaggccgaggcaggcagatcacttgaggccaggggttcaagaccagcctagccactatggtgaaacctcacctctactaaaaatacaaaaagttgctgggtgtgctaggcgtggtggctcatgcctgtaatcccagctactctggaggctgaggcacgaaaactgcttgaacctgggaggcagaggttgcggtgcagtgagccgagatcgtgccactgcactccagcttgggtgacagagtgagactctgtctcaaaaaaaaaaaaaaaagttgggcatggtggcacacgcctgtaattccagctacttgggagtctgaggcacgagaatcgctcgaacctgggagatggaggttgcagtgagcccaaatcgtgccactacactccagactgggtgacagaccgagactgtcacaaaacaacaaaccaaaaaccaaaaaaatatagtgagacctgtctctacaaaaattaggcaagtatggtggtatgtgcctgtaatctcagctacttgggagactgaggtgggagaattacctaagccctagaggttgaggctgcagtgagccgtgatcacaccactgcacttcagcctggaaaccagagtgaaactgtgtctcttaaaaaaaaaaaaaatttctttccgttttttgtttttttttttgagacagagtcttgctctgtcaccaggctgcagtgcagtggcgcgatctcggctcactgtagcctctgcctcctgggttcaagcaattctcctgcctcagcctccccagtagctgggactacaggcacacgccatcacacccggctaatttttgtatttttagtagagatggggtttcaccatgttggccaggatggtcttgatctcctgacttcatgatccgcccgccttggcctcccaaagtgctgggattacaggcatgagccaccgtgcccggccaggatatttctttctttcttttcttccttcctttccctttttttttcttttttacatttttggaagttaattttattatatgaagatggtatacaaaatacattcatcatgactaaaaataataggacccaggatatttcttttaatgtctcttggtctcaacctgacagtttcccccataaaagccaaagcatgttttcccgagaagtagtaatttgtgtttttactaaattatcaataaattctaattttatcatgttaagaaaaaccagcttactattaataattttttttttttttgagatgaagtctcacactgtcacccgggctggagtgcagtggggcgatcttggcttgctgcagcctccacctcctgggttcaagcgattctcctgcctcagcctcccaagtagctgggagtacaggcgtgcgccaccacgcctggctaatttttgtatttttagtagagataaggtttcactatgttggccaggctggtctcgaactcctgacctcgtgatccgcctgcctcagcctcccaaagtgatgggattacaggcgtgagccaccatgtctggcctattaataattttatgagaacaagcagcagtataaacagaatcaaatctacaacatataggaaactagaaatcccaaatctgccctgacctgatctaaaggctggctttagtacaatagctaccagtataaattgagctgacttacatcttgaaggcaaaggctgatctgatatgaaccgaagcacactaaaaaatgcagtatcacctggccaggcgcggtagctcatacctgtaatcccagcactgtgggaggccgaggcgggtggatcacctgaggtcaggagttcgagaccagcctggccaagatggtgaaaccccatctctactaaaaatacaaaaattagctgggtgtggtggcacacgcctataatcccagctactttgaaggctgaggcaggagaatcgcttgaacttgggagacagaggttgcagtgagcagagatcacgccactcacttcagtctgggcaacagagtgagactctgtttaaaaaaaaaaaaaaaaaagaaatgtgttatcactttataaactgtttctatctgatatttcacgagactgtaagaaagttacttcctgagatccttatagattattggatctatacccttaaagggtatataagtttaatattgtagttagactgccagaaccatctaaactttcccctaattactgagagtgcatcatctcacagtagcccaatatgccagctttaataaaatctcacctatccagagtccagtggaagctggcaagaaaaagaaatcagaaagctggttacagagtcaaattaaatgggcttacgtgttaagtgactagtaagaacagaagcagcactgtgaggggaacgaaaataaaccccctatattagcttttaactacaggtgtttaaaatatgaaaatatctcaaattgggtcctagaaagcttattttcataaagcaaaatttcataaacgtgtactatagtgtcttcggtatttgcattgggaagggatctcattaacaggacctcttgccctggaagttttctcctagtggttaattccacaggttttccaggcagaaaatggttttcttcccgcctaccccctgccccccaggatggagtcttgctctgttgctcaggctggagtacagtggcatgatcttggctgactgcaacctccgcctcccaggtttaagcaattctcctgcctcagcctctggagtagctgggattacaggcatgcaccatcatgcccaacagctattgttttttttttgagatggagtctcgctctgctgcccaggctggagtgcagtggtgccatctcagctcactgcaagctctgcctcctgggttcaagcaattcttctgcctcagcctcctgaggagctgagactacaggcgcatgcaaccacacccagctaattttttgtatttttagtagagatggggtttcaccatgttagccaggatgttctcgatctcccgaccttgtgatccgcccacctcagcctcccaaagtactgggattacaggcatgagccaccatgcctgaccttctaatttttgtatttttagtagagatgtggtttcaccatgttggtcgggctggtctggaactcctgagctcatgatccacctgccttggcctcccaaagtgctaggattacaggtgtgagccactgtacccggcccagaaaacagttttctttctaactagatgagctggctgtccagtcctcccactatcaaaaatagctactctcagattggcagccaaagttacatatccaaaaatcagaattctgtttgggtgtctaccttgaaggctggttcataaacttctgtgctattttccccaataaattacaagctaatcaaagacagtacacaggacagtatggtgtgtgctctgctgccaccccttggataggggagcaagcattctggccaaaccacggaatcaaggaaatttatgatacactgcttcagttatcatcacaaacacttgctaggcttctaaactgtaatttccaaaaaacctttttgataattccttctggagttatgtcaaactctacatacatgccaatggagagaaaagatacttgctttggaagagactggaaacactgggcaactaaacagaacttccatcacaatctagactgtaggtgccacctacctgacacaggggtccactcatgcacagggagaatacgaagagataaaagatggggaaaacacttgagtaccaattttactggcttatgcttggtaagccaattctcaaggggcctacaaccctaggggtttgtaggaagttctttcttttctttttttttttgagagggggtttcccttttgttccccaggcaggagtgcagtggcacgatgtcacctcactgcaacctccgcctcctgggttcaagccattctcctgcctcagcctcctgagtagctggggtttcaggtatgtgccactacgcctgactaattttgtatttttagtagagacggggtttctctatgttggtcaggctggtctcgaactcccgacctcaggtgatccgcccgcctcagcctcccaaagtgctaggattacaggcgtgagccaccatgcccggctggaagttttttcttaaaaggtgttggttttttaaaaagccgacatgctctgacttacagagaatagtttcctaagatgcagtcggcagggaatggaatgaaaacggatggcaaaggtaaagtctcagagctgaggaagaacaggcaacaaaccccaaagatttggaacgtttaaggctaaagaggggagaaatttgggacaaattaactgagagaactcaaaatgccttacagcaacccttcaaataagataatgatgtggagggcaaagcaatgaccttaagataagcagctacttactttccactgctgatagtttaagaagataaacattcattaagcaaccctactgtatagcccagttgggcaaccttacattccatatccatgtaacattccagaggaccaaggagcaaatacacctaagaatgtaatcttgttataggattccactttaaaaaatggctcaaaagtgtagcttgcctaagaattgttttttgtttggtagatttctacaaagttgataaatgaaacaaaacttgaaacttggtcttggcttcttattccttttgaattaggtgcaaaaaattacctttcactagtttccctgcatgccccctccccctaccttctatgggggaaacattaagtttctgaatttacctttaaaataagacacctgactagggaggggaaatgcagattattaaatggatggctttcactttaaaaatttaaagggtactttaataacttctgatgttttgtatgttaggtttaatacaagcagactgggccaggcatggtggctcatgtctgtaatcccaggactttgggaagccgagacaggtggatcacctgtggtcaggagtttgagaccagcctggccaacatgaggaaacccatctctactaaaaatacaaaaactagctgggcgtggtagtgcatgcttgtaatcccagcaggagaatcggcttgagcctgggaggcagaggttgcagtgagccaagatcccgccattgcactacagcctgggtgacagagcgagactccatctcaaaaaacaaaaacaaaaccaacaaaaaccaaaaccaaacaaacaaacaaacaaaaaaaacaagcagattaacgtttttccagtaaagtttccaaacaagataaacattcatttaccctcactcctgcaagtcaatcaaagttgttagaccagtttgtgtaaacacccaaaataaaattaaggaagctgaatacttccatgtcttttaaagtgaacacccttcaggggaaaatgaaaaataaagctctcactaaggagatgctggctacacaggcaaactacaaccttctttaactgtaatagttttccttcgtttttctactatccctatactcctcttccgaaatcaaagaactagtgaatcatggggtacagcaatgtgtcacatgcaggttgtaaaaactgggcaaaacaagagacaacatacagcaatgtatccctcaaagctcccaggggcctctgcactcagattctcttcttgttctcattggttttaggggcactttggcttatcaaagctttcatcaatgcttcgcccagagggttaacgtctgaaaaatcaaacaggtgaaaaaaaggaattgtaacagaactaaaccaaataaatcccaaacaaaactcaagtagaaagataatttttttagagatggggtcttgctctgtcacccagactggagtgcagtggcacaatcacagctcactgtaacctggaaactcctgggttcaagtgatcctcccaccctagcctgggactacaggtacgcaccaccacgctcagctaatttttctttttattttcgagataggatctcacaaggctgcccaggctggtcacgaactcttgggcccaaacactcctcccacctcagactcactgagcagctaaggttataggcgcaagcgaccgtgcccgcctgacccacaaggatcttaatcaatgttcaccatcatcaacaatgctcaagaacacttcagtttgcatacctcccagccctgaatccttttagagctttctaaagaagcaaaataaaagaatacatgctcagacacaaaagatcccttcttcctccatcctgactcaatagtttctgaatagggagagtgagggtggtgatgattttggttgagacagtctcaattttgaaatatgaaagattttttttttctctgagacagagtctcgctctgccacccaggctacagtgcagtggtgtgatctcggctcactgcagcttctgcctgctggattcaagtgattcttctgcctcagcctcccaagtagctgggatacaggcgcccactaccacgcccagctaattgttgtatttttagtagtgatggggttttgccatgttggccaggctggtctcgaacccctgatctcaaattatccacccacctcagtctcccaaagtgttgggattacaggctttagccaccgcacccagctgattcttttctttgagacagagtctcactcttgtctcctaggctggagtgcagtggcgccatctctgatctttgcaacctctgcctccccagttcaagcaattctcctgcctcagcctcccaagtagctagggttacaggcacgcgccacaatgcctggctatttttagtagaggcagggtttcaccatgttggccaggctggtctcgaactcctgacctcaagtgatctgtctgccttggcctcccaaagaattgggattacaggtgtgagcgactgtgcccggcctcaaatacgcaagattctaatgcagaactagggttgagaatcactgcatctggcttgctttcttcacagggtcatctctaggtctgctgaaggtaacaagcctccacaacctcacctccacccaaagaagaagaacccagagcagttgcttgctgcatttaccctatgctatggtttgaaggtgtccccccaaattcatgtgttggaaacttaatccccactgcaatagtattgaaaggtggggcatatggaatgtgtttaggttatgagggctctgccctcatgaatagattcatgctgctatttaaaataaggtgcttataagacctgagagctacagtcacacgcgcacacaaaaaagataaaataaggtgcttataagtagtgggccatctctcttttgttctcttgccatgagaggaacagtgttcctccccaacaaaggatgcagcgttcaaggtgccatcttaaaagcagagagcaggcccttaccagaacaccaatctgtggtattctgttatagcagcacaaaaacaaaaatcaaaaaacccccaaaacctaagacaacctagctataatacaaccataatgaattgtgacagctcagagatactcaactttaccagcccgaacactcactccccctcaagtactctgccatccaagtcatcacttgtaaatcacgttaactactttcaggttaggaccaggaacgttttagacactgcttactatactccctaaccgggatgtacagtacatgctccccaagaagctttcatcccagggtttgatggctgggttgtgcctaggctatggatggccaaatttttcaccacttcccttttcaagctcccatctgtgcctgcctcacaaagctcaatttaaatctcagccagaggccaggtgcagtggttcacacctgtaatcccagcactttgggaggccaaggtgggcggatcacgaggtcaggagattgagatcaccctggctaacagggtgaaaccccatctctactaaaaatgcaaaaaaattagccgggcgtggtggcgggcgcctatagtcccagctacctgggaggctgaggcaggagaatggtgtgaaccgggaggcggagcttgcagtgagccgagatcgagccactgcactccaacttgggcgacagagcgagactccgcctcaaaaaaataaaataaaataaataaataaataaatctcagccagatcatttctgggaaagtcactaagccagcagtattacatggatcaccacctgaaaatcaatcagttcctcttcaatttctactccatttccaaaactgtcattgttttattcactgtgtgttttccatttttcttctcccaaatttgcaaaactaagtttaaacttttaaactaagatggtctttttgatatggggttaatatgggaacagaataggaggagcccagattcaggctcacgtccagctctatcacttaatggccgtgtgaccgaaggcaaaccacacaaatccctgtgggtctgtttctacttacttcacaagatcatgaggattctacgagatcatatatgtcaagtgcctagcttggagagcagatagtaactgatcactaaatggtaatgagatggagctctagttcttgactatcgcctcccctccaccagtagtaccagttggaaagaagtagcacagcccaactagaaatggggaggggagagaggtaatatcagatggggttgaagtcttatttgaatcctgttaggtcctgaagtatgagctgattttttgtagcagatgatggtcacctttacgggattacaggacttgccaaatcttccacagaacaaaagagctataccaaaaataatatggccagaacactggaaactctgtaatttatcataagggagaaccatagaaattcattcctttctaaaacttgtgtggcatgagttcagtattctgatataacctatggccagtcttcacagggacctgatactcaacttctcttttctcttccaccaagtatcaaacaatgaaacacattgtttacagtaagtgtatataagcttctttttttttttttgagacggagtctcactctgtaacccaggctggagtacagtggcgccatttcgactcactgcaacctccgcctcccgggttcaagcaattctcttgcctcagcctcccaagtagctgggattacagacacggaccaccacgcctggctaatttttgcatttttagtacggaaagggtttcaccatgttggccagactggtctcgaactcctgacctctccatccacctcagcctcccaaagtgctgggattacaggcgtgagccaccgggcccagcccaagtgtatataagcatcctgagggcaaaaatcattttagcacatagtggtgctcaaacatttgaaaaatgaataaatggccaattcctaccatcatctctatatactcttttttaagcaaacaccagagatttattctaaactaccaaataaaataccaataaaaaaatctggccgggcacagtggctcacgcctgtaatcccagcactttgagaggccgaggcaggcggatcacgaggtcaagagatcgagaccatcctggccaacatggtgaaaccctgtctctactaaaaatacaaaacttagctggatgtggtggcacgcacctgtagtaccagttacttgggagtctgaggcagaagaatcgcttaaacctgggaggcagtggttgcggtgagccaagatcgcaccactgcactccagcctggagacagagcaagactccacctcaaaaacaaaacaaaacaaaaaccaacaacaaattgtcagtccttggagaggaactaatgtgccttaaattgactaactgtccccatctttcactgcacctaaaagttcaaaccatcatactatattaggcgtttaccttaagaaaaccagcactaaacaaaaccaacccttatgaagtgtcattttaattttgttgatcctcacattaatgccaccccactccctctgctactaccatctatgaggcatgttaggaggtggatggggctgccttttataaaaggtttagttagactatcaaattaggagggatgattctgttacccttcaaagggactaggaaagttacctgaaattagtttatgcaattgaccttagagtcagatgctattaccaaatgggagaaataccaagaccggaacttactgagacattacagcaacctccaccctagggtacagaataactcagatgtccaaacattttcagaataaagttcacaaaggttcattttagctttctgtcccccagagaacaaagatttactcagtcatctaaaacaaaaatgtacacatctggtagagtgtgtacactttttctacaatgataggcattattagtcttaaaaagaaaaattaaaagatcttcacaaacccagtggaatattccaccaggaagcagctttgaagctggaaaatttctctagtgttcttacaacagtgcaaagcaagagactgcaatcacaaccagtgttcgggattcattacttcactacttagatctttctaatatacgaatgagctcctggggagggattttgcaacaagttatttctctctccactgatgctcgtcaagaataaacatgttcagtatccaagttcttcctagggtggaaatagcatgtctgttttcttttaaatctttgcacctgagtctcagcacacctgctcctcctactaaattacaaatctccatggacaagagtcttcctttcagaagggaatgggagacgtctctattcagcaaaagaaatacttgccaaagggcaaggtagtgttgtacaaattagcaccacaggctttgaaatcagaaaagtgagtacagaatctggcactgacccttactaaaggctgtgatattaggcagctatttactccctgtatgtactttaatttcttcatccatgaaatggcaataatagctttcctcacagagctgttataaggttataagggggggggtcaaatgtatgcttactcatcctcagaaaactagtttcttttttttttttttttttgagacagagtctccctctatagcccaggctggtattggctcactgcaacttccgcctcttgggttcaagcgattctcttgcctcagcctcccgagtagctgggattacaggcatgtgccaacacacccaactaatttttttatttttagtagagacaggttttcaccatgttggccaggctggtcttgaactccttacctcagtgatctacctgcctagacctcccaaagtactgggattacaggcatgagcaaccatacccagccaatgttaccttttttaaagaagaagaagaaagcattagttcccccatgaagcagatggggaaactgaagcccatggatgaataattggcttttttttttgagacagagactggctatgttgcccaggctggagtgcagtggcacgatctcggctcactgcaacctccttttaataaaagatgaatttcggccaggcgcggtggctcacgcctgtaatcccagcactttgggaggccgaggcgggcggatcacctgaggtcaggagttcgagaccagctttgccaacatggcaaaactctgtctctactaaaaaatgcaaaaattagccggctgtggtggcgggtgcctgtaatctcagatacttgggaggctgaggcaggagaatcgcttgaacctgggaggtggaggttgcagtgagctgagatcacgccactgcactccagcctgggcaagagagcaagaccgtctcaaaaaaaaaaaaagaaaaaattagccaggcttggtgggacacacctgtaatcccagctactcgggaggctgagctgaacctgggaggtggaggttgcagtaagctgagatcgcaccactgcactcaagcctgggcgggaaagcgagactccgcctcaaaaaaaaaaaaaaaaaaaaaaaaaagaccttaatcatctgcttatactaaatccccttcaacatgtactgtgttattctgtactcactaatatggagttgaaaatggtttatattatcattccatggttgtgtggcagatcatgttttcattttattacatatttcttccaaaatgtctagtgcccaactcacagcagatgtttggtgaagcccattagcttactggttaatagtaaaagtgcatttctggcttcatattcatatacccagatgtgtattttggaggaaaatctagtttataaggtcacagacacagcaggaaaacaaaaagaaccttttattttgactatgatcattcttctaaaggagatcttagaagaacaaatgaaaatgtgaaaacaagagtacaaactcaacatgcagagctatctgtatgataagaaccagttgccaggcacctgaaaatgtcaagtcctctgaacctgaaaggattgtgagaagagtaaagagagtgggcaaggatgtgtgtcaaatggcataagataaaaccgtatcagagggagcttcatcatactctctgaggacagtacccagtgagaaacctcagactctcaatttctaacctgccggggaaaaaaagcctgaaccttcctaattccttctccccctcactaagatagtaggctgctgaagaattaaaagacacctacagaatgtatcctaggagaaggttctattctgagagccctagagaataggctggactgagaagtaatttctactgtccagcctcttagttgaacagatccagcagtgggaaggcaaatttctccttcctactcttcaaataggatcgaagaccatttatagccctgctgcaaagctgacactaacttttttaacaatgaagtaccatcccaggacagggggtggtgctgtactgggccgatcctcaatctcaagttcaaagaaaacgagccctgtgaagaaagggtccaactggtgtggaggatgggagagacctataacctacacagcactctgccttaaatgatactctaattatgtactcttgcttaccttgcaatatgtccagagtaagccttccttccctggaagcataagtatatctgctattacaataggaggtctgtcaagacttgaaattcaaagggagtaattgttcattaggttcacagtgcatagaacaccatgccagatacaacggctgttaggactagttctgagttgaagcaggcagcctacatacttggaggaaactaaggaccaccaccacatcctttctaacatatatactctgtcctcttccctttactacctcttttctctctcatctatttctcctctttctcatagttcagacctgtggcatctgtatcctgatcttttaataatacagttctccattagggtatctctacagaatcaatgtttgtatatacaaaaggaaagagctaacattacagagcactctctatgtggcaaatgtggtgttaagtattttaacccatattatctcaactgttaccacctaatccaagattaatgtccatagttacacatgtggaaaccaaaatttggaaagagtgagaagtctgtagttgtttgttctatattcatctcttctcacaaaacttaaaatagtctagttcttgacttttttctcatgtggtctttatttattattattgttattattattttttttgagatggaatcttgctctgtcgcccaggctggagtgcagtggcgcaatctcggctcactgcaagctccgcctcccgggttcaagccattctcctgcctcagcctcccgagtagctgggactacaggtgcccgccaccatgcctggctagtatttttagtagagacagggtttcactgtgttagccaggatggtctcgatctcctgaccttgtgacctgcccaccttggcctcccaaagtgctgggattacaggcgtgagccaccgcaccaggcccctattattattattattttttttttttctgagactgagttttgctcttgttgcccaggctggagtgcaatggcgcaatctcggctcaccgcaacctccacctcccaggttcaagcgattctcctgcctcagcctccctagtagctgagattacaggcatgcaccaccatgcctggctaattttgtatttttagtagacagggtttctccatgttggtcaggctggtctcaaactcctgacctcaggtgatccacctgccttggcctcccaaagtgctaggattacaggcgtgagccaccacgcccggcctgggcccctattatttttgagacagagtttcactctgttgcccaggctggagtgcagtggcggaatcccggctcactgcaacctacgcctccaaggttcaagcatttctcctgcctcagcctcccgagtagctgggattacaggtgcaagccaccacacccagctcatttttgtatttttagtagagacagggtttcaccatgttggctaggctggtcttgaactcctgacctcaagtgatccacccaccttggcctcccaaagtgctgggattacaggtgtgagtcaacgtgcccagtcctcatgtggcctattaatttgtctaaccaacagtttgggggaagggaggcatggaaagagccagaatagaggacaaaaaaagtcttctttatgagcctgaactttaaatggttcaggtatttgtatcaaagaccacaatgtatcattttagctacaaccagcccttcaacgatagtgagggaaaaaaaaaaagaatgtgaaattcagtgctttgagaatattatttccaccaccatttaggtgaatattctattaaccaacaatgtttacttggggaaggtactcaaacacatccaacataccttaatttattcaaagtatataaattaagcaatctgttcatattaattatctctaagatttaaaacattaacctattcaatgatctcgccaaaacactgttaaatctatataatgtgaggaattcagtggggattctttaaaaatggttatatttgggggcaggaacaaccaattttatttcatttagaattaagatatcaacaagttatttttaagtaaacagtttttaaaatgtccaaacactacagcagaagtttgcaagctcactgaccttcaaacaagggttatggttatgagggttatctgaccaagtgttcattggataagaaacacataaggtttcctagtgaagataagtgaagacattttaacacccacagacacaacctaacccaaattaacactgtccattcctttgtcacattcaccactgtccctggctagcacaggctctagttatgattttattaacattaccttaaaactataaggtgtccaacattatttctgaggccacctcttgcctgctcagaaaacaccaagggaaaaaacaaccaataattctccccctttttccaacatacgttgacctgttttagttccttattcaagataccctcaaccacagtattggtttatgtatacatttgtccttcataagccaactgtggagcatataccaggagcaatcatgaacagggaagaactaccatcaactttaagtggggcctatgtctaccaaaataattaactggttattttactagcacacacaaactaacattcgaccaggcttatctgaaaccaaataagcatgttctacccaaatcaaaaatcaagtttatgtgtgacactcctttcaactcagaagattaagtatgatgctggttacaaaacagaatgctatgaagttccccattttagtaatgtggcctctataaatgctcttctacacacgtgtaacataaaatagaatctgttatagctcagactacattttaaggaaatctagttttgtattttctgaaaataaaatatacccattatagcacattggtttaagttctgaactctgctacatttttgctgtgacatcttggacaaattatctcttagcctcaggtgccttgtctaccaaatggtggcaatacttgtgaggattaaatgacttaataatgtactgtagcacagtctataatatagtatgtgcttaataaattattttgccaacatacttccctttattcagatgtagttagtgagcccattttgcaggtggttcctttttcaagctacattaaatttgggtcatatatcaagagataaccacataggattatcttaatttcaaaatcactcttattctagcatattttaataactactgttaaaaacaaatccatgattcctatgcctagaattctacactgctaaggggaggaaagggctttttcatttccaaaacaatactgttactcaaccactaagtctcactaccttgtcctaataaccatgcctgaaaacctcagtttcctcctgaaaaccagagtatccccaaaacatcagcaaatacagattcattttgccatccacttaagtctttaaagcccattacaattcttctaaagatattttatcactaggtaaagtaggaataacattttccactgtaccctatctatgaaaatctagagtctgactttaacacaagttggcaatgaaaatattcccacctccaaaaactggtatatactggggaatcttctgactcccttaccaatactcagagatggccaagattttaaatttccatgggatcaagatgcaaccaaatcctgattaaaagcaaagtaggacatgattattaaccacaatgtgtagcggaaggtcctccagctattttagacagcttaatcatgtctgaaatatccaaactcaacaacttgaaatacaagttgtgtcttataacttcatttttagcatgctttaaactttactgaactttgctaaacaaagaggtaaagccttcaaaagccttaaagaggcgcttaaaagtttctagtggctaggtaacatgggtagaacaaatttaagaatgagtttccttcattaagcagtagaaaggaatgctgttacttattaagcaatgtcatcttcaatgttacttcattcaaacaggcaaattatagtcatgatttaattttttggactgtttcagagaatataacgtatgcaaattaaaatgtgtaaacctgcctgctactgaaagcagtaagaacaaatccagaggtcacatccacctatatacaatactgcaacaacagcaatctataaaatgcaatactggattgaaggcttcaagtaacaaaacaagatcctactgaaacaaaagaacctggctaattcttggtagtgcaacataatgggtcgtgacctatgttaccctttctgtacagtattctcacattttgggaataactggtcactctatcatacggcacaagttcctgtaagatcattaagaaggtctggatattctattgaattcaaagaaaaacctaaggactaacaagccgctgtcttcgattcatattaaactaacgtttctccagtaaaccgaaggagtgagcacaagcccgtcactgaatggggccaaacttttagaagcctcattccaaacagaactgtccctaatttattaagaacaaaacactagtaaaaccaacctgtgaattgggccttcagtacaattaagcacatcctgtttcatataacagtaataatgaagagcttggaggggctgtcattctaaaattgcaaatctacccataaatgacaatcctgggctggaaaccagaatgtcaaattcttgtgctgaaatcaacttttcacatggcctgaggcaggccattctactattctaagaatgctcagacatacaagtatgtaataatgttccaaacacttttttttgggggggggggcacttcctgtaagtaaaaagtttctatgactgggaaaggaacaaaataaagtaataaaagaaacaggaatacccctggcacaccttcctcaaacgaacaacgttaaaaaaaaaagaaaacacacacacacagctaattttaatctagcctactctccccccaatggacacacctacagtttcttatcaaaatgtacaagactcaaagcccatttaattcaattatgaatctcactcaacaagcatcaagcacatcaggcgcctctctacagcgatatccccacaagtttcagagaaatgccagcagggactctgtagttatgattcctatcaaacggccccctaacccgtatttctcctggacatacacatgcagattcattaaccaaaacctacccagcacccctcacatcgcgcgtacgttggcattttcagtttataggtgggtcctggaacagctaaaaccaggaagctccggggtaattagaggacttgggagaagtcatcttgggacaggtggaagacccagagaaatcaggaatcagaaagaagctgtccctggccacctctgcttcccgtcccatccaaacttcacccacccgggtctcagaagcccagaagggagaggccattttaatgaggcctggctgagaaatgaagggagaagaggaaatcagggaagggccctgggaaaggaaggccgaacactttgccacaatagcacccgagtcgggtggcagcacctggagcccgaagagggaggacctggacttaagggcccgggagaggtgcaaaagtagcggtggcctaccacgaggggggccgagtgatctaaaccggggagcgcgggccccttacccccatgcggggaaaggaccccttctcgggccaaccgcgccgaccctcgcccctgggtcaggggctactacccagagatccagaaggcgggagttggctagtgcctggttctcctcatccggccatgcggcgcgggggcgtccatcctgaggggtccgggaaccaagagggcacggagggtgccggacgcggcgctcacccgcgggccgcctccaagctcttaatgagcttcttgatcttccagatctccacgttcctgtcggcagcactggggtcgtccgccatcttctcgcctcctcctccctagagcggcccggcggggcccggagacaccaagaccacagagttagcgccgccgctggggcagagcggcccccttcctcgccatcccccagaggccctctcctcccgtccggtgcagctcgccacaaaggtcaccggcctttccctccctgtgccttacctaagggcccagtcctgggcggcagcggctgctcctccccggcggcggctccgcggcggcggcggctctgacgtaggacaccggctccctctctccaggcagctgcatgtgttgcaatccgctcacatggggcctgtgacatcacttcctccgccaggggcggagtggaaggcggcaggcggaagggagggggccggtgcgagt

SEQ ID NO: 1696 - DNA, 32723 bp, Homo sapiens
accactttcacaatctgctagcaaaggttatgcagcgcgtgaacatgatcatggcagaatcaccaggcctcatcaccatctgccttttaggatatctactcagtgctgaatgtacaggtttgtttccttttttaaaatacattgagtatgcttgccttttagatatagaaatatctgatgctgtcttcttcactaaattttgattacatgatttgacagcaatattgaagagtctaacagccagcacgcaggttggtaagtactggttctttgttagctaggttttcttcttcttcatttttaaaactaaatagatcgacaatgcttatgatgcatttatgtttaataaacactgttcagttcatgatttggtcatgtaattcctgttagaaaacattcatctccttggtttaaaaaaattaaaagtgggaaaacaaagaaatagcagaatatagtgaaaaaaaataaccacattatttttgtttggacttaccactttgaaatcaaaatgggaaacaaaagcacaaacaatggccttatttacacaaaaagtctgattttaagatatatgacatttcaaggtttcagaagtatgtaatgaggtgtgtctctaattttttaaattatatatcttcaatttaaagttttagttaaaacataaagattaacctttcattagcaagctgttagttatcaccaaagcttttcatggattaggaaaaaatcattttgtctctatgtcaaacatcttggagttgatatttggggaaacacaatactcagttgagttccctaggggagaaaagcaagcttaagaattgacataaagagtaggaagttagctaatgcaacatatatcactttgttttttcacaactacagtgactttatgtatttcccagaggaaggcatacagggaagaaattatcccatttggacaaacagcatgttctcacaggaagcatttatcacacttacttgtcaactttctagaatcaaatctagtagctgacagtaccaggatcaggggtgccaaccctaagcacccccagaaagctgactggccctgtggttcccactccagacatgatgtcagctgtgaaatcagactgaaatgctgaaataacgataaaaaaaaatacagaggttaaactagcaaagtgagtaaagtcaagggataaagaaaatttgttggaaaactcacaaagcaggacataaagcaaggccattagatatatctcattagtgtgacatctgggaggacaaagcatccaaaccctttcttctatataagtggtgagatgatgaaggttgtaagagggcttctgcccccttgaagacttcagatgctggggaaaggatagataagaataaggatgaaccaggcttttggagcctgggaaataatgactagcgataaacctgaagggaagttaagtatacgatccccagataatactaaggagaaaggcaatgtgattctgcagccattgtagccagagataataagcccttgaggaaggggccaggggaatttttctaaggatagacagtattaatgcagcactctcttctgctattaaactctcattggcttctaaaaggagtttcggtgagtgatttgctgagatgttgcattttcatggctgctgcctttaggtattattgcaacagtttggaattttgaaattaaaacagttctgtaaaaccagtttagttttgtaaagtgtatgcatcaaagatgtccttcattcagacattactgagttacaactatggtgccaggtactgtgtcagggtactaggggtatggggataaaccagactccctctttgatctaaagcagcatgaggccaggtgagaggtttcaatataatgtgataaaatgtgcactaggtactaagggatcatagagaaaggaacacattaaatggggaaacaattgatagagagagaatattttcatctgggtcttaaaagatgagtaggcgttctctctctttaaatgtctgatataagggcattttatgcaaagaggatcactcgtgcaaagactcagatttgcaagaacgtgaggtatttcaggagttttgtatggttccatatggactatgacaagtgagacaggtaaactaggcagagctggtcatcagataatgaagtcattaacctaaggagattggacaataaaatgcaatatggaggtatcgaagtataaacataaggagtaccactgatggctgatttaggatgcccagtctggcaacacgctaatgaaatgatagtgggggagggggccgtaccaagactaggagagagcagtcctgagactattgcaattatctgcgggagacataaaggctagaacctgaacagtagcagtacaaaaaaagaggggagttcaaatgatattaaggaagtagaagtggtatgacttaaccatctgggtatggaaggggaaatggctagagtcttggggactttgtgtttgatgtgattatggaccacagaataatgtctaagagaactggctctttagtctgactgccagagtctgaatcctgaatgttttagtatgttaccttgggcaaagcccttagcctctatgaatctatcttcctcattcataaaaataagatgacagtgcctatctcgtgggacttttgtgaggatgaagtgagataatggatgcaaagttactgagcacagtgtccaacacagcagaagcattacatatacattagctattactggctacattatgatatacagttagggagttggaaagataatctgaaattcaggagacgtatctgactataggtgagtatttggaactcattgttctgtaaacagtagttacagccacgtgtgtgggcatctggagagtgagcatggatattgtgatacctagtacagtgcctggcagtagtggttgtatgctcagtaaattttgttgacagggtcagggccggactagactgtggtaagcaaggcctgtagggcataaatatacttgtatgccccgagaagtgaggacctcttaaatattgtgccctacatgccttgtttggttcactcttgtcccagccctagcaagtatatataaggtgaaaaaggaaaaagctgaggctggagcctgggagaaccctggacatttaagggccatggagaggaacaggagttaatcaattcaagtgctggatggataacaggagttagagcaaagcggggaaccagaatagagtgattattataaaaagagtttcctaaaaagggagagatcaacaattagaaattatttagagcagccagtaaatacataaactcaaaattattctttaggtcattcctgattgtgacaatagtcatttcattatataaatgtgattaaggaaggaaaagagctacacagaagttattaaagagctaaagagaattgagaaatttaaaacagaagaaagtagggccaacatgaaaggagtagggagaaaaagagataaccagcatattgtctcactgatcctgccaacacctgtgagatagatattcttattatactactgttaaacctaatttacatttgacaaagttaaggttcagagcttgtgtgacttgtccaaggtcacaggtctagaggaggcagatacttgattcaaacctatttctgtctgatctgattctaaagtctgttttttcactcaaccacactgtacagtcagctctccttgtgagttccacagccacagattcaattaactgcagatcaaaaatattcaagaaaaaaatggatggttgcatctctactgaacatgtacagactcttttatctttcattattccctaaacaatacagcataacaactatttacatagcatttacattgtattagctattaagagaaacctagagatgatttaaagtacaaaggaggatgtgtttaggttatatgcaaatagtaagccatttttatatcggagacttgagcatccacagatcttgatatttgcagggggtcttgccaccaattttccatggatactgaggaacgactgtaaatggatgcaggcatggatgctatttaggagtgtccagggccaagtaaatgagttgctgagcagagaggtgggtggaggctgtgaggcatcaatatgtggtggcatccatctgcattttggtgatttttttccttcacagtcctcggctgtctgggaagagaaggatgaaggcagatggctgctccaatttaggggctaggattgcagggtgggcacagcattgcaaacgagtgaaggaaattgagaaatatggccaatgaagagttgaagagaggcctggcatggtggctcacacctataatcccagcactttcagaggcccaggcaggcagatcacttgaggtcaggagttcgacaccagcctggccaacaaggtgaaatggtgaaaccccggctttactaaaaatacaaaaattagctgggcatggtggcgggtgcctgtaatcccagctacttgggaggctgaggcaggagaatagcttgaacctgggagatggaggttgcagtgagctgagatcgcaccactgcactccagcctgggcgacagagcaagactctgtcaaaaaaaaaagagttgaagagaaaaagtctaggctaaattcaaagaaaaaaagtgagcccaaaaggaacttgcagagcaagggaaaagcagggatgtcaagggactagaacactccataaagtgaacagctgcaatgaaaataagggaagaaagtttagttcatctccgtttctttcctttcctttttactttcctttctcttcctttttggagttaatcaggaagtagtcccaaataccccagaaagttcatcttataagcccttggtcctcttgagatggtatcagatatattgctagacccttgaagaaaggaacaactccaggcaacttcttgagtccctgttattaattttatacatacacacacatatatgtatatacatgaaaacacacaaacacatgtgtgtgtatacagccatgcattccttaacaatggggatatattctgagaaatgtgtcattaagcaatttcatcattgtgcgaacataatagagtgtacttacctaaacctaaatggtatagcttactacatacctaggttgtattgatgtggcctattgctcctaggctcctgggctgcaaacctgtacagcatgtgactgtactgaacactgtaggcaatggtaacagtggtatttgtgtatctaaacatagaaaaggtacagtgaaaatacagtattataaccttatgggaccactgtcgtataatgtggtccatcattgaccaaaatgtcattgtgcagcaaatgattatctcatatatatatatatatgatatgatatatatgatatatatgtgtgtgtatatatgtatacatatatatgtgtacatatatgtatacatatatacacacacatatatatgtacacacatatatgtatatatatgtacacacatatatgtatatatatatgtacacacacacacatagagagagagagagaggagaggagaggaaggagggagggaaggagaaatatgattcagatagagacatctatcctccagagttcaggagtgtctcttcagactaggtagatgtagcttaaaaaaaacatatcctgaattctagagagatgcttaaatcactgcaattcctataacacttgccaaccaaaggtgctgttgatctgaaattgcttttttaaattaatgcagtgatttttctttaacatctagtgacagacactggggtcacatttgcagctggaccataattaggcttctgttcttcaggagacatttgttcaaagtcatttgggcaaccatattctgaaaacagcccagccagggtgatggatcactttgcaaagatcctcaatgagctattttcaagtgatgacaaagtgtgaagttaaccgctcatttgagaactttctttttcatccaaagtaaattcaaatatgattagaaatctgaccttttattactggaattctcttgactaaaagtaaaattgaattttaattcctaaatctccatgtgtatacagtactgtgggaacatcacagattttggctccatgccctaaagagaaattggctttcagattatttggattaaaaacaaagactttcttaagagatgtaaaattttcatgatgttttcttttttgctaaaactaaagaattattcttttacatttcagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacagtgagtatttccacataatacccttcagatgcagagcatagaatagaaaatctttaaaaagacacttctctttaaaattttaaagcatccatatatatttatgtatgttaaatgttataaaagataggaaatcaataccaaaacactttagatattaccgttaatttgtcttcttttattctttatagactgaattttggaagcagtatgttggtaagcaattcattttatcctctagctaatatatgaaacatatgagaattatgtgggttttttctctgcataaatagataatatattaaactttgtcaaaaggactcagaaagatcagtccaaccctctaacccatattgaatggtgatatactacagggttatgccagtgtgggaactatcgctggtaaataagtttaatcctccctagggcttcacaaagaacattgttccaccccaggagggtggaaggaagaaactgaaatgattgtgtcttagaacctaatgaaagtttgcattcctcagtaaaatcagagactgctgattgacttaaatgtttatagcttcaaagtcctcctcattatcatggcccacaagcccttccatgattgtccttccccaccctccccattacccttcttgcctcctctgctacttctctcctcgcacactgggctccagccaccctggccttcctgtcacttcttgcacactctaggaatgctcccactttggaggctttatctggctgtttctcttatttggctgttcccaacttcctgtgggctgactccctcacctccttcgggtctttgcccaaatgttaccatcttaatgaggcctaccttcaccatctattaatacttcaacctgccccagtagccttaccactctagacacctgtacagaactccactctactttttaacagagcttttcaccatctaatgtatcatataatttcttactcatactatttatcatttattttctcctactccactaaaatgcaagtttcatgttggcagggatattcaattgttttgtttattgatatattcctagcacctagaacagtatctggaaaagaggtactcagtaaatatttatcaaatgaattgaccaaaagaaggaaaactcaaaactttaatgacaactaactttaaagctacaataacttaaaattcagcagtaggattttgagggagggtaagtttcaaagattgacttacctaagactatctgcataaataaaaagaaattaatccagacaacaaattcaccaacttccatcaattggaaatccaattctattttctacagtttatgttctggagacactactggacactcttttactctcataactcataactcctccacttttgtttttaaatcatgagagaaaaagagttgactctgttatattgttttatctacctttccttgatcttagaaacgaatactaccataccagcttctactgaggtgccccctaaagttagtccaaataggtctttgcaatctccattcccgcagaatttagaactttgaatcacatgatttatttctaaaagtaaatccatgccgattttccccaccaaaaaattcctgactattaaactcctacaatcccttcattgctcactccccacccccaggatcatattttaaagttgggcccttgccttttgggtcacataggtacactgtttgctataccacaggtatagctatctggaaaacatggagggtattattctgttactactgcttcgtcaaccaaaaaataaaacaaaacaagaacaaaaaagaaacaaactccctgcctcttttcacttgcagtcaaggttcctaaccactacaaaattagcctatgtttcttcttgcacatagtagaaacccaagcttctcactgctgtgctattctgtaccatcaactcatcacataaagagcctggttgaagaatgattgtccaaccacattactagcatctgtcaagactttccagtttacaaaaggcctatcacatttaaccctcacaccatccttgtgaccaaagcattattaactccattttacaggagagtaaactgaagcttagggaagttaaaagaactgccaaaggtctcccagttggggagtcatgaagcccagaagagaagccaaattctctgctgctcaaccccttgctttcactattacacctcagggccttcaaatctaaatgcagttattcattaaacaggaacctggtagtcttaaacaggaatctctcacttggtaagatcttgtctcttgttgtatttgaccccaactgtctatggctttgcctgaacccaaagtacacacagcctagaaaccaaaggagaaccaaatgtgggataaaatgacactcattttaacgacatgtctcagcaaatgagttcctgtgtagctggctgaaagcccagaccctttcagtaaaacatcctgaataattcacatttgttggtctataatataaagggcaaatgtagctcatttttagaccagttctgaacatcaatagtaacaaaccagagataaccgattttgttttcatagaattggaacaaattagagtatctgtgcaaaagcatatcagatctaggagcagaggggacaaggtctaatttttaaataagcaaattttccagggagggactacttatgataaagggatattagtctcttagtcaacggaacctggatacacgcttctgacagagaagagggagaataggcaggaatctacacaccagatgtcaaggagatttgctttaaaatacgactgataattagaaatttctcagtttcccccttttccctcattctttgattcttattgttatctttatctcttactcctttgtttctcatatattgagtcttacagatcaagctcctatttttttcttcaggggtatttttctagttcaaagtgcctaccatctcccttctggttctattcatccttctctcccaaagctcctttagaagtgtggattaaggcagagcactaagaaaccagacttaaagattcccttctcattctgacttttctcctttcacctattccttcctcctgttttcttaccatcagtgtcttcaaaggctttcaagtacacggtaaatgcagaaacttcaagaaaggcagaatggaaacataaccaatgcatacataaataaagcacactgtagaatctttttaaattctgtatgatatatcgaatgctgtctctcacattacctagaccatttgaaaccgaatttgtaaaacatagactatctttaagtagtaacagatgcttctgacatgttttctattgtcttgaaccattactgcatatgatacatcaaagttaagtgacaatacaagaaagcagattcatttgctccctgcctaggccgtcagttcctaaagtggaaacgccatatattatctagctcagtttgctctacaagacctgcaatagagccttgtgtgacatagagataatatttgttgaagcaattaaatttgacttggaattaactctgccatcattctataaggaaggattgaaaatccttctcaccctgtgctgatatagtacctttctatacaaaaacgtccttctccctcttcccttggattgcataaactatgtacatgccttcctcagggcacttttctaggacagtgtcagcctaaggatctttgtttgggtggcttttagaaactcaggaagacaggagcatcatatgcctataggcagctggcttccaggtcagtagttttgctctgaccctaaaatcagactcccatcccaatgagtatctacaggggaggaccgggcattctaagcagtttacgtgccaattcaatttcttaacctatctcaaagatggagatcagtgtgagtccaatccatgtttaaatggcggcagttgcaaggatgacattaattcctatgaatgttggtgtccctttggatttgaaggaaagaactgtgaattaggtaagtaactattttttgaatactcatggttcaaagtttccctctgaaacaagttgaaactggaaaatgcaatattggtgtatcataatttttcttaaaaacatacctttgatgcttataaacatttcatttgtagtgatagttttcaggatatgagttcaagaagctacattaaaatcaataacaatatttggtaactaatattaagtaataatgatgttccactcacttattaatctttaatacaaccgtatgtggttagtactatcattatgcgcattctatgcagatgagaaaaccgcaactccaacggccaaaaattacagaggcataaatggtttagacaggacttaaacttcagtgtgaccaaaacccatgcttctaactactatattcaaaactcagagaaaactgaacccagaaaattgaaatcatgactaaattgctatcaacataggtagtgaaagtcaattaagtacagaactggagtatgactggccaattatcccatataatgggaattctccacatgtacaaaccacttcatatgctaaacttgttgacaacattcaaagctcatccctgaatttgactatattgattacatcaaaaatgttacatagcaaccttagaatccttgtgtaccttttcttctcaaagcctagattatttctttttccgacgtttcagtaattggagcagtaaaccccagtgtcccttacctacttgtttattacctccagatgcaatattactggtactgtgattgagaaacgcacacagtgctaatgaggaattcactttctactctgacactctggaagaatagagatgcaatcctaaggaagaatttaacaccacaggctacatgactaaggataaagagtagaaaattagcaggactctattaaggcattacagcaatccacctgacagatgaaaaaggcatgaaatgaaatgaaatgtagcagctacactcgtcctattgagaaaggaaaaaagtcacctgtaatgttgttcagaaatcctttcagtactaaaaaattcattgaccatcttcctttagtctcgaaaatttcttagaaggtaaaaaaaggaaaaggtgacagggcaaagacatttgaaaagaaagaaaagagtgaatgaacttgcacacctggcttggactcccattcccttaggtttccattgtgggggacaaactaatgcctgggttacctttcttgagagtgtgttaattgattcaatatctctgaagtgctactttcatctgaaaggttataatttgaaattcagatttacctggataaatttgatcttgctattatggaaacctctagaaatccttggagtagttactcattatcagcttaaataatatagccggtggagctgagggaatgagtaactcaattagtctcagttacaactgaagggcacattgttgtaaactataattgaaaacataaatatctttacctagtttaaaaataaagatgctttaaaaggaggaagggaatagccctgaggaatgtaaatataagcacaaaacttctacaacagagtttgctacgtgtgtggctgtgttccacccagcaaaaatgctaagtctacaactgacacaacttggatactctcatgttcccacattttggtttggtcaaggctgtgcagttgtactgcagccaccaccactcctggcctctacagtatattgatctgacccaccaatctgatcaaggtttagaaaaatattttcagcccagttagctcacaaacaaaatgagaattcccacaaattgctctttatctcagacaacagaggaaagctacagcaaaagcataaacaaattaccatttaagtttgttgcttcaaattaaagactaattgcaacagctactagatagcacagtttatggggcatctcggccccaagtcttttgtcttataaggtcttgaaaaaaagaaaggagattttcatcaataagagttttttgttatctttttcccttgttcatcaggcccttcactgcgagagagaggtgtaaacgttcagggcatgcattctagttaaagaatattaattggctattgggtccctttggttagaataaagacctctgtatgatgtccctagctgtacatcaaacccaaatatctctcagataaatgaaggtctgtaagaatttggtcattcctgtctcttctaaagagtaacagaggcattttcccgcagtaaagtagaatggaaagaaaacaaaaatcacaagcctataaacaccttcttcaattttcccagcatgtcacagacactactgtcttatttactacgtatttctgaggagtaaaaaaaggaaatatgttgagtttagctgaagcacagcatattttgtggtaaacttgttaaataaaacatcttttgtccaagctttggttgtcacacaagtggatatatcaggaaatataaaggcagaataaactaaagcagaacatactaacatttgtagtaggcatgaagggaattagaaagtgtttgtgttaacatggagggagggagaacagatgctttgagatgttcttcaacagatattctaggcactgagacccccttcgggaccagagagagcccatatccaccacagtacctgacacataaatgctcagtaattgataaatgagtcccattctaactgttccttagccctgctctatggaactctcccctggaattccttgtgccattattttatttctggaatcttcagccttttagctgagggcaaaagattgctgattaggaagcaatatttcccacctcctgcgcaaaacaagccaaagatcaacagcagcagcaacatactgagccctaaagggcaatgacaaatgtggagaatgatacagaggtctggttacttcttagccaatgacacagaatcacaattgagaaaacacagagtttattcattcccattgtgcatgccctggacaaaccaagctgcacctttcgtaacttatcacaatctcatattgacggaacactttctacaggtaatgtttgatttggctgaacactttagcattgcttcgtagcaacaaaatgatagctagtaacagaaaaagatccagggatattaccactgttagtgaggagaaaggccttttaattaattaattaattaattaataggaccaagtgccatctttttggatcatgcccttagtggattattggtagcaaaggttaaagctcaagctggttcctttgtccccctggcaacagttgatttgcctccctttatctcctgaagtatccgtaaggactaagagccaattattacatttggctatgctagcatatgtaaaatagagtttaaaagtttagattcatcactcaaaaattcatattctccaaaaccatacagtcactctgttagcctgtgttcccccagaaaaaaagtcacaagcttatttattaacatgtgcaatcccagggggcaagagaaaggaactgaagagtgaggcagaaaggaaaagaaagccaataagaggatgagttatcaaactactcgtttctaacagcaactgattgcttaacttcctgggactgtctccaataagtcaaattggcctcaggttagtccacctgagtgggaagaagcggtgaaagaatttgtctgtcagtatctgtctctcattggttagaagttcgacttatggggaattaactccctcacatttcctagttggatatgcttgggtacccagagggtcatatggcatccatgcctcagcatgaacagggaagcttcaaggcaaaagacacatagtgcagctatgagccaaggcaattcaaggatacacccataggaggctggttgacatccacccagagctaatcaccaccatgctggaaaaagacacaggtgaagctgagaagaatgaaggtggtgcataggaggtatctaatacagtcactcattttcaaactttccatgttatgattgcactgaccactgaggatttctattgaaagttttactgttgtcaaacacgtacacaaggggaaaggtgtcttacattgtttatgttcctgtgctgctctagaaacagaaataggctcaagagcagagcctgtttttcttaattcagcaggtctaagctaacaagtcctgaaacatggtacttcctgttattggtattgcataggagaaacaaagggaaagcacagtaattagaaaatacaaaacaagatggcaggaataagccaaaaatatcaggaaacacaattattgtgaattgggattaaactaatctattaataatgacaactttcagcttggagttaaaaatttaattgtatactgttaacgaaagtgatacctaaaataaaattacactgggaggccaaaatgaagggatgtgaaaagaactatcaggtaaaaactaacaaaaagaaactagcaaagcaatcttaatatcagacaaaatagaatccaagaggaaaatcatttcaaaagacaagagattttttttattaataaggggaattgcataggagagtaaagaaaatgtgggccactggaatgcttagcactaatgacatattggtctttggtcttcagttaccttacaggaccctatttcattctcttatgtttgatatgtaaccacctcagccagcttcaagttgctttttggccctaatggacttcctagcactataatttcttttttttaaatgttttattttaggtttaggggtacatgtgaaggtttgttacatagataaacatgtgtcacaggggtttgttgtacatattattacatgacgcagatattcagctcagtaccaaatagtgatcttttctgctcctctgcctcatcccaccctcctccctcaagtagactccagtatctgttgtttccttctttgtgtttataagttcttaacacttagctcccgcttacaagtgagaacctgcagtatttgatttttgttcctacgctagtttcctaaggatgatagcctccagctccattcatattcccacaaaagacataatctccttcttttctatggctgcataatattccatggtatatatgaaccacattttctttatccggtctgtcattgatgggcatttaggttgattccatgtctgctattctaacactgtaatttctaaagacttccagattctacttttataggtaacctgttaaacagtctagctctggaagccaagcaatttctagaataactaagcaatagaaattacacttcaatgcagaaaggcagtatctacatgagattatgaaattgcggttgctttttgtgttcactgaaaaaaataagtaaaactgtaactttcagaaaaaatgattgtacatatagaaaacccaaagcatctaaacaattaaaataaataagtatagaaagattactggatacagagtcaacatacaaatatcaattgtatgtctatataccagcaacgattcaaaaatgatttttataatagcattaaaaattagacgcttagtaataaatgtgagaaagatgtgcaagaactctacataaaaaattatgagacgttattgagaaaaattaaggaaaacctaaataaatgaatgaataggcaatgtttatcaattaaaggatacaatatagtaaatatatcaaatgtttactaatggattcaatgcaataccaaagtgcccagcaggctttttttggtggtgggaggtcgggcaggattcataagctaattataaaatgcatatggaaatgcaaagagccaaggatagccaagacagttttgaggaagaataaacttgtactacttacactaccagatgtcaagacttattatcgagttacatttattaagacagtgtggtactgacacaaggatagacaaatagatcagtgaaacacactagagtgctcagaagcacacctgtacatatataaaggcttgatttatgatagaggtgccagtgcagtagagaaggaaattattggtgttttcaataaaaagtgataggtcaattagatattcatatggcatgaagtatgaaacaataacaatttatattcataacttgcagaaagcaaaaatttcttaaaatacaaaaagtgatcaccataaaggaaaagattgataaactggactatattaaaactaaggactcctgttcagcaaaagacactacttcgactgaaaagacaagtcacagagtgagacaagatatctgcaatacagatacctaataactgaaccccatacagtgatggtgggaatttaagttcgtacaatcattttagaaaattgcttggcagtatctactagatctgaacatgtgatccagtaattacactcataattataagccagtaaaaaggcatgtttatgtcaccaaaagatatatacaagaatgttcattacactattatacataagagccaaaaactggaaacaaaccaaatatccattaacagtagaatgaataaataaaagctgtaatagtaatacagtggaatactacacagcaatgtaaatgaactactgctgtacaaaacaacatggtttaatctcacagacaaaatgttaaatgaaagacacagacgagtacatattgcgaacttctgtttataattcaagaactggcaagaactgtttactgtgttagaagtccaggtaatggtaacctataaaaaggaaaaagggtggaatgattgggagggggcatcttctggggtattgataatgtgctatgtattggtcagtttagtgtttaaacaggctcatttactttgtgaaaacttacactaaaattgtgtgtattttttgaatatatgttatacattaataaatagggtttttaaacctgtagttcataatttagtgaaagtagaatatccaaacatttagttttaaaccaatcaattatagtgctaccatcatttttatgcattattgagaagtttattttacctttctttccactcttatttcaaggctccaaaatttctctccccaacgtatattgggggcaacatgaatgcccccaatgtatatttgacccatacatgagtcagtagttccatgtactttttagaaatgcatgttaaatgatgctgttactgtctattttgcttcttttagatgtaacatgtaacattaagaatggcagatgcgagcagttttgtaaaaatagtgctgataacaaggtggtttgctcctgtactgagggatatcgacttgcagaaaaccagaagtcctgtgaaccagcaggtcataatctgaataagattttttaaagaaaatctgtatctgaaacttcagcattttaacaaacctacataattttaattcctacttgaatctgcttccttttgaaatcatagaaaatatcagtagcttgaattagaccaattaattttctagattgcatcatattttaaatataaactatgtaatcatctacaacctgaattctttctgtgtccaatttgtccaatttttttctctaacatttatatcacaaagcaattaatttgtgtgatttctgcatatgtatttgtaattcatcaagtcaaatcaatgtagtaatactatatcataaaatatacacaaataattgagtgataggcttctagtataaggacggtaagtttgaagcatgattctatctgggctggctagtttactctgagaaagttattttttattgttgggtcttaagctgagtttacacacttggtgtcagaatgattccggcaatgaactgttttatgttctgctaggctgatcagcacaatctatatggctgtgaacaaaacaatgtttcccagtcatgccaaccatgccaccattttaacagctgattagtgtattcagaacatctccactccatgttcgtatggctgttatctaaagatgaaagcagtagacacttttattttttgaaaaatttaggctctgcagggtcaattatatttgataaatgaggggcttttttgaagcaaactagatataatttcttttgcatttctaaagcctgatatcttattaattggtacattaaattgtgcaccatttctctgtaactgtttcagtacctgtctcagcactataccaggcagaagaaattaaagaaagaaccagtgccgagatcagcttggtcagggagaccctaatcctgcggcactagaggaattaaagacacacacacagaaatatagagtatggagtgggaaatcaggggtctcacagccttcagagctgagagccccgaacagagatttacccacatatttattgacagcaagccagtcataagatttactgaaagtattccttatgggaaataaagggatgagtctggctagttatctgcagcaggaacatgtccttaaggcacaaatcacttatgcaattgtctgtggtttaagaacacctttaagcagttttccgccctgggtgggccaggtgttccttgccctcattctggtaaacccacaaccttccagtgtggatatcaaggccatcacgagcatatcacagtgctgcagagattttgtttatggccagttttggggccagtttatggccagatttggaggcctgttcccaacaaaccagaagctaggaatatatatcctgcaaataaaatgaagaatctctaaggcttcagggcctgcccacttgttcttctgcctggttcttcacatacactgtctcaaagctagtctaccttgagaggagcatgaatatgtgtgtgggtgtgtgtctgtgtattttaaccttaaaaacctaacttccagtatagacagatggcatactagctaaacccttacaagttcttctatgctataaaagagaaacagaattgagaaccacctccaactattaagtgttatatttgaatatagccttagctttagcagaataagtaggccaaacttaaaataagcttttctgccttttcaatgataaaggtcccttttctgtagccattgttgattgtgtacacttatacataagtattttgaactaatttcctgttttctcaaccacttgctgtcttcatgatactttgtcgcagctggttgctatagaaatgtctgttacaaggaatgtggcttgaaggaaagtgataaatgaaaatgaaatgtgaagtgactttgtttgactacaaattcccattctggtagtccccagtgtatcaatacattatttttctttagaaaataaaccaacccaaggaaaaatggtgggcaggtcctggtgaatatggctgtgataattatattagcaatctctttggctaatatttgaagcccaaataattgaatcacaatgatctctccccagaaaatatataaaatgcaccttggaatctagaaggccttttagtctgcaaaagaaaccttcttaatcataagcagcagaagtcccatttaccaaattggaaagttaaagttacaaagcatcaatcataagacttccattcagggatggcaattgggagtaagactttttagtaaagaaactaaacacaaagtcattagactctgtaaaagtcttaccaaatttgattctggaacacctattctatttccgtaaagatgatgaattccggagccaaatgttcttttcatgaaggatttgaaaactgtccatgaaaataacgcaatcaaccttttagcttgagactctattcactgattagatttttttaaatactgatgggcctgcttctcagaagtgacaaggatgggcctcaatctcaatttttgtaatacatgttccatttgccaatgagaaatatcaggttactaatttttcttctatttttctagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggtactttatactgatggtgtgtcaaaactggagctcagctggcaagacacaggccaggtgggagactgaggctattttactagacagacctattgggatgtgagaagtatttaggcaagtttcagcactaaccaatgtgagaaggcctccagagatgagcagttggtgaaagagaggctcaaaaccagctaccatacaggtcaagaagaatttggcattaaggaaacagcatagcaggattccagacaggcaactggtcaacaacatgaaggtctggaagaaaggtcgcaggtactcaggttcagggcactacttcagcttcagcccttgcaaaaactggtgagagttggaaagtctttaggctaagaaaaattggattatttaaaagggggtaaagaaagggactcaaggaggaaggattaaggcaagaactaggttccaagaaacagggcatgagagagagtcttgatctaccactatagttctcgtggtagcatcagaatcacctgggaacgtagaaatgcaaattctcctgctctacactagacctaccaaatcagaatatctagggggtggggcccagcagtctgtgcgcaaacaagcactgcaggtgattttgatgcacattatagtttgaaaactaggccaggtgcagtggctcatgccaataatcccagcactttgggagactgagacgggaggattgcttaaacccaggagtttgagaccagcctgggcaacacggcgaaaccccacctctaattaaaaaaaatacaaaaattagctaggtgtgatggctcccacctgtgctcccagctattcaggaggctgaggtgggagaatcacctgagcctggaaagtcgaggctgcagtgaattgtgatcacaccactgcacttcagcctgagtgacagagtaagaccctatctcaaaaaacagaaaaagaaaaacactggcccaaaggaaatgaacttgttacagaagccggggttcaaaacaccaaataatgcacttgtacctagtccttcccgggtgctctgcagacatttctccaagcgtagtctgcaaacaacctacatatgtagaattacctatgcacatttttcatttaacaaccaagagctacatttgtagcaaaatctgggttgtaacttagcctacagctgaagcctaagagattccgtctgtgagaagaaataacccacctctttggcccccctccccaggcaggaagccaggatggtccttatataaagttgtgctgtccaataggtaaccactagccacatatggctatttaaatttaaattaactacaattaagagaaattaaaaattcaattcctcaattgcacctgccaaattttaagcacataacaaccacatgtggctagtaactactgtattggagagtgcaagcggagatagaacactctattactgcagaaatttctattggatagcacttataatagtttagtgtaacttaaaactccctagttgccacagtcatgatttagtagtaatttcatggatttctctactgaggttagaatctctgccattagagactgataaatttaaagtttgcaattatcaaactggtgacaatttaagccagaatcaggtaaatgtcctcagttttaacagcattggaattttctgggactagctgtgtatctatccaggattcttgagaatgcctgccatttttcaacataatggatgtaaggtattacacatatacctggggatggggtggtaggtataattgcacaagcattgtggagaatggtatcaaagagtggcagaacatcacaatcaaggttttccctttcttttacctttgctttttaaaaagacaatatttgctggacctgatcttataactcataaatgggacactgtatgttcctttttacctcctctgtttctacttaattgcaccctatgaggactgcttcccttacctaccataaccccttccttcactcatccatatctttactcttcttcacaactctgtaatattgaccttctttatgaacctttcctggaacaatccctcttaagtgcaagcactgttattatgccttcaatgtatttaatatccatgtatctattctctctaattttgtcattttgtgttctcatgtattttcattcattatgtgtccaacttccatggataacatggttacaacaaaagatcctactttatgacaattatcttccttgggtttgtgggacatagaacagtgctcagagtaggggatccaagaacccaggagaatatattagctaagaagataacttccgtttttaaaagtccaagattcaggagatcaaaaccatcctggctaacatagtgaaaccccgtctcttccaaaaatacaaaaaattagcccggcgtggtggcaggcgcctatagtcccagctacacgggaggctgaggcaggagaatggcgtgaaccggggaggcggagctggcagtgagccgagatcccgccactgcactccagcctgggcgacagagcgagactccgtctcaaaaaaaaaaaaaaaaaaaaagtccaagattaaaaaaaaaaaaaaaaaaggatgtctgctttgtgagtttagcattgtctccttgtcattccagaaatgaaatggcaaatacatttaaatcagaactaaaaaggggaacagggtataaaggctcaatttagtcacatcatttccgtttctcacccaccccctttaaaccagatgtttgccaatgcattaacaatgcagatgtttcctgaaagaaagtttagtaactcaagcagacaccttattttcttttcaagcagaaaagactatgagatggtggttgtggttgttccgggagggagaagatataaatgatacacattatttcaaatcatttcatgacctcactgcacacttatagttattgtacctgttgtctttttgctgtcaagcctagctaagatcatttggaatgttcaagatcactcatacatgcatgtgcacacatacacatgcacatatgttcactccctatttcatccacatgaactaagattactgatgtgtacagattcaaagcacttttattcttttccaaaggcaagaagctgagctactttccagaatagttgtgaaagaccctgtcatacttctgcattgtttcctccacaccacctccatccagttccttatgaatggttactggttttcaaaaatatgagataaattgagtgtataaaagtcatttttagacaaaatgaaacaggaaatgaaagaaaccagaatctctcctcatttgtggatgggccagctccaccatgtcatggttaatctgcagggaggaaatactagatttgattgcagatcagactgcagcaaacctgctgtgactaaggcatcaagagaaagcaagcaacagctggggcttcagtggtgaaaacattatatatctagctttgaaatatgaaatactgtttagcagtgtcacctagaaaagagtgtttcaaaatgctgatgcttcataagaacctttctcttcagagttgtttcttttatctttcaaattagccagggtgggaaataaagtgatcacttggtgaagaaatctcacaaagaagaacatagagagttcactttcatctggagtaatgaacagattgaacaaactagaaatggttagtctgttaaagaaaaggtgtaggtgagctgtttgcaagagccacaagggaaaggggaagacaacttctttgtggacttaagggtgaaagttgcaagcaggcaagacgattctgacctccattaagaaagccctttccaaccaacaaccactgggttggttacgcaggttgggcagcattgggagcaaatgttgattgaacaaatgtttgtcggaattgttgacttaaagagctgttctgtcactggggacagcagcggctagatagccccattcagggagagggcatttgttcacctggccagagatcagagcaggctaagggactgctgggatcctgtccagctttgagaccctacagagccatgttcacctagcacgtatcccgtctgcggtcacgctcatttcttaccttattccagggctttcacctcagcttgccaggctggagccaagggccaacgcagccgcgccttgttcgcgatggtagcttcccaggagccccctatggttccggaacggcgctgccggccccatcctgtttgctacctcctaaagccaaaggcactggcgggccgggccagcttctaaagtcgcgcaaggttagaaggttccggacaggaacggcgtgaggccaatggaaggaggtacttcagtttccctccagatgcccagcgatgggctcagagctccttgagaactcgggaaaggaagcagggtctctgaagaaatacttcaggagtagaaagaggaagctagagggttaaatgcactacacaggaacagaaatgagtttttcttagagttagtatatgtctagaggtgtagtaaactaaaacaagtcttgaattgcataccgccacgtagggaagaaatgaaaacctttgaatattagtgaaaaaagggaaactgcaacgcctgtattactagatagctttcatcaacagctcaaaaccgacagatttaaagaagcaacaccgcattttggctttctaaagctttaatttggtttggatcccatgcccatgaccctgccagctgacaattctaagcatgcgcaaactggccccaaaaattcctcccacatttccgaagaactatttggccctttatgtgaagtacctggtttttccattttctgttttaccataggcctcagttcggtgtgtggcgtatttattctacatttaacaatttgaagatcattctattagattaaaaaaaaagaatacaatggaagccaagtgattaagctttccttatgcttatattaagttgtagcatatgcatttaccgatagttaaccgtattaacctacagaaaatgtccagggaaatggtctatttcttattctatttttgacctaaagaaaatctttaaaatgtcttagcattttccccagtctccatccactttcctcagctttggcctgaagctatctttaaaggtaccctgtacagctcttgccctgtacagctagctacagagattcaatcctttctgttcgattaggacacatctcagtggcagataacatgcaaagttattatatgtatgaaccagaacttgtttttccttaggggccaggatgttacactaaggtcttaagactatagtaatatcttcacttgaaaaagccctctattattcctatctcagatgataaaaattcaattaagagaaataagaacgtgacatgtgtaatcgcacctggctctacaaagctagtctggacagacatttaaacaattatcctctaagattatttgatgaaatgcatttcaatgactagttaaccattaaaaaccaaagtgagcatcccatctgttcccagtcaaatgacctagagcaaaggactaggcaaaccacatctgtgggcatagcaagctgtacatcacaaacaaatgaatttgctttgtatatgagtgagagcaaacactctttattgtacaacttgggtgggtaagtagggagaataatggttttactgaaatcgcaggtaacggttacgttggagttaaaggttaggaagaaaaccaaagggtaagagctgttgttctgggctggcattgtcaatgaagagcataaattcagatgtgaatgtatattttgtagaagcatgtgtgttgttggtttttgtgtatgtgtgagtctgaaagagggaaaacaggctcccattagactatgactaacaaaaatgtttgacagattataactcagatgtcttactcagagcatatgccttcccattttccccattattccccaacatgatgtctttaagaacttgtccttgaccgagcagacatctcataccccaaatagctaatattttgatagctatgatcctgaacggccaaacattccaaaaccaagtagtttgtaatatctttaaatgcaaatatattttaggccttttccttggcaaggatgtttggtcaggggttggcaaaaataatgctcttcagacttaaaagaacacaaccatatttcttagccatccaccagaaagtagtagaagctccaggaagcaagtctttgtcaggagtcagactagctacatcataatctctctgcccaggggctgtggatgtcatccatcctggcctaactagcctactgagctgagagatgtccaatttccccccaatacactaaccagaggagaaggaccgtgatatcattgcatgtgaattcttaattccaattgcttaaacaaatatgttcagttgtaactatcaataccagtatataacagtgttggccaagttttattgatgctgacaatcaattggagttacagccagacacatggtcttatgaccggcgtacttacgcagggctttgcactgagacaggtcgtgcatctgaggtttactgctttgcatttttgttttgtaactgaagtctgatgagacagccagagcatgtgctacctagggacttgaatccctgcagccccatttcacttctcaccaccttccggggtggtttctcgacctcccactcccctaccacctggtgccttagccagccctggctctccctccaaacacctgcccaatgagcactgccaccccatggtgcccagacatgctctccctcctcatccctacctagctaccattgccactcccctcccccagcggggacatgggcataggagcagggagagttaaggttggtcaggtgcacgtgccctatgctatcttggaagggggcttggccatgtggcatctctggaccaagaatgcgccacagcacatttggagggtgaatggtgggggcacaccccttgtccacctctatttcaggcatggaacacatcctggcatgaaagttgcagtcccttgggaatcacctctccaccttgattgccacagtaggccagtgacaagggaagattgacacatcatcccctgctggggcccagtgtcctgtggctggcaggcaggggatcctaaggacatgtgggtgttaaattgtagggtgcacttcctgggcacctttgagggtctgcactgccccagcaaatatccccatgctagaaggagcaaaatattaaatggcaaattttaaaaatgtaacaagatgggttgcaaaagagactacagaggaaagcaaaagttttgtattttagtatcttccatggcacttttcttcctagcttttgaacaaggggccccacatttttatttctcactgagccccacaaagtatgtagccattcctgcccggagtgaggacttttaaaacataaagattatcaagtcttggaaattctgattcagtagatatataacaggtctcaaacttaattatgtaaagaatattctggagagcttccttttacccagtcccacccaccaaatattctgataaattaagcttcgattagcccccagatctgcattttataaggatccccagatgattctactgcaattggtccacagaccatgcctggaccgaatttgggtgcttaggagcacaaattctggagccgggcagacttgagtttgcttcctagctttaccaactgatctcaggggagttaatgtttacctctaaactttagctcatgcatctataaataaatatattaatatcatgtcataaggatattatgttgtattaaatgtctttaaaacaccacaatgattagcccaaagtaaacactcaataaatgttcaaaaatttaggaaaattgttaagactgggttgtatgcacactggtgtttattatattatgtagttttttctgtatttttacaacatttcagaattaaaagcaacagctagaaaaagagggaaatggccgggtgcagtggctcacgcctgtaatcccagcactttgggaggccaaggcgggcggatcacgaggttgagagatcgagaccatcctggccaacatggtgaaaccccatctctactaaaaatacaaaaattaactgggcatggtggcatgcgcctgtagtcccaggagaattgcttgaacctgggaggcggaggttgcagtgagccaagatctcaccactgctctccagcctggtgacagggcaagactccgtcaaaaaaaaaaaagagagggagagccagagtatgaaaaaggaagtcagagccctttaatgagtcagctttgtaggtctccaggtaggaggctagtgcttcagtgtctaggacatagtaggtgttcagtaaattaaattcaggacaaaaagaacatgccccaaggaccatctgatatccacttaaagtgatggactacctcgtttcccttgtttatgaatgggttcatgcctaagactgtgtgcactttaatacaagggcagtcgttcagaactagtcaggtcctgaaaaggatttaccaaatgttgagtgtgccctctagtgttcacacttcccagctttcttcctataaaggtggatcaaggcacttgcttacaactggaactgaaatcctccaagtcgatctagacattgagatggagaaaatattcattgtcgactgtaattatgcaacgaatatccagttgagataatggacttgcctcttatctaataatacccaggctcaatgcgtcactgctttgtccactttgcccaaaattcaagcacagctaagttgatattttaggacaaaggcagcttactatccagccagaggggagtagaatatggttaagagagagtggaaagaatgaatgagccctgctattcctcactgcctggatggctataagcacagcccttatggaggccttaggtcttgcttcataatattccagtttgaaaagggtttgaaaagacctcctagaaaaatcagtagtttttctcttttgagtaacatgtagcaaaaaaaatttcatcatgtaggtacagggaacaccctaataactattaatctcaaggagtcaagccagtgtgtttcctaatgtatctgctgtatccccatgaagcaaattttgccatcagagaaactgactcatggggaaaaaatccaaggacctcaaatcaccaaaagaagccattcctcagatttgcctaagcttaagcttccctgtctctcattgtgtgttgctttcaatgcagttacataaatggcttttttgtttatgcaccaaaaacactaattcatctgcaaagctcacatttccagaaacattccatttctgccagcacctagaagccaatattttgcctattcctgtaaccagcacacatatttatttttttctagatcaaatgtattatgcagtaagagtcttaattttgttttcacaggttgttttgaatggtaaagttgatgcattctgtggaggctctatcgttaatgaaaaatggattgtaactgctgcccactgtgttgaaactggtgttaaaattacagttgtcgcaggtaaatacacagaaagaataataatctgcagcaccactagctctttaatatgattggtacaccatattttactaaggtctaataaaattgttgttgaataaattgggctaaaggcagaagggtcataatttcagaacccacgtcgcaccgtcctccaagcatccatagttcttttgatatacccctattatcactcatttcagtgaggtacaattagttcttgatgtagccatttccataccagaaggccttcccaaaaatcagtgtcatgtcaccgatccttttatctctggtgcttggcacaacctgtagcaggtcctcagaaaacaaacatttgaattaatggccaaatgagtttgtgctcaaaaaaggggtgaggatacttgaaatttggaaaatctaggataattcatgactagtggattcattatcaccaatgaaaggcttataacagcatgagtgaacagaaccatctctatgatagtcctgaatggctttttggtctgaaaaatatgcattggctctcattacatttaaccaaaattatcacaatataagaatgagatctttaacattgccaattaggtcagtggtcccaagtagtcacttagaaaatctgtgtatgtgaaatactgtttgtgacttaaaatgaaatttatttttaataggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacagggcctctcactaactaatcactttcccatcttttgttagatttgaatatatacattctatgatcattgctttttctctttacaggggagaatttcatattttacctgagcaaattgattagaaaatggaaccactagaggaatataatgtgttaggaaattacagtcatttctaagggcccagcccttgacaaaattgtgaagttaaattctccactctgtccatcagatactatggttctccactatggcaactaactcactcaattttccctccttagcagcattccatcttcccgatcttctttgcttctccaaccaaaacatcaatgtttattagttctgtatacagtacaggatctttggtctactctatcacaaggccagtaccacactcatgaagaaagaacacaggagtagctgagaggctaaaactcatcaaaaacactactccttttcctctaccctattcctcaatcttttaccttttccaaatcccaatccccaaatcagtttttctctttcttactccctctctcccttttaccctccatggtcgttaaaggagagatggggagcatcattctgttatacttctgtacacagttatacatgtctatcaaacccagacttgcttccgtagtggagacttgcttttcagaacatagggatgaagtaaggtgcctgaaaagtttgggggaaaagtttctttcagagagttaagttattttatatatataatatatatataaaatatataatatacaatataaatatatagtgtgtgtgtatgcgtgtgtgtagacacacacgcatacacacatataatggaagcaataagccattctaagagcttgtatggttatggaggtctgactaggcatgatttcacgaaggcaagattggcatatcattgtaactaaaaaagctgacattgacccagacatattgtactctttctaaaaataataataataatgctaacagaaagaagagaaccgttcgtttgcaatctacagctagtagagactttgaggaagaattcaacagtgtgtcttcagcagtgttcagagccaagcaagaagttgaagttgcctagaccagaggacataagtatcatgtctcctttaactagcataccccgaagtggagaagggtgcagcaggctcaaaggcataagtcattccaatcagccaactaagttgtccttttctggtttcgtgttcaccatggaacattttgattatagttaatccttctatcttgaatcttctagagagttgctgaccaactgacgtatgtttccctttgtgaattaataaactggtgttctggttcat

SEQ ID NO: 1697 - DNA, 25255 bp, Homo sapiens
cctacccgcgcgcaggccaagttgctgaatcaatggagccctccccaacccgggcgttccccagcgaggcttccttcccatcctcctgaccaccggggcttttcgtgagctcgtctctgatctcgcgcaagagtgacacacaggtgttcaaagacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggtgagccctctcctgcccgggtggaggcttaccccgtcttagtcccggggataggcaaagtggggcgggcgcgggacgcgtgcgggattgcggcggcagcggcgcacgcgggcacctgggagcggcgggctgctgcgggaggcgttggagactggctcccgggggctgttaggaccttccctcaggcccgggtgctcagaacgctggaggacttgcttttcttgggccttgatgcgaagtgctgaccccgctgggcaggcggggcagctccggcgctcctcggagaccactgcgctccacgttgaggtgggcgtggggtgcggacaggaattgaagcggaagtctgggaagctttagggtcgctggagggggaccccggttggagagaggagcggaactcctggacaagccctgacaagccaagccaaaggtccgctccggcgcgggtgggtgagtgcgcgccgccccgcgggggcggggagagagcctgcagccttcagaacagatattgctcattttctggcagttctcagacgtaggaaataagtcagcaccgaagcagtggttaagccggagggctcggaagaacggcaccttttctttctcgaaaaagttatatgggggctgaatgagcttctggaggcttgtttaccgttttttattgtcacacagaaaaagaaactgccttgtctcccttccgggaattctctctttaagactgtaagtcgctgcctgagtggtttcattttgttttgtttttctgcccttctctttcttcttttgccctttcttagcttgcactcccatggtgatttctgcttggtctcctgctggggttggtggtactcgttcccaccgcacagaacccggcgcctattattggccaagaaacttgagcagcctgttttgaaaagtccctcgctcagaaatgccagcttgcagatggctaatcaaagagacgtggatccaggaggctcatttgagtaccggagcctctgagagtccatggatttttattttattgggccccaacaaagtgccaggcatagcgagagaagtgtttacaaatgtgatctccgcggattctcacgagagccatgtagtggggaagataaccacatccccattttacagatggcgaaatgaggttcagagagcttcagtaattcagccaagatcacacagctagtaaatgggagatatgggattgaactcagatctaattccaaaactcaggctgttcgctgattgcatctgatatccagattacaccaagaggctgagatgtctgggtccattttatgattagaaaaaaaaatcctgttcctttcagaaatagtgtgcactatttgggattctttagaaacttccttggagaaaattaatgattcaagattgagaaaacatttatacaacctcaggccacactcttctctctcttgttattaaccattgcaccactgcaatgttggctgctttgaaaatctcatagtttttggacagcagtattagtaaagtgtaagaaaattgtcaaagcttggagctatgcttgttgaacttttgtaccaatagcacctttaccagaggctgcgtgtttaaagcccgaagaaaactttgcttttctgaaagaatacacacacacacgcatatgtaaatattcatacatttatgtatatatacatattataatacctataagttaggtataacttatatttgtatatgatatatggcctaggaaattaaggcttattaaataaaatttataaatgcagatgagtcaaatacaaagatcagacataactctatcacctaagtaatcattgtttacgttttgcagtttatcttccatttctcccctctaatatgactcttttaaatttagttacacagaaattggttttgcgctcacgacatgcctaacatcaggcctttatccttaaagaagtttcaacactcttgtgtcacctcatgtgtctacagaaaatgtttgcttttatgccttcacggttatgttttcttagtagtagcaataaataaaatagatgcaaagtgctaattacttggaatacagaagcaaattttaattctattaatgggctggacatagatgggtggggagctgttttctgcttttcccctcttcccctagtcctctgactctggtgataactatagtcaacaagtatccccatccttaaccccttttgcttctctttctctttccttctctcaaccttcctggtgttagttttctctttcctatttctgagtgtttttactccgacacttacaataaaaaagtttgaaatcccaaaaagttgacaaatttctaaaggagacagaaaaagagtcaaacttactttacaaattaatttgagaaatagctgtgggttgcattttttttttttattgtgcatgaccctgttattggccaagaaacttgagcagcctgttttggaaagtccctcgctcagaaatgccagcttgctaattgaagggatgtggatccatgaggctcatttgaattccgaagcctctaagagtccatggatttttattttattgggccccaacaggttttgtcttgcattatttaggacattggccaggcaatcactggacagccagtttgctctcctttacattttgtagaatggttatcttatggtcaaaggaaagggagagggcctttggaaaataaagctgtgtatttacaagcagtcatacagaatagttttgtggggaaaataaagaacagttatttaatttgtaatttaatcatttttcttaaaccaacccaaagagcataaaatggaatatttatttatttttgtagcttaatttgtaatttaataatttttcttaagccaacctaacgaacatattgggctgtttattttcatttttaatgggccatatttacatcacaaaggacttgagaagtcttacaaatacaataaaatgataaaatatgaattaagacattagcaaccaggatggaaaaacacaaatttgtaaatgatggccaggtttgcaagcaaaaattaaattgataaatggcagcacccccactaccagctatagttagactgatgaaaaatcctctaatgttcatgcctgaaatacagttaccacccttagcagcaaattagaggcaaagaagttctggaatttggacgttgtctctgagtaagctctttgagacactggacaagtaatttccttctgaatactcttatactgacacataggagaagtgtcagtgtttcaaaggaatctctttgaaggctactacattgctttaggggtgccagattaccagagtaaactgccagtttgagagaataactgtttcttaagagatggtctgaaacctaagtaaggaaatccccccacttgaaagcccctaggaagttaattgcttttggcaaattatcttgggccccaaaagtcccttgatgagcacatgttttgtaataggtactaaagactatttacttatgatgaaaaataaaataacacaatttaaaacttgaaattgataaaaagcaacttgaaaccaaatttaggacagtgaacccatccctttcttatttttaaataggtaaatatagaaaaaatgaccacatgatgtgaaacaaaaagcaaatatttaaaaactacatttatactttatctcaccacactaatgtaaagaattttgattttacttataaattcttagccttgtctacacatatacataattgcatgtttaatttgagctatatatagtctgttttttgttcctttgcatgttacacaaacctttttctatttctacataatttttatctcatattttttattggatacattatagagagagcatttattaaatgagctgggattactataatttttattatttattttttaatttattacttatttttataatttactattgaaaaaaagcatttcttaaatgtactgggatacatatatatatatgactttttcttgttactaaaaaattactcatagaacttacatattaaaattttaggacttgtgatgaaaaataataaaataattcaaaacgataaaaagcaacataattttatatgttgtaccttgtacttccttataaggtacaacactacaatagccttagtgtgtagttttctttttgctatgtatgtatatatatattcataaaagtggaaaaataacatttaataaatcctctttattttctggaaaatccttgctttaaaaaaagtctttagctttttatatagttctacttctaacaccaattaaatatcttcaattcagtctcaagcaggaacaaatcttcagtccacttgcctacctttactgtctttgaagtgacagtgtgagtagtaaagcccaaatcagagagaaattgacttttgtaagattggtaacttcaccttccccggaaggaaatgaggtggttcttccctttgatcacaactgctttcttgatttgaaataaactgttgtacagcccagtcaccccatctttagacatttagaaatggcaatcatagttatataggacaactagcctgagtcccactaagtagaaatgatagtgaatttagtataagattatacctttaggctgggcaggtgactcacacctgtcacccagcacttcaggaggccaaggtgggtggatcatggatcacttgagattaggagtttgagaccagcctggccaacatggcaaaaacccaactctactgaaaatacacaaattagctgggtgtggtggcgtgcctgttatctcagctactcgggaggtcgcggcaggagaatcactggaacctgggaggtggaagttgcagtgagccaagatcatgccactgcactccaggctgggcgacagagtgagactccgtctacaaagaaaacaaagaaacaaaaaatcatacctttagagcaaggccagccttgtgaattagcaaatctgactacaaattcaatcagcagatgtactcagcccagcaaagtgagcaagcttactataggttgtgttaaggcatggactgggataaactggcaaaattagagtaaatttgacaatttgacattggattcattaatgatagcctgtccttcaatgaagtcaggcagcattgtgtttctattcacctctgtgttttgtgaggctataaaaatataagatatgagaaatgtgaatactttttatttgtgagggcagatatcttgaaaaagagagcgagaggaagtcagagtatgcgggtgaagactcttgtttttttgctgaggatttagctttggtttttagccattctcacagagatcattggtcctaattaactggttgttgttgttttttttcatgtgaatgtctgtaaggtttcaggcttgattttaaaaattgggcctatactcacagaaagacaaatactgcatgatctcgtttatatgtggaatctaaaagttttgaatccataaaagtagagagtagaatagtggttaccagaggctagttgggggcaaagttgggggatttagggagatattggtcaaaggatacaaaatttcagttaggaggaataagttcaagagatctagtgtacaacttgatgtctatagctaataacaatgtattgtatacttgaaaattactaagagtagattttaagtgttctcgccacacacacacaaaagaaaatgataagtatgtgaaggaatgcccaatgtaattagctcgatttagctaattatcttccaaaatatgtacataattatcttccaaaatatgtacataattcaagacatcatgttatataccataaatatatataatttttttatttgtcgaataaaaataatacaaaaaaaccctgggcctatactgcccacaggtagtggccacaggcagagctggtcccaagcccctccctctctctgtagtcccttatcccaggttgctttattcttgtatgacccacgtggcccctctgggcttgtaagggctctggggctgtattttaggactctatagcccttacattacccatttcctctaccaaaggtcatttctcttatcttcaagcttatttttggaagggtcattatttcttcatgagaagtcaaattctgatttgcaagtgctgaacacagatgccattagtctataaaactcttatattctcacatgtaaatgtagtaacctgctaacctcagattctgcttcctctaacctagttgccctgcaactgtgatgaacctcaaaatcaccaagggtacttccccattctcagagatcctgattccttaggtctatgtaggggccttagcactttttattaaataatgcatcactacaggattctgatgtctgtcggggtcttgagaactatttttctgactctagcactaaactcaaaatgtaatttcagatggaatttcctaggctcattcattttattttatttatggcttggccagtcatggatctaatcagtaacttgcaactgttgcttcaactacctctgtcctggactttccagagattggctttaagaaagaaagaggacatccctgggataagattaccatgtgtatttttatgtacagattttgaaaaacatacaaatgaatgggatctttgcttatctcttccatgtagaaaaatttattttacttctatttcaggttttcaataatgtagtaggacaagatgacatcactatatccctgttttttacacagatatattagagatgcattatcttattggaaattttaaactattcaataataaactattagtcttttagaatttctttttcctcaagtgttgataagtaactgaaagtctacaagcagacaagcagaattagtcggtggaacttcatttcttgctccatttttgtcctcagcagtagagggtggtgagatttcaacccagcctagcaggaccaataagtctggaaagaagtagctctagttcatattggcacctgctaattctagttctgaagaccatgggaaatctcttgcctatttagctcagtgatcatccaagatgggaaattcttgggctcagctgtgagggatcccaagtttatatgtaacactaatgtctcacaaatcaagaatccaagagaatcaagagactatagttcattccttatattaaattcttaggactgccaactgggtggctacagttttgggggctagaagtctgatatcaaggtgccaactggactggttccttctgaggaccacgagggcaggatctgttcaggcttgtagatggccttcttttccatgtgtcttcacattatcttcctctgtttgtatgtgtgtccaaatttcctcttctttttttttaatttagaaatttatactgtctacaagctttatatagctttagttaaaaaaaagcaaaaaaaaaaaaaaatcaaaacaaaaacagtgaagccaagacactcttccaaagtctggacccttccggccttccaaatacaagagctctggaagttgtatataccaaatttcctcttcttaaaatgtcaccagtcacattggattaaggcttaccctattaacaccattttaacttaatcacctctgtaaagaccctatctcctgatacagtcacattcggatgctcaggaagttagggtatcagtatcactatatgaatttgggagttgggggaggacacagtttagcccatgacagtcctgaatctcctttgctagatgcatgactgtgggccagtcacttcaccagttgggatactgccatctctatcagaaaaggggtttgggctaggtcatctataaagtcctttctgctctaaattgtaaatataatgagataccaacatttagtttaattgtttaaaattttagaagctaactggatgctttgctggtgtcaacactcccctttacaaaaaaaaattcggccgggcatggtggctcacgcctgtaatcccaacactttgggaggccgaggcaggcggatcacggggtcgagagattgagaccatctggccaacatggtgaaaccccgtctctactaaaaacacaaaaattagctgggcctggtggtgcacatctgtagtcccagctactcgggaagctgaggcaggagagtcacttgaacccgggaggcggagcttgcagtgagccgagatcgcgccactgcacctccagcctggcaacagagcgagactccgtctcaaaaaaataaataaataaataaaataaaataaaataaaataaaatctcactttctgtttctactgttctctcaagtacccctctgccttctgttacttctttgctgcattctgagaggaatggggtggggagcactctttcctgtagaaccccataacccatctattttcatcaatttatttgaaattcaaagccaggggttaaaatgtccactttcaatttgagatgtctaactttcagataaatctattaacatgcatttctaagtgacttttaagctaagcattttattttattgagctcgtatggaagggtaactattatacttgtataataaagtgcactttcaaaaatactcggttcaaatgtaaaataatattcgtaatattttaagacaaacctcctagaacttatatgtgtctttcttcccagagcagtctctatgggtgcctaaacaatactgcattattagatttttttcagtttataagccacacaagaaagttaacccatgtcatctctagaggcataaaaatagacagttgttctgagaaacatatctgtttattcctagttcagtaacagcgcaatgagatcctaaattatgaggtactttttgtttatcttattgtctcattggcaaccagcaactcctgttgcatttttgacatgggaatctatcagggtgtggttaataaagtacatttccatggtaagtattctttaagaaaaaataaaccaagatttcatcagagacagaaattactgcaaactgtacttaccagtttctggtgatttgtataactgagctttcaatttcaaaaattaaaaagttctctttagtgtaacatatttttgtgtccagtaattttacttcaaaaataaaagagaattttctttaccatcaaacaacgttgctgtaatgagtggtgatatatttagtcctagaggaccaaagagaaataaaatggctttgattatgctggtttaagaaaatatatccgatgaaacagaggttaatatttgtgatgtttgatttagtaaaattataagactaccaaagaaaactagaagagcaaaataaccaaaatttatataaagaattcaatgttgataattcaaaggtttagaattttttccacctttcaaatactaagttgctgttatagatttactaccattattacccagattttctattttactaaaaaataataacacagttcgttatgataaatcagtatagatctttaggctcaacacaaccctgctaccttttaaacttttttattatacaacaaacacatatgcattatcaagaaaagatgagtttagcaaaatgaagaaaaatagtcttatcaactagaaataagcaccattaaaatttctgtgtgttaaaagataatatgctgctgaaactttttttttcttgaaatgtccctcttttctttcacttttcattttcttaatccctaaccttctactgttgaattttctggaccaccgttataccccctcatcaatagggcatttttttctgcagtagctgagcacaatggtcatattgaagaaattcccttgtgggggctttgcctagaggtaaaatcctcttggccgggtgcgttggctcatgcctgtaatcccagcactttgggaagctgaggcgggagcatcttctgaggtcaggagtttgagattagcctggccaacgtggtgaaatgccgtctctactaaaaatacaaaaaattagccgtcatagtgtgcattcctgtaatcccacctactcgggaggctgaggcaggagaattgcttgaatgccggaggcagaggttgtagtgagccaagatctagattgtgccactgtgctccagcctgggtgacagagcaagactccgtctaaaacaaaacaaaacaaaacaacaacaacaaaaacaaagtaaaaccctcttcactgtgatgactctaaagcttgcttttgtctctctaaatcacaacaaaccgtttgcagtgtgatgctgtgctcaaaattgagaattctcactgactgttccaggcatctgtctactcattcttgccatgctgagggctgtcatttctcaccactgaatgcctttttttttttttttgtgcttctttttaaaagtcttttcctgtttgctttgaacttcaataaaaacagggggtaagaaggtaatatgcttttattttgtctgtggggtttttttcttccttcttttggttccttttcagatcctagctcatcaaggccatttgccacactgacactggaataagcctgaatgggggtctatatttcttccagtagttagtttaattcggtcattgagctgttgctctatttgtaaccgtcatgctagatccgagggctgactattcctgagaaagtgtggagatcctttcagactgccatggtgctagggcagagtttcagtcattatcttctgtgtctgctaattcttgcatcatttcttctactctgtaacctggttggctatgaaaagtgattcttcctcactgatgctgcaggcaatgggtgaatatccaattgttctctcaggttcttgtcatcggatacaaagaacaaatttcatgtgtccctgtttctgagaggttcaaagggagcaaatgcacagattctagcttaggatgacttccagcttctaactatttgtctgtgcattccatttcctcacccctgcgagaggttgcagtcatggtaacggctgttctgagaaattcagtgcccaaactggagggaggggaacacaaactcagcttcttcccaagcttcagggcagggctggcaagttttgccttccccgccagcaagagccctggctttaggggtcttgctacagttttcccagactggaggtcttggggctggattctggttcttagcgaattcttgccaaacacctcccctttccccagtatccatttgttttgaaggttctttgcaggcttcttgccaataattgtcttaaaacaaatggagttgtttgcatacctagatggagtaaaatatttaggaaactattctacaaatatgaaacagcccagatttgggccagaagtcctggtcctgagtctcttgttagccactcttaactgtgaattattggacaaatcatttctcgcactctgtgtaatctgtcacctgggtacttgatgatttaaaccaggaattgtggcccttctcataatactgtctcctaaatattgggtgaatttagtatatcaaggagggcagggcactatacccgtaggggactctctctctccctctgtctctttgcctttctcagatatgcatctttggtggcagacctggggttcaaaccacagttgttttgaaatttctctttccttctccactatgctccccctcactgaaactttaataataaaagtagcacacttattgggcatgtatttgttatgtgccaggttctgtgctaacagctttaagtgcattattccacgtattttcacaacaagcctgtgaggaagaggttatttccacttatagataaagaaactgagacttggagaatgtaagtgattttacccacaaacacagggcagtaagtgggaggccctgttcaccttagaacacctggcttctatcattcatggtgctgtttctagtgtggtttgaagaacctgagatccaaactgctatacaagtgacctgctgctttcttggagagagaaatctgaaagacagtggagccctcacattgtctttgcctgtgcacagcagatactgccaattttgggtgggttacacttgtttaccacgttgcttacttcagaaatcaataaaattctcttcatgcttttattttacaggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtatgttacacaaaacatccagagattacagtgaaagtcacagttaggagtagcacatagtaatcatgactataataattttacagtttttggttcccctatattatataacataactgagagaaaaacaactatgaaattattttccaaagatgagttttatttatatttatcacgcttatttgatgtggttatggataaatttaatttacaagtgacatgcacctctgaaatgagaagactggtctatttggctccatttttttctaagcaaaaatgactcatttgtgaatatgaaagcttatcatgtcaaaactgattaggatctaccataacaatagtggaactctgaaagcaagagacttctcctcttaagggatatgtctcagcacttcccttcaatcagaaggtctctaagaaagctgtcctggcactgaagcctgcaaaatatatttgcattttgcagctgaataactagacgaataagaaaagcaacaggcagaaaccaacagcttttttttttaaatcaatactttgaagggcaaactaatttcagatcacaaatccttcaaacactggtaaattagaagctaagcaaaatgcaattgtgcaaacatttcttcaactttgagtagagttgaaaaaaggaaaatagcacatgggttcatgtgatagattaatagaacaaaaaaggactgtagtatgtttcatggttgtcctcccaggcttccagcactcaagctgtaaaacaggatgggtcctgtttgtgaaaagattctaccagtctccctgtgcttcatgtccagattttaataaccgttatggaaaaatctcccctataacccaacccatttatacttaaacccatttacacttaaatcttctccaacacgaataaagaatggcgtcctggctttattataacctgctaaacacaatcaatttgctctatgaattgaaatctttgttcataattttaaaacctaaaatgtaaattaaaatgaacaaaatatgctttgcacatcaaactgtcaaggatttttgtctattgctttttcggttttgctttgttttattttaatttaagaagtgaatgtaaattgttacaaacttttaagaaatacatttggatatatgagtcaaaaatttgaaaaaaaattttttttaacttttttttcttattattatactttaagttttagggtacacatgcacaatctgcaggttagttacatatgtatacatgtgccatgctggtgcactgcacccactaactcgtcatctagcattaggtatatctcccaatgctatccctcccccctccccccaacccactgtttatacttgctaagatagcaattaatttatacgaaaataccctgagaaaataatcaaaaataaaggaaaatattgtacacatgatatttcattatcaatatgatgtaggattccttaggtaaattctggaatatttaaagactgaaatagtatgtatcaaagtcatgttttctgatatatttctaatataatcctcaattatataaaccttcttaagtaatttccaactgatctggctggattaactgattctccctgatccgtctataaaatatcctggatggcatccaaccatgttaaatactcttcccacttcaattccctcttgttgaattttaggcttatcaatatctaagttgcttccaaatctgtttatgctcattagtgttgtgatattcatatgtaatttgattgaatattgcataaattaatgaaatacaaatacagagaaaagacagattttatttctaagaaaactaggttgagtgctttggagaattcaataaagatgagctgctaaaatgttgttgatgaattttgtgagggaaaaataaaagttaagtagtaggaaaaatcacaaaaatctctaaagccattcatagagattattggtatgtttatgttttcctttcatcaaaaacgaagggagggagggagggagggagggaggagaaaaaaagaaagaaatgaaaaaggaagagaaaaatagacaaacaggaaattataggtgatgcattatggatgtgacttaagaaagaacctgggattataataacttctatatcacaaaattgtcaaatgattatatagttatattttataaattaaaacaaaatatttacagtatttttaagtgatttcctatgtaaattgacatttttgattaaatgatcaaagaagtcctccccacatcatcatattcaataagaaggattctatggtatactgcacacatatttcatatatacacattgtacatatatatatatacacacctgttatatatatgctcatgcatatacatgtatgtatgtattatatgcataggaatgcaacaaaataacggcaatatctccagattgttgatatatagttttttgtttgtttgtttgtctgtttttttgagatggagtctcactctgtagtccaggctgaagtgcagtggcatgatctcagctcactgcaacctctgccttctgggttcaagcaattctgcagcctcagcctcccaagtagctgggactacaggagcacaccacaacaccgggataattttttgtgtttttaatagaggcggggtttcaccatgttggtcagtctggtctcaaactcctgacctcaggtgatctgcctgccttggcctcccaatctgctgggattacagacatgacccactgtgcccggcctgatacataagttcttattatactttcctgccttttccaacatttctataataagcatatgtaccattatactaaaaaaagtattttaaaatctgattttcaataaaacaactacttattttcttattttaataaattttgttttcatactttggaggaacgaaagaacctgtggtttactgtatctccattataccaaggaagttgtgctaggcacattctgtaagataattcattaaagagaccaattcattcagagaccagtataataccactagcaaaaaataaaattatacttggacttgggttctgttttctttaaatattgctacaatgttatatagccctatgcactatttttgaattttgttctgggaatctccagtttgttttttactattgacagactattatctttacttactaaaatagcatatatatttacatgtcataatttgctcatgtagtaaatattttgttttatcaaaaagaatatatgaagttattaaggaattcatgttcctaggaaacacagcagaaattaattttgctgtataggtgagcagagcagattaaactgcttatatttttaaaactagttataccattaacaattagagtcactagtaatgtttttctcacacttcccttgatattttctgtcactttcttcttaattctctattcccttaccttcatctagctttccccatagcatttttttagcacttgatatcaatatatttatttgtgtattgtctgcctgcatcccaagaaggtgaagtctttggtgatgaagggtttatcttatttcctgcataatatcaaacttctaaaaagttcctaggactcaataggcatttaataaacacctatcagataaatgaattttttaagagaacacattacataatgctttctaatagcaatacagtgacaaactttatttttaagtaaattaatgcaaatatgtatattatttaaaattgtttgtttttaagataacaagcctgatagataataaattttggcataaatatgttaatgcttatcaaaactcatcagtacatatcctgtcttttgatgaaaaagtaatagaaaggggagaacaaagagaactctcatgctcactaggcaggccgagtgcagctctgacagcaatgcaagagaaatattactatctccatcatatgcaggatgaaatttaggcttggagaaaacaacacttcgttaaagattttatagctgctcaagatttgaccaaggcttttaaaacttcaaatgttcttttccttattacactgtttcttatcaggatttgtggactttggaaagtaaaatgaaaagtcagagcaatgtgagttagtttgataatctcagtggccagtaacagctatccccactctgaatatataccaaccaacctctcccctttctccaaggaagttagttcttggcaaaggcatttcatgcagtgtactttgtcattctaaccttcctttttttttgtatgctcctgttgctaatcatcctatttctatgggcttcagtcactcttttagcttttgtcttgggagactttctgtctgttgacatgacttttaaaataatcttctcccccattgtatttatatctcattagcctaccccccctccccttgtgttttagaagagttttattgtctgtcatccctctatagttcccaccctgttacctgcccgtgtcctgttcaaacacttgctccttttttccttgggcaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggtaagagtcttaaaatgcaattgaaagaggccaatcttggaatttcatgtagaaccatttataagacaatttgaaattggggcctactgtggtgctatgttgacacacaggaaagggaaggacaggtggctagggtaccgcagaaccaggtgccgagctaactactggtctagacctttatgagtaagtctaggcaattcttccagatataggagaatgagtaaatatgaaccctaggaacagggttcatcagctcaaatcaaaagctcagaaattattttttttctggccttgacttacgcttatataatggtgctcgttcatggccagaaaaattcagaagcctgcagatacaaggacacagaaatccaaaaggtaggtaggaatgctccccctttctttggggatttagtttgtcctgataattccatctggggacctgaattttcatggatatctcaatgtattctaaggacccagattgaagtataacagaagtgtttctagttttgtttgacatgaagaaacctctggacataaagcttttcccatccctattcagcctataaagcaatgtttctcatccctggcagtgcattagaattgcttagggagctactaaaaatgtttcatgtttaggtcccatctcagggcaattacatcagagtctctgagtgaggaccttggtattggcctgatggagtaagtctggggtagagcctaacattctacatttttaacaagctcccaggtgatgctcatgctgccagtccccaggtcaccctttgagtgttaaggctagagactagaggaacaggggagacgtctaagtattggtgaggtttgtcttggttgctgctaaatgattgctggccatttcaacctggggtttcctgttctgtgtttaaacactgactgtattactggtgtcatgctgtgactgttgatataagcagtggatctcaaaaatccatgcagctcctgcccaccattttcatagtctgcttataattagccgctataactaatagtttccaaactgattttctaggcttagaagtggaaataaactgcacccggacccagaataccaagtgcagatgtaaaccaaactttttttgtaactctactgtatgtgaacactgtgacccttgcaccaagtaagttttagtctttctctgattaaaacactagatataacatgagagttatcattttcctagggaagtaacactgactgagagttaagaattagggttctagtcctgctttgcctccaagcaactagatgactgtttgctcatttaaacactggtgaacttcctgtgtaggtgacactttgctggccacttaagctaaagatatgagccagacatatgcctggcatcaaggtatcagtccagaagcacagacagtcaaggaaagcaatggttattgtgtttcaacagcatgagaatagcatcagaagagacttatgttccaggtgttacaaattatacagaaaaacttttcaactctgcctgaggagatggaggtgaagacatgaatgtgtctcatgacttgaatcttgaagaaagaaaagaaagagcattaacaggtgcacatggatggaatgcacattataggcagggaaacagcagctgcaaagagacaaaggaagctcaggaaaacagaatacctggctggagtgtaggaaagactgagaagcgttcagggctgaatcatgaagggccttgtcttttaggctaaagaggttggttttgacccaaagttagagaacctgccttgtaagtcatcttgggaagcttttaggagttcatctaataggcttaagaaataagcacatgatgccttatgttttatttgctaggaaaattttatgtacagttgtcccaggctctcccctggccacaagtgtctgagagtgcccctatgatgacaggctaggtaggcattggggaagcagctgacttagtaaaataataacaataatagtaattccaaatatttcataatcttgatttaattttcttgtcatcataaccttttgaaatagataatattatttccatgttattgatgagataaaaggctcatggcagtgtgacttcccaagctcacctagtcaggtaatgggcagaggctgtgaactcagacaacctgattgtgaatgtttgtctgtctgaaggaaatcacacatgaacctcttgagtctcctgatcaccaccggttgctaaaagtggcagcctctaagggccagctgagtaccctccctgagctacatcatgggcgtggctatcacctggccattttcttggtctataggaattttttgaaattacttttgacagtttattttaagagctagtttaagctataggatttacgtgttcagtttattactaggtttaagtttatttttgtatccacttcatctctcttgtgtgtcactattttcctatcttcctttaactcttgaaatcttaagacagagtcattccttatgatatttttcatccagccatccaaattatattaacttgtgccagctttagatactaatttagaaatatttgaaggaatacgtttgccagagatgcaaagatgaataaaatggcccctaatttacaaagtgccattgaaaattataaaggaattattctgccaggcttttgaatttctcctgtatttttttttctagatgtgaacatggaatcatcaaggaatgcacactcaccagcaacaccaagtgcaaagaggaaggtaattatttttttacggttatattctcctttcccccaaccccatggaaagatgtgaagaaaaaccaatcactcttgattactagaaagtcctttatttaatcttaaagattgcttattttcatataaaatgtccaatgttccaacctacaggatccagatctaacttggggtggctttgtcttcttcttttgccaattccactaattgtttggggtaagttcttgctttgttcaaactgcagattgaaataacttgggaagtagttcacaaagatttgcctcattcttacctataaaaagctaccactttggtagatttatgtattgttaatttcttgcccctgaatgcagccttgagagctgactgataagaacaaatgaaattattcctcagctagtttctgagcaacagttttggggcattgagtggtattctcatccttcctatgaacaggtgttctctgcagcagcagaattggccaaaaatcagaagcaattcttcactattcattgagatctccctatgcaaaaagagaacacaagaagcaaaggcattcccaggaaacacattgcagggaacactttaaaaacttgtacttcactgcctcctcttcctcggcctaattgcttgtttttaattatttctccttcttaacttaaaatactatggggacacatgttatacaaaggtgacttagtagagtcagtagaaaagccaaaattagatattatcataattagtctagaaaaatccctttaagtcattcatcaactacagggtcacaccaactttcagtaacttagaagtattcaattttcccttctcagaacaattatctgtttcttcagttcagttgaagaagaaagtttgccttgcctttagcggttgtttagctgaaaatacatttgggatatttaagcactgtaattgtgctcagagacatacagattcttctatctcacattgactttaatgcatacacctattgagtatgtatgcttgagttatttgtgtgtgtatttcatttctgggcatccatagcaagttgatgttgacttgcttgtcctacggcttctgcatcctgccatagtcttgccgtccacatctttgctggacagagagtggtgcttgccatatggtaagtcaaaagccatctccttgctaggccagcctgtggtaattagatgactaattaagatatgtcctttcactagaacacttgacttagtagtacgaaagttccaaaatcagcggtctcctgcgatgtttggccacttttaagtttcactgaatttctcctttttccttcttatatttctcttagtgtgaaagtatgttctcacatgcattctacaaggctgagacctgagttgataaaatttctttgttctttcagtgaagagaaaggaagtacagaaaacatgcagaaagcacagaaaggaaaaccaaggttctcatgaatctccaactttaaatcctgtaggtattgaaataggtatcagctttccttgaaaagaaaaatagagaaattagtgatttggctttttgttacttccttttacttttttgtttcttgtttgtttcattttgtttgagatggagtcttgctccatagcccaggctggagtgcaggggtgcaatcatggctcactgcagcctcaaagtcctgggctcaagtgatcctcctgcctcaactgtgaccctgggactacaggcatgcaccaccatgccaggttaattttttatttttattttttatagagacagggttcactttgttgcccaggctggtctcaaacttttgacctcaagcaatccttctgcctcagcctcccaaagttctgggattataggtgtgagccatcacatccggcctgttactttctttatttaaacattgcttgtgtttgtgggtgcataggttaaaggggcctcacagatgaattatgatatggtacccaaattaaaagtaaacttgtacacaaaaaccgtaagaatcaacaaaggagggaattgagagtgtgctgaaaatgagctgaaaaaagaacttggccaacctccatgttccgtgttgttgttatccctgcagagaaacagcctttaccaggcatgggttcagtatccaagcctgagcaaagagattgctcttaaagtttgtcataagggcacagcttaactttctctggctgccggttgaccttatgtctcaccatatcttttcccaacatggtatcaatatatttcagatagcaagaaatacaccgagaaaagaaaccagttgcacttaatggaattattttcttatttggggccagggctcagtgggagttaggattctttaaattaatatggtaaaaaaaatttcaatttgagccattttctggtattaagaataagaatagttacagggaagaaaattttagagtagttatatttattatttattttaataagtctatatgaaaaataacctcaacctattttatgaattctttaggtttcttgcctttaaaaactaagacaatattgcttagtttctggcaaggccggaacctttcagaataaaaattgaatggtaaaagtaaccttcttaatcacttaatctagcttcctaattttatacatcaagcaactgattgtacttctttctgaattaaggaaaaattagaagttcacatttagaatattctaaagatatatttttatttgtctttctctgcttccattttttgctttctaggaaacagtggcaataaatttatctggtaaggcttttatcattttatttcatagagatggcatcctttagagtaataggccaatttcagagtaaaataatgttactaatttcagtgacatattatgggatcttgttatttctcatacaattctacctgctcagcataaagcatttatcaggcagtttgtttaaatttataatgaatactcatagttaaaaataatcaagtaacaataagacacaatagtctgaggcttaagaaacttttccttcataatcagctagatgtattacagaactcctgcctaaaaagatctagaggttaaagtgtactgtagactcaggtattatcagtgtacccaactctataacaacatacatgattccattcagttgttctttgatctgtgatttagagataagatgatcataaactctttgcttatacttttagatttgtgggtcattgatcattggatccataagagatgttataggtgatcttttccaatcctcttaatttataaatgagaaaagaagatacagaaatgttatgtattgtggcccaggttatttaacaaattactgggtatatggcaggatttggagttagaactcaaggttgtcttgtttctgtattcccctagtcagctcttcatagacctttaggacttagctatattctgaagtactataaaaagagaaataaacatggttttcactaatgggaatttcatttagaaaaacaaattttcagactattttctatttttcagatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccccaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaataatgtttttggta

SEQ ID NO: 1698 - DNA, 25255 bp, Homo sapiens; identical to SEQ ID NO: 1697

SEQ ID NO: 1699 - DNA, 25255 bp, Homo sapiens; identical to SEQ ID NO: 1697

SEQ ID NO: 1700 - DNA, 25255 bp, Homo sapiens; identical to SEQ ID NO: 1697

SEQ ID NO: 1701 - DNA, 25255 bp, Homo sapiens; identical to SEQ ID NO: 1697

SEQ ID NO: 1702 - DNA, 25255 bp, Homo sapiens; identical to SEQ ID NO: 1697

SEQ ID NO: 1703 - DNA, 25255 bp, Homo sapiens; identical to SEQ ID NO: 1697

SEQ ID NO: 1704 - DNA, 7828 bp, Homo sapiens
gaggtgtttcccttagctatggaaactctataagagagatccagcttgcctcctcttgagcagtcagcaacagggtcccgtccttgacacctcagcctctacaggactgagaagaagtaaaaccgtttgctggggctggcctgactcaccagctgccatgcagcagcccttcaattacccatatccccagatctactgggtggacagcagtgccagctctccctgggcccctccaggcacagttcttccctgtccaacctctgtgcccagaaggcctggtcaaaggaggccaccaccaccaccgccaccgccaccactaccacctccgccgccgccgccaccactgcctccactaccgctgccacccctgaagaagagagggaaccacagcacaggcctgtgtctccttgtgatgtttttcatggttctggttgccttggtaggattgggcctggggatgtttcagctcttccacctacagaaggagctggcagaactccgagaggtaagcctgccggcagactgctgtgccctggaggcaccaggcataaggggatggagggcccactgcctggcttgcaaagtgcttttcaatcctttttttttttttcttagaaatgggttgttctagttattctattctatagacagagaaatggaggctcataggggtgaagggaatattttttactttgtaaagaatcagagcccaacagtttgtctttcctcagttgtcaactcagtctgttgaaccacttactgcctcatacctattgatttaaggagtaaaaaacaaacaaacaaaacttttaagttttgcttggaagtaaatttgttcagatgaccaaactaaatcttgaaaattggtacgattccaaatcacaaaactgagggacagtgaggcaaaattgcttggccaaagcccaagttagcagaacttctgaggtatttggattctctttccagggcttggtttatttgacgattctgcctcttttgcttaaagaattttatttttattatacatcttttctctttctgttttactagtctaccagccagatgcacacagcatcatctttggagaagcaaataggtgagtcttttttcgcatgtacattgagttcccaaagatgatcctcagcacagaactatgttaatggaatgccttaaattctgtcccacactttggtttctgtacactataagaggaattctggctaattcagaatctctggtctatgattccttgagctgctttaaaaatgtgaagtgaattgaattgctcacaatcaatatagctgagcactgcacacaattcaaaatcacttccacttgactttggaaagagacacacatatacaaccctggacctttgccccctgagaagtggctccaggcctgtccccttccacagacatcctggtcctggcacacacgccagtggctgtaactcctgggaagagaaggcgaaatgaaggcagagacagatgtttctgagaaacgtcctttcctcttttaaatgccctaaagagattacattgaagctttatttacaatatgttttataggatgtaagcttttaaaacatggataatcaattccccacattagaatggtttttcttgaagtcactgagaagcttaagggaagacttcagccatcattcaaaggatgttcagcttcacccacagaggcagtcatgaggtacccttgatcacaaaggaaaatcctttgtatgggagctagggcaagaagatgataggttgaacactgatctcatgaaatttcagggcatagttgtgcaagctctgtacagatagattttacagtgtgcttcactagtctaagattcattgaaattttagatttagatttacaatgagattcattgaatttttagaggtggaaggaagcttagaatatatctagtccagccatttcattttttggaagagaaacaaaataccagatggattaggtgaatatgcccaagaccactggtatgccattggggctagaaggaacacaggctcttgatgccttgtcacctacagggctttccagtactggactggtgcctcatgaaggagggaaactcctgtctctctgtagtgagcatggaataagaaatagatgaaaagcaggatacctctgcaaagactataggtagatctcatccttagaaactcagaataaagaagaaggcagcactggccatctattaagtgaagcaagttccagtttctccggatgtggctactgcacatgacccagtcgcctgtctactatcctagactgttaagttcttatatgagccactgttgggatgctctggcccctgcttctgtgtcctaatccttaaatgttagaaagtccatatgtacacaagcagagtggaaatatttgatagaaaagtaaagcctctggaggacgtctgaaataagatcattttgaaaatctgtggaatgtgcctggtctgataggtatctaattattcatctttcacccactctctggagtcaatttagtgattaaaagtcaaatgatcaggtgagtcagatccatctaccccagtaagcaattatgttctctagatcaacccaaataaaccagaaattggtaaatcatcacatggaaatcaaatcagtaactttactaataagaaaagagatgcaaattaaaaatagggaataccaattttcatcaaattaataaagattaaaaaaaaacccagactgacaaagatttgagagaaaagtgcctgtgcaaacattagtttcagccagtatacatgtaaattgctataactttttttgaagagcgctttagaaatacatagcaaaagcttgtaactagtagtttacgttgtaatcctatcgctaagaatttatcttaagaaaataatcagagatgtgcccgaagatttatatataaggatgttcattacttccttatgagcctatttataataaataattcagaagaaacttgaatgcctcatacgagattagttatatacattatggtgtattcagacaagcacataataagcagcaactaaaagtgatgtatcagaaggacatttaatgctttggggattgtgcactctgtattgttagataaaaagacaagttacaaaagggtatgtttagtttcatactgactatgtaaccatgtatgcacatttttatattcttaggaactggaaagttttacacactgacatactaacagtgattttctctgggagatactattatagattatttatactttctaatttgctcctttttacattttccatttttttccggttaactaattaaatcttttattcattcacatgtgtgaggctagatgttgggtgttggatgctgattgaggatgagccagcccagggggcctgtccttatggagcttttagcagggggaagaagctaaacaaaagcaagcaaacagaccatgcaattccaaagttgtactaagtacaacctgagaatcttctttaaggaggtgttgtttacgctaacaccttgggggtcagaagcccgatgagtgaacggctgtgtgcatgtgctgtggagtggggtggggctgggggcgggcatttcagcgctgggaacggcacatgcaaaaaccctggggcaggaagcactcataaccagtgtctaggatatccttgcaatttatttattccagtataggtacagcagatattcttagtgagcatgttctgtaagaataacgttgtactaggctctgtgagggatataaagacatgcaacatgtggttctctgttccgtttcctgccggtgcgtggctgagtgccagattagttgctcgggtggtttgcggtgtaggaatgcagaggagactcagttttgcctttcctgttcgctaacacctcctacatggtgggttgtcttggatgactagagaggtcatgattgctcagctaatgttctctgtggattgggccattctcataccatatgtgagttttacaggctaatcacgaacctgacatagacaagcatctcctgtgaatatttattgaagtctcagttagctgaattcattagctaagtggcagctgtctatcttgtctgaaacagttgaagtcagagaaatagtgtctgttttgagaactattgtctatccttccatttaatttgtccaacatttgctagtaacatgccctgtgttagaaactgggcttctctggtgaactcaacgtatcgtaaggaacttgtcgttatttgaggggaataagataatttatgtagttaccccagagacaagaggagtcagaaatgacaagagaggggaagacagagggatcctagatttcaaaagaggggcagatcatatttgatcaaaaaaggcttgagagggtttcccaaagaaagcggtaataggtagtccttatgggatgtttaggaatttgacacagaaatctgcttgaaagaacattacgggcagaagacatggcatgaacaaaggcacagaggaaggaaagtgggggtatgtgtaggccacagaactcccgttgtgtggcaatgctcagtgggagtaaggagataaggctggacagatgggctgggattgtgtgatggggatacttgtatacgacggcatcttcggggaggagcaattaaaggtgtttgaggactcagtgatatgaggtgattgtcagaggtcttaagataattaatttggggcagattgtaaaatgtcactgggggaagatctggtgacacgcagacagatcagtagtcttcttcagcctctgtcctgtaagtctttggaacaagagaatcagagtggacagagccctggaattggcgtcaggagagcagggtgtggtcccatctgtgatgctgactagctgggtcttcttggattagtcacccaacttctaagctcattttgcaatcgataaggtgggacaataatacctacctcaaagggttgtggtgagttctaaatgcaataactgacatgacagctctttatgaataaatgtttatattaattatgttttattgtaacattataatttatacatatgtcaatcttaatttggtttatttttttacctctttgtttctgaaatatagactactatgaatcctgcagttcagacctacatgattagtatatgttagactgttgccatttacggttttaaaatcttttttttaaaatgattggatttaaattcccaccaaaataatagttgctatttcattttaacatatatttttcctctctctatgatacaggccaccccagtccaccccctgaaaaaaaggagctgaggaaagtggcccatttaacaggtctgtatctggaaggtacaggtgagatttgggaaagcttttggcaaaaggcaaaatggctgcctggtttccattaccaggctctagagagttgttacttcctggagacagtatttgaacccaataatactaacacttttcttgtcgagtcagtcttatgaacacactttgatcccctattctctgggcaaggccctcttctaaattggagacctggagctgattatgacatgacccctgcccataagaagctcattcttttcagtcattccaaagtcccttgggggattgggggcacagatccaagaggtgagagatgagaaggtgaggaatgaggacttattttagtcagtgctttcttggttttctggaagagcttcactctgctttgtccaagagtataaataggagtgagaagggagactcaatcctggcacttgtagagtttcaatatgtgcctgtaaagtggagtgaaatgatatggtatgggcactcccattataaactacataaataatggaataaatatcacagaaagtggtaggctattgtccctggaattatttaggcagaaattatagaatgatccggtcacatcagcagacacttactgaatacctgctgtgtgccaatttggggatgtgaagatgagtagcacatggctcttgcccccagggagcttgacatctaatagggaaagacaggcacttatgataatttcagtacttcagagatttaggttatgttcatgatgttgtggggatacaaagaaaagggaactgtaccccaaattgaggggctgaataattcttactgcaggtgagaagatggaccagatggtccctaagatccttcccaactttagaactttagagttccttggatttggctttttccttcaggaaaggacttcaaagcctagcagatttggtgctagttctgaagatagtaaaatctttgttccagagagcaaatattttctcaataatttcttactgcaatggattacgggtatatactattgttccaattgtgtggatgacaaaataggacaacgttgttgaggaaattctgtgatggatcaagttctgacccctcagccagttctataccagctgtcattctgggtgaaacatttgttgaaggaagggcccacagttttgccttagaaacttagtttgttggatgcatgactattccttgttgaaagctccttttggatttatttcaggcaagtccaactcaaggtccatgcctctggaatgggaagacacctatggaattgtcctgctttctggagtgaagtataagaagggtggccttgtgatcaatgaaactgggctgtactttgtatattccaaagtatacttccggggtcaatcttgcaacaacctgcccctgagccacaaggtctacatgaggaactctaagtatccccaggatctggtgatgatggaggggaagatgatgagctactgcactactgggcagatgtgggcccgcagcagctacctgggggcagtgttcaatcttaccagtgctgatcatttatatgtcaacgtatctgagctctctctggtcaattttgaggaatctcagacgtttttcggcttatataagctctaagagaagcactttgggattctttccattatgattctttgttacaggcaccgagaatgttgtattcagtgagggtcttcttacatgcatttgaggtcaagtaagaagacatgaaccaagtggaccttgagaccacagggttcaaaatgtctgtagctcctcaactcacctaatgtttatgagccagacaaatggaggaatatgacggaagaacatagaactctgggctgccatgtgaagagggagaagcatgaaaaagcagctaccaggtgttctacactcatcttagtgcctgagagtatttaggcagattgaaaaggacaccttttaactcacctctcaaggtgggccttgctacctcaagggggactgtctttcagatacatggttgtgacctgaggatttaagggatggaaaaggaagactagaggcttgcataataagctaaagaggctgaaagaggccaatgccccactggcagcatcttcacttctaaatgcatatcctgagccatcggtgaaactaacagataagcaagagagatgttttggggactcatttcattcctaacacagcatgtgtatttccagtgcaattgtaggggtgtgtgtgtgtgtgtgtgtgtgtgtgtgtgtatgactaaagagagaatgtagatattgtgaagtacatattaggaaaatatgggttgcatttggtcaagattttgaatgcttcctgacaatcaactctaatagtgcttaaaaatcattgattgtcagctactaatgatgttttcctataatataataaatatttatgtagatgtgcatttttgtgaaatgaaaacatgtaataaaaagtatatgttaggatacaa

SEQ ID NO: 1705 - DNA, 14156 bp, Homo sapiens
ctcttttctaagcttgtctcttaaaacccactggacgttggcacagtgctgggatgactatggagacccaaatgtctcagaatgtatgtcccagaaacctgtggctgcttcaaccattgacagttttgctgctgctgggtgagtgagggtcattctgaaatggggcaatttcagacactcctactgcctggactccaggtaccagtgtggtaaggagcaggcctgggccctggaagcaggggatagattgaaagaggagagaggaccctgaattcttaagtgttccaatggttcctaaggtcagaactcagaggtagtttcatagtccctggaaagtccattctgcaccaaacattcatgtgtactttgtagtcatgaggaggaacaggaaatgagataaaggggacatatgaagtgaatacttttataaaagatcaactggaaacaggatcttgagatgggtcctggagaaggaagagcccaagctcacctccccagcatttcacatacgcagctaaatttgaagccgtgttctcctgctcgacgttgatccactctcttctcttttacagcttctgcagacagtcaagctggtgagtatgccctttgcttccttgtattgacagtgttgtatcctcataatatgatgctgtgtttgctggggcggcgggggggtatgtctattccactgaaaatcaagcttgggttcagcatgggcagttcccccattttagtggggtctgggatttgcttcttagatccactgaagacccaagggaatgaggccgctgcaagtacagatcttgaactacatctacaataggactcttgggtgcctgacctcccttgggagctcctttggcatccacagtcccttcagggttatttattccacacccctttccactctgcccctcagcagctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccggtcagtggaggaaggccccagggtggacctgggagggccaggacggatgaaatctgtttacagacagaggtttgcaggaaagagtgggcgtggactgcttactgggaagcactgttgtgagttgctcattcattccccatttcacccaccctctttgcttagcatgcgtggtgggggaagggggaatttctaataattttctcagcatgtgttaggttgtttttgcctcagtcttgattgagcaagggggttacgaggccacaaacagctgagtgtgggagaagcagaaggaaatccctactttaaaaaactaccctcctcctgtggcaatgcggtaaagcagagaggttgggggaaatagacctctaaaggctctaaggcaggaggctgccagacaggtgtgtggaggtgggagtgtagaattcagtctggaagatgaggtcagaggtgaggggagggtgaagggtagatcaggcagaggctgataggctgttgcaactattttgacttttattcctgagtgagttgagatggctttaattaaaggagtcacgtgatctgatttagctttatgtaaacatctgacagtgttcagtttaatagagtctgtagagaaaatgcttctagatagtatttcttttttttttcccccaagtagctgggactccaggcacacaccaccatgccaagtgacttgtttttatttatttttatagagacagggtctcagtatgttgcccaggctggtcttcagctcctggcctcaagtgatcttccctcctcaggctctcaaagtattgggattataggcgtgagccaccacgcctggcttagatactgtttctacctgcttccaatgtctgaaaatataagcacatttctattgttgtttacttgagctgcactcttggtgcataaaccctggagatggtcacaggtaaacattcagtgttttagattctcctgttcaacactgaaagggtgatttgtttttgtggtcctttaaggctgctgctgtaccagagagatcctggctgtggagtcgctttctgttgatggtgctttactgaaggggaataaataaatattgagttgacctcaaaagctgcctaatgacatcatagctcctctctgtattggcttcccagagacagccgatagtaattctgactcttcttatgaaaatgtaaaaatatagataataaaaattgagggctgggtgtggtggctcatgcctgtaatcccagcactttgggaggctgaggcaggaggatcacctgaggttgggatttcgagaccagcctgaccaacatggagaaaccctgtttctactaaaaatacaaaattagccgggcatggtggcgcttgcctgtaatcccagctactcgggagactgaggcaggagaattgcttgaacctgggaggtggaggttgcggtgagccaagatcacaccactgcactccagcctgggcaacaagagtgaaactctgtctcaaaaaaaaaaaaaaaaaaaaaaaaaattgagatctgaagcattgttagagagaaactacctagtcccacctatccattgtacaaagaaatgcaactgattagacccaagagctcagcagttaatggcacagccaaaatcgcaatcctgactttagtttctgttttatgccatctcagtaatggtacctggcctttcatatacagaatactttttttttttggccaggcacagtggctcatgcctgtaatcccagcactttgggaggacgaggtggatggatcacttgaggtcgggagttcgagaccagcctggccaacatggaaaaaccccatctctactaaaaatacaaaattagccgggcgtgatggcgcatgcctgtaatccagctactcaggaggctgagggaggaggattgcttgaacttgggaggtggagtttgcagtgagccgagatcgcgccattccactccagcctgggcaataagagcgaaactccatctcaaaaaaaaaaaaaagaaaaagaaaactgtttttttaaatgaatttttatttaaataagatcgaataaattatatttattcctatgatacagcaatttgattttcatctttattaagtctattgaaactttgttaatagatttgtcctccgaggtagctgaattttggaatctgattactctgccatcagtgaagggaaggaattgttgggagtgaggatgtttgtaggcaaaaaggaaaaagtgattttaaatttaaaatttttcttgaatgccccttttattcagagtcacaaatgaatactgaattcacctgtgtgaattcaagtcatgcctttttatttcttatgtggatggaagattttatgcagggtacagtatggtctgaatgtttctgtgcccccaaaattcatatgatatgaattaatcaaatagcaacccccagggtgatggtattaggaggtgaggtctttgggtaggtgattaggtcatgagggcagagcccttataaaagagggccgagggagctcaaaggcctcttccgccatgtgaggacacagtaagaagcctcagttctgtgaaccaagaagtaggctcttatcaaagaagctgtaagcaccttgatcttggactttccagcccccagaacagggagaaataaatttctgttgtttataaaccacccagtttatagcattttgttatagcagccagaacagactaagacagggtggatgagggatgattaaggctctatttttttttttttttaaccagcaacagcatgtggaaaaaaggggggaagaaggctctacttctttgctaatacagttcaaggctgcccaccctcacttcccaaagcttgtacaaaatttaccattaaattagtaatccccagaccacaaaaactgacggcttcaggccctgtcgagtagcctctacagttactgaaatgcgctcatttctctactcaaacgtagtattttaaattcctcagaattgttttaaatatctgctctgcatctttgaaacctctgaaaacttctgcttttagaagtcccacagatataataccatatattgcctataagagaatgctcacatctgtcatgaagcatcttcatttctgtctgccagacatcatgtcaagttctgtgagtaacgtacctctgagactgaaaaacccttggaatctatccttacaactttttcttatcatatttgtgtctttcagaatggctggtgctccagacccctcacctggagttccaggagggagaaaccatcatgctgaggtgccacagctggaaggacaagcctctggtcaaggtcacattcttccagaatggaaaatcccagaaattctcccatttggatcccaccttctccatcccacaagcaaaccacagtcacagtggtgattaccactgcacaggaaacataggctacacgctgttctcatccaagcctgtgaccatcactgtccaaggtatggggagtctgccaagatgtagggaggggagaagaggggatggacaagggctgaggtcacatgggcctacatggaggtctgagaaagcccatagcagcaaaattgggcactggagcaaagaggagtggggtggaagcctggctaagtattgaccaacaagtaggggccagagcttggagccctcacgtcccaggtaataggtagtcaggctgttgtttcactttgaaatgtaggccccagactaaagatggcagtgaagcagagctccctcattgatgcagaggttccctaagctcctgggcattcctaagagctgaggtttgcctcgtttcttctcatggctcatgttatagccattcactccagaaagcctggcacgtcatggactgttcaaggctgtgctccatagagtaatgatgcctccagctatgcgaggctttgggcccaccctccgtactgtccccaggggctaaggggaatccttccctctgctcctgcatgctcaccagtgtgctttcattcatttggtggagaaacctgggtagggaggaggcacaagtccagccacagaaaccctgtgccagtgaggctggggatgtggtgaatcttgcattggtgagtgactcagacacagaagagcttcaggtgacaagcactgggacatagcattggaggtgggaggtgggacagggagaatacaaacgttgtcattaaaatagtaaccccccatcctgccctaatgtctgtcttccctagtgcccagcatgggcagctcttcaccaatggggatcattgtggctgtggtcattgcgactgctgtagcagccattgttgctgctgtagtggccttgatctactgcaggaaaaagcggatttcaggtttgtagctcctcccagtcccttttgttatcagtttccatttggcccagggcctaaccccagacattgccagaatcccgctcttagggctagatatgcattccgatctaggcccaccttttatttattagttcatttattagttcatcctcaacaagagcactaataggagtcacctcacagggttgccatggggatgaaagaggctgatgctcttacaccagtgcctggtaggcagtaacagcacacaaacagggctgttgccattctggaggaggtggtatgtgagggcagcgcttagctagggaaggaggactctccaggcactgggccaaggcagggactgaggctgggtggggcttatatgaggggggagtagatagggtactgcaagcctctgagaaagagaaataatcccactaacacctcacaaagcactttgcaattggttcatagccaacacctcagttactgatgataagtaaatacagagaaacagagagagagagaggcagactgtgagacacaggggtgtttttaaaaggcagagcaagcctcagacagatgccatggcgtggcctttctgacactcctgggcgtccccatgggtgagctgaattctgcctctggactagcccttttccaggtgggagcagcccctgagcaggggaactgggggtgggaggacaggaaacatctgccagagggaaggcctgagctggtcccatccaatcctggccctggtccttggtcctgaggactcaggccccactgcctaatcctgctaacctcctgtgtgtccctcccagctctcccaggagaccctgagtgcagggaaatgggagagaccctccctgagaaaccaggtgaatacagagttgtctcagggattcagtgatggctcaccagggctgccggctggacctgagccagcgagaaggggcttgtgcgagttcagctgggagccagggagggagcagcgatggggggatggccagggctcaaatcgcttggtcaactctgagtctaatttctgggcctaaagaggacctcgctggagatgagaagagaaacaccagtcccagatacagaggagagggcggtgttcaaatttctaggaccaggaatctggtgatatttccagagcaagaaatcagagatactttggtctttctgtggagctttggcagagctggcagaggatggggttaggggctgtaagactgaggccaatcggacgtgggaggcaggagtctaaggggaaaggaggaggaggcctggaaacccctcaatttgctgaggaatctgcctctgtggagggatggggtggagtggccaggctcagctgtctgtggaacactaagaggaggtttgggcttgagaaaattctggggggctaggggcactagtgggctctactctgtgggcaaagctcggttccaatgcccatgcactcaaggttgactgaattttggcctggttctgcccccatcacacagtggagccctgagcaagtcagtctccctgatggggttcagtctcctcactgaggaaatgagtgggtggccagggtgacctctcaggccttctaggtctgacattcaggtgggagtatgtaaaggaacttccaggaggatgccaggcaacttccagactgtagttaaagtcagagcataaaggaaaccagtgctttctctgggggcttccatgacagtaggaacaggcaggaaaaaggctgtcaaagaccgcacctcagatggctggagtatgatttagagcagagccaacagatttaagagcttgagcaaaatatcacttgttcagctgtgcttgcagcaaggttgcacgtccactggccaggcccagtggtgataggggcctgtgttcacaccagggccaaagcagatctggaaaatacaaagtccaagcaactggattatccgtcttgttgtgtggttctgtctacactggcataagcacacttcacgaggcacttttgcagccaggcatgggggctgcataaatggttttttaaaaatcctttcgcaaaaggcaaagctgggttgctggaattgttggggaatgtattagaatgggaattcagaatgtggtttgctgcagaatttacagcatggcaataaaggctctctgtgttcagggggtgagagaagagactagatgcattgtctcagatgtctcccgacttcctgagaaatgccactttgcaaatactggggctacttttcacactggccaagtcagtttatgacaaaaacatgaggcaattaggtgtgttttggacactaaccagagaaagtccttccttccctcccttcctccctccctccttccctccctctctcccttcctgccttccttccttcccccttccctccctccctttctccctccctaagctccctccctgcctctctttttctctctcatgttactttctctttctgtcttcctttttaatgccatggagtactatattcttcaaagttccaacaaagatgcactacatttggacaatgtggaaatggccctcagccttctcttcctgatgtggtcagcaaaaatctggactttacttcactctgatgctgaacaccctgctccacgtcttccccagtatctcagatccccaagctgtctggtttgcttctaggaaagctcagcaattccctgaaaagagtgtggcccaagtgactgcttccctccaccagtgtggcccatggggaaggcttgtggctgggtgaccccaagggtgggtacatgaggccatatttacttagcccttggccttacaggactgtgtcaaggggtcagcagtccttgctttgagtctggttatggttttgcagcctcagcatcagcgtgggcaggcccttttcaacagcagtgccctggctaatctttttctttttccccacagccaattccactgatcctgtgaaggctgcccaatttgaggtgagtaatcccagccatctccttttcctcctgccttgtcccttctctcctgtttcctctcatttttgcctttgttaatgcaaaattaaaatggagactgggcctgaaaactcctgagcaaacaaagccacccaggccttagaaatagccttatcattgcttaaactgcaaacataagtgaaactcaagttggattgtaactaaaaataggtaatacttaacttggatcatttctggtaaatgtttatgttagacagaaataagatttaaccctagccaatcgtaagcagccaactaacataattatgtgactaagaacacttcagtaaggtacctcacccaaaagacaattatgtaactgcaaacctatcaaatttctttatttttcttccacattttccaaattaatacttgtctctgactttctgtcattaaaacattagacctcttttggtttggtgtcacccaattcatgaattgcttcttattcaaatgaactctttaaaattgtattgtgccttagatttttctttaacagtttggtgtcagaagtaggatataaagtagaatctcccccaaagatccctaagagcaatgggtgaccaggcataggtacccattaagcccattgtgttcactggtttcttcctgcatttgtgagtcactaggtaagtccctctcagatatcaggcttgcaacttgtgtcctgagctctctgagtttatttgagtaattttatttctcatttgattcagcagttaatcttggtatttgacaagttcatctgtttccaacaggaactatactaggtccagtatagtgtactagtttccagacaaggtctgatttctggattgggatccagaggtcaaattgggtacttgacagattgaactaggtgttcaacagaaaccgaactgggggtccagttggagtcctcaggtaggtaaatttcagaagggcaagatattatggctttgtcagaatgtacagagtctgggactcctccatctgaaacacagtgatttctatgttcagataatatgggcccagaacctgtgactttctagagaaataggtgtgccttacctattgagccttaccagagatgacttaaagttgcaatggtcacagtgaggatgtttaaatctagaaaaaattgttcatttaagggatgcattgggaaaaaatgagatcccaaatgtctcagaaacaatgataaataattttgattggtatgtaaaggtttctaaaagaatgatttaaaaaaatagtctctctaagtaaatctttacaatgtgctaataagaaagtattctaaacctattaacctctttgattgcttgctttttccatctgaacctactcaatgctaacgtccttaaaaaattagatcctcaaatgagccaggagtatctacaacaactaaatttaactcttgttattgcacacatgaactattataaaagcaaccactaaggctaaaaataataaaaactaattggaaataggccagataaactaggtgtctcgttagtcactcatttaaaatttaatccagtctcaataagattgactcctaataataggtgaaaatgccccaaaactccttcttggagaagcttcgtaccctttctctgggcctttgagttgtgtaaatgtttttaaaacacaagcttcagcaaaatgactcatcaaaaagaaaaaaggaggaattttttagaaacaaactggcaaatgaaaaatcttaatagtcctctccacaaatatcaataaaaagtgccagccatcagaacagctaactttaactagaggctagatccaactaattagttttatattattatacctggcacatggctaaaatttcagaacaaaagccatgaatttctgtttgcatctttctgtatgtttacatatatctacacatgtgtatgctatttgtacataatattattctacctccagatggtatttattagaaacagtattaaaggagctcaactggcctagagaaaaataagcacttatataaattacatattttctcagaagaaaagaactttgccaaaatgcttttcaacttcatatgacctgagtaatctttaataaatgagaatattggtattaatgaaagtgaatattccacctagttttacccaaataagctcatgttgtctgctatacaatttgtcaaaaaaataccttgagatgacaggtagttggttttgttaatattatgtttgccactttaactatgttaaatgaaatgacaggtattcattaaatatctacaccatttccagataagacaaactactaaaacaaaaataaaaaagtgttccacttatctttttctctctacctgattgtttcagaatttggaaactcttattaagtatttttattttcaatctgggtatttgcataggttcaataagaatctattctccttgtaacaggacataattgggcaagtccttggcttggcttcttagcctagagaggcttttaaaggtctaatctgagatttctcaattactagatagtttttaaaaactaaagttgactgataaaaagtcagtaaagtctcttggatatcaccaaagctgtggctaaaatatattttaaaattactgtttttattatacctatataaataatcaggtcaaatttaatgaaactagatttatttttgcaaaaaagttaactttgattttcggtaaaaatggaaaataaaaatatttttctccagaataaaaaagattatattttagtagaaaactattgtgcatccattgtcaaattctaggcctgttcattttctttgaagttttattatctccctataaaccagattgactcctgaatttttgttttttagttccactaaaaactaaaactgcccttttccaaagctctgcaaactgaaactggtgactttaagcttcagaaaaatcactgcaacagagcacttatgccttaatgccaatcttaatgcctgctgctatctgggtcactcagagagtttaccagaatgtttaatgaaataaccagagacattcaaattgcaaaccagtaaagcacatcacattgcaactgctatcttcagtctaccatttaaacttgcctcaaactcacctctagaaattgtttcacctagctgccctctaaactcaaaaactaagatcataatttgctccaaatattaactttgtttttttaatagaagaatactctgaattcctttcaagcaatacaatctaaaatgagcaagttagcctcaatagcaccccaaaatagaagttcttgatatcttaacagcttaacaaggaggagcttgtgttcctactgatgtcaaaagaaatggttgaagatctcagctggctttatggtgattctagaactgggcaacacttgcctccttaaattagaataaggtttccaatgagttacagcagaggagattggcttcatagacagaaaaaggtctgaagaaagcagaaacaaagaatttaaagtggattggctattttaaaactggttaaagttgcaaaagacaggaataggaaaacagaataataaataactggttggttaacatcaggttactcttttgtaaggatgccaattgaaactggcctgtttgggaaattagatttttaggttattaggttattatctctctctcctgatttttccaaaggccagataagaatgtagtttctgtttgatgacttgaaactttatcatgggtgattccactttgatttttagtctgttctgtttgggcctagtgcaggagcttagtgcaaaacaatagcctcctaaaatttaaaagactttaaagaacatacatgagtttttcatcagataatatttatttgtattcattaatttatttgattggttaagtcttggctcccgagaatctttgctcagaggaatttttcaatccttggctattattctccttatagttattgtatttacctccccggtgtattgaattatcctatgggttttaaatgctttcctgcagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcctttattttgcttccacattttcccaataaatacttgcctgtgacattttgccactggaacactaaacttcatgaattgcgcctcagatttttcctttaacatcttttttttttttgacagagtctcaatctgttacccaggctggagtgcagtggtgctatcttggctcactgcaaacccgcctcccaggtttaagcgattctcatgcctcagcctcccagtagctgggattagaggcatgtgccatcatacccagctaatttttgtattttttattttttttttttagtagagacagggtttcgcaatgttggccaggccgatctcgaacttctggcctctagcgatctgcccgcctcggcctcccaaagtgctgggatgaccagcatcagccccaatgtccagcctctttaacatcttctttcctatgccctctctgtggatccctactgctggtttctgccttctccatgctgagaacaaaatcacctattcactgcttatgcagtcggaagctccagaagaacaaagagcccaattaccagaaccacattaagtctccattgttttgccttgggatttgagaagagaattagagaggtgaggatctggtatttcctggactaaattccccttggggaagacgaagggatgctgcagttccaaaagagaaggactcttccagagtcatctacctgagtcccaaagctccctgtcctgaaagccacagacaatatggtcccaaatgactgactgcaccttctgtgcctcagccgttcttgacatcaagaatcttctgttccacatccacacagccaatacaattagtcaaaccactgttattaacagatgtagcaacatgagaaacgcttatgttacaggttacatgagagcaatcatgtaagtctatatgacttcagaaatgttaaaatagactaacctctaacaacaaattaaaagtgattgtttcaaggtgatgcaattattgatgacctattttatttttctataatgatcatatattacctttgtaataaaacattataaccaaaaca

SEQ ID NO: 1706 - DNA, 14156 bp, Homo sapiens; identical to SEQ ID NO: 1705

SEQ ID NO: 1707 - DNA, 8268 bp, Homo sapiens
ttatcattcatattttattaccatggttttcccatcttctatctaagagtagcatgcaagatcttgtaaaatgctttattggaaccaagaaatgttgcgcttaaagcttacaaaacagagacagctaaagctttctttcataagcaacaattgtcttctccatccccacctcattggaactgacatgatgaaggatttgaaagtttcataacttaactcagcgaagctcagtagtacatttagtattggttatacaacatttgtttaataaatgcaatgaacaaagctacacaggaattagatattgaagcagaaaaggtggttttacagtccctgcattaacctctaattcttactaccctggccaagaaagcattttcacctcctgcgctttccttcctgtgtgcttgtggttggttctttcttctcaggctttctcattctgatgctgagatagttctgttcacttagcaacttgggacagtgacacagggtttgttctgtactttcttttccaccccaccccccaccgcaatcctcagtccccttcctaggaccattttctactcctagcattaagaggactcatcgttatatacttggagatggtccagttctgatagagtcccctggaagactcaattctacgtcaccctcatgatttcctgttaattccactacggctaatgttctaggaagacacccttatctctgggctcagatgggaacacctcccttagactatcctggactacctgctatttctcagccatgctttcattggtcccactgaattccctagatccccagcagttcccacactctgtatggtcctgcctcaaccattaattctacttatccatttatttaggaataattgtttttttttcccctctaaactgggtaatttataacacgagcaatttttgtatgtttaaaggattaccatccctagcctgtattgttgctttgctgtgagggaacggttgggacagaaaaagtgtttgtgtagctctgaaacttcaatttctaggaatgcagctactcactggggcttccctgcttgaagatcatgggcttttcccttccactggagaccaaggaaaagtcgagagttggataagggatctggctctgagttctatgtttcctgctgcttgtagagaggcctgaggatgatggggttgcaaatccagagaaatgttcagagatgctgctgctactgctcttattacccccatgggatgggggtcatttgtcttgagggtcctttctccatttaaatttatggtccttccagtctcttgttgagcttcgaatgtttgtcttcacagagaaatatagtcctgtgtccactgcaaaaaggagtaccatcaccaagcagaaagagacttggtacccaggtggaaagaatgatgagatggttgacactgccaaacctattaggagaagtggagagatgaaaaaaaatgacagtcactaaggcagatatttggaacaaacagtgaggtcaccagtagaaagtctttgacaacagccaacaggcaagtggtaggaatggtggggaagtctgggggaaagtattgcttcctcccattggttcctgatcttagtgctatctgagcagaggacagctcaccaaacactgagcaaaggctcctgcttgtttgacagagatgtgacagggagcgttaacaagttaggttgtaagctgggttttgtgtgacagttaagaaattgtcagacaatgctatggtctagaaactgggacaaatttgttgattttgcatttcaattttttaaactcttgattttgatatatttccaaacttaaaaaaaaaatgaccagaatagtttaatctcgtatatcctttacccagatccactcattgtttacatgttaccccatttgctttatttgctctctttccctaaccacttgggagtatttactttcagtttaaagtgtcatgaaattatttttgtacaaattatggcattgtagtgtcaaaatctcaaaaggtgttttgctgcctttctacatgcaaattgtttacaatttatgtcttgggctagttacagatagaagttctgtgaaactggaaagtccaggcacaccactctagagctctgattctggaggctggtgctacagaacctagagatgttttgtggatgacttaatgggatcataggatattagtgcttgttcaaatcttttacttactggttaaatatacaggctttgaagtctttgatgtgaccttagggaaacttatttatttatttttgcacctcggttacttcatctgtaaaatggaatattacctatctcatgttgtgaaggtctactgtgatagtcaaaccaggtgcatgtaaagaattgtttagcacagagtctagcacactgaaaggtgcccaataaatgtcagcttatttttgttacggaagaagaaattggggttcagagagactaagtggctcacctctggtcagatggttaattagctgcagggccagaacccaggttctgggctctttctgtgaggggatgaggggctcctgccagtttggatcgtggctaaaaggcttggataagaaggaggccagcacgataggaacatatgacaccgtgggtgtgattagcgtaaggaaagacagaggtatttattggggaggagatgtggcttctgctcctgccatcatgctgcagagtgaatgacacctcctagctaccccaaaagaatggactgaaacagagctgcaaacctaccctgcaatcagggacttttggggacctcctggtgatcaccaggagggaaccacatatgaagaagtgcgtgtaagaatcaggaatctcctcccaactcaacttcccagtgtgattgcaggttccacacacaggcgtccctgggcattccagggtggcacatgtctcaccttgagtgatggtgatgttcacagtctctgaagacacatttttactcccaaaaagccccctgcagaagtaggagccgctgtctttgagtgtggcttttggaatgtagaagtcagaattatgatgaaaatacttcctgcctttgccattctgtaaatatgtgaccttatgcagagcagtgttcttccagctgtgacacctcaggtgaatagggtcttcctccttgaacacccaccgaggggcctggagcaacagccagcctgaaagacacagacaccccaggcccgggaggcctcagctctcagtgcagagctttgtgaaggggccacgtaccacccagatcctgagacataagggaaagccagattgggagtcaaccctgcatagctccctttggggaagagctgatggggccctgcaagagaactgaagtcataccaagacctttgtctaatggggaagagggacacacacacatgtgatcaacacacagggttagagcagagggactaagcaatgaggtaagtgagaagcaacgatgagcatatctgcaggatccttaagtgctagacttagatttgctgtggcaggtgacaaggattcacagtaagttctagatcagagtaaaaattgcatttgaaaatgatgaattgccctattagaggaaaaggtagatttcagaaggaataggcaatcaaaggaatattgaaagactcttgtggcagtcaggaataaggtgacggtggccacggagtggctgcagaaattgtgaaggagaactcaatgtaaacaccagggaggggaagggcgggactggtattgctcagcctggcaattcgtggtttctaaggtgtcacagggcctcggtgagaccaactttattactgagcatggccttcaagagaggaaattcttgtatcgccagagcttattctcacgatcatgtcaccaagtaatttactgagcatggccttcaagagaggaaattcttatatcgccagagcttattctcacgatcatgtcaccaagtaatcagacttcacaaagagagaacatgaggtcatggtcgggaaagggcctgaataattaaaaaataatgatgttataggtaagtattataatggcataagaaaatattcatgagacaattttaagttaaaaaagcataatacttcaaatattttaaaaagtattatgcacagaaaaaagaaggatatgcacttacatattaacaggggttttctctgaaggagtgggactgaaggacattttaaatttctcctgtttacttttatatatttttgaaattgaccccaaatgacttttgtaataagaacaaaacaaaatttacaataattttattttttaaatctacattctcagcttgaattactataatttaaaaaatctactacctgatgctaaacaaaattggtaggacgtgtgttggtcatgattctctaccacaaagatttgccaaacagaaagtaatcttcattacctattaagagatatcatttatcaaaagaagccatgtgcctatctatccacttactttttcagcagagagatgaatcattattagcataaagtcatggttagtatatagtctggtggcctttggaggaacattcttgttcgaatctatcctgtcatggacccagtgaatgtccatatgtatattccttcaagtgatatttcatcaagcactcactatgtatgacacactgtggactggagatacccagatgatgggacatatagttctcagcctcaaagaatctacagtctagacatagaaacataaatattcagaaataatcacaatacaatatgacaagtgctacaacaggctaagaataaaggactgcggggctgactagattggaataaagaaattctgcctgaaagaagtaaaaaatgcaggctgggcgcggtggctcacatctgtaatcctagtactttgggaggccgaggtgggcagatcatgaagtcaggagatcaagaccatcctggctaacgctgcgaaaccctgtctctactaaaaatacaaaaaattagccgggcgtggtggcatgcacctgtagtcccagctacttgggaggctgaggcaggagaattgcttgaacccgggaggtggaggttgcagtgagccaagattgcgccactgcactccagcttgggtgacagagagagactctgtctcaaaaacaaaaacaaaaacaaacacaaacaaacaaacaaaaaaagaagtaaaaaatgcttctcagaggaggacataagtgaaatgggtcctaaaggattaaaggatgctcagaagtttacctggtgaagctaattctcatggtcacagtttaatatagccttgattggctagacttctaaagccagtttctagagccaagttcaaggcaaactagtaactcttagacttgatttttctattgctttctcttggtaattcccccattttatttggttgtaggtggacatctcttacctagctagaaatggacatatcttcttgtagctctggagagtgaagaccatgtcagttgagtggtactgtcagaggccaaagagccacaaaaatcagtttcagaggcccaattccatggagctctcttgcagatccacctccttatgcccttcttcccccaaagcttgttccacccataaacattgtatgaatggaacagccgtggaagtagagttaggtttgcagggcgacactgcagggaccagcctatgtggtaagattgtagggacaccaggaaagacctctgccttcaaaatatttctcctacctgtgtctgacgtctatattctgttaatagtacacaagaactttcatgtcatgattaatgtgcaggctgaacatgtatctgcctctattggaagagctatcacattaccaaatttatgcttaattataggtttgagtatagcattgatgaggagacagaaagatatgatgctaggccactaggattgctttgggaggtggcttagggcattacatgtctgagagcgagaaggagattgaggtcctaacaccaaattcattaatttattcaataaatattattggccaggtgtggtggctcacgcctgtagtcccagcactttgggaagccaaggctggtgaatcacctgaggtcaggagtttgagaccagactgaccaacatggtgaaaccctgtctctactaaaaatacaaaaattagctgggcgtggtggcgggtgcctgtaatctcagctactcgggaggctgaggcaggagaatcactacaacccaagggggcagaagttgcagtgagctgagattgccgcattgcactccagcctgggtgacagagtgatactctgtctcaaaaaataaaattaaaaaaaatgaaaataaatatataaataactattattgagcatctatgccatggcctaaccttcacatgacacattcacattgtatgcactccatatggggattcttggaattgtgcaatgcagcagtcctatatctactgtctgacaggctttgacattttgcccaagacctacttagagctaggactacaactctgataccattcagtgggaccacacatcatctcatcttagcttttatctctaagaatatcatctctggctcttaccaagtatttcaggaccctttgtttcaccctttattggtgattttcctcttccccttcatcaactcaccgatatggacttctagctgcaccgggtcactgagggtggagaggtttgtctggcacctgtactctccactgtcgtcgactgtggcagcgtcaatgaagtagctcgaggcctggcttgagatgaggctctcattgtgaaaccactgtgtggaattgtcctcaggggagtaggctccctggcacttcagagtcacactgtccttctcgagcaccctgtaccattgaggctccaggaacaccacagcctttgggagatcttctgaggagccaagataatgtggggtgaggacagggagaggagcaggctctacactgccattcccagggagcctcaaagccagaatgagctcattgcaaacccatgcttggtggctcagtcttagagcatcttggccccatttttggcctgttcagtatcttaaggaaagctggccagagaagcacagggccaagttctgctgtgttggaggaactatccctgctaaccccacatcagcattttcccattcaacaagcatttcccaatatcttatggcctttgtccccatatgtgccccactgggtcaatccaagaccatgaagctgactcaccagtccgcatgccagctgaaactgcaagaaaaaagataaatcaaatattgagtaggggcagagatcagagtgattagaacatagagtgagtttaaaactcccctgccctcctctgccccaggagcccaattttcccaagaatcaggatgtttctggtggaaaccttgctacctgctctctggtctccactgttcatgcctcttgcgccactgtcaacacaaatccctattttcaacactgctcccttaccccttgctccctgtgcaaactcacaaattaagggtacaggttgaatttccctgaaccaagctacagaaagagcctcaacccatatccccacaagaaagggtagaaattgaaaatcatagaggagaaccctggaatgtcaaactgaaagagacagaccctagggaccatctagtcgaagctctttggttccacagagtgattctgggacccagaggggtgaagtgactggcctcactcatgagtatgccccaattggaaccagcattctcctcatttctagccccatcttggcttgtcctaggagctcaatccacagctatagatgtggtgaggggtcccatcccttcgtgggagtctcattcgtagcctgaaaaggggtctctgctgaacccaaggcatctcaaacttctccctcaaccagggagaccctgacttacctagaagtagcagagcagttgggaggagcagctgccacatgatgccacactggagtggacaagtcaccaaagatatccggagccctaaagggaccaaaccgactagacaggaggaagtaaacagcctttccccagcccctccacccatctctgtcacccaccaatttccttttcttgaaacttcatctgacttctcagtctgaagtctggcaagggagccccaccatagaacaggaccaggaaggaaagagcctggaggcaaggtgggtgggtctgccccctttactccctcaaaggtctgtggctgagcatctgaggacacacacagaatc

SEQ ID NO: 1708 - DNA, 8268 bp, Homo sapiens; identical to SEQ ID NO: 1707

SEQ ID NO: 1709 - DNA, 8863 bp, Homo sapiens
ttatcattcatattttattaccatggttttcccatcttctatctaagagtagcatgcaagatcttgtaaaatgctttattggaaccaagaaatgttgcgcttaaagcttacaaaacagagacagctaaagctttctttcataagcaacaattgtcttctccatccccacctcattggaactgacatgatgaaggatttgaaagtttcataacttaactcagcgaagctcagtagtacatttagtattggttatacaacatttgtttaataaatgcaatgaacaaagctacacaggaattagatattgaagcagaaaaggtggttttacagtccctgcattaacctctaattcttactaccctggccaagaaagcattttcacctcctgcgctttccttcctgtgtgcttgtggttggttctttcttctcaggctttctcattctgatgctgagatagttctgttcacttagcaacttgggacagtgacacagggtttgttctgtactttcttttccaccccaccccccaccgcaatcctcagtccccttcctaggaccattttctactcctagcattaagaggactcatcgttatatacttggagatggtccagttctgatagagtcccctggaagactcaattctacgtcaccctcatgatttcctgttaattccactacggctaatgttctaggaagacacccttatctctgggctcagatgggaacacctcccttagactatcctggactacctgctatttctcagccatgctttcattggtcccactgaattccctagatccccagcagttcccacactctgtatggtcctgcctcaaccattaattctacttatccatttatttaggaataattgtttttttttcccctctaaactgggtaatttataacacgagcaatttttgtatgtttaaaggattaccatccctagcctgtattgttgctttgctgtgagggaacggttgggacagaaaaagtgtttgtgtagctctgaaacttcaatttctaggaatgcagctactcactggggcttccctgcttgaagatcatgggcttttcccttccactggagaccaaggaaaagtcgagagttggataagggatctggctctgagttctatgtttcctgctgcttgtagagaggcctgaggatgatggggttgcaaatccagagaaatgttcagagatgctgctgctactgctcttattacccccatgggatgggggtcatttgtcttgagggtcctttctccatttaaatttatggtccttccagtctcttgttgagcttcgaatgtttgtcttcacagagaaatatagtcctgtgtccactgcaaaaaggagtaccatcaccaagcagaaagagacttggtacccaggtggaaagaatgatgagatggttgacactgccaaacctattaggagaagtggagagatgaaaaaaaatgacagtcactaaggcagatatttggaacaaacagtgaggtcaccagtagaaagtctttgacaacagccaacaggcaagtggtaggaatggtggggaagtctgggggaaagtattgcttcctcccattggttcctgatcttagtgctatctgagcagaggacagctcaccaaacactgagcaaaggctcctgcttgtttgacagagatgtgacagggagcgttaacaagttaggttgtaagctgggttttgtgtgacagttaagaaattgtcagacaatgctatggtctagaaactgggacaaatttgttgattttgcatttcaattttttaaactcttgattttgatatatttccaaacttaaaaaaaaaatgaccagaatagtttaatctcgtatatcctttacccagatccactcattgtttacatgttaccccatttgctttatttgctctctttccctaaccacttgggagtatttactttcagtttaaagtgtcatgaaattatttttgtacaaattatggcattgtagtgtcaaaatctcaaaaggtgttttgctgcctttctacatgcaaattgtttacaatttatgtcttgggctagttacagatagaagttctgtgaaactggaaagtccaggcacaccactctagagctctgattctggaggctggtgctacagaacctagagatgttttgtggatgacttaatgggatcataggatattagtgcttgttcaaatcttttacttactggttaaatatacaggctttgaagtctttgatgtgaccttagggaaacttatttatttatttttgcacctcggttacttcatctgtaaaatggaatattacctatctcatgttgtgaaggtctactgtgatagtcaaaccaggtgcatgtaaagaattgtttagcacagagtctagcacactgaaaggtgcccaataaatgtcagcttatttttgttacggaagaagaaattggggttcagagagactaagtggctcacctctggtcagatggttaattagctgcagggccagaacccaggttctgggctctttctgtgaggggatgaggggctcctgccagtttggatcgtggctaaaaggcttggataagaaggaggccagcacgataggaacatatgacaccgtgggtgtgattagcgtaaggaaagacagaggtatttattggggaggagatgtggcttctgctcctgccatcatgctgcagagtgaatgacacctcctagctaccccaaaagaatggactgaaacagagctgcaaacctaccctgcaatcagggacttttggggacctcctggtgatcaccaggagggaaccacatatgaagaagtgcgtgtaagaatcaggaatctcctcccaactcaacttcccagtgtgattgcaggttccacacacaggcgtccctgggcattccagggtggcacatgtctcaccttgagtgatggtgatgttcacagtctctgaagacacatttttactcccaaaaagccccctgcagaagtaggagccgctgtctttgagtgtggcttttggaatgtagaagtcagaattatgatgaaaatacttcctgcctttgccattctgtaaatatgtgaccttatgcagagcagtgttcttccagctgtgacacctcaggtgaatagggtcttcctccttgaacacccaccgaggggcctggagcaacagccagcctgaaagacacagacaccccaggcccgggaggcctcagctctcagtgcagagctttgtgaaggggccacgtaccacccagatcctgagacataagggaaagccagattgggagtcaaccctgcatagctccctttggggaagagctgatggggccctgcaagagaactgaagtcataccaagacctttgtctaatggggaagagggacacacacacatgtgatcaacacacagggttagagcagagggactaagcaatgaggtaagtgagaagcaacgatgagcatatctgcaggatccttaagtgctagacttagatttgctgtggcaggtgacaaggattcacagtaagttctagatcagagtaaaaattgcatttgaaaatgatgaattgccctattagaggaaaaggtagatttcagaaggaataggcaatcaaaggaatattgaaagactcttgtggcagtcaggaataaggtgacggtggccacggagtggctgcagaaattgtgaaggagaactcaatgtaaacaccagggaggggaagggcgggactggtattgctcagcctggcaattcgtggtttctaaggtgtcacagggcctcggtgagaccaactttattactgagcatggccttcaagagaggaaattcttgtatcgccagagcttattctcacgatcatgtcaccaagtaatttactgagcatggccttcaagagaggaaattcttatatcgccagagcttattctcacgatcatgtcaccaagtaatcagacttcacaaagagagaacatgaggtcatggtcgggaaagggcctgaataattaaaaaataatgatgttataggtaagtattataatggcataagaaaatattcatgagacaattttaagttaaaaaagcataatacttcaaatattttaaaaagtattatgcacagaaaaaagaaggatatgcacttacatattaacaggggttttctctgaaggagtgggactgaaggacattttaaatttctcctgtttacttttatatatttttgaaattgaccccaaatgacttttgtaataagaacaaaacaaaatttacaataattttattttttaaatctacattctcagcttgaattactataatttaaaaaatctactacctgatgctaaacaaaattggtaggacgtgtgttggtcatgattctctaccacaaagatttgccaaacagaaagtaatcttcattacctattaagagatatcatttatcaaaagaagccatgtgcctatctatccacttactttttcagcagagagatgaatcattattagcataaagtcatggttagtatatagtctggtggcctttggaggaacattcttgttcgaatctatcctgtcatggacccagtgaatgtccatatgtatattccttcaagtgatatttcatcaagcactcactatgtatgacacactgtggactggagatacccagatgatgggacatatagttctcagcctcaaagaatctacagtctagacatagaaacataaatattcagaaataatcacaatacaatatgacaagtgctacaacaggctaagaataaaggactgcggggctgactagattggaataaagaaattctgcctgaaagaagtaaaaaatgcaggctgggcgcggtggctcacatctgtaatcctagtactttgggaggccgaggtgggcagatcatgaagtcaggagatcaagaccatcctggctaacgctgcgaaaccctgtctctactaaaaatacaaaaaattagccgggcgtggtggcatgcacctgtagtcccagctacttgggaggctgaggcaggagaattgcttgaacccgggaggtggaggttgcagtgagccaagattgcgccactgcactccagcttgggtgacagagagagactctgtctcaaaaacaaaaacaaaaacaaacacaaacaaacaaacaaaaaaagaagtaaaaaatgcttctcagaggaggacataagtgaaatgggtcctaaaggattaaaggatgctcagaagtttacctggtgaagctaattctcatggtcacagtttaatatagccttgattggctagacttctaaagccagtttctagagccaagttcaaggcaaactagtaactcttagacttgatttttctattgctttctcttggtaattcccccattttatttggttgtaggtggacatctcttacctagctagaaatggacatatcttcttgtagctctggagagtgaagaccatgtcagttgagtggtactgtcagaggccaaagagccacaaaaatcagtttcagaggcccaattccatggagctctcttgcagatccacctccttatgcccttcttcccccaaagcttgttccacccataaacattgtatgaatggaacagccgtggaagtagagttaggtttgcagggcgacactgcagggaccagcctatgtggtaagattgtagggacaccaggaaagacctctgccttcaaaatatttctcctacctgtgtctgacgtctatattctgttaatagtacacaagaactttcatgtcatgattaatgtgcaggctgaacatgtatctgcctctattggaagagctatcacattaccaaatttatgcttaattataggtttgagtatagcattgatgaggagacagaaagatatgatgctaggccactaggattgctttgggaggtggcttagggcattacatgtctgagagcgagaaggagattgaggtcctaacaccaaattcattaatttattcaataaatattattggccaggtgtggtggctcacgcctgtagtcccagcactttgggaagccaaggctggtgaatcacctgaggtcaggagtttgagaccagactgaccaacatggtgaaaccctgtctctactaaaaatacaaaaattagctgggcgtggtggcgggtgcctgtaatctcagctactcgggaggctgaggcaggagaatcactacaacccaagggggcagaagttgcagtgagctgagattgccgcattgcactccagcctgggtgacagagtgatactctgtctcaaaaaataaaattaaaaaaaatgaaaataaatatataaataactattattgagcatctatgccatggcctaaccttcacatgacacattcacattgtatgcactccatatggggattcttggaattgtgcaatgcagcagtcctatatctactgtctgacaggctttgacattttgcccaagacctacttagagctaggactacaactctgataccattcagtgggaccacacatcatctcatcttagcttttatctctaagaatatcatctctggctcttaccaagtatttcaggaccctttgtttcaccctttattggtgattttcctcttccccttcatcaactcaccgatatggacttctagctgcaccgggtcactgagggtggagaggtttgtctggcacctgtactctccactgtcgtcgactgtggcagcgtcaatgaagtagctcgaggcctggcttgagatgaggctctcattgtgaaaccactgtgtggaattgtcctcaggggagtaggctccctggcacttcagagtcacactgtccttctcgagcaccctgtaccattgaggctccaggaacaccacagcctttgggagatcttctgaggagccaagataatgtggggtgaggacagggagaggagcaggctctacactgccattcccagggagcctcaaagccagaatgagctcattgcaaacccatgcttggtggctcagtcttagagcatcttggccccatttttggcctgttcagtatcttaaggaaagctggccagagaagcacagggccaagttctgctgtgttggaggaactatccctgctaaccccacatcagcattttcccattcaacaagcatttcccaatatcttatggcctttgtccccatatgtgccccactgggtcaatccaagaccatgaagctgactcaccagtccgcatgccagctgaaactgcaagaaaaaagataaatcaaatattgagtaggggcagagatcagagtgattagaacatagagtgagtttaaaactcccctgccctcctctgccccaggagcccaattttcccaagaatcaggatgtttctggtggaaaccttgctacctgctctctggtctccactgttcatgcctcttgcgccactgtcaacacaaatccctattttcaacactgctcccttaccccttgctccctgtgcaaactcacaaattaagggtacaggttgaatttccctgaaccaagctacagaaagagcctcaacccatatccccacaagaaagggtagaaattgaaaatcatagaggagaaccctggaatgtcaaactgaaagagacagaccctagggaccatctagtcgaagctctttggttccacagagtgattctgggacccagaggggtgaagtgactggcctcactcatgagtatgccccaattggaaccagcattctcctcatttctagccccatcttggcttgtcctaggagctcaatccacagctatagatgtggtgaggggtcccatcccttcgtgggagtctcattcgtagcctgaaaaggggtctctgctgaacccaaggcatctcaaacttctccctcaaccagggagaccctgacttacctagaagtagcagagcagttgggaggagcagctgccacatgatgccacactggagtggacaagtcaccaaagatatccggagccctaaagggaccaaaccgactagacaggaggaagtaaacagcctttccccagcccctccacccatctctgtcacccaccaatttccttttcttgaaacttcatctgacttctcagtctgaagtctggcaagggagccccaccatagaacaggaccaggaaggaaagagcctggaggcaaggtgggtgggtctgccccctttactccctcaaaggtctgtggctgagcatctgaggacacacacagaatctgccagagtgtgccctcagccatcccaggatgcttgccccatctcctggatttggatccacccagcaccaagaatgggacagtgagaccctggggatgagattcaaggtgggaggagcattctctgagggcttccttcatttcacctcagaacttgtcactctcctgcctcgcccagacccatctatctccagctgaggccctgcctgcacacagaaagtggtcctttcaaatcttcagaccactagcagtgtctctgcctcaatattatctccacgcagaatttctttcaaaattcaaaattcaaaatctatatgctcctgggatatgtaatccacaggagctactgactttttagtgtgatttgatcattagatttccaggttagaagaaacccaggtagggtagagaaatgggccctggaagaacaagtcaccagcgaaaggctgaaaagatcacagaaaaggtgggggtggggaggggcgaggacaggaactctttaccttcctcgtgttacccaggtcctgcggatttagctcaggcccctccgggccactggatctgggctggtctgtcagcctaggagccggggctcc

SEQ ID NO: 1710 - DNA, 8863 bp, Homo sapiens; identical to SEQ ID NO: 1709

SEQ ID NO: 1711 - DNA, 8863 bp, Homo sapiens; identical to SEQ ID NO: 1709

SEQ ID NO: 1712 - DNA, 5715 bp, Homo sapiens
ttgaaagggctaaaatgattttatttttaaatgtggacaggcaagcagaggtggttggcaaaggcaaggtggctgacgatccggaagctgtacaggagagataagggcactggctgccagagtgccctatcgaagcatcatccgaaccctgcggtaggggtggcccacaccacggcctgaggcccagtcaatgccatatttgtgggcggcagcctcagacactgcatagcgaccattgagatttgatcggtaacaggatgcataccaccaggcaccgtggacaatcactgcacagttgctgttgcttgaatcgtggtcagcgtcataggtggtaaagggcctcccactgtggaggctcagggaatcccctagcagggaagggatggaaagcaccttggtgcccagcaccacgcctggcacctttggagatataatgccatgggagtctcagagcaactaagagttgaattttatcaggccccacgagcaacaccaaggggccaggttgtttgcgcagggttactcggctggttgaagcagcggcaggacttgaactcgggactgtctggctccaaagctcccagcttttccccctgtcttaccccctccagaatccccggcccccctctagctcctttgtcttctctcagctcccatccagtctgagcaactctgctaggaaaagctgggaggaacctcttaggtgcctggccaggaaaggtggttccctgaggcactccctcataaccacttccctcttttaaatctctccccaatagtcactgtttctctgaaagaagacttccgtggttcctcttccaaagcagagaacactaacactcaacagagcctcaggcggcacccaaaacttcctccttgcctccctgcgctccccccgcctttttttttttttctgagatggagtctcgctctgtcgcccaggctagagtgcagtgacactctcttggctcgctgcaacctctgcctcccagatttaagtgattctcctgcctcagcctcccgagtagctgggattacaggcaccctccaccacgcccggctaatttttttgtatttttagtagagacggggtttcaccatgttggccaggttgggtttgaactcctgacctcaagttatctgcccgcctcggcctcccagagtgctagggttacaggcatgagccaccgtgcccggcctccctgcccattttatagaggaggaaactgaggctcagtggaggggtaggacttgcccaaggtcacataagtactaaatggcagagatggattcaaactcaggtctgtttgcctccagatcccaaattcttcactgttgcaccatcctgtttcatgattgccatttctcagatgcggaaactaaggcccacagaggagacaggattgccctgggtcattcatgggggcagtggcagcactgggaaaggatccagcctccttcctctgctccccttaggctcactcacctgcagtgccctctgagaacttgcccagtgccagctggtagtggtctacctcaccgaggaggcggaaggtcgcatagtgggcgaaagtacggttaccattaaagtcttccagctctacccgcagctcccagttacctggaaagaaggggaggcagggatggaggaatcctcagttcttgggggtggggcagggattcaggatggcagacagtaacccccagactccaggaccctgctgggaactcaccctggagagtaagctggtgcaaattctcatttcccagccagaattcagactcttggttcccaaaacctgctctgtaggaggaccaagagcggaagaaatccacagaaccatcctggcgcctctgaaacacctgggggagggggggcacagcagctattactccaggctgggcactggcagctgagggtgcaggaactgtgaggggtgggtggatacccactctctctttggattggggcctgttgataaaatggggatccttcaagttagctttgaatatttctatgaactctacattcccttgttaacttttactgacactcaacttcatgccacagccttgcaagccctgggaagactgaattgacaaaacactgtccccacccacaggagatggccagcgctgctgggtgtcagtcaaaataacccaatttcatttactataagaaccaagaacgcttggtggctcatgcctgtaattccagcactttgggaggccgaggcgggtggatcacttgaggtcaggagtttgaaaccagcctggccaacatggtgaaatcccgtctctactaaaaatacaaatattagccgggtgtggtggctcacacctgtagttccagctactcaggaggctgaggcacaagaactgcttgaacctgggaggtggaggttgcagtgagccgagatcacaccactgcactccagcctgggcagcagagcaagactccgtctcaaaacaaacaaacaaacaaaaaaaccaagatattttacattagagaggccactcccacagcccaagctggacccctggccttaccctgatgtcttccacctccccctccaagccaagtaggccccaggtcctatagagttgtcaacctaagtacttctatttccattgctccactgtcttattttatttatttatttttttgagatagagtctcaccccctgttaccaggctggagtacagtggtgtgatctcggctcactgcaacctctgcctccctggttcaagcaattctcgtgccttagctttctgcatagctgggattacaggcacctgccaccacgcccagctaattttttgtatttttagtagagatggggttttgccatgttgcccaggctggtcttgaactcctgagctcaggcaatccacccacctcggcctcccaaagtgctgggattacaggtgtgagctactgtgtcaggcctgctccactgtctttactgcctggctccttgctgtcttcctaaaccatgtccctgcctccactggtcccccaatgcagtgcatctttcatggtgtagcccgaatcatctttttaaaacagaagttctacttggcccctcccctgcttaaaactctcctggggctacccattgccctgcacactcttcttttttttttttttttttaagacagagtctcactccgttgcccaggctggagtgcagtgactcaatcttggctcactgcaaccaccacctccggggttcaagcaattctcccagctcagcctcctgaataacttggattacaggcgcccaccatcacgcctggctaatttttatatttttagtaaagatggggtttcaccatgttggccaggctgatctcgaactcttgacctcaggtgatctgcccgccttggcctcccaaagtgctgggattataggcgtgagccaccacgtccagccaaccaccgcgtctgggcgcgctgcacacttcttaagttgatcatttagtgccttccatgaactggcctttacagaggtcctcaatccatgttccgtcagtgccggcagactttagccgacacccacgcctgctctcagctcactcacgcgttccctgcaaaccttttactctgctgcctccctgagtttatctttacttctagctggaatgcccctccctaccctatttttttttttttttttttttgagacagagtttcactcttttcacccaggctggagtgcaatggcaagaactcggctcactgcaacctccacctcctgggttcaggcaattctcttgcctcagcctcccaagtagctgggattacaggcgtgagctactgcactcaacttaaggtcttttcaaaaggcacctcctctgtgaagccctcatacttcttcaggtcccattgggggctcactaaacatttgtcagtgaattcctctaggaaatgccttgctctggtgggttctggctcccctaggggccaagggggagaagtgaccagtgggcctggcctgttagcccatttctcagacactcaccagccagccgcccccctcggtgtccatgtcacaaaagactgggagggccctgccctcaggtaggcacagatggtaccagccgctcaaggtggcgccctggctcaacagctcccggcagtttctggggcctgggaaaggggagatggactggggtggtgcccaggttattccctgacccccacccccaggcactggaacaagtgtgggaccctagggaccctcttggctccttcaggtccctgaagaagggttctgaggaggctgtggggaggatcttggccacacttgggggtctgccaacacccaacaccatgtgatcccaagttcctggctcctgcaagggctgcctcaccttcctggcaccggagcaggttcactggatctcctgccccagagaagggatgagtgttggctctgatgtctcagcaccccagcgctgagccaccagtggagccggtacccaggcccttttccgaatccttcccactcctcccagccttccataccctgtaggagggccatcatagggtacccaggcccttctcctaatcctctccactcctcccagccttccaaaccctgtaggagggccttcatagggtacccaggcccttctcctaatcctccccactcctcccagccctccatccccaataggagggccatcatagggtagccaggcccttctcctaatccttcccactcctcccagccatccattcccctgtgagagagccatcataggcacagcagccaagcagagatcccaccctagagtccagggacagaggcaaagaaagcggggaggcctccagccccacttactcacctggctcacccttggggcccatcttgcctggtggtccaggtggccctgaaatcacaaaggcagagatttcctgagtcccaccccatgcccaggaccaaaaagaaacaagagacttggagccagaggttcaaatcccagtttcacccttcactcactttgtgattgcgggcaaatatcttatcctctctgaacctccctttcctcctcagcagaatggggatgaaaccacttacctggcagagttgatcttaggatgccgggtgcccagcctggagctggcacagagtaggttccttgctcctttgtcgtggcccctcagcacagacaaaaattgctactttcctgccttccccattcccaagatcccagcccgctccccagcccctctcaccttgaggacctggggctcccttctccccaggacttcctggagctccgggacaactgggcaggaggacaactttgctggcttccagttccctgggtcctacagggagacacaggcagggtgggcacagggtagactgtctcttccagacccctcttcagttctcttcctgtctcccagattcccactgtcaggatgcttgtctcctgagctggcaaggtttcgtgtgctttgcatccatttgcatatatttacatgcagagcccagattatgaaactcccaccctgctccttgaggttgatgagccttggtggggggacacccagcgagggaatgaggagtgggttggtgaggagggcaccctaggtgcccacctgggcagctggggtgttcctgggtcttcaggcaggcaggccccccaagcaggagaagccacagggagggcaggatccacagtagatccatcttgct

SEQ ID NO: 1713 - DNA, 5715 bp, Homo sapiens; identical to SEQ ID NO: 1712
